United States Patent 8,999,380 (MODIFIED POLYNUCLEOTIDES FOR THE PRODUCTION OF BIOLOGICS AND PROTEINS ASSOCIATED WITH HUMAN DISEASE) - sequence listing, part 12

SEQ ID NO: 19895 - DNA, 1725 bp, Artificial Sequence
  Description of Artificial Sequence: Synthetic coding sequence
atgctgggggtcctggtccttggtgcactcgctcttgcaggactgggattccctgcacctgcagaaccacagcctggcgggtcccagtgtgtggaacatgactgctttgcactctatcccggtcctgctacttttctcaacgcaagccaaatttgcgatggactccggggacatctgatgaccgtccgatcatcggtggctgcggacgtgattagccttctcctgaacggagatggaggggtcggccggaggcggctgtggatcggtttgcagcttccacctggttgcggtgatcccaagcggcttggaccacttcgtggcttccaatgggtgaccggtgacaacaatacctcgtactctcgctgggcgaggcttgatctcaatggagcccctctgtgcgggcccctttgcgtcgcagtgtcagctgctgaggcgaccgtcccttcggaacccatatgggaagaacaacaatgtgaggtgaaggccgatggttttctgtgtgagtttcattttcctgcaacctgccgacctcttgctgtggaaccaggagcagccgccgcagcagtgagcatcacctacggaaccccttttgcagcacgaggtgcagactttcaagcgcttcccgtgggttcgagtgccgctgtggcaccgttgggcttgcaacttatgtgtaccgccccaccaggagcagtgcaaggacattgggcaagagaagccccaggtgcatgggattgttcagtggagaacggaggatgtgagcatgcttgtaacgcaatcccgggcgctcctcggtgtcaatgtccggcgggcgcagccctccaggcagatggtcgatcgtgtaccgcctcagcaactcaatcgtgcaacgatctttgcgaacacttctgcgtgccaaacccggatcagccaggatcgtacagctgtatgtgcgaaaccggatatcgtctggcagcagaccagcataggtgtgaggatgttgacgactgtatcctcgagccatccccttgtcctcaaagatgtgtgaacactcaaggcggatttgagtgtcattgttaccctaattacgatcttgttgatggcgaatgtgtggaaccagtcgatccatgttttcgagcgaactgcgagtaccagtgtcagccgctgaatcaaacgagctacctgtgcgtctgtgcagaaggattcgcccccattcctcatgagccgcaccggtgtcaaatgttctgcaatcaaactgcctgcccggcagattgtgatcccaacactcaagcatcctgtgaatgtcccgagggatatatcctggatgatggcttcatctgcactgacattgatgaatgtgaaaatgggggattctgttccggtgtgtgtcataacttgcctggaacgtttgaatgtatttgtggtccagactcggcacttgcaagacatatcggaactgactgtgatagcggcaaagtggacgggggagattccggatcgggagaacctcccccatcccctactccaggctctacccttactccgcctgcagtggggctggtccattctggactgctgataggtatttcgatcgcatctctctgtctggttgtggccctcctggcattgctgtgtcaccttagaaaaaagcaaggagccgcaagagcaaagatggaatacaagtgcgctgcgccttctaaggaagtcgtccttcagcatgtgcgcactgagcggacccctcagcggctc

SEQ ID NO: 19896 - DNA, 1725 bp, Artificial Sequence
  Description of Artificial Sequence: Synthetic coding sequence
atgctcggtgtcttggtgcttggtgcactggcactcgcagggctgggattccccgctcccgccgagccacaacctggaggatcccaatgcgtggaacacgattgctttgcactttatcctggacccgcgacctttctcaatgccagccagatttgtgacggtcttagaggtcatctgatgaccgtgagatcgtcagtcgcggccgacgtcatttcgcttttgcttaacggtgatggtggagtcggacggcgcagactttggattggcttgcaactgcctccagggtgtggtgatcccaagagactgggacctctccgcggttttcaatgggtaactggtgataacaacacttcatactccagatgggcacgtcttgatctcaacggagcccctctgtgcggtcctttgtgtgttgcggtgtcagccgcggaggcaactgtcccgtccgaacctatttgggaggaacaacaatgcgaagtgaaggctgacgggtttctgtgcgaatttcatttccctgcgacttgcaggccgcttgccgtggaacctggagcagcggcagcggcggtgtcgattacctacggaacccctttcgccgcacgcggggctgacttccaagcacttcccgtgggtagctccgcggccgtcgcaccactggggctccagcttatgtgcaccgcgccacctggtgcagtgcaggggcattgggcacgcgaggcccccggtgcatgggattgctcagtggaaaacggaggttgcgaacatgcctgcaacgcgatcccgggcgcacccaggtgtcaatgtccagccggggcagcactccaggccgacggaagatcgtgcaccgcatcggccacgcaaagctgtaacgatctttgcgaacatttttgtgtgcctaaccctgatcaaccaggttcttactcctgtatgtgcgaaactggataccggctcgcagccgatcaacacagatgtgaagatgtggatgactgtatactcgaacccagcccatgtccacagcgttgcgtcaacacccaaggcggatttgagtgtcattgttaccctaactacgacctggtcgacggcgaatgtgtggagcccgtcgatccctgctttagagccaattgtgaataccagtgtcagccactgaatcagactagttacctgtgtgtgtgcgcagagggttttgcacctatcccacatgaaccccatcggtgccaaatgttctgtaaccagactgcatgtccagcagactgcgatcctaacactcaagctagctgtgagtgccctgaagggtacattctcgatgatggttttatctgtaccgacatcgatgaatgcgagaacggcggtttttgtagcggagtgtgccacaatttgccaggaaccttcgaatgtatttgtggacccgattccgctctggcccgacatatcggaaccgactgtgatagcggtaaggtggatggcggggactccggaagcggggaaccaccaccttcgccaaccccagggtcgacgttgactccaccagcggtgggacttgtgcattcagggcttcttattggtatttcgatcgccagcctctgcctggtcgtggcacttctggccttgctgtgtcatcttagaaagaagcaaggggcagcgagagcgaagatggaatacaagtgcgcagcaccatcgaaggaagtggtcctgcaacacgtgcgaaccgaaagaactccacagcgcctg

SEQ ID NO: 19897 - DNA, 1725 bp, Artificial Sequence
  Description of Artificial Sequence: Synthetic coding sequence
atgctgggtgtgctcgtgctgggtgctctggccctggcgggcctcggattcccggctccggccgagccgcaaccgggcggctcccaatgcgtggagcatgactgtttcgcactgtacccaggccccgcgaccttcctcaatgcttcgcaaatctgtgacggactccggggacacctgatgactgtgagatcctcagtggccgccgacgtgatcagcctcctgctcaacggcgacggcggagtcggccggcggcggttgtggatcggcctgcaacttccaccgggatgcggcgatccgaaacgcctgggtccattgagaggtttccaatgggtgactggagacaacaatacgagctactcccggtgggccagactggacctgaatggcgcgcccctgtgcggaccgctgtgcgttgccgtatcggccgcagaggcgactgtcccatcagagcccatctgggaggagcagcaatgcgaagtgaaggcagatggatttctctgtgaattccacttcccagcaacctgcagaccgctggcagtggaaccgggggccgccgctgcagccgtgtcgattacgtacggaactccattcgcggccaggggcgccgatttccaggcacttcctgtgggtagctccgcggcggtggcaccgctcgggctgcagttgatgtgcactgccccgccaggagccgtgcaaggacactgggcgcgggaagcacctggtgcctgggactgctcggtcgaaaacggcggatgcgaacacgcgtgcaacgctatcccgggagctccacgctgccaatgcccggcgggggctgccctccaggctgatggcagatcctgcactgcatcggctactcagagctgcaacgacctgtgtgagcatttttgcgtgccgaatccagatcagcctggaagctactcatgtatgtgcgaaaccggctaccggttggcagccgaccaacaccggtgcgaggatgtggatgattgtatcctggaaccgtctccgtgccctcagcggtgtgtgaacacccagggaggattcgaatgccactgctatccgaactacgatctggtggacggtgagtgcgttgagccagtggacccctgctttcgcgcgaactgcgagtaccaatgccagcctctcaaccagacctcctacctctgtgtgtgcgcggagggatttgcacccatcccgcatgagccgcacaggtgccagatgttctgtaaccagactgcgtgtcctgcagactgtgatccgaatacccaggcatcctgtgaatgccctgagggatacatccttgacgatgggttcatttgtaccgacatagacgaatgcgaaaacggaggtttctgctcaggtgtgtgccataacctccctggaactttcgaatgcatctgcggtcctgatagcgcgctggcacgccacatcggcacggattgtgattcgggaaaagtggacgggggagactcgggctccggcgaaccgccgccaagcccgactccaggatcaactctgactccgccggcggtgggcctcgtgcattccgggctgctgatcggcatctccattgcctcgttgtgtctggtggtcgcgctgctggcgctgttgtgtcacctgaggaagaaacaaggagcggcacgtgcgaaaatggagtacaaatgcgccgcccctagcaaggaggttgtcctgcaacacgtgagaaccgagcggacgccacagcggctg

SEQ ID NO: 19898 - DNA, 1725 bp, Artificial Sequence
  Description of Artificial Sequence: Synthetic coding sequence
atgctcggagttctcgtcctgggtgctctggcgctggctggcctcggatttcccgccccagcagaacctcagcccggaggatcacaatgcgtggaacatgattgctttgctttgtaccccggaccagctacctttctgaatgcttctcaaatctgcgatggcctgagaggacacttgatgacagttcgttctagcgttgcggcagacgtgataagcctccttcttaacggggatggaggcgtcggccgccgacggctgtggatcggacttcagttgccccccggatgcggcgaccctaagcggcttggccctctgagagggtttcagtgggtgacaggagataacaataccagttacagcagatgggccaggctcgacctcaatggtgcccccctgtgcgggccactttgcgtcgctgtgtctgcagcagaagctaccgtgccttccgaaccaatctgggaggagcaacagtgcgaggtaaaagctgacggtttcctgtgtgaattccacttccctgccacttgccgaccccttgcagtggagccaggcgctgcagccgctgcagtcagcatcacctatggcaccccattcgctgctaggggcgccgattttcaagctttgccggtcggcagctctgccgcagtcgctcctctgggactccaacttatgtgcaccgcgccacctggagccgtgcagggccattgggctcgggaagcaccaggcgcgtgggattgtagtgttgagaacggcggctgcgagcacgcatgcaatgcgatccctggcgcgcccagatgtcagtgtccagccggagcagcacttcaagctgatggcagaagttgcactgccagcgcaacacaatcttgcaatgacttgtgcgaacacttttgtgttccaaaccctgatcagcccgggtcttacagttgcatgtgcgagaccggatacaggttggccgccgaccagcataggtgtgaggacgtcgacgactgcatcctggaaccctctccatgcccacagagatgtgtgaacactcaaggcggatttgagtgtcattgctacccaaattatgatctcgttgacggcgagtgtgtggagccagtcgacccatgcttccgtgccaattgcgagtaccaatgccagcctctcaatcagacctcgtacctctgcgtttgtgcagagggcttcgctcctattccacacgagccacataggtgccagatgttctgcaaccagactgcttgccccgcagactgcgaccctaacacccaggcatcttgcgagtgccctgaaggatatattctagacgatggcttcatctgtacagacattgacgagtgtgaaaacggcgggttttgcagcggggtctgccacaacttgccaggaacattcgagtgcatctgtggacctgactccgctctggcgcgccacatcgggaccgattgcgactctggaaaagtggacggaggagattccggcagcggtgagcccccaccaagtccgaccccagggtctactctcaccccacccgccgttgggctggtacacagtggactgctgatcggaatatccatcgcctccctgtgtttggtagtcgctctcctcgcactgctttgccaccttagaaagaaacagggcgctgcacgtgctaaaatggagtataaatgtgcggccccctccaaggaggtggttcttcagcacgtcaggaccgagagaaccccgcagcgcctt

SEQ ID NO: 19899 - DNA, 1725 bp, Artificial Sequence
  Description of Artificial Sequence: Synthetic coding sequence
atgctgggagtgcttgtgcttggagcgctggcccttgccggcctcggcttcccagccccagcggaaccacagccgggcggctcccagtgcgtggaacacgattgtttcgccctgtacccagggccggccaccttcctgaacgcctcccagatctgcgacgggctgcggggacacttgatgaccgtccgctcgtcggtggctgctgacgtgatctcattgctgttgaacggtgatgggggagtgggccgccggcgcttgtggatcggactgcaactcccacctggatgtggggatccaaaaagacttggaccactgcgcggtttccagtgggtcactggcgacaacaatacttcttactcgcgctgggcaagactcgatcttaatggagcgccgctctgcggtcctctctgtgtcgcagtgtctgcggctgaagccactgttccgtccgaacccatctgggaagaacagcaatgcgaggtgaaagccgacggctttttgtgcgagttccatttcccggcgacctgccgcccgctcgctgtcgagcctggagctgcagcggccgcggttagcatcacctacgggactcctttcgcagcccggggagccgattttcaagcacttccggtgggaagcagcgcagcagtggcccccctgggcctgcagctgatgtgtactgccccgccgggagctgtccagggacactgggccagagaagcgccaggagcttgggactgctccgtggaaaatggtggatgcgaacacgcgtgcaacgccatcccgggcgccccgaggtgccaatgtccggccggtgcagcactgcaagcagacggccgcagctgtactgcatccgccactcagtcatgcaatgacttgtgcgaacatttctgcgtccctaatcctgaccagccaggatcatactcatgcatgtgcgaaactggataccggctggcagccgaccagcatagatgcgaagatgtcgacgattgtatcctggaaccctccccctgcccccaacggtgtgtcaacacgcaaggtggatttgaatgccattgttaccccaactatgacttggtcgatggggagtgtgtggagccagtggatccgtgcttcagggccaactgcgaataccagtgccagcctctgaaccagactagctacctctgcgtgtgcgctgagggattcgctcccatcccacatgaaccacaccgatgccagatgttctgtaatcaaaccgcctgcccggcggattgtgacccgaacacgcaagcgtcttgcgaatgcccagaggggtacattctggacgacggatttatctgtacggatatcgacgagtgtgaaaacggaggattttgttccggcgtgtgccacaatctgcccgggacgtttgaatgcatttgcggtcctgattcggcactggcgcgacatatcggcactgattgcgactctgggaaggtggatggaggtgatagcgggagcggcgagccgcccccaagcccaaccccaggcagcactcttaccccgccggcggtcggactcgtccactcgggcctgctgatcgggatctcgattgcctcactgtgtctggtggtcgctctgctggcccttctctgccacctgcgtaagaagcaaggagccgcgcgggccaagatggaatacaaatgcgctgcaccgtcgaaggaggtcgtcctccaacatgtgcgcaccgagcggacgcctcagcgcctg

SEQ ID NO: 19900 - DNA, 1725 bp, Artificial Sequence
  Description of Artificial Sequence: Synthetic coding sequence
atgctgggcgtgctcgtgctgggtgccctggcactggcggggctgggtttcccggcgccggccgaaccgcaacctggaggatcacagtgcgtcgaacacgactgtttcgcactgtaccctggcccagcgactttcctcaatgctagccaaatttgtgatggtttgcggggacacctgatgactgtccggtcgtccgtcgccgcggacgtaatcagcctgctcctgaacggagatgggggagtcggccggagaaggctctggatcgggctgcagctgcctccaggatgtggggaccccaagcggctgggtccactgcgcggtttccagtgggtgaccggagacaacaacacttcgtactccagatgggcccggttggacctgaacggcgctccactgtgtggaccactctgcgtggctgtgtcagccgctgaggcgaccgtcccgagcgagccgatctgggaggaacaacaatgtgaagtcaaggcagacggtttcttgtgcgaattccacttccccgccacgtgccgcccattggccgtggaaccgggagccgccgccgcagcagtgagcatcacctacggaacgccattcgcagccagaggcgctgatttccaagcattgccggtcggatcttccgccgcggtcgccccattgggcttgcaattgatgtgcactgcaccacccggagccgtccagggacattgggcgcgcgaggcacctggagcctgggactgttcggtcgagaacggaggctgcgaacacgcctgcaacgccattccgggagcaccaaggtgccagtgcccagcgggtgccgccctccaggcggatggccgttcctgtactgcctcagcgacccagtcatgcaacgatttgtgcgagcacttttgcgtgccgaatcctgatcaaccaggatcctacagctgcatgtgcgagactggatacagactggcggctgaccagcaccgctgcgaggatgtcgatgactgcatcctcgaaccatccccctgcccgcaaagatgcgttaatacccaaggcggcttcgaatgccactgctaccccaattacgatctcgtggatggcgagtgcgtggaacccgtggatccatgttttagagccaactgcgaataccagtgccagcctctgaatcagacctcgtatctgtgcgtgtgtgccgagggattcgctcccatcccacacgaaccgcatcgctgccaaatgttctgtaaccagaccgcctgtcctgccgattgcgacccgaacactcaggcgtcctgcgagtgccctgaaggatacattcttgacgacgggtttatctgcacggatatcgatgaatgcgaaaatggaggtttttgctcgggtgtgtgtcacaatctgccgggaacctttgaatgtatctgtgggccagatagcgcactcgcgcggcatatcgggaccgactgcgattccggtaaggttgatggcggagattccggatctggcgagccccctccgagcccaactccaggatcgactcttactccacctgccgtgggactcgtgcattcaggacttctcatcggcatcagcatcgcatcgttgtgtctggtggtggctctgctcgctttgttgtgccacttgcggaaaaagcaaggagccgcccgcgcaaaaatggagtacaaatgcgcggcgccaagcaaggaagtcgtcctgcagcatgtcaggactgagcgaaccccacagagactg

SEQ ID NO: 19901 - DNA, 1725 bp, Artificial Sequence
  Description of Artificial Sequence: Synthetic coding sequence
atgctcggagtgcttgtgctgggagctctggctttggcaggacttggctttccagcaccagcagaaccacaacctggtggttcgcaatgcgtcgagcacgactgcttcgcactgtaccctggacctgccaccttcctcaacgccagccaaatctgtgacgggctgcgaggacatttgatgaccgtgagatccagcgtggccgcggatgtgatatcacttctcctgaacggggacggtggtgtcggaaggcgcagactttggattggactgcaactgcctccgggctgtggtgacccaaagaggctgggccctctgagaggattccagtgggtgaccggagacaacaatacttcgtactcgcgatgggcaagactggatctcaacggcgcacctctctgtggtcccctttgtgtggcagtgtcggcagcagaggccaccgtgccctcggagcccatatgggaagagcaacaatgtgaagtcaaggcagatggattcctgtgcgaattccatttccctgccacctgccgtccacttgccgtggaaccaggagccgcagcagcagctgtgtccattacctacggaaccccttttgccgcccggggagcggattttcaagccctgccagttggatccagcgcagcagtcgcacccctcggactgcagcttatgtgcactgcaccgcccggcgcagtccaaggtcattgggcaagagaggcaccaggcgcatgggactgcagcgtggaaaacggcggctgtgaacatgcgtgtaacgctattcctggcgcaccccgatgccaatgtccagcgggggccgctctgcaagcggatgggagaagctgtaccgcatccgctacccaatcatgtaacgatctttgtgaacatttttgcgtccccaaccccgaccaacccggtagctactcctgtatgtgcgaaacggggtaccgcctggcggcggaccagcacaggtgtgaagatgtggatgattgtatactcgaaccatcaccctgtccacaaaggtgtgtgaacacccagggcggtttcgaatgtcattgttaccctaattacgatcttgtggatggtgaatgcgtggaacccgtggacccttgtttccgggcaaactgtgaataccaatgtcaaccccttaatcagacctcgtatctttgtgtctgcgcagaaggatttgcacccattccacatgaacctcataggtgccaaatgttttgtaaccagactgcctgtccagcagattgtgacccaaacactcaagcatcgtgtgaatgcccagagggatacatcttggatgatggatttatctgcactgatatcgacgaatgcgaaaatggaggtttctgttcaggtgtttgccataatctgccgggtaccttcgagtgtatctgcgggcccgactcggcccttgctcggcatatcggaactgattgtgattccggcaaggtggatggaggtgacagcggctcaggagaaccacctccatcacccactcctggatcaacgcttacccctccagccgtcggtcttgtgcatagcgggctgctcattgggatctcaattgcatccctttgcctggtcgtggctctcctcgcactgctttgccatcttcgaaagaaacagggtgctgcaagagcaaagatggagtataagtgcgcagcgccttctaaggaggtggtgctccagcatgtcagaactgagcggacccctcagaggctg

SEQ ID NO: 19902 - DNA, 1725 bp, Artificial Sequence
  Description of Artificial Sequence: Synthetic coding sequence
atgcttggagtgctggtgctgggtgcgctggcattggcagggcttggcttccccgcaccggccgagccccagcccggcggatcacagtgcgtcgaacacgattgctttgcgctttaccccggcccagcaacctttctcaacgcctcacagatatgtgatggactgagaggccatctcatgactgtgcggtcgtcggtggcagccgatgtcatttcgcttctcctcaatggtgatgggggagtgggtagacgacgactctggattggactgcaactgccgccaggttgcggtgacccaaagcgactgggacctctcagaggatttcagtgggtcactggtgacaacaatacgagttactccaggtgggccagactcgaccttaatggtgcacccctctgcggtccactttgtgtcgcagtgtccgcggcagaagcgactgtaccgtcggaacctatttgggaggaacaacagtgtgaagtgaaggcggacggattcctttgtgaattccattttccagcaacttgtagacccctggcagttgagcctggagcagcagcagcggctgtcagtattacttacggaaccccctttgccgcacgtggcgcagattttcaagcccttcctgtgggttcctctgctgcagtcgcacctctgggattgcagcttatgtgtaccgccccacctggagccgtgcagggacactgggcgagggaggcccctggtgcatgggattgctcggtggaaaacggcggttgtgaacacgcctgcaatgcaatacctggtgctcctaggtgtcaatgcccagctggagcagcccttcaagctgatggtagaagctgtacggcatctgctactcaatcctgtaacgatctttgtgaacatttctgtgtgccaaaccctgatcagccaggctcttattcctgtatgtgcgaaaccggatacagactggccgctgatcaacatcgatgcgaagatgtggacgattgtatcctcgaaccttccccttgtccacagagatgcgtgaacacgcagggaggatttgagtgccattgttacccgaattacgacctggtcgacggtgagtgtgtggagcccgtcgacccatgcttcagagcaaactgcgaataccagtgtcagccacttaaccaaacctcctacctgtgtgtctgtgcagaggggtttgcacctataccacatgagccgcatagatgccaaatgttctgcaaccagactgcatgtcctgccgactgcgatccgaacacccaggcctcatgcgaatgtcccgaaggatacattctggacgacggttttatctgcaccgacatcgatgaatgtgaaaatggggggttctgctcaggtgtgtgccataacctcccaggtactttcgagtgtatttgtggacccgattcggcactggctaggcatatcggaaccgattgtgattcgggtaaggtggatggaggagatagcggtagcggagaacctcccccaagcccaacccccggctcgacccttactcctcccgcggtgggtttggtgcactcaggcctgttgataggaatctccattgcgtcgttgtgtcttgtggtggccctccttgcgcttctgtgccacctgagaaaaaagcaaggcgcagcgcgagcaaagatggaatacaaatgtgcagcaccctcaaaggaggtggtgcttcagcacgtgcgaacggaacggactccacagcgtctg

SEQ ID NO: 19903 - DNA, 1725 bp, Artificial Sequence
  Description of Artificial Sequence: Synthetic coding sequence
atgctcggggtgttggtgctgggcgcgttggcactcgctggccttggtttcccggcgccggcagagcctcagccggggggaagccagtgcgtggaacacgactgctttgccctgtatcctggtcctgctactttcctcaacgcgtcgcaaatctgtgacggccttcgcggacacctcatgacggtaaggagtagcgtggccgcggacgtgatctcgctgctgttgaacggcgacggcggagtgggccggagacggctgtggatcggcctgcagctgccaccgggttgcggtgatccgaaacggttgggaccactgcgtggattccagtgggtgactggggacaataacacgtcctactcacggtgggcccggctggatctgaacggggccccgctgtgcggaccgctgtgcgtcgctgtgagcgccgccgaagccacggtgccgtccgaaccgatttgggaagaacaacagtgcgaggtcaaggcagatggattcctctgcgaatttcactttcctgccacttgccggccgctggccgtcgaacctggagctgccgcagcagcggtttccatcacctacggaaccccgtttgccgcaaggggggcagatttccaagccctgccggtgggatcgagcgccgcagtggcacccctcgggctgcagcttatgtgcactgcaccccctggagcagttcagggacattgggctagagaggccccaggagcctgggattgctcggtcgagaacggtggctgcgaacatgcctgcaacgcgatccctggcgcaccacggtgccagtgtccggcgggagcggccctgcaggctgacggacgcagttgcacggcatcggccactcagtcgtgtaacgatctttgcgaacacttctgcgttccgaatccagatcaaccgggctcgtactcctgtatgtgcgagactggataccgactcgcagccgaccagcaccgatgcgaggacgttgacgattgcattctcgagccgtcaccgtgcccacagagatgtgtgaacacccaaggaggattcgaatgccactgctaccctaattacgatctcgtcgacggtgaatgtgtcgaaccggtggacccttgtttccgggcaaattgcgaataccaatgccagcccctgaaccagacgagctacctctgcgtgtgcgccgagggatttgcgccaattccacatgagccccatcggtgccaaatgttctgcaaccaaaccgcctgcccagctgactgcgaccctaatacccaagctagctgtgagtgtccagagggctacatcttggacgacgggttcatctgcaccgacatcgacgagtgcgagaacggaggattctgctccggtgtgtgccataacttgcccggtactttcgagtgcatctgcggcccggattcggcgctggcccgccatataggtacggattgtgacagcggaaaggtggacggaggagattcgggtagcggagaaccgccgccgtcgccaaccccgggatcgactctgacccctcccgctgtcggtcttgtgcactcgggcctgctgatcggaatctcaatcgcttccctctgtctcgtcgtggctcttctggcattgctgtgtcacctgcggaaaaagcagggagccgcccgagcgaagatggaatacaaatgcgctgcgccatccaaggaagtcgtgctccagcacgtgaggacggagcgcaccccacagcggttg

SEQ ID NO: 19904 - DNA, 1725 bp, Artificial Sequence
  Description of Artificial Sequence: Synthetic coding sequence
atgttgggagttctggtgctgggagcccttgcactcgccgggctcggattcccagcccctgcagagccacaaccaggaggtagccaatgcgtggagcacgattgttttgcgctctaccccgggcctgcaacttttctgaacgcatcgcagatttgtgacggccttaggggacatcttatgactgttcgaagctccgtggcggcagatgtgatctcactgcttctgaatggtgatggaggagtcggtagacggcgcctgtggatcggattgcagctccccccagggtgcggggacccgaagagactcggtccacttcgtggatttcaatgggtgaccggtgacaacaatacctcctactccaggtgggcaagacttgacctgaacggagcccccctgtgtggtccactttgcgtggctgtctctgcagccgaagccaccgtgccctcagaaccaatatgggaggaacaacaatgcgaagtgaaagcagatggatttctttgcgaatttcatttccctgcgacctgtagacctctggcagtcgaaccaggggcagccgcagcagctgtgtcgatcacttacggtaccccttttgcagctagaggagccgactttcaagcgctgcctgtcggatcctccgccgcggtggcgcctcttggcttgcaactgatgtgcactgccccgcctggcgcagtgcaggggcattgggcacgggaggcacctggagcgtgggactgttcggtcgaaaacggtgggtgcgaacatgcttgtaacgcgatccctggtgcaccaagatgccagtgtccagcaggtgcagcattgcaggcagatggacgcagctgtaccgcgtcggcaactcaatcgtgtaatgacctttgtgaacatttctgcgtaccaaaccctgatcaaccaggatcgtactcctgtatgtgtgagactggataccgccttgcggcagatcagcatcgctgcgaggacgtggatgactgtattcttgaaccaagcccatgcccacagaggtgtgtgaatacgcagggaggattcgaatgccattgctaccctaactacgatctggtggacggggaatgtgtggaacctgtggatccttgttttcgcgcaaactgcgagtatcagtgtcaacctctgaatcagaccagctacttgtgtgtctgtgcagagggttttgcgccaattccacacgagcctcatagatgtcaaatgttttgcaaccaaaccgcatgtcccgccgactgtgatcccaacacccaagcctcctgtgaatgccctgaagggtacattctcgacgatggtttcatttgcactgatatcgatgaatgcgagaacggaggattctgttcaggtgtgtgtcataaccttcctggaaccttcgagtgcatctgcggcccagattccgccctcgcacgccacattggaactgattgcgattcgggaaaggtggatgggggtgattcgggatcaggtgaaccaccaccaagccctactcctggttccacccttacccctcctgcagtgggactggtgcatagcggccttttgatcggtatttcgattgcaagcctttgtttggtcgtggcgctcctggcactcctgtgccatctccgaaaaaagcaaggtgctgcacgcgccaagatggaatacaagtgtgcagcaccatctaaggaagtggtgctgcagcatgtccgcaccgagcgtactccccagcgcctt

SEQ ID NO: 19905 - DNA, 1725 bp, Artificial Sequence
  Description of Artificial Sequence: Synthetic coding sequence
atgctcggagtgctggtgttgggcgcattggcgctggccggcttgggcttccctgccccagcagagccacagcctggggggtctcagtgcgtggagcacgactgcttcgcactttatccaggaccagccacattcctgaacgccagtcagatctgcgacggcctaagaggccacctgatgactgtccgctcttcggtcgccgcagatgttattagccttctcttaaatggggatggaggagtagggaggcggcgtctgtggatcggtctccagctgccacccgggtgcggcgaccctaaacggctgggccctttgcgcggattccagtgggtcaccggcgataataataccagttactctaggtgggctcggctggatcttaatggcgcaccactctgtggacctctttgtgttgctgtctcagctgcagaggccactgtaccatccgagcctatctgggaagagcagcagtgtgaggtaaaagctgatggattcctgtgtgagttccacttcccagcaacctgtcggccattagccgtcgaacctggcgcagccgccgcggccgtctccataacctacggtactccctttgccgccaggggagctgactttcaggcgcttcctgtaggatcatccgctgcagttgctcccctgggacttcagctgatgtgcactgctcctcccggggccgtgcaggggcattgggccagagaggcccccggagcttgggattgttcggttgaaaacggaggatgtgagcacgcctgcaatgctattcccggcgctccccgctgtcagtgccccgccggagcagcgctgcaggcagatggcaggagctgtaccgctagtgccacacagtcgtgcaatgacctatgtgaacatttctgtgtgcctaatcccgatcagccaggctcctatagctgcatgtgcgagaccggttacaggttagcggccgatcagcatagatgtgaagatgttgatgattgtatactcgagccctccccatgcccccaaagatgcgtgaacacacagggcgggttcgaatgtcattgctatccaaactatgacctcgtggatggagagtgcgtcgaaccagtggatccttgctttagggctaactgtgaatatcagtgtcagccgctgaaccagacttcatacctttgcgtgtgtgcagaggggtttgcccccatcccacacgagccccaccgctgccagatgttctgcaaccaaaccgcttgtcctgcagattgcgacccgaacacgcaggcttcttgtgagtgtccagaggggtatatacttgacgatggatttatatgcacggacattgacgaatgtgaaaatggcggtttctgttcgggggtgtgtcacaacctgccagggaccttcgagtgtatatgcggcccagactctgcactggccaggcacatagggacagactgtgattccggaaaggtcgatgggggagacagcggttctggtgagccaccaccctcccccaccccgggaagcactctcactccccctgctgttggtctagtgcatagtggattgctaataggaatatccatcgccagcctgtgcctggtggtggcactccttgcgctgctgtgccacctgcgcaagaaacaaggtgcagcccgggccaagatggagtataagtgcgcagcccctagcaaggaggtcgtactccagcacgtccggaccgagcgcacaccccaaagactt

SEQ ID NO: 19906 - DNA, 1725 bp, Artificial Sequence
  Description of Artificial Sequence: Synthetic coding sequence
atgctgggagtgctggtcctcggtgcactggcactcgccggtctgggtttcccggctccagcagagccgcaaccagggggatcccagtgcgtggaacacgactgcttcgcgctgtatccagggcccgccaccttcctcaacgcctcacaaatttgcgatggactccggggacatctgatgaccgtgcgatcatccgtcgccgccgacgtgatcagcctgctcctcaacggagacggaggcgtgggccggcggcgcttgtggatcggactgcagctgccgcccggctgcggggacccgaagcgcctgggaccccttagaggattccagtgggtgactggagacaacaatacgtcctacagccggtgggccagactggacctgaacggagccccgctgtgtggcccgctgtgtgtcgcggtgtccgccgcagaagccaccgtgccaagcgagcccatctgggaagagcagcaatgtgaggtgaaggcggacggctttctgtgtgaattccatttccccgcaacttgtcgccccctcgcggtcgaaccaggcgcggccgccgcggccgtttccatcacttacggcaccccattcgcagcaagaggagcggactttcaagcgctgcccgtgggctcctcagcggcggtggccccccttgggctgcagctgatgtgcactgccccgccaggcgctgttcagggtcactgggccagagaagccccgggcgcttgggactgctcagtcgaaaacggaggatgcgagcatgcgtgtaatgctatcccaggagctccgcgatgtcaatgccctgccggggccgcgttgcaagccgacggcaggtcctgtacggcctccgccactcagagctgtaacgatctgtgcgagcatttttgtgtacctaaccctgatcagccggggagctactcctgtatgtgcgagactggataccgccttgctgcagatcaacaccggtgcgaagatgtcgacgactgcatcctggagccgtccccatgccctcaacgctgtgtgaacacccagggcggatttgagtgccactgttacccgaattacgatttggtggacggagaatgtgtggaaccggtcgatccatgctttcgcgccaattgcgaataccagtgccagccgctgaatcagacctcgtacctgtgtgtctgcgcggagggcttcgcccctatcccacatgagccgcaccgctgccagatgttctgtaaccagaccgcgtgcccagcagactgcgatccgaacacccaagcgagctgcgaatgtcctgaaggctacatcctggatgatggattcatctgcactgatatagatgagtgcgaaaacggtggattctgttccggagtgtgccacaatctgcccggcaccttcgagtgtatctgcggaccggatagcgcacttgcaaggcacatcggaactgactgcgacagcggcaaagtcgacggtggagatagcggctcgggagaacccccgccgtcaccgactccaggatcgactctgactcccccagctgtcggactggtgcatagcggcctgctgatcggcatctccatcgcgagcctgtgtctggtggtggctttgctcgctctgctgtgccatctgcggaagaagcagggagctgcacgcgccaaaatggaatacaaatgcgctgcgccgagcaaggaagtggtcctgcaacacgtgcgcactgagagaacgcctcaaagactg

SEQ ID NO: 19907 - DNA, 1725 bp, Artificial Sequence
  Description of Artificial Sequence: Synthetic coding sequence
atgctgggtgtgttggtgctgggtgccctggcgctcgcaggactgggcttcccggcaccggctgagccccagccggggggctcgcagtgcgtcgagcatgactgctttgcgctttacccaggaccggcaacttttctcaacgccagccagatttgcgatggactccggggacacctgatgaccgtgagatcctcagtcgccgcagacgtgatcagcttgctcctcaatggagacggaggagtgggacgccggcgcctttggatcggtctgcaactcccaccggggtgcggcgacccaaaaaggctcgggcctttgcgcggatttcagtgggtgaccggagacaataacacgtcgtactcgcggtgggctaggctcgacctgaatggagccccgctgtgtggcccactctgcgtggctgtctccgcggccgaagcgaccgtcccgagcgaaccgatctgggaagagcagcagtgcgaggtgaaggccgacggcttcctgtgcgagtttcacttccccgcaacttgtcgcccgctcgcagttgagccgggagccgccgccgccgcggtgagcattacctatggaactccctttgccgcccgcggcgcggatttccaggcgctgccggtcggatcctccgcggcagtggcccctctcggcctgcagctgatgtgcaccgctccgcccggagctgtgcaggggcattgggcccgggaggccccgggggcgtgggactgctcagtcgaaaacggaggatgtgagcacgcatgcaatgcaattccaggcgctccacgctgccagtgccctgcgggtgcggcccttcaggctgatggacgatcgtgtaccgcaagcgcgactcaatcctgtaatgacctctgcgagcacttttgcgtgccgaacccggatcagccaggaagctactcgtgcatgtgcgagactggatacaggttggcagcggatcaacacagatgcgaggacgttgacgactgcatcctggagccttccccttgcccgcaaagatgtgtgaacacccaggggggcttcgaatgccactgctacccaaattacgacctcgtggacggcgaatgcgtggagccagtcgatccatgtttccgcgccaattgcgagtaccagtgccagccgctcaaccagacttcgtacctgtgcgtctgcgccgaaggtttcgcgccaatccctcacgaaccgcatcgatgccaaatgttctgcaaccagactgcgtgtccggcagattgcgaccctaatactcaggcctcgtgtgaatgtccggagggttatatcctcgatgacggattcatctgcacggacatcgacgagtgcgaaaacggcggattctgctccggagtctgtcacaacctgccgggaaccttcgaatgcatttgcggaccggatagcgcactggcccggcacattggaaccgactgcgacagcggcaaagtcgatggtggtgactcaggttcaggagagccgcctccgtcgccgaccccgggatcgaccctcactcccccggcggtgggtcttgtgcactccggcctgctgatcggcatttccatcgcctctctctgcctcgttgttgcgctgctcgcgttgctgtgccatctccgcaagaagcagggagctgcgcgggcgaaaatggaatacaagtgcgcggctccgtcaaaagaggtcgtgctccaacacgtgcgcacggaacgcaccccgcagcggctg

SEQ ID NO: 19908 - DNA, 1725 bp, Artificial Sequence
  Description of Artificial Sequence: Synthetic coding sequence
atgctgggtgttcttgtactgggagcgttggcactcgctggcctgggtttccctgctcccgcagaaccacaacccggtggtagccagtgcgtagagcacgattgttttgctctgtatcccggacctgctaccttcttgaacgcttcccagatctgtgacggacttcgcggacatctcatgacggttcgcagctcagtcgcggctgacgttataagcctgctcctgaatggagacggcggagtcggtagaaggcgcctttggataggattgcagctgcctcctggttgtggcgacccgaagagactgggtcctcttaggggattccagtgggtcactggtgacaacaacacatcttacagtagatgggccaggttggacctcaatggagctcctctgtgtggtcccctgtgcgtggccgtctccgctgcggaggccaccgtgccctctgaacccatctgggaggagcagcagtgtgaggtaaaagcggatggtttcctgtgtgagttccattttcctgccacatgccgcccccttgcagttgagcccggagcagcagctgctgctgttagcatcacctacggaactccttttgcagccagaggcgccgacttccaggcgcttcccgtgggttccagtgctgcagttgctccgctcggactgcaactgatgtgtacggcaccgcctggagctgtacagggacattgggcgcgcgaggctcccggcgcttgggactgctctgtggagaacggtggctgcgagcacgcatgcaatgctattcccggagctccgaggtgccaatgccccgccggcgctgcacttcaggctgacggtaggagttgtaccgctagcgctacgcaatcttgtaatgacttgtgcgagcacttctgcgtacctaacccagatcaacccggatcctatagttgcatgtgtgagacgggatataggttggcagcagatcagcacaggtgcgaggacgttgacgactgcattcttgagccctctccttgcccacagagatgcgtgaatacgcagggaggcttcgaatgccattgctaccctaactacgaccttgtcgatggagagtgtgtggaaccagtggacccatgttttagagccaactgtgaataccaatgtcagcccctgaaccagacctcatacctgtgtgtttgcgcggagggattcgcgcccatcccacatgaaccccatagatgtcagatgttttgtaaccaaactgcctgccccgcagactgcgatcccaacactcaggcctcctgcgagtgccctgagggatatatcctcgacgatggctttatttgtacagatatcgacgagtgtgagaacggcggattctgctccggcgtgtgtcataacctgcccggcaccttcgagtgcatttgcggaccagactcagcactcgctaggcacatcggcacggactgcgacagcggcaaggtggatggtggcgactcaggttccggcgaacctcccccatccccgacccccggctcaactttgactccccccgcagtaggtttggtgcattccggattgttgattggcatctccattgctagcctgtgcttggtcgtcgcgctcctcgcactgctttgtcatctgcgcaagaagcagggcgctgccagggctaagatggagtataaatgtgccgctcccagtaaggaagtagtgctgcagcacgttaggaccgagcgcacccctcaacgcctg

SEQ ID NO: 19909 - DNA, 1725 bp, Artificial Sequence
  Description of Artificial Sequence: Synthetic coding sequence
atgctcggggttctggtcctgggcgcgctggctctagcgggcttgggcttccccgctcccgctgagcctcagcctggcggaagccagtgtgtggaacacgactgttttgccctgtaccccggtccggcaacgtttctcaacgcttctcaaatttgtgacggcttgcggggccatctcatgacggtgcgctcgtccgtggcggcagacgtcattagcctgctgttaaacggggatggcggggtgggacggaggaggttatggatcgggctacagcttccaccgggatgcggggaccctaaaaggctcggacccctcagaggatttcaatgggtgacgggagacaacaacacctcctatagcaggtgggctcgcctggacttgaatggagcgcccctatgcggcccactgtgtgtggctgtatccgccgccgaggcaaccgtgccaagtgagccaatttgggaggagcaacaatgcgaagtgaaagcagatgggttcctttgcgagttccatttccctgcgacctgtcgtccacttgctgtcgagcccggtgctgccgcagccgcagtgagtattacatatggcactccattcgccgctagaggggccgacttccaagccttgccagtgggatcatctgctgccgtggccccactggggctacagttaatgtgtacagctccaccaggagcagtccagggccattgggctagagaagcaccaggagcttgggattgctctgtcgaaaacggaggctgcgaacacgcctgtaatgccatcccaggcgcccccaggtgccagtgccctgccggggctgccctacaggccgatggccgatcatgcactgccagtgcaacgcagtcatgcaacgacctctgtgagcatttttgcgtacccaacccagaccagcccgggtcctacagctgcatgtgcgaaactgggtacagactggccgccgatcagcatcggtgcgaggacgtggatgattgtatcctagaacccagtccttgtcctcagcgatgcgtgaatactcagggaggctttgaatgtcactgttaccctaactacgacttggtggatggtgaatgcgtggagccggttgatccttgctttcgcgccaattgcgaataccagtgccagcctctgaatcagacatcttacctttgtgtctgcgctgaaggattcgcgcctatcccccatgaaccacacagatgccagatgttctgcaaccagacggcctgccccgcggattgcgatcctaacacccaggctagctgtgagtgtccagaaggttatattttggacgacggctttatctgtacagatatcgacgagtgcgagaacggcggcttctgttctggcgtttgtcataaccttcccggaacgtttgagtgcatctgcggcccagatagcgcactggcccggcatatcggtaccgactgcgacagtggcaaagtagatggtggcgacagcggttccggagaacctcctccttctcccactcccgggtcaacactcacaccccctgccgtgggcttggtgcactcaggacttcttatcggtattagcatcgcaagcctgtgccttgttgtggccctccttgccctgctctgccaccttaggaagaagcagggggcagcccgtgccaaaatggagtacaaatgcgccgccccttctaaggaagtggtgcttcaacatgttcgaaccgagcgaactccccagcgtctc

SEQ ID NO: 19910 - DNA, 1725 bp, Artificial Sequence
  Description of Artificial Sequence: Synthetic coding sequence
atgctgggtgtgctggtgctgggtgccttggccctcgcaggtcttggttttccggcccccgctgaaccccagcccggaggatctcagtgtgtcgaacacgactgctttgctttgtaccccgggccggccacgtttctaaacgcttctcaaatttgtgacggattgagggggcacctgatgacagtgcggtcatcggtggcagccgacgttataagtttactcctgaacggggatggtggcgtgggacgcaggagattgtggattgggttgcagcttccccctggctgtggcgaccccaagcggcttgggcctctccggggattccagtgggtcacaggggacaataacacttcatacagccgctgggctcgactggatcttaacggagcaccactgtgcgggccactctgcgtcgcagtgtctgctgccgaggctacagtgccgagtgagccaatctgggaagagcagcagtgtgaggtgaaagccgacggcttcctatgtgaatttcacttcccagctacatgtagaccacttgctgtggagcccggagccgcagcggcagccgtgtcaataacctacggtacacccttcgccgcaagaggcgccgattttcaggcgctgcccgtggggtccagcgccgccgttgctccgttaggcttgcagctcatgtgtacagcccccccgggcgctgttcagggtcattgggctcgagaagcacctggagcatgggactgcagtgtggaaaatggaggatgtgagcacgcttgcaatgcaatccctggggctccccgatgccagtgtccggccggcgccgcattgcaagcggatggaaggtcatgtactgcttccgcgacacagagctgcaatgatctctgcgagcatttctgcgtgccaaatcctgaccagccgggcagttattcttgtatgtgtgagaccggctaccgcctggctgcagatcagcaccgatgcgaggacgtggacgactgtatcttagaaccgtccccatgtccccagaggtgtgtcaacacacaaggagggttcgagtgtcattgttatccaaactacgacctggttgacggcgaatgtgtagagccggtagacccttgttttcgagctaactgtgaatatcagtgtcagccgttgaatcagacaagctatctctgcgtttgtgcagaaggcttcgcccccattccccacgaaccacaccgatgtcagatgttctgtaatcagactgcttgcccagccgactgtgatccaaacactcaagcctcctgtgaatgccccgagggctatatcctggacgacggattcatttgcaccgatatcgacgaatgcgagaatggcggtttttgctcgggggtgtgccacaatctgccagggacatttgagtgtatctgcggcccagattcagccctagcccggcacatcggcacagactgtgacagcggtaaggtcgacggaggggactccgggtccggtgagccgccgccatctcctactccaggatctacgcttacacccccagccgttggattagtgcacagcgggctgctgataggtatttccattgccagcttatgcctcgttgtggctctgctagcactcctgtgtcacctccggaagaagcaaggtgcggcccgcgctaaaatggagtataaatgcgccgctccgagtaaggaggtggtgctgcagcacgtgcggacagaacgaacgccacagaggttg

SEQ ID NO: 19911 - DNA, 1725 bp, Artificial Sequence
  Description of Artificial Sequence: Synthetic coding sequence
atgttgggtgtgctcgtcctcggcgcgttggccctcgcgggactggggtttccagcaccggccgagccgcagccgggtggatcccagtgtgtcgagcatgactgcttcgcgctgtaccccggaccggccactttcttgaacgcctcacagatttgcgatgggctgaggggacatctcatgaccgtgagaagctcagtggcggccgacgtgatctccctcctgctcaacggagacggaggcgtgggaaggcgcagactctggatcgggcttcaactgccacctggatgtggcgatcctaagcgcctgggaccactccgtggatttcagtgggtcactggggataacaatacctcctattcgcgctgggccaggcttgacctcaatggggcccccctgtgcggaccactttgcgtcgctgtctcggctgccgaagccaccgtgccatcggagccgatttgggaagaacaacagtgcgaagtgaaagcggacggattcctgtgcgaattccattttccggcgacctgccggccgttggccgtggaacctggagccgccgccgcggccgtctctatcacctacggcacgccgttcgcggctagaggcgctgatttccaggccctgcctgtgggatcctccgctgctgtggcgccgctcggactccaactgatgtgcaccgcccctcctggcgccgtgcagggccactgggcaagagaggccccaggagcatgggactgctcagttgagaacggaggctgcgaacacgcttgcaatgcaatcccaggggcgccgcggtgccagtgtccggcgggtgctgccctgcaagccgacggacgctcttgtaccgcaagcgccacccagagctgcaacgatctgtgcgaacatttctgcgtgccaaacccagaccagccgggatcctactcgtgcatgtgtgaaactggataccgcctcgctgccgatcagcaccgctgtgaggatgtggacgactgcatccttgagccttcgccgtgtccgcagagatgtgtgaatacccaagggggatttgagtgtcactgctacccaaactacgatctggtggatggcgagtgcgtggaaccggtggacccatgcttccgggccaactgtgagtaccaatgccagccgctgaaccagacgtcgtacctgtgcgtctgcgccgaaggattcgcgccgatacctcatgaaccccatcggtgccaaatgttctgcaaccagactgcatgtcccgctgactgtgaccccaacactcaagcgagctgcgagtgtccagaaggatacatcctggacgatggcttcatctgcaccgacatcgacgaatgcgaaaatggaggtttttgctcgggcgtgtgccacaatctgccagggactttcgagtgtatctgcggaccggactcggcacttgcacggcacatcggcactgactgcgatagtggaaaggtggacggtggtgattcaggaagcggtgagccccctccttcaccgactccgggcagcactctgacgcccccggcagtaggcctggtccactccgggcttctgatcggtatctccattgctagcctgtgcttggtggtcgcactgctcgcactcctgtgccacctgcgaaagaagcaaggagcggcacgggccaaaatggagtacaagtgcgcagcgccgtcaaaggaagtcgtgctgcaacacgttcggaccgaacgcactccacagcgcctg

SEQ ID NO: 19912 - DNA, 1725 bp, Artificial Sequence
  Description of Artificial Sequence: Synthetic coding sequence
atgttaggagttttagttttaggagctttagctttagcaggattaggattcccagcaccagcagagccacaaccaggagggtctcaatgtgtcgaacatgattgttttgcactatatccaggtccagctacatttttaaatgcttcacaaatttgtgatggtttgagaggacatttgatgacagttagatcttcggtagctgcagatgttataagtttattgcttaatggtgacggtggagtaggacgaagaagactatggattgggttacaattaccacctggatgtggagatccaaagagacttggaccattaagaggatttcaatgggttacaggtgataataatacttcatattctcgatgggctagattagatcttaatggtgcaccactttgtggtccactatgtgttgcagtttcagctgctgaagctacagttccatcagaaccaatttgggaagaacaacaatgtgaagttaaagcagatggatttttatgtgaatttcattttcctgctacatgtagaccactagcagtagaaccaggtgcagcagctgccgcagtcagtattacatatggaacaccatttgcagcaagaggagctgatttccaagcattaccagttggatcctctgctgcagtagccccattagggttacaacttatgtgtacagctccaccaggagcagttcaaggacattgggcaagagaagcacctggagcatgggattgttctgtagaaaatggaggatgtgagcatgcatgtaatgctattcctggagcaccaagatgtcaatgtcctgctggtgcagcattacaagctgatggtagatcttgtacagcaagtgctactcaatcttgtaatgatctttgcgaacatttctgtgtgccaaatccagatcaaccaggaagttatagttgtatgtgtgaaactggatatcgtttagcagcagaccaacatagatgtgaagatgttgatgattgtatcttagaaccatcaccatgtccacaaagatgtgtaaatacacaaggaggatttgaatgtcattgttatccaaattatgatttagtagatggagaatgtgttgaaccagttgatccatgttttagagcaaattgtgaatatcaatgtcaaccactaaatcaaacatcatatctttgtgtttgcgctgaaggatttgcacctataccacatgaaccacacagatgtcaaatgttctgtaaccaaaccgcatgtccagctgattgtgatccaaatactcaagcatcttgtgaatgtccagaaggatatattttagatgatggatttatatgtactgatattgatgaatgtgaaaatggaggattttgttctggtgtttgtcataatttgccaggaacattcgaatgcatatgtggtccagacagtgctttagccagacatattggaactgattgtgattctggaaaagttgatggaggagattcagggtctggagaacctccaccatcaccaactccaggatcaacattaactcctccagctgtaggtttagtacatagtggattacttattggaatttctatagcaagtttatgtcttgtagtggcattgttagctcttttatgtcatttacgtaaaaagcaaggagcagctagagcaaaaatggaatataaatgtgcagctccatcaaaagaagtagttttacagcatgttagaacagagagaactccacaaagactt

SEQ ID NO: 19913 - DNA, 1725 bp, Artificial Sequence
  Description of Artificial Sequence: Synthetic coding sequence
atgcttggggtgctggtgttgggcgccctggcactcgccggactgggattcccagcccccgcagagccacaacctgggggaagccagtgtgtggaacacgactgtttcgcactgtaccccggtcccgcaaccttcctcaatgctagccaaatctgtgatggacttcgcggacatcttatgaccgtgcggtcatcggtggccgctgatgtgatttcgctcctgctgaatggagatggaggggtgggtagacgcagactgtggatcgggctgcaacttcctccaggatgtggagatcccaaaaggctgggcccgctgagaggttttcaatgggttaccggagacaacaatacttcgtactcaaggtgggcccggcttgatctgaatggagcacctctgtgtggacccctctgtgttgcagtgagcgcagcggaggccaccgtgccatctgagcccatatgggaagagcagcagtgtgaggtcaaggccgatggattcctctgtgaatttcattttccagcgacctgtcgcccgcttgcggtggagccgggagcagccgcagccgcagtgtcgattacctacggaaccccttttgcggcacgaggtgcagattttcaggcattgcctgtgggatcgagcgccgcggtcgcaccacttggtttgcaactcatgtgtaccgcccctcctggagcggtgcaagggcattgggcaagagaagcacccggggcatgggattgctccgtggaaaatgggggctgtgaacatgcgtgtaatgcaatccctggggcgcctcgctgccaatgtccagcgggagcagcactgcaagcagacggacgttcatgtacggcatccgcaactcagtcttgtaacgatctttgcgaacatttttgtgtgccaaaccctgatcagcctggatcctactcgtgtatgtgtgagactggatacagactcgctgcagatcagcatagatgcgaagatgttgatgactgtattctggaaccttctccatgtccgcaacggtgtgtgaacacccaaggaggctttgagtgtcactgttacccaaactatgatctcgtcgacggtgaatgcgtggagccagtcgatccctgttttagagcaaactgtgagtatcaatgccagccactgaaccaaacctcctacttgtgtgtctgtgccgaaggattcgcaccgattccgcacgagcctcaccgatgccagatgttctgcaaccaaaccgcatgcccagcagattgtgaccccaatacccaagcatcctgcgaatgtcctgaagggtacattttggatgatggtttcatttgcacggatatcgatgagtgcgaaaatgggggattttgctcaggagtgtgtcataatctgccaggaacctttgaatgtatttgtggtcccgacagcgcacttgcccgtcatattggcaccgactgtgactccggcaaggttgacggcggtgattcgggctccggagagcctccaccatcacctactcctggatcgactctgacccctcctgcggtgggtcttgtgcattccggacttcttatcggaatctcaattgcatcgctgtgcctcgtggtggcactgctggcactcctttgtcatctgcgaaagaagcagggagcagccagagccaagatggagtacaagtgtgcagcaccttccaaggaagtggtgctgcaacacgtgcgcactgagcggaccccacaaaggctg

SEQ ID NO: 19914 - DNA, 1725 bp, Artificial Sequence
  Description of Artificial Sequence: Synthetic coding sequence
atgctcggagtgctcgtgttgggagcactcgcactggccggactcggtttccctgcgccagccgagcctcagccaggaggctcacagtgcgtggaacacgactgttttgccctgtatccaggacccgcgaccttcttgaatgcatctcagatctgtgatggcctgcggggccacctgatgactgtccgatcttcggtggcggccgatgtcatctcgctgctgttgaatggcgacggaggggtgggaaggcgccggctctggatcggcttgcaactgccgccggggtgcggagatcccaagagattgggcccgctgagaggtttccaatgggtgactggagataacaacacctcgtactcccgatgggctcgcctggacctgaacggggctccgctttgcggacctctgtgcgtggcagtctcggccgccgaggctaccgtgccgagcgagccgatctgggaagaacagcagtgtgaagtaaaggccgacgggttcctttgtgagtttcacttccctgccacctgcaggccgctggccgtggaaccaggagcagccgccgccgcggtgagcatcacgtacggaaccccgtttgctgctagaggtgctgacttccaagcactgccggtaggatccagcgcagcagtcgccccgctgggactgcaactcatgtgcaccgcaccacctggggcggttcaaggtcactgggcccgggaggctccgggcgcatgggattgctctgtggagaacggcggatgcgagcatgcatgtaatgcgattcccggagccccgcgctgccaatgccctgcgggggcggctcttcaggccgacggccggagttgcaccgcgtccgccactcagtcctgcaacgacctgtgtgaacacttctgcgtaccaaacccggatcagcccggctcatactcatgcatgtgcgaaaccggttatcggctggcagctgatcagcaccgctgtgaggacgtggacgactgcatactcgaaccttctccgtgcccccagagatgtgtcaatactcagggaggattcgaatgccattgttaccctaactacgacctggttgacggcgaatgcgtcgaaccggtggatccctgtttccgcgccaattgtgagtaccagtgccagccactgaaccaaacgtcctacctgtgcgtgtgcgcggaaggcttcgctccgatcccgcatgagccacaccgctgccagatgttttgcaaccaaactgcttgccctgcagactgcgatcccaacactcaggcctcctgcgagtgcccggagggttacattctcgacgatggattcatctgcactgatatcgacgaatgcgaaaatgggggattttgctcaggagtgtgtcataacctgccgggtaccttcgaatgcatttgcggtccagactcggcgctcgcacggcatatcggcactgactgtgactcgggcaaagtcgatggaggagattcgggatccggggagcccccacccagcccaaccccaggatccactctcaccccgccagcggtgggcctggtccactcggggctgctcatcggcatctcaatcgcgtcgctgtgcttggtggtggcgctgcttgctcttctctgtcatctcagaaagaaacaaggagcagccagggctaagatggagtacaagtgcgcagctccatcaaaggaagttgtccttcagcacgtgcggacggagcgcactccccaacgcctt

SEQ ID NO: 19915 - DNA, 1725 bp, Artificial Sequence
  Description of Artificial Sequence: Synthetic coding sequence
atgcttggcgtgctggtcttgggggcactcgctctggcaggcctgggctttccagcacccgccgagcctcaacctggcggttcccaatgtgtggagcatgactgttttgctttgtaccctggaccagcaaccttcttgaacgcatcccaaatctgcgatggtctgcgggggcatcttatgacggtccgtagttctgttgcggcagatgtcatttcactgcttctcaatggggacggaggggtaggacgcaggcgcctttggataggacttcagctgcctccaggttgtggagatccaaagcggctcggcccactgaggggattccagtgggtgaccggtgataacaatacttcgtattcgcggtgggcacgcctcgatctgaacggagcaccactttgcggacctttgtgtgtcgcggtgtcggcagcagaagccactgtcccctcagaacctatttgggaggagcagcaatgcgaagtgaaggcagatggatttctttgtgagtttcacttccccgctacctgcagaccgctggcagtcgaacctggggcagcagccgccgcggtgtccataacttatgggactccttttgcggcaagaggcgcagactttcaggctctgccagtcggttcctccgcggcggttgcaccacttggtttgcagctcatgtgcaccgcgcctcccggtgcagtgcagggacactgggcaagggaagcgcccggtgcctgggattgctcggtggagaacggaggctgtgagcatgcatgcaacgcgattcctggggcccctagatgccagtgtccagccggtgcagcacttcaagccgatggccgcagctgtaccgcctcagcaacccagtcctgtaacgatctttgtgaacacttctgcgtacccaatcccgatcagccgggtagctactcgtgtatgtgtgaaaccggctacagactggcggcagaccaacaccggtgtgaagatgtcgacgattgtatactcgaacctagcccttgtccgcagcgttgcgtcaatactcaaggaggttttgaatgtcattgttaccctaactacgacctcgtcgacggagaatgtgtggaacccgtggatccatgttttcgggccaactgtgagtatcaatgtcaaccgctcaaccaaacctcgtacctgtgcgtgtgtgcggaaggattcgcccctattccacacgagccacacaggtgtcaaatgttttgtaaccagaccgcctgtccggccgattgtgatcctaatactcaggcctcgtgtgaatgtccggagggatacatccttgacgacggatttatctgcaccgatattgacgaatgtgaaaatggaggtttctgttccggagtgtgtcataaccttcctggcacctttgaatgtatttgcggacccgattcagctcttgcccggcatataggcactgattgtgattcagggaaagtggacggaggggattcaggaagcggtgaacctcctccttcacctactcctgggtcaaccctcacgcccccagcagtcgggctggtccacagcgggcttctcattggaatctctattgcatccctgtgtctggtggtcgcccttctcgccctcctgtgccatcttcgcaagaagcaaggcgctgcacgggcaaagatggaatacaagtgtgcagccccatccaaggaggtcgttcttcaacacgtcagaaccgagaggacgcctcaacggctg

SEQ ID NO: 19916 - DNA, 1725 bp, Artificial Sequence
  Description of Artificial Sequence: Synthetic coding sequence
atgctaggcgtactcgtattgggggccctggcactcgctggactggggttccctgcacctgcagaacctcagcctggtggatctcagtgcgtggaacatgactgctttgccttgtaccctggccctgctactttcctgaatgcctcccaaatctgcgacggtctgcgtggccacctgatgactgtgaggagcagcgtagccgctgatgtgattagtctgctcctcaatggagatggtggggttggccggagacgtctctggatcggcctgcagctgccccccggatgcggagatccaaaaagactggggccactgcgcggatttcagtgggtgactggcgacaataacacatcctacagcagatgggcaagactggacctgaacggcgcgccgctctgtggtcctctttgtgtggccgtttccgctgccgaggctacagtgccctcggagcccatttgggaggaacagcaatgcgaggttaaggccgacgggtttttatgcgagttccattttccggcaacttgccgacccctggccgtggagcccggcgctgcggcagcggcagtctctataacatacgggacgccttttgctgcccgaggtgccgacttccaagccttgcctgttggctcctctgccgctgtggcccccctgggcttgcagctgatgtgtaccgcgccgcccggcgcggtgcaaggacattgggccagagaggcgcctggggcctgggactgcagcgttgaaaatggaggctgcgaacacgcgtgcaatgccattcccggcgcaccacggtgccagtgtcccgccggcgccgccctccaggctgacggacgcagctgtaccgccagtgcgacacaatcttgcaatgatctctgcgaacatttctgcgtgcccaatcctgaccaacccggctcttacagttgtatgtgtgagaccggttatcggcttgctgccgaccagcaccgatgtgaagacgtggatgattgtatactcgagccatcaccatgcccccagagatgtgtgaacacgcaagggggtttcgagtgccattgttatcccaactacgacctggtagacggtgagtgcgtggaacctgtagatccctgttttagagccaattgtgaataccaatgtcagccactgaatcagacatcctacctatgtgtgtgtgcggaggggtttgcgccaattccacacgagcctcacaggtgccagatgttctgtaaccagactgcctgccccgcagattgtgacccaaatacacaggctagctgtgaatgcccagaaggatatattcttgacgacggctttatctgtacggacattgacgaatgcgaaaatggcggcttctgtagtggagtttgtcataacctgcccggcacttttgagtgcatctgcggacccgacagtgccctcgctcgccatattggtacggactgtgattctgggaaagtagatgggggcgactccggatcaggcgaacctccaccttcccccactccagggtcgacactgaccccacccgcagtgggcctggtccacagtggtctcctgataggcatttctatagcgtctttatgcttggttgtcgcactgctcgctctgctgtgccacttaaggaagaaacagggcgccgcccgggcgaagatggagtacaagtgcgccgcccccagtaaagaggtcgttctgcagcatgtcaggaccgaacgcactcctcagcgcctt

SEQ ID NO: 19917 - DNA, 1725 bp, Artificial Sequence
  Description of Artificial Sequence: Synthetic coding sequence
atgcttggcgtccttgttttgggcgccctcgcactggctggactgggctttcctgctcccgcagagcctcagccaggcggctcccagtgtgtggagcacgactgcttcgcactctatccaggacccgcaacttttctgaatgcgagtcagatatgtgacggccttcgggggcatctcatgactgttaggtccagcgtcgcagctgacgtcataagcctgcttcttaacggcgacgggggagtgggccggcgtcgcttatggattgggctgcagcttccaccagggtgtggcgaccccaagaggctgggacctctgcggggcttccagtgggttaccggagacaataacacttcatacagcaggtgggctcgcctggatttgaacggagccccgctgtgcgggcctctctgtgtggcggtgagtgccgccgaagcaacagttccctctgagcccatatgggaagagcaacagtgcgaagtgaaagccgacggctttctgtgtgaattccacttccccgctacttgccgccccctcgcggtagagcctggggccgccgccgccgcagtaagcataacatacggaacgccgtttgcagcccgaggcgctgatttccaggcattaccggtcggatcctcagccgcggtggctccactgggccttcagctaatgtgcacagctcctcctggggctgtgcagggtcactgggcccgagaagcgcctggggcctgggactgctccgtcgagaatggcggctgcgaacatgcctgcaatgcaatccctggcgcgccgcggtgtcagtgtcccgccggtgctgctctgcaggcagatggccggagctgtactgcgtccgcgactcagtcgtgcaatgatctgtgtgaacatttctgcgtgcctaatccagatcagcctggctcctactcctgtatgtgcgagacaggttacagattggcagcggatcagcatcgctgtgaagatgtggacgactgcatcctggagcctagcccctgtccccaacggtgcgtcaatacgcaggggggcttcgagtgccactgctaccccaactacgacctagtggacggcgagtgtgtggagccggtggatccttgcttccgcgctaactgtgagtaccagtgtcaaccactcaatcagacctcttatctgtgtgtttgtgctgagggctttgcgccgataccgcacgaaccccaccgttgtcagatgttttgcaatcaaacggcatgccccgccgactgcgaccccaacacccaagcatcctgcgagtgtcctgaaggctacatcctcgacgatggattcatctgtactgacatagacgaatgcgagaatggtggcttttgctcaggcgtttgccataacctccctggcacgttcgagtgcatctgcggaccagattcagctctcgcccggcacattgggacagactgcgatagtggaaaggtggatgggggtgactctggaagcggtgagccgcccccatcccctacccccggctccacactgactcctccggccgtggggctggtccactccggccttctgatcggcatctcaattgcgtctctgtgtcttgtggttgccctcctcgcgctgctgtgtcacttgcggaaaaagcagggagcggctcgagctaagatggagtacaaatgtgctgctccctctaaagaggtcgtccttcagcatgtgaggaccgagaggaccccacagcgtctg

SEQ ID NO: 19918 - DNA, 1725 bp, Artificial Sequence
  Description of Artificial Sequence: Synthetic coding sequence
atgctgggggttctcgtcctgggggcattagccctggcaggcctgggctttcccgccccggccgaaccccaacctgggggctcccaatgtgtggagcatgactgtttcgcactataccccggaccagcgaccttcctaaatgcctcacagatttgcgacggcttgagaggccatcttatgactgtgaggagttctgttgcggctgacgttatcagtttgctgcttaatggggatggcggagttggacggcggcggctgtggattggactccagctgccccccggctgcggtgaccctaagaggcttggacccctgaggggttttcagtgggtgacaggggacaacaacacaagttactcccgatgggcgcgtttggatctaaacggggcaccactatgcggccccctgtgtgtggctgtgagcgctgccgaagcaactgtgccatctgagcctatttgggaggaacagcagtgcgaagtgaaggccgacggttttctatgtgagtttcacttccctgctacatgtcgccctctggcagttgagcccggtgccgccgccgctgcagttagcattacttacgggaccccctttgcggctaggggagcagattttcaggccctgccagtgggttcatctgccgctgtggcccccctgggtctgcagctaatgtgtactgcgccaccaggggccgtgcaaggccattgggcccgggaggcgcctggagcgtgggactgttctgtggaaaacggcggatgtgagcacgcatgcaacgcaattccaggggccccaagatgtcagtgtccagccggagctgctttacaagccgatggaagaagctgcactgcgagcgctacccagtcatgtaatgacctctgtgaacatttctgcgtgccaaaccccgatcagcccggttcttacagctgcatgtgcgagactggatatcgtcttgccgcagaccagcatcgctgtgaagacgttgatgactgtatcctggaacccagcccatgccctcagagatgtgtcaacacacaaggcggttttgagtgtcattgctacccaaactatgaccttgtggacggcgagtgtgtggagccagtagatccttgcttcagagccaactgcgagtaccagtgtcagcccctcaaccaaacgtcatacctgtgtgtctgcgctgagggatttgcccccattccacacgagccccaccgctgccagatgttttgcaatcaaaccgcatgcccagctgactgcgatcctaatacacaggcctcatgcgaatgtcccgaaggctatattctcgacgatgggtttatctgtaccgacatcgacgagtgcgaaaatggcggcttctgctcgggagtgtgccacaacctccctggaacgtttgagtgcatttgtggccccgattccgccctggcgagacacattggtactgattgcgacagtggaaaggtggacgggggcgatagtgggagtggggagccaccacccagcccaactccagggagtacgctgacacccccagctgtgggcctggtccactcaggtttgctgataggaatctctatagcatcactatgccttgttgtggcattactcgccctgctgtgccatctgagaaagaaacagggcgccgcccgcgcaaagatggagtataagtgtgctgctccaagcaaggaagtcgttctgcagcacgtccggactgagcgcacaccacagcgcctc

SEQ ID NO: 19919 - DNA, 1725 bp, Artificial Sequence
  Description of Artificial Sequence: Synthetic coding sequence
atgcttggagtccttgtcctcggcgcactggcccttgcaggcctgggattcccagccccggccgaaccgcaaccaggaggctcacaatgtgtcgagcacgattgttttgcgctctacccaggtcctgccacctttctcaatgcttcacagatttgtgatggacttaggggacatctcatgactgtgcgttcgtcggtggctgcagacgtgatttcccttctgctgaacggtgatggtggggtgggtcgacggcgcctgtggatcggccttcaactgcctcccgggtgtggcgatcctaagcgcctgggaccattgcgaggttttcaatgggtgactggagacaataacacgtcctattcgcgttgggcacggctggacctgaacggagccccgctctgtggccccctgtgcgtggcagtgtcagccgccgaagccactgttcctagcgagcccatctgggaagagcaacaatgtgaagtcaaagctgacggtttcctgtgtgaatttcactttcctgccacctgtcgaccactggccgttgaacccggtgccgccgcagccgcagtcagcataacttacggtacgccctttgcagcacgtggagccgatttccaggcacttccagtgggtagcagcgcagcggtcgcacctttgggactgcaactgatgtgtaccgcaccacccggagcagtgcaggggcattgggcacgtgaagcaccaggtgcctgggattgcagcgtcgaaaacggtggatgtgagcatgcctgcaacgcgattcctggagcaccaagatgtcagtgtcctgctggggcagccctgcaagccgatggaaggtcttgtactgcatccgccactcagtcgtgtaacgatctttgtgagcacttttgtgtacctaaccccgatcaaccaggaagctacagctgcatgtgtgaaactggataccgtctggccgcagatcagcatagatgtgaagatgtggatgattgtattcttgagccctccccatgccctcaaaggtgtgtcaacacgcagggaggattcgaatgccactgttaccctaactacgacctggtggacggggaatgcgtggaaccagtggatccctgcttccgcgcgaactgcgaataccaatgccagccacttaaccaaacctcgtatttgtgtgtgtgcgcagaaggttttgcgcctattccacacgaaccccatcgctgtcaaatgttctgtaatcaaaccgcatgtcctgccgactgtgatcctaacacccaggcgtcgtgtgagtgtccagaaggttacattctggacgacggcttcatttgtactgatattgatgaatgtgaaaatggcggcttctgttccggagtctgtcataacctccccggtacttttgagtgtatttgcggacctgattccgcactggcacgccacattggaaccgattgtgattcaggcaaggtggatggaggtgattcgggtagcggtgaacctcctcctagcccaactcctggaagcacgctcactccacctgcagtgggactggtgcattccggacttctgattgggatttcaatcgcgtccctgtgtttggtggtggccctcttggcactgctctgccatctgcgcaagaagcaaggagccgcaagagcaaagatggagtacaaatgtgcagcaccgtccaaagaggtggtgctccagcatgtgcggactgagagaaccccccaacggctt

SEQ ID NO: 19920 - DNA, 1725 bp, Artificial Sequence
  Description of Artificial Sequence: Synthetic coding sequence
atgcttggtgttttggtcctgggggcattggccctcgccggcctggggtttcccgcgccggcggagccgcagccaggtggctcgcagtgtgtcgaacacgactgctttgcgctctacccgggcccagcgactttcctgaacgcatcacaaatctgcgatggtctgcgcggccacctgatgaccgtgcgctcatctgtcgcagctgacgtgatctcactgctgctgaacggcgacggcggcgtggggcgtcgcagactgtggattggtctgcaactcccaccgggctgtggcgaccctaagagattggggcccctgcgcgggttccagtgggtgaccggcgacaacaacacttcgtatagccgatgggccagactggacttgaacggagcaccgctctgcggccctctgtgcgtggccgtgtcagcggcggaagcaactgtcccatccgaaccgatttgggaagagcagcaatgcgaagtgaaggccgacggattcctgtgcgagtttcatttccccgcgacctgccggccactcgctgtggagccgggtgctgctgccgcagcagtgtctatcacttacggaaccccctttgccgcgcggggggccgacttccaagcgctgcccgtggggtcatccgccgccgtggccccactgggactgcagctcatgtgcactgctccaccgggagctgtgcagggtcactgggcccgagaggcacctggagcttgggattgctcagtcgagaatggtggctgtgagcatgcgtgtaatgccatcccgggagccccacgctgccagtgccctgcaggagctgccctccaagccgatggccgctcgtgcacggcttcggctacccagtcctgtaatgatctgtgcgaacatttctgcgtcccaaacccggaccagccagggtcgtacagctgcatgtgcgaaaccggataccgcctcgctgccgatcagcacagatgtgaagatgtggatgattgcatcttggagccaagtccatgcccgcagcggtgcgtgaacactcagggagggttcgaatgccattgctaccccaactacgaccttgtggacggagaatgtgtggagccggtggacccgtgcttcagagctaactgcgaataccagtgtcaaccactgaatcagacctcctacctctgcgtctgtgcagagggatttgcaccgatcccccacgaaccacacagatgccagatgttctgcaatcagacggcatgcccggctgattgtgatccaaatacccaagcctcctgcgaatgcccggaagggtacatcctggacgacggatttatctgtaccgacatcgacgagtgcgagaacgggggtttttgttccggggtttgccataacctccccggcactttcgagtgtatttgcggaccggattcagcactggcacggcatatcggtactgactgcgattctggaaaggtggacggaggagatagcggatcgggagaaccacccccgtcccctacgccggggtcgaccctgactccgcctgcggttggactggtccactcgggactgctcatcggaatcagcattgcgagcctgtgcctggtcgtggccctgctcgcactgctctgtcacctgcgcaaaaaacagggtgcggcccgcgcgaaaatggagtacaagtgcgccgcaccatcgaaagaggttgttctccaacatgtgcgcaccgaaagaaccccacaacgattg

SEQ ID NO: 19921 - DNA, 1725 bp, Artificial Sequence
  Description of Artificial Sequence: Synthetic coding sequence
atgctcggagttttagtcctgggagccctggcccttgccggattgggatttcccgcaccagccgaaccacaacccggggggagtcagtgtgtcgagcacgattgctttgctctctaccctggaccagcaacgttcctgaacgcttctcagatctgcgatgggctgagggggcatctcatgactgtccgctcatccgttgccgccgatgtgatctcgctgttacttaacggagacgggggggtcggaaggaggaggctatggatcggattgcagctgcccccagggtgcggggatcccaaaagactggggcccctgagagggtttcagtgggttactggagataacaacacttcttacagtcgctgggcaaggcttgatctcaatggggcacccctatgcgggcccttatgcgtggctgtgtctgccgcggaggcaacggttccaagtgagcctatttgggaagaacaacagtgcgaagttaaagccgatggattcctttgtgagttccacttccccgctacatgtagacccctggctgtcgagcccggggccgctgcagctgctgtttccataacgtacgggacaccttttgctgccagaggggcagactttcaggcactgcccgttggatcatcagcggcggttgctcccctagggctccagcttatgtgtactgcaccaccaggggccgtccaggggcactgggctcgggaggctcccggagcttgggactgttctgtggagaacggaggatgcgaacacgcctgcaatgcgatcccaggggctccacgctgtcagtgtcctgctggagccgcccttcaggcagatgggcggtcatgtacagcctcagccacacagtcatgtaatgacctctgtgaacatttctgtgtacccaacccagatcagcctgggagttattcttgtatgtgtgagacagggtatcgacttgctgcagatcagcaccgctgtgaggatgtcgatgattgtatcttagaaccatctccttgtccccagcgctgcgttaatactcagggggggtttgagtgtcactgctaccccaactatgatctggtggatggggaatgcgtagaacccgttgatccctgtttcagggccaactgtgaatatcagtgccagccactgaaccagacatcttatctctgcgtgtgtgctgaaggattcgcacctatcccccatgaacctcatagatgtcagatgttctgcaaccaaacagcctgcccagcagattgtgatcctaatacacaagcaagttgtgaatgcccagaaggatatatactggatgacgggtttatttgtacagatatagacgaatgcgaaaacggggggttctgcagtggagtctgtcacaatcttcccgggacatttgaatgcatatgcggacctgactctgctctcgccagacacataggaacagattgtgattcggggaaagtggatgggggagattctggatctggagaacctccccccagtcctactcctgggtccacactgactccacccgccgtggggcttgttcactcgggacttctcataggaatatcaatcgctagtctctgtctggtggtagccctattggccttactgtgccacctcagaaaaaagcagggggccgctcgcgcaaagatggaatataaatgcgcagcaccctccaaggaagtggtcctccagcatgtgaggacagagcggacaccacaacggcta

SEQ ID NO: 19922 - DNA, 1725 bp, Artificial Sequence
  Description of Artificial Sequence: Synthetic coding sequence
atgctcggcgtcctggttctgggagccttggctcttgctggattaggctttcccgctcctgcagagcctcagccaggcggctcccaatgcgtcgagcatgactgctttgctctgtacccgggccctgctaccttcctgaacgcttcacaaatctgcgatggtcttagggggcatttgatgacagtgaggtcttcggttgctgcagatgtaatttctctgctgctgaacggagacggaggagtgggcagaaggaggctgtggatcggtctccaactcccacccgggtgtggagaccccaaacgcttagggcccctccgaggcttccaatgggtgacaggcgacaataataccagctatagtagatgggccaggctcgacctcaatggcgcccccctctgcggaccgctgtgcgtagcggtatcagcagctgaagcaaccgttcctagcgagccaatttgggaggaacagcaatgcgaagtgaaagctgatggcttcctgtgtgagttccactttccagctacgtgcaggccactcgcagtcgagccgggcgcggccgccgctgccgtctctattacctacggaacaccattcgccgcgcggggagcagacttccaggctttgccggttggaagttctgctgcagtggcacccctgggattacagcttatgtgtaccgcccctcctggggctgtccagggccactgggctcgcgaggctcccggcgcttgggattgcagcgtggagaatgggggctgtgagcacgcgtgcaacgccatccctggcgcacccaggtgtcagtgccctgcgggcgctgccctgcaagccgatggaaggtcttgcactgctagcgctacccaaagctgtaacgacctttgcgaacacttctgcgtccccaatccagaccaacccggaagctacagctgcatgtgcgaaacaggctaccggcttgctgccgaccagcacagatgcgaagatgtagatgattgcattctggagccttctccttgcccacaaagatgtgtgaacacccagggagggtttgaatgccattgctatccgaactacgatcttgtggacggtgagtgtgttgagccggttgatccatgctttcgagccaactgtgaataccaatgtcagcccttgaaccagacctcctatctgtgcgtctgcgccgagggattcgcgcccatccctcacgagccgcaccgctgccaaatgttttgtaaccagacagcttgtccagctgattgcgacccaaatacccaagccagctgcgaatgccccgagggctatatcctggacgatggttttatttgtacagatatcgacgagtgtgaaaacgggggcttctgctccggtgtgtgtcacaaccttcccggcacattcgaatgcatttgtggtccggactcagcgctggctaggcacatcggcacagactgtgattctggcaaagtcgacgggggcgactccgggtcaggggaaccacctccatcgcccaccccagggtcaacccttactccccctgcggtcggtttggtgcatagcggcctgttaattggtatcagcattgccagtctttgcttagttgtcgccctgctagcccttctttgccatcttcggaagaaacaaggcgccgccagggcaaaaatggaatataaatgcgccgccccctctaaagaggtagtgctacaacacgtccgcaccgagagaaccccccagaggttg

SEQ ID NO: 19923 - DNA, 1725 bp, Artificial Sequence
  Description of Artificial Sequence: Synthetic coding sequence
atgctgggagtcctggttctgggagctttggctcttgccggtcttggatttcccgcgcctgccgagcctcagcctggtggaagtcagtgcgtagagcatgactgttttgctctctatccgggtcctgcgacgttcctgaacgcctcccaaatctgcgatggcctgagggggcacctgatgacagtgaggagttcggttgccgccgacgtcattagtctcctgctcaatggagatggcggagtcgggcggcgccgcctgtggataggattgcagctcccccctggctgtggagaccccaagaggctggggcccttaagaggcttccaatgggttacaggcgataataatacttcctatagccgctgggccaggctggacctgaatggggcccctttgtgcggaccattatgcgtcgccgtgtccgccgcagaagctactgtcccatctgaacctatctgggaggagcagcaatgtgaggtgaaggccgatggatttctgtgcgagtttcactttccggccacttgtaggccactggccgtcgagccaggagcagcagctgcggctgtgagcattacatatggcactcccttcgccgccagaggcgctgacttccaggcattgccagttgggtccagtgccgcagttgcccctctgggtctccaactcatgtgcactgcaccacccggcgccgtccagggacattgggccagggaagccccaggagcatgggattgctccgtggagaacggcgggtgtgaacatgcctgtaatgctatcccgggcgctccgcggtgccagtgccccgctggtgctgcactccaggccgacggtcgctcctgcacagcaagcgccacacagtcttgcaacgatttgtgcgaacatttttgtgtgccaaaccctgaccagcccgggagctactcctgcatgtgcgaaactgggtatcgactggctgcggaccaacaccgttgcgaggacgttgatgactgtatcctcgaaccttcaccatgtccgcagcgctgcgtcaatactcaaggaggctttgagtgtcactgttatccaaattatgatctggtcgacggcgaatgtgtagagccagttgatccctgttttagagctaactgcgagtaccagtgccagccccttaaccaaaccagttacctatgtgtgtgcgcagaagggtttgctcctattccacatgaaccacataggtgtcagatgttctgcaaccaaacagcctgtcccgcggactgtgatccaaatacgcaggcctcttgcgagtgccccgaaggttacatccttgatgacggttttatttgtactgacatagacgaatgtgaaaatggaggcttctgttccggcgtgtgccataatctcccaggaacatttgagtgcatttgtggcccagacagtgccttggctaggcatatcggaaccgattgcgactctggaaaggtcgatggcggggacagtggatctggtgaaccaccgccaagccctacacctggctccactcttacgccccccgccgtcggcctcgtgcatagcggacttttgatcggcatcagcatagccagtctgtgcctggtggttgccttgctggcactcctgtgtcatctgaggaaaaagcagggggcagcacgggctaagatggaatacaagtgcgccgccccatctaaagaggtggttctacagcacgtaagaactgaaaggacgccccagcgtctg

SEQ ID NO: 19924 - DNA, 1725 bp, Artificial Sequence
  Description of Artificial Sequence: Synthetic coding sequence
atgttgggagtcctggtgcttggagcacttgctcttgcaggacttgggtttccagcaccagctgagcctcaaccgggaggctcacagtgcgttgaacatgattgttttgctctttacccgggacctgctacttttcttaatgccagccagatatgcgatggacttcgtggtcatctaatgactgtaagaagctctgtggctgctgatgtgatctcactccttcttaacggcgatggtggcgtagggcgacgacgtctctggattggtctgcagttacccccaggatgcggagatccaaaacgacttggaccactacgtgggttccaatgggtaaccggagataataacacgtcgtacagtcggtgggctagactggatcttaacggcgcgccgctgtgcggtccactatgcgtcgcagtttcggccgctgaggctaccgtgccctcagaacctatttgggaagagcaacaatgcgaagttaaagctgatggtttcctatgtgaatttcatttcccggcaacatgtcgaccgttagcggtggaaccaggagctgccgctgcagctgtgtcaatcacttacggcacaccattcgctgctcgaggcgcagattttcaggcgcttcctgttggttcgtcagccgcagttgcgccgttgggactacagctcatgtgtactgccccaccaggtgctgtgcaagggcactgggccagagaagcccctggagcatgggactgttccgtggagaatggtggatgcgaacatgcttgcaacgccatacctggcgccccaaggtgccaatgtccggctggtgccgcgctacaagcggatggacgatcttgtacagcttcagctactcaaagctgtaacgacctatgtgaacacttctgtgtgcctaatccagatcaaccgggcagctattcctgtatgtgtgagactggataccggttagccgcagatcaacatcgttgtgaagatgttgacgattgtattttagaaccgtcaccatgcccacaaagatgtgtaaatacccaagggggattcgaatgccattgctatcctaattatgatcttgttgatggtgaatgtgtagagcctgtcgatccatgctttagagccaactgtgaatatcaatgccaacccctaaatcaaacttcatatctctgcgtatgtgctgaaggatttgcaccaattcctcacgaaccgcatcgctgtcagatgttctgtaatcaaacggcgtgtccggctgattgcgatccgaatacacaagcctcctgtgaatgtcctgaggggtatatactcgacgacggttttatatgcacagatatcgacgagtgtgaaaatggaggattctgttcaggagtctgccataatctacctggtacttttgagtgcatttgcgggcccgactcggctttagctagacatattgggaccgattgtgactctggaaaagtcgatggtggcgattcaggttcaggggaaccgccgccatcgccgactcccggaagcacgcttactccaccagctgttggacttgtacatagtggccttttgattggaatttctattgcatcgctctgtctcgtggtggcactgctagctttgttgtgtcacttacgaaaaaaacaaggcgctgcacgagcaaaaatggaatataagtgtgcagcgccaagcaaagaagtcgtcctccaacatgtacgtactgaacgtacgccgcaacgtctt

SEQ ID NO: 19925 - DNA, 1725 bp, Artificial Sequence
  Description of Artificial Sequence: Synthetic coding sequence
atgttgggcgtcttagtgttgggtgccctagcactcgcgggactcgggttccctgctccggcggagcctcaacctggaggcagccaatgtgtcgagcacgattgctttgctctgtatcccggacccgccacatttctgaatgcatctcagatatgcgatggcttgcgtggacacttgatgacggtccgatcatctgtggcagccgacgtgatctccctcttgctcaacggtgacggaggagtggggcgccgcagactgtggatcggactccaactccctcctgggtgcggagaccctaaaaggttgggacctctgaggggatttcaatgggtgactggagataacaacacaagttatagcaggtgggcccggcttgaccttaatggcgctccgctctgcggccctctgtgcgtggccgtgagcgcggccgaggctaccgtcccgtccgaaccaatctgggaagaacagcagtgcgaggtcaaggcagatggatttctctgcgagtttcatttccctgctacttgtaggccactggccgtggaaccaggggcggccgctgctgcggtgagcattacctacggcacccctttcgccgcccggggagccgattttcaagctcttcctgttgggtcgtctgcggcggtggcaccattgggtctccagttgatgtgcaccgctccaccgggagcagtgcaagggcactgggcccgagaagcccctggggcttgggattgttccgtcgagaatggaggttgcgagcacgcctgtaacgccatccccggcgccccaagatgccagtgccctgctggcgccgccctgcaggcggacggtcgtagctgcacagcgtctgcaacccagtcctgtaatgatctgtgcgaacacttctgcgtccctaatccggaccagcctggaagttactcctgtatgtgtgagacgggatatcgactggccgctgatcagcatcgatgtgaagacgtggatgactgcatcttagaaccgtcaccatgccctcagaggtgcgtcaacacacaggggggcttcgagtgccactgttaccccaattacgacctggtagatggcgaatgcgtcgaaccggtagacccttgtttcagagcaaactgtgaataccagtgccagcccctcaaccagacgagctatctttgcgtatgcgctgaggggttcgcccccatcccacacgagcctcatcgatgtcaaatgttctgcaatcaaacagcctgccccgccgactgtgaccctaacactcaagcctcttgtgaatgtcctgagggctacatcttagacgacgggtttatttgtaccgatattgacgaatgtgagaacgggggattctgctcaggcgtctgtcacaatcttcccgggaccttcgagtgtatttgcggcccagacagcgccctggcccgccacatcggaactgactgcgactctggtaaagttgatggaggagattcaggatctggagaaccgccacccagcccaacgcctggttcaactctgactcctccagctgtcggcctggtgcacagcggcctgctgatcgggatttccatagcttccctatgtctggtcgtcgccctgctcgctctgctttgccatttgcgcaaaaagcagggagcggcacgtgctaaaatggaatataagtgtgccgccccatctaaggaggtcgttctgcagcacgtgcgcaccgagcggaccccccaacgactc

SEQ ID NO: 19926 - DNA, 1725 bp, Artificial Sequence
  Description of Artificial Sequence: Synthetic coding sequence
atgttgggcgtactggtgctgggtgccctcgccctggcgggcttgggattccccgcacccgccgagccccagcctggtggctcacagtgcgtggaacacgactgcttcgctctctacccaggcccagccacttttctgaatgcgtcgcagatctgtgatggccttagggggcatttgatgacggtgcgatcatcagtcgccgcagatgtgataagcctcctacttaacggggacggaggagtcgggaggcggcggttgtggattggccttcagcttccaccaggttgtggcgacccaaagaggttaggcccattgagaggattccagtgggtcaccggagataacaacactagttacagtcgatgggcaaggttggatctgaatggagctccattgtgcggcccactctgtgtggctgtgtctgctgcggaggccaccgttccctcagagcctatttgggaggaacagcagtgcgaggtgaaggccgatggcttcttatgtgagtttcacttccctgcgacgtgtagaccgctggctgttgaacccggggcagccgctgcggctgtatccattacttatggcacacctttcgcggcccggggagctgattttcaagcgcttccagtgggctcttccgccgctgtggcacccctcgggctgcagctcatgtgcaccgcaccccccggagccgtccaaggtcactgggcaagagaggctcctggagcctgggactgtagcgtggagaacggcggctgcgaacatgcgtgcaacgctatacctggcgcccctaggtgccagtgccccgcaggagctgccctccaggctgatggtcgaagctgcacggcaagtgccacacagagctgcaatgatttgtgcgaacacttctgtgtccccaacccagaccagccgggatcttattcatgcatgtgtgagactgggtaccgcctggcagctgatcagcatcggtgtgaggatgtggacgactgcattttggaacccagcccctgtcctcagcgctgtgtgaacacccagggcggctttgaatgccattgttatcctaattacgatctggtggatggagaatgtgtggagcccgtggacccttgtttccgggcaaattgcgagtatcaatgccagcctctgaaccaaacatcctacctttgcgtatgtgccgagggcttcgctcctatcccacatgagcctcaccgctgtcagatgttctgcaatcagactgcctgcccagccgattgcgaccccaatacccaagccagttgtgagtgcccggaaggttatatcctcgacgacggctttatctgtactgatatcgacgagtgtgaaaacggtggattctgctctggcgtgtgtcataatttgccgggcacctttgagtgtatttgcggccctgacagtgccctcgccagacatataggaactgattgcgactctgggaaggtggatggaggcgattcaggttcaggcgagcctcccccaagtcccacacccgggtcaacgctgaccccgcctgccgtggggctggtgcactcgggacttctgattgggatctcaatcgcctcattatgcttggtggtggctctcctcgcactgctctgtcacttgaggaagaagcagggggccgcgagggcaaaaatggaatacaaatgcgctgcgcccagcaaggaggtggtgttgcagcacgttcgcactgagcggacaccccagcgccta

SEQ ID NO: 19927 - DNA, 1725 bp, Artificial Sequence
  Description of Artificial Sequence: Synthetic coding sequence
atgctgggagtcctcgtccttggcgcactcgccctggcggggctggggtttccggccccggcggagccgcagcctggtggctcccagtgcgtggaacatgattgcttcgctttgtacccgggtccggccactttcctgaacgcgagccagatctgcgacggattgaggggccacctgatgactgtcagatcctcggttgcagcggacgtcatctcactcctgctgaacggtgacgggggagtcgggcggagacgcctctggatcgggctgcagctgccgcccggatgcggggaccccaaaaggctgggacctttgagaggctttcaatgggtgactggcgacaataacacctcgtacagcaggtgggcacggctcgacttgaacggcgcgccactgtgcgggccgttgtgcgtcgcagtctccgcggcggaggccaccgtcccgtcagaaccgatctgggaagaacagcagtgtgaagtgaaggccgacggatttctgtgcgaattccatttcccggctacgtgcagacctcttgctgtcgaaccaggggcagccgccgctgctgtcagcattacctacggcacccctttcgccgcccgcggagcggatttccaggccctgcctgtgggaagcagcgcagcagtcgcccctcttggcctgcaactcatgtgcacggccccgccgggcgcggtgcagggacactgggccagagaggcccccggggcctgggactgttcggtggaaaatggaggatgcgagcacgcctgcaacgcaatcccaggcgctcccagatgccagtgtccagccggcgcggcgctgcaggccgacggtcgctcttgcaccgcctcggccactcagtcatgtaacgacctctgtgagcatttttgtgttccaaacccggaccagcccgggagctactcgtgcatgtgcgaaaccggctaccgcctcgcagcggaccaacacaggtgtgaagatgtcgatgactgtatcctggagcccagcccatgccctcagcgttgtgtgaatacgcaaggtggattcgaatgccactgctaccctaactacgacctcgtggacggagaatgcgtggagccggtggacccatgcttccgcgcgaattgtgaataccagtgccaacctttgaaccagacttcttacctgtgtgtgtgcgctgaaggcttcgcgcctatccctcacgagccgcatcggtgccagatgttttgtaaccaaactgcctgcccagcggattgcgatcctaacacgcaagcatcctgcgagtgccccgagggatatatcttggacgatgggttcatctgcacggatatcgacgaatgcgaaaacggcggcttctgttcgggagtgtgccacaatctgccgggtaccttcgagtgtatctgcgggccagactcggcccttgcccgccacatcggtactgattgtgatagcggtaaggtcgatggcggcgactccggaagcggcgagcctccgccctccccgacgcccggatcgacgctcaccccgcccgcggtgggactggtgcattccggccttctgatcgggatatccattgcaagtctgtgcctggtggtcgcccttctcgccctgctgtgtcacctgcgcaaaaagcaaggagccgcccgcgcgaagatggaatacaagtgcgccgcgccatcgaaggaggtcgtgctgcagcatgtgagaaccgagcgcaccccgcaacgcctc

SEQ ID NO: 19928 - DNA, 1725 bp, Artificial Sequence
  Description of Artificial Sequence: Synthetic coding sequence
atgctgggtgtgctcgtgctgggtgcactcgctctggcaggtcttggcttccctgcccccgctgagccccagcccggtggatcccagtgtgtcgaacatgactgcttcgccctgtaccctggcccagcaacctttctcaatgcttctcagatctgtgatggtttgagaggccaccttatgaccgtgcgcagctccgtggccgctgacgtgatttctttgctcctcaatggtgacggcggtgttggccgtcgtaggctgtggataggtctccagctcccccccggttgcggcgaccccaagaggctgggtcccctgcgtggttttcagtgggtaaccggtgacaataatactagctattctaggtgggctcgcctggatctgaacggcgctcccctctgcggaccattgtgtgttgccgtcagcgccgcagaagccactgtgccttctgagcctatttgggaggaacaacaatgcgaagttaaagcagacggctttctgtgcgaattccacttcccagctacctgtcgtcctttggcagtcgagcctggtgccgctgctgctgcagtgtccataacatatggaactcctttcgccgcacgcggcgccgacttccaggcattgcccgtaggttcttccgcagcagtcgctcccctcggactgcagttgatgtgcaccgcccccccaggagccgtgcagggccattgggctcgtgaggctcccggagcctgggactgttcagtggagaacggcggctgcgagcacgcttgcaatgctatcccaggagctcctagatgtcagtgtcctgcaggtgctgccctccaggctgacggacgttcttgtaccgctagtgctactcaatcttgcaacgacctttgtgagcacttctgcgtacctaatccagatcagcctggctcctactcttgcatgtgcgaaaccggctaccgcctggccgccgaccagcaccgttgcgaagacgtcgatgactgtatcctggaacccagcccctgtccccagcgctgcgttaacactcaaggaggatttgaatgccactgttaccctaactatgacttggtggacggtgagtgcgtagagccagtggacccatgttttagagcaaactgcgagtaccagtgccagcctctgaaccagacttcttacttgtgtgtgtgcgctgaaggcttcgcacctataccacatgagccccacaggtgtcaaatgttctgcaaccagaccgcatgtccagcagactgtgaccctaacactcaagctagttgtgagtgtcccgagggatacatcctggatgacggcttcatctgtaccgacattgacgaatgtgagaacggtggtttctgttccggtgtgtgtcacaacctcccaggtacattcgagtgcatctgcggaccagactccgccctcgcccgtcatataggtactgattgcgatagcggcaaggtggatggtggtgatagcggaagtggtgagccaccacctagtcctacccctggttccactttgacaccccctgctgtcggtcttgtccactccggtctcttgatcggaatcagcatcgcttcattgtgtctggttgtggctctgttggccttgttgtgccacctccgcaagaaacagggcgcagcacgtgctaagatggagtacaagtgcgccgcacccagtaaagaggttgttctgcagcatgtcaggacagagagaactccacagcgtttg

SEQ ID NO: 19929 - DNA, 1725 bp, Artificial Sequence
  Description of Artificial Sequence: Synthetic coding sequence
atgttgggtgtccttgtattgggcgccttagctcttgcaggtcttggcttcccggcccctgcagagccccagccaggtggatcacagtgcgtagagcacgactgtttcgccctgtaccccggacctgctacatttctgaacgcgagccaaatctgcgacggcctgcgtggtcatcttatgactgtccggtcctcagtcgccgccgatgtgatctcattgttactgaacggagacggcggcgtgggcaggaggcggctttggataggattgcagctcccgcctggatgcggcgacccaaaaagactggggcccttgagaggtttccagtgggttaccggggacaataatacaagttattcgcggtgggcacggctcgatttgaacggagcccctctttgtggtccactgtgcgtggcggtatccgccgcagaagccacagtacctagtgagccaatttgggaagagcagcagtgcgaagtgaaagccgacggattcctttgcgagtttcactttcccgcaacatgccgacctctggcagtggagcccggcgccgccgccgcagccgtgtcgatcacatatggcaccccatttgctgctcggggcgctgactttcaggccttgcctgtcggaagctcagctgctgtcgcccctcttggtttacagctaatgtgcaccgcaccacccggtgcggttcagggccattgggcgcgggaggcacccggtgcttgggattgcagcgtggaaaacggcggatgtgagcatgcctgcaacgctattccgggcgcccctcgctgtcagtgtcctgctggcgccgctctgcaagcggatgggagatcatgcaccgcttcggccacacagagttgcaatgatctctgcgaacacttttgtgtgcccaatcccgatcagccagggagctactcctgtatgtgtgagaccggttaccgtctcgcggcggaccagcacagatgtgaagatgtagatgattgcattctcgagcccagcccctgtccccagcggtgtgtgaacacgcagggtggcttcgagtgccattgctacccgaactacgacttggtggatggagagtgcgttgagcctgttgacccgtgctttcgggctaactgtgagtatcagtgtcagcccttgaatcagacttcctacctttgcgtctgcgccgagggtttcgccccaataccccacgagcctcacaggtgccaaatgttctgcaaccaaactgcatgcccagcagattgcgatcccaatacccaggctagctgcgaatgtccagaaggatacatcctggatgacggatttatatgcacagatatagatgaatgtgagaacggcgggttctgctccggagtgtgtcataatctgcccggtactttcgagtgcatttgtggccccgattctgcacttgcgcggcacatagggactgactgcgattccggtaaagtcgacgggggagactctgggtcaggcgagcctcccccaagccccactccgggcagcactctgacgccccccgccgtgggactggtacatagcggccttctaatcggaatcagcattgcgagcctgtgcctcgtcgtggctttgttagccttgctctgccacttaaggaagaagcaaggagccgcgcgcgccaagatggagtacaaatgtgctgccccaagcaaggaagtggtgctccagcacgttcggacagagcgcacaccacaacgccta

SEQ ID NO: 19930 - DNA, 1725 bp, Artificial Sequence
  Description of Artificial Sequence: Synthetic coding sequence
atgctgggcgtcttggtcctaggcgcccttgcccttgcgggcctgggctttcccgctcccgctgaaccgcagcccgggggctcacaatgcgtggaacatgattgctttgccttgtaccccggccccgctacatttctgaatgcgtcgcaaatttgcgatggccttaggggtcacctgatgacagtcagaagctccgttgccgccgatgtgatcagtcttctgctgaatggcgacgggggagtcgggcgtcgccgcctgtggattggactgcagctgccgccgggctgtggtgaccctaaacgcctggggccgctccggggcttccaatgggttactggagataataacacgagttattcccgatgggcccgcttagaccttaatggcgcccccctctgcggaccactgtgcgtcgccgtatctgccgccgaggccacggtgccctcggagcccatctgggaagagcaacagtgcgaagtgaaggctgatgggttcttatgtgaatttcattttccagccacctgtcgcccactggccgtggagccgggcgccgccgcggccgccgtctccataacttacggcaccccctttgctgcacggggcgcagattttcaggctctccccgttggaagctctgcagccgtggctccgttgggacttcagcttatgtgcaccgcaccaccaggcgcggtgcaaggccattgggcacgtgaggcaccaggcgcttgggattgcagcgttgagaatggaggctgcgaacacgcttgcaatgcaatcccgggcgccccccgctgccagtgcccggccggcgccgcattgcaggcggacggccgctcgtgtacagcgtccgctacccaatcttgcaacgacctgtgcgagcacttttgcgtgccaaacccagaccaaccgggttcttattcatgcatgtgcgaaacgggatatcgcttagctgccgatcagcaccgctgcgaggacgttgatgactgtatcctagagcccagcccgtgcccccagcgatgtgtgaatacacagggaggcttcgaatgccactgttatcccaactatgacctggtggacggcgagtgcgtggaaccggtcgacccatgttttcgggccaactgcgaataccagtgccaaccactgaaccagacctcgtatttgtgcgtttgcgccgagggattcgcccctataccccatgagccacaccgatgccaaatgttttgtaatcaaacagcttgtccagctgattgtgaccctaacactcaagccagctgcgagtgtcccgagggctacatacttgatgatggattcatctgtactgatatagacgagtgcgagaacggtgggttctgttcaggagtctgccacaatttgccgggtacctttgagtgcatttgtggaccagatagtgcgcttgctaggcacatcggaacggattgtgacagtggtaaggtggatggaggcgacagtggctcgggagagccaccgcctagtccaactccaggatctacacttactccgccagccgtcgggctcgtgcacagcggactgttgattggcatctccatcgccagcctgtgcctcgtagtagcgctgctggcgctgctctgccacctgaggaaaaagcaaggggccgcccgcgcgaagatggagtataagtgcgcagcccctagcaaagaggtggtgctgcagcacgtacgcaccgaacgcacgccccagcggctt

SEQ ID NO: 19931 - DNA, 1725 bp, Artificial Sequence
  Description of Artificial Sequence: Synthetic coding sequence
atgctcggcgtcttggtcttgggggcacttgccctggcaggcttgggctttccggcgccggcagagcctcagccgggcggatctcaatgtgttgaacatgactgctttgcactttatccgggaccggctacctttcttaatgccagtcagatctgcgacggcctgcgtggccatttgatgacggtgagaagtagcgtggcggccgacgttattagcttgctgttgaatggcgatggcggggtcggccggcgtaggctgtggattggactgcaactgcccccggggtgcggggatccgaagcgtttagggccattgcgcggctttcagtgggtcacaggcgataacaacacaagctactcgcgctgggccagacttgatctcaacggtgcgccgttatgcggacccttgtgtgttgctgtaagcgcggccgaagcaacagttccgtctgaaccgatctgggaagaacagcagtgtgaggtgaaagcagatggctttctgtgtgagtttcatttcccggctacgtgtcgtcctctcgcagttgaaccaggggccgcggccgcggcggtcagtatcacatatggaacgccttttgccgcacgcggggctgattttcaagccctcccggtcggatcttcagccgcggtcgcgcctctcggcctgcaacttatgtgtactgctcctccaggggctgtgcagggacattgggctcgagaagcgcctggggcttgggattgtagcgtcgaaaatggcggttgtgagcacgcttgcaatgctatcccaggggctccgcgatgccaatgtccggcgggtgccgcactccaggccgatgggcgctcatgtaccgcatccgctacacagagctgcaatgatttatgcgaacacttttgcgtacccaatcctgaccagccaggctcatactcatgtatgtgtgagacaggttatcgtttagcagcagatcagcaccgatgtgaagacgtagatgattgtatattggaaccttctccttgtcctcaaaggtgtgtcaatacgcagggaggcttcgagtgccattgttatccgaactatgatcttgtagatggcgagtgtgtcgagccggtggacccgtgctttcgcgcaaattgtgagtatcagtgtcaaccattgaatcaaacgtcatacctttgtgtatgcgcggaggggtttgcaccaatcccacatgaaccgcatcgctgtcaaatgttttgcaatcaaactgcgtgtccggcagactgcgatcctaacacgcaagcgtcttgtgaatgtccggaaggttatattcttgatgatggctttatttgcacagatattgatgaatgtgagaacggcggcttttgctctggtgtttgccataatttgccgggcaccttcgaatgtatttgcggaccagattcagcccttgcgagacatattggcacagactgtgatagcggaaaggtagatggcggcgattctggtagcggggaaccgccgccgagccctacaccgggttctacgctgacgccgccggcagtcggccttgtacattcggggcttttaatcggcatttcaattgcttctttatgtctggttgttgcactgctggcactcctctgccacctgcggaagaaacaaggcgccgctcgggctaaaatggaatataaatgtgcagcgccatctaaagaagtggttctgcaacatgtgcgaactgaaagaactccacagcgttta

SEQ ID NO: 19932 - DNA, 1725 bp, Artificial Sequence
  Description of Artificial Sequence: Synthetic coding sequence
atgctaggagtgctggtgttaggggcactggcactggcaggattgggctttcctgcccctgcggaaccccagcctggggggtcccagtgcgtggaacatgattgtttcgctctgtatccagggccagcaacgttcttgaatgcctcacagatttgcgacgggcttcgcggccacctgatgacagtgcgctccagcgtggccgcagacgtgatttctttactacttaacggagacgggggcgttggacgcaggcgattgtggattggtctccagctcccaccaggatgcggagaccccaaaagattggggcccctgcgcggtttccaatgggtgaccggggacaacaataccagttatagtagatgggctcgattagacctgaacggtgcccccctctgtggtcctctgtgcgtggcagtttctgctgccgaggccaccgttccgtccgagcctatttgggaagagcaacagtgcgaagtgaaggcagacggattcctgtgtgagttccactttccggcaacatgccgaccactcgcagtggaacccggcgcggccgcagccgctgtcagtattacatacggcacacctttcgcagcccggggggcggatttccaagctctgcccgtcggaagttctgctgccgtggcacccctaggccttcagctgatgtgtactgctccgccaggtgccgttcagggccactgggctagggaagcccccggagcatgggactgtagcgtagaaaacggcggctgcgaacacgcatgtaacgcaataccaggggccccgagatgccagtgtcctgcaggcgctgccctgcaggcagatggaaggtcctgtacggcaagtgcaacacagagttgcaatgacctctgtgagcacttttgcgtgccaaacccggaccagcctgggagctattcttgcatgtgtgagaccggctataggctcgccgccgatcagcatcgctgcgaagacgtggatgattgcatcctggagccgagcccgtgccctcagcgatgcgtgaatacccagggaggtttcgagtgtcactgctatcctaactacgatctggtcgacggcgaatgtgtggaacccgtggacccctgctttagggccaattgtgaataccagtgtcagccactgaaccagacctcgtatctgtgcgtttgtgccgaggggtttgcgcccatccctcacgagccacaccgctgccagatgttttgcaaccaaaccgcctgccctgccgactgcgacccaaatacccaggctagctgtgagtgtccagaggggtacatccttgatgacggatttatatgtacagacatagatgaatgtgaaaacggcggattttgcagcggcgtgtgccacaacctacccgggacttttgaatgcatttgcggtccggactccgctcttgccagacacattgggactgactgtgatagcggtaaggttgatggaggcgactctgggtctggcgagccacccccctcacctaccccgggctccaccctgactccccctgcagtcgggctggtgcatagtgggttgctgattggcatcagcattgcatctctctgtttggtggttgccctgctagccctgttgtgccatctgcgtaagaaacaaggagccgctagagcaaagatggagtataaatgcgcggcgccgtccaaggaggtcgtattgcagcatgtgcggacagaacgcacccctcagcgcctc

SEQ ID NO: 19933 - DNA, 1725 bp, Artificial Sequence
  Description of Artificial Sequence: Synthetic coding sequence
atgttgggagtcctggtcctgggtgcccttgcgctcgccggccttggtttcccggctcccgccgaaccacagccgggcgggtcccaatgtgttgaacacgattgtttcgctctgtaccccggacctgccacattcctgaatgccagccaaatctgtgatggcctgcgagggcatcttatgactgtacgctcatccgtggcagctgatgtcatttccctgttgcttaacggggacggcggtgttgggcgacggaggctgtggattggcctgcagctgcctccaggatgcggtgacccaaaaagactcggacccctccgggggttccagtgggttaccggggacaataacaccagctacagtcgatgggcaaggctggacctgaatggggcccctttgtgtggtcccctctgcgtggcagtttctgccgctgaggccacagtgcctagcgagcctatctgggaggagcagcagtgcgaagtcaaagccgatggttttctctgcgaatttcactttccagcaacgtgtcgccctctggcggtggagcccggagccgcggctgcagcagtcagcatcacctatggcaccccttttgctgccagaggcgcggatttccaagctctgcctgtgggttcttctgcggctgtcgcgcctcttggcttgcaattgatgtgcactgctccccctggcgcggtgcagggccattgggcgcgcgaggccccaggcgcttgggattgtagcgtggagaacggagggtgtgagcatgcttgcaatgccatacctggcgctccacgctgccaatgtcccgctggggccgcactgcaggccgacgggcgcagctgcaccgcctcagctacccaaagttgtaacgacctctgcgaacacttctgtgtgcctaaccctgatcagcccggctcatactcatgcatgtgtgaaacaggctaccggctggctgccgaccagcacaggtgtgaagatgtggacgattgtattcttgaaccttccccctgcccccagaggtgcgtcaatacacaaggcggttttgagtgccattgctaccctaattacgatctggtggatggcgaatgcgttgaaccggtggatccgtgctttagggctaactgtgaatatcagtgccaaccactcaaccagaccagctacctgtgcgtctgcgcggaggggttcgccccaattccccacgaacctcatcggtgtcagatgttttgtaatcaaaccgcctgccctgcagattgcgacccaaatacacaggccagctgcgagtgtccagagggctatattctcgacgacgggttcatttgcacagatatcgacgagtgcgagaatggcggattctgtagtggtgtgtgccacaacctccctggcaccttcgaatgtatctgcgggcccgactccgccctcgcaagacacatcgggactgattgtgatagcggcaaagtggacggcggcgatagtggctctggcgaaccgccaccgtcccctactcctggatccactcttactcctccagccgtgggactggtgcattctggactgcttattggcatcagtatcgcctcactttgcttggttgttgccttgttggcactcctgtgccacctgcgaaagaaacagggggcagctagggccaaaatggagtacaagtgcgccgcaccatcaaaggaggtggtcctccagcacgtcaggaccgaacgcactcctcagcggctc

SEQ ID NO: 19934 - DNA, 1725 bp, Artificial Sequence
  Description of Artificial Sequence: Synthetic coding sequence
atgctcggggtgctggtcctgggggccctggcgttagcaggcctcggatttcccgcgcccgccgagccccagcccggcgggtctcagtgcgtcgagcatgactgttttgccctttatcccggtcctgccacctttctgaatgcctcacagatttgtgatggactgcgaggccacctgatgactgtgcggtcaagcgtggcggccgacgtgatttccttgcttctgaatggggacggaggcgtcggtagaagacgactgtggattgggctacagttgccccccggttgcggagaccctaagcgtctcgggcccctcagaggctttcaatgggtgacgggagacaataatacatcttattctaggtgggcgaggttggacctcaatggtgctcctctttgtggccctctttgtgtggccgtcagtgctgccgaggctaccgttccatccgagcctatatgggaagagcaacaatgcgaagtcaaggccgacggcttcctgtgcgaatttcattttccagccacatgtcgccctctggcagtcgagcccggtgccgcggcagccgccgtcagcatcacctacggaacaccatttgccgcccgaggcgctgacttccaggcactgcctgtgggctcctcagcagccgtagcccctctgggtctgcagttgatgtgcacagctccaccaggcgccgtgcaagggcactgggccagggaggctccgggggcctgggactgtagtgttgaaaacggaggatgtgagcacgcatgcaacgccattcctggagcacctagatgtcagtgcccagccggcgcagctttgcaggcagatggccgtagctgcaccgccagcgctactcagtcgtgcaacgatctctgtgagcatttttgcgtgcctaaccctgaccagccaggatcttactcctgcatgtgtgaaactggctacaggctagcggctgatcaacacagatgtgaagatgtggacgactgcatcctggaaccctccccatgcccccagcgctgtgtgaatactcaagggggcttcgaatgtcactgctatcccaattacgacctagtggatggagagtgtgtcgaacccgtggacccatgctttcgagccaactgcgaatatcagtgtcagcccctgaaccagacttcttatctctgcgtatgtgctgaaggatttgcacctattcctcatgagccacacagatgtcaaatgttttgtaaccagactgcctgccccgctgattgtgacccaaatacacaggcatcatgtgaatgtccagaagggtacattctggacgatggtttcatctgtacagatatcgacgaatgcgaaaacggaggtttttgcagtggcgtgtgccacaacttacctgggactttcgaatgtatttgcggccctgacagtgccctggcgaggcatataggcacggactgcgactctggaaaggtggacgggggggactcgggatccggcgaacccccacctagtccgacccctggcagtactctgacgcctccagctgtgggactagtccattccggactcctgatcgggatcagcatcgccagcctgtgcctggtggtagcactgcttgcccttctctgccacctacgaaaaaaacagggcgccgcccgagccaagatggagtataagtgtgccgcgcctagcaaagaggtggtcctgcagcatgtaaggaccgagagaaccccacagcgattg

SEQ ID NO: 19935 - DNA, 1725 bp, Artificial Sequence
  Description of Artificial Sequence: Synthetic coding sequence
atgctgggggtgctcgtcctgggagcccttgcattggcgggtctgggtttccccgcacctgcagagccacagcctggagggagccaatgcgtggagcatgactgttttgcactttacccagggccagcaactttcctgaatgcatcacaaatttgcgatggattgcgcggtcatcttatgaccgtgcgaagcagcgtggcagccgatgtgatttcgctccttcttaatggagacggaggcgtgggtcgacggcggctgtggatcgggctgcagctcccaccgggatgtggcgatcctaagcgactcgggcccctgagaggattccaatgggtgactggagataacaacacttcctactcgaggtgggcaagactggaccttaacggagcccctctttgcggtcctctttgcgtggcggtgtcggccgccgaagcaaccgtgccctccgaaccgatatgggaagaacaacaatgcgaagtaaaggcagatggctttctttgcgaattccattttccggccacttgccgccccctggcagtggaacccggcgcagcggcggcagcagtctctattacgtacggtaccccgtttgcagcccgaggagcagactttcaagcgcttcctgtaggttcctccgcagcagttgcgccccttgggcttcagttgatgtgcactgcaccgccaggtgcagtgcaaggtcattgggctcgtgaagcaccgggtgcgtgggattgttcagtcgaaaacggtgggtgcgaacatgcgtgtaacgccattccaggggcacctcgttgccaatgtcctgcgggagccgcgctccaggcagacggacggtcgtgcaccgcatccgcaacccagtcttgtaatgacctttgcgaacatttttgcgtgcctaatcccgatcaacctggatcctattcctgtatgtgtgaaaccggatacagactggcagctgatcagcatcgctgtgaggatgtggatgattgtattcttgaacctagcccgtgtcctcaaaggtgcgtgaacacccaagggggatttgaatgtcactgttaccctaactacgacctcgtggatggcgaatgtgtcgaacctgtcgatccttgttttcgagcaaactgcgagtaccagtgccaacctctgaatcaaactagctacctgtgtgtgtgcgctgaaggtttcgctcctatccctcacgaacctcataggtgtcagatgttctgtaatcagaccgcttgtcctgcggactgcgacccaaacactcaggcttcgtgtgagtgtcccgagggatacattcttgacgatggctttatctgtaccgacatcgatgaatgtgagaatggcgggttttgctcgggtgtctgtcacaacctccctggtactttcgagtgtatctgcggcccagactcggcattggcgagacatatagggactgattgcgacagcggcaaagtcgacggaggtgactcgggatcaggggagccaccaccatccccgactcccggttcgaccctcaccccaccagcagtgggattggtgcatagcggtttgcttattggaatttccatcgcgtcactttgtcttgtggtggcgctgctcgcactgctttgtcacctgaggaagaagcaaggagcggctagagcgaaaatggaatacaagtgtgcggctcccagtaaagaggtcgtgcttcagcatgtcagaaccgagcgcacgccacaacgactg

SEQ ID NO: 19936 - DNA, 1725 bp, Artificial Sequence
  Description of Artificial Sequence: Synthetic coding sequence
atgctgggagtgctggtgctgggagcactggcgctggctggactgggcttcccagcgccggctgagcctcagccgggaggttcgcaatgcgtggaacacgactgctttgcgctctacccgggacctgcaacctttctgaacgccagccaaatctgtgatggcttgcggggccacctgatgactgttagatccagcgtcgcggcggatgtcatatcgctccttctcaacggagacggaggagtagggcgacgccgactctggatcgggttgcaactcccgccgggctgtggtgacccgaagcgcctgggacctctccggggctttcaatgggtgaccggagacaacaatacgtcgtactcgagatgggcccggctggatctgaatggcgctccactgtgtgggcctctctgcgtggcagtctcggcggctgaggcaaccgtgccatccgaaccaatctgggaggagcagcagtgcgaggtcaaggccgatgggtttctttgtgaattccacttcccggccacttgtcggccactggcggtagagcccggcgcggcagcggcggctgtgtcgatcacgtacggaactccgtttgcagccaggggcgccgacttccaagctctgcctgtgggctctagcgcggcggtggcccccttgggtttgcagctcatgtgcacggcgccgccaggtgccgtgcaagggcactgggcccgggaggcgccaggagcctgggactgtagcgttgagaatggaggctgcgaacatgcttgcaacgcaatccccggagcccctcggtgccagtgcccagcaggcgcggccttgcaagcagacggaaggtcatgtaccgcgtcggctacccagtcctgcaacgacctgtgcgaacacttctgcgtgccaaacccggaccagccaggctcctactcctgcatgtgtgaaaccggataccgcttggctgcagatcagcaccgctgcgaagatgtcgatgactgcatcctcgaaccgagcccgtgcccgcaacgctgtgttaatactcagggaggcttcgaatgtcactgttaccctaactacgatctggtggacggagaatgcgtcgaacccgtggacccgtgtttccgggccaactgcgagtaccagtgtcagcctctgaatcaaacttcctatctgtgtgtgtgcgcagaaggtttcgccccgatcccccacgaaccgcatagatgccagatgttctgcaatcagactgcatgtccggcagactgcgaccctaacacccaggcctcctgcgagtgccctgagggctacatccttgatgatggattcatctgcactgatattgacgaatgcgagaacggagggttctgctcaggagtgtgccacaacttgccaggaactttcgagtgcatctgcggacctgattctgcgctcgcgcgccatatcggtacggattgcgactcaggaaaagttgacggtggagactcaggatccggggaaccgcccccgtctccaaccccgggttcgaccctcactcctcccgctgtggggttggtgcatagcggcctgcttattggaatcagcatcgcctcattgtgccttgtggtcgctctgctcgctctgctctgccatctcaggaaaaagcagggagcagccagagccaagatggaatacaagtgcgccgccccgtcgaaggaggtggtactgcaacatgtgcgcacggaacgtaccccccagcggttg

SEQ ID NO: 19937 - DNA, 1725 bp, Artificial Sequence
  Description of Artificial Sequence: Synthetic coding sequence
atgctaggggtgctggttttgggcgcgttggcattggccggtctgggcttcccggctccggcagagcctcaaccgggaggatctcaatgcgtggagcacgactgtttcgcgttgtatcctggccctgcaacattcctgaacgcgagccaaatctgcgatggtctgcgcggacacctcatgaccgttcgctcttccgttgcggcagatgtgattagcctgctgttaaacggtgatggtggcgtcggccgccgccgactgtggatcgggttgcagctgccaccaggttgtggggacccaaaacgccttggtccgctaagaggctttcaatgggtgacgggcgataacaacacaagctacagccgctgggcgcgcctggatctcaatggtgctccgctgtgtggcccattgtgtgtggcagtctctgctgctgaggctactgttccgagcgaacctatttgggaagaacagcaatgcgaagttaaagcagacggctttttgtgcgagttccacttccctgccacgtgtagaccgttggccgttgagccaggggccgcagccgcggctgtgtctatcacttacggcacccctttcgctgcacggggcgccgactttcaggctctgccagtgggttccagcgcagcagttgcgccactgggtctgcagttgatgtgtaccgcacctccaggtgccgtgcaaggccattgggcgagggaggcaccgggtgcatgggattgctctgtcgaaaacggaggatgtgagcacgcctgcaacgcaatcccaggcgcccctaggtgccaatgccctgcgggtgccgcgctgcaggcggatggtcgatcatgcacagccagcgcaacacagagctgtaatgatctctgcgagcacttctgcgtgcccaaccctgatcaacctggctcatactcatgcatgtgtgagaccggctatcgcttggcggctgaccagcatcgttgcgaagatgtggacgactgcatcctggaaccttcgccgtgcccgcaacgctgcgtcaatacccagggtgggttcgaatgtcattgctatcctaattacgacctggtggacggcgaatgtgtggagcctgtcgatccttgttttcgtgcgaattgcgagtaccagtgccaacccctgaatcagaccagctacctgtgtgtctgcgccgagggttttgcgcctattccacatgagccacacaggtgccagatgttttgcaaccagaccgcatgcccggccgactgcgatccaaacactcaggcaagttgtgagtgcccggaaggttacatcttggacgatggctttatctgtaccgatatagatgagtgtgagaatggtgggttctgcagcggagtttgtcataacctgccaggtacttttgaatgtatttgtggtccagacagcgcactggcccgccacatcggaaccgattgtgatagcggtaaggtcgacggtggtgatagcggctccggggaaccaccaccaagccctaccccgggttctaccctcaccccaccggccgtcggactggttcatagcggtctgctcatcggcatctctatcgctagcctctgtctggttgtggccctgctagcattgttgtgtcacctgaggaagaagcagggcgcggcccgcgccaaaatggaatataaatgcgcagcaccgagcaaagaggttgttttgcagcacgttagaacagagcggacgccacagagactg

SEQ ID NO: 19938 - DNA, 1725 bp, Artificial Sequence
  Description of Artificial Sequence: Synthetic coding sequence
atgttgggcgttttggttcttggtgcacttgccctcgctggcctaggatttcctgcacccgctgaaccacaacctgggggatcgcagtgtgttgaacacgactgctttgccctctaccctgggcctgctacatttttgaacgcttcacagatttgcgatggacttagaggacaccttatgactgttcgcagcagtgttgcagctgatgttatttctcttcttttgaacggggatggtggcgtcggtagaagaagactgtggatcggtttgcagctgccaccaggatgtggtgatccgaagaggctcggtcccctccgtggctttcaatgggttacaggagataacaacacctcttacagtcgttgggcaagactagatctgaatggggcaccactatgcggaccactctgtgtcgctgtctctgctgctgaagctactgttccctcggaacccatctgggaggaacagcagtgtgaggtcaaggcagatggattcctctgtgaatttcactttcctgctacatgtagacctctggcagttgagccaggggctgctgccgctgcagtttcaattacatatgggacaccttttgctgctagaggcgcagacttccaagctttgcctgtgggtagcagtgcggctgttgcaccattgggcctgcaacttatgtgtaccgctccgcccggcgccgtacaggggcattgggcccgtgaggctcctggtgcttgggattgttcagtggagaatggtggatgtgaacatgcttgcaacgcgattcccggtgccccacgttgccagtgtccagctggagctgcacttcaagccgatggacgaagctgtaccgcgtccgcaactcaatcatgtaacgacctttgtgagcatttttgtgttcccaatcccgaccagccagggtcttatagttgcatgtgcgaaacaggttaccgtctggctgctgatcagcacaggtgcgaggatgtggacgactgtatcttggagccttccccgtgcccacaacgatgtgtaaatacacaagggggcttcgagtgtcactgctacccaaactacgacttggttgatggagaatgcgttgaaccagttgatccatgtttcagagcaaactgtgagtatcaatgtcagccgctcaaccagactagctatctctgtgtatgtgcagaggggttcgctccaattcctcatgaacctcaccggtgccaaatgttttgcaatcagacggcttgtccagctgattgtgatcctaatacacaggcgtcttgcgaatgtccggagggatatatattggacgatggattcatttgtacagatattgatgaatgtgagaatggaggcttttgcagcggcgtgtgtcataatctgccaggtaccttcgaatgcatatgcggtcctgactcggcgcttgctcgtcatattggcactgattgtgactctggtaaggtggatgggggtgactctgggtcaggagagcctcctccttcgcctacgccgggatccacattaacaccacccgctgttggcctcgttcattccggacttctgattggtatttctatcgcctccttgtgcctcgtggttgctcttttggctcttctttgccatcttaggaagaagcagggcgcagcaagagctaaaatggagtataaatgtgctgcccctagtaaggaggtagtgctacagcatgtccgaaccgagaggactcctcaaaggctg

SEQ ID NO: 19939 - DNA, 1725 bp, Artificial Sequence
  Description of Artificial Sequence: Synthetic coding sequence
atgttgggagtgctggtcctgggggctctggcacttgcaggactgggattccctgcaccggccgaaccgcagccgggaggatcccaatgtgtggaacatgactgcttcgcactttacccgggcccagccaccttcttgaacgctagccaaatctgtgatggactccggggccatctgatgaccgtcagatcatccgtggccgccgacgttattagcctccttttgaatggagacggcggggtgggtagacgcagactgtggatcggactgcagcttcctccgggatgcggtgatccaaagaggctgggcccactgcgcggattccaatgggtgactggagacaacaatactagctactccaggtgggctaggctggacctcaatggagccccgctgtgcggcccactgtgcgtggccgtgtcagcggccgaagcgacggtccctagcgagccgatctgggaggagcagcagtgcgaagtgaaggcggacggattcctctgcgaattccattttccggccacttgccggccgctggcagtggagccaggagccgcggccgcagcggtgtcgatcacgtacggaactccgttcgccgcccgcggagctgactttcaggccctcccggtcggatcaagcgccgctgtggccccgctcggactccagttgatgtgcaccgccccgcctggcgcggtgcagggacactgggcccgcgaagcgccaggtgcatgggactgctccgtggaaaacggcggctgcgagcatgcctgtaacgccattccgggagcgcctcgctgccaatgccccgccggagccgccctgcaagcggatggtcggtcctgcaccgcctccgccacccagtcgtgtaacgatctgtgcgaacacttctgcgtcccgaaccctgaccagcccggatcctacagctgtatgtgtgagactggatacagactggcggccgaccagcataggtgcgaggacgtggatgattgcatcctggagccctctccttgtcctcaaagatgcgtgaacacgcaagggggattcgaatgccactgttacccgaactacgacctcgtggacggggagtgcgtggagccggtcgacccttgcttccgggcgaactgcgagtaccagtgccagccgctgaaccaaactagctatctgtgcgtctgcgccgaaggattcgctccgatcccgcacgagccacatcggtgccagatgttctgcaaccaaaccgcgtgtccggccgattgtgacccaaatactcaggcgtcttgcgaatgccccgaaggttacatcctggacgacgggttcatttgcactgacattgatgaatgcgaaaacggagggttctgcagcggagtgtgtcacaatttgcctgggaccttcgaatgcatctgcggacctgatagcgccctggctcggcacattggaactgattgtgactcaggaaaggtggatggaggagactcaggatccggagaaccgcccccatcaccgacccctggatccaccctgactcccccagctgtcggtctggtgcactcgggactcctgatcggaatctcgatcgcaagcctttgcctggtggtcgcactcctggcactcctgtgccacttgaggaagaaacagggagctgcccgcgccaaaatggaatacaagtgtgcggccccgtccaaggaagttgtgctgcaacacgtgcggaccgagcggactccgcaaaggctt

SEQ ID NO: 19940 - DNA, 1725 bp, Artificial Sequence
  Description of Artificial Sequence: Synthetic coding sequence
atgttgggagtgttggtgcttggagcactggcactcgcagggttaggattccctgctcccgcagaacctcagcccggagggtctcagtgtgttgaacatgattgtttcgccctgtacccagggcctgccacattcctcaacgcttctcagatctgtgatggactccgaggacacctaatgacagtgcggagttccgttgctgcagatgtgatttcccttctcctcaacggagacggaggagtgggacgtaggaggctttggataggactccagctccctcctgggtgtggggatcctaagcgactggggcctctgagggggttccagtgggtaactggagataacaatactagttattctagatgggctcgactagatctaaatggagccccactatgtgggcccttatgtgtggccgtatcagccgcggaagcaacagtaccttcagaacccatatgggaagaacagcagtgtgaagtgaaggcagatggattcctgtgtgagtttcacttccccgccacttgcaggcctcttgccgtagaaccaggggcagctgcagcagcagtctctatcacttatgggactcccttcgccgcacggggagctgatttccaggcgctccccgtgggaagtagtgcagctgtagcccctctagggcttcagttaatgtgtacagcacctcctggagcggtgcagggacactgggcaagagaagcgcctggggcttgggattgtagtgtggaaaacggggggtgcgaacacgcatgtaatgcaatccccggggcaccaaggtgtcagtgcccagccggagctgctctgcaggctgatggacggtcctgcacagcatctgccacacagtcctgtaacgatctgtgcgaacatttctgcgtgcctaaccctgatcagcctggatcttatagttgtatgtgtgaaacgggatatcgcctcgctgccgatcagcatagatgcgaagatgtcgatgattgcatactcgaacccagtccatgtccacagcggtgtgtgaacacacagggagggttcgagtgccattgctatcccaactacgatctagtggatggggagtgcgtggaacccgtagatccatgctttagggcaaattgcgaataccagtgccagccactcaaccagacttcctatctctgtgtttgcgcagaagggttcgcgcctataccacatgaaccgcatcggtgccagatgttctgtaaccagacagcctgccctgccgattgcgatcccaatacacaggcctcatgcgagtgtccagaaggatatatcctggatgatggattcatctgcacagatatcgatgaatgcgaaaatggagggttttgttccggggtctgtcataacttacctgggacatttgagtgtatttgtggaccagactccgctctggctaggcacatcggaactgattgtgattctggaaaagtggatgggggggattccgggtcaggagaaccaccccctagtcccactcccggaagtactctcacacctcccgccgtaggactcgtgcattccgggctcctcataggaatatcaatcgcctctctatgtctcgtggtggctctacttgcccttctgtgccacctgcgaaaaaaacagggggctgccagagccaaaatggagtataagtgtgctgccccatctaaagaagttgtattgcagcatgtcaggacagaacgaacaccacagcgtctc

SEQ ID NO: 19941 - DNA, 1725 bp, Artificial Sequence
  Description of Artificial Sequence: Synthetic coding sequence
atgctgggtgtgctggtgctgggtgcactggcgctcgctggactgggcttccccgctccagctgagccccaaccaggcgggtctcagtgcgtcgaacacgactgctttgctctgtatcctggtcccgctacatttttgaacgcctctcagatctgtgatggcctgcggggtcatttaatgacagttcgctcgtccgtcgcagcggatgttatatccttgctgcttaacggcgacggaggcgtaggcaggcgacgcctctggatagggctgcaactcccgccgggttgcggagatccaaagcggctcggtcccctgcgagggtttcagtgggttactggagataacaacacgagttactcccgctgggctcggctcgacctgaatggggcacccctgtgcgggcctctgtgcgtcgctgtcagtgcagccgaggctacagttcctagcgaacccatttgggaggagcaacagtgtgaggtgaaagccgacggctttctgtgtgaatttcacttccccgctacttgccgaccattagctgtggaacctggtgcggccgccgccgccgtgagtattacttatgggactccgtttgcggcgaggggagcggattttcaggctctccccgtcggctcctctgctgccgttgcacccctgggtctgcagctgatgtgcacagccccccctggagctgtacagggacactgggctcgtgaggccccgggtgcctgggactgtagcgttgagaatggaggctgcgaacacgcttgcaacgccatccctggcgcgccacggtgccagtgccccgcaggggccgcattgcaggcagacggtaggagttgtactgccagtgcaacccaatcctgcaatgatttatgcgaacacttttgcgtaccaaaccccgaccagcccggatcttactcatgtatgtgtgaaacgggctatcgcttagcagctgaccagcatcgctgtgaggatgtcgacgactgcatcctggagccgtcaccctgcccccagagatgcgttaatacacagggcggcttcgagtgccactgttatcctaactacgacctggtggatggcgaatgtgtagaaccagtggatccctgcttccgtgccaactgtgaataccagtgccaacctctgaaccagacatcttatctgtgtgtgtgtgctgaaggttttgctccaattccccacgaaccacataggtgccagatgttttgtaatcagaccgcttgtccagccgactgcgatcctaacacgcaggcttcgtgcgagtgccccgaagggtatattctggacgatggctttatttgcactgacatcgatgagtgcgagaacggcggattctgcagcggagtgtgtcacaatttacctggcaccttcgagtgtatctgtgggcccgactccgcattagccagacacataggaaccgactgtgacagtggaaaggtagatgggggtgactccgggtcaggagaaccgccaccgtcaccaacgcccggtagcactctgacaccccccgccgtgggactggtgcattccgggctgctgatcggaatctccatagcgagcctttgccttgtggtagccttgctggcactattgtgccacctgcggaaaaaacagggagcggcccgagccaaaatggaatacaagtgtgcggcgccttctaaagaggtggtgttacagcatgtaaggaccgagagaacacctcagcgactc

SEQ ID NO: 19942 - DNA, 1725 bp, Artificial Sequence
  Description of Artificial Sequence: Synthetic coding sequence
atgctaggcgtgctcgtccttggcgccctggccctcgcaggcctggggttccccgctcccgccgagccccaacctggtgggtctcaatgcgtggagcatgattgtttcgccctctatcctggccctgctacttttctgaacgcaagccagatctgcgatggtctacggggacacttgatgacagttcgcagctccgtggctgcagacgtgatttctctcttgctgaacggggatggaggggtgggcaggcggcggctgtggatcggactacaattgcctccgggttgtggggatcctaaacggttaggccctttgagggggttccagtgggtcactggcgataacaacacctcgtactctcggtgggcccgccttgatctgaatggcgcaccattgtgtggccccttatgcgtggcagtctctgctgcagaggcaacagtcccaagcgagcccatatgggaagagcagcagtgcgaagtcaaagcggacgggttcctctgcgaatttcattttccagctacctgccgtcccctggccgtcgaacctggagcagctgcagcggctgtgtccattacttatggcacccccttcgcggccaggggagccgattttcaggccttgcccgttggaagctccgctgccgtggctccattggggcttcagctcatgtgcacagcgcctcctggcgcggtccaaggtcattgggcacgggaagcccctggcgcgtgggattgttcagttgaaaacggcggttgcgagcacgcttgcaacgccattccaggggcccctcgctgtcagtgccctgccggggccgccctccaagctgatgggagatcctgcaccgcctctgcaactcagtcatgtaatgatttatgtgagcacttttgcgttccgaaccctgaccagcccgggtcatactcttgcatgtgtgagacaggttatcggctagctgcagatcagcacaggtgcgaggacgtagacgattgcatactggagcccagcccctgcccccagaggtgcgtcaatacacaggggggcttcgagtgccattgctaccccaactacgacctcgtcgacggcgagtgcgtggagcccgttgacccatgctttcgggcgaactgtgagtatcaatgccagccccttaatcagacctcctatctgtgcgtgtgtgccgagggcttcgcgccgataccccatgagccccatcggtgccagatgttctgcaaccagactgcctgtccggccgactgcgatccaaatactcaagcctcctgtgagtgccccgaaggctatatactagacgacggttttatttgcacggatatcgatgaatgtgaaaacggtggcttctgttcaggcgtctgccacaacctgcctggaaccttcgagtgtatttgtgggcccgattccgctctggctaggcatattggaactgactgcgacagcggcaaagtggacggcggagattctggctcgggcgaacccccaccgtctccaacgccaggcagcactctaaccccacccgccgttggcctcgtgcactctggcttgttgataggaatttccattgctagtctgtgtctggtcgtggccttgcttgcgctcctctgtcatctgagaaagaaacagggagcggcccgtgccaagatggaatataaatgcgcggcgccatcaaaggaagtggtactgcagcatgtgcgcactgaacgaacaccccagaggctg

SEQ ID NO: 19943 - DNA, 1725 bp, Artificial Sequence
  Description of Artificial Sequence: Synthetic coding sequence
atgctcggggtactggtgctgggtgctcttgccttggctggcttgggcttcccggcccctgcggaaccacagccaggcggctcccagtgcgttgagcacgattgcttcgccctttatccaggccctgccaccttcctgaacgcgtcgcagatttgcgatggtctgcggggccaccttatgactgtgcgctcgtctgtcgccgctgatgtgatctccctgctcctcaacggcgacggtggcgtgggtcgccggcgtctgtggatcggacttcagctacccccaggttgcggcgatcctaaacgtttgggtcccctccgcggcttccagtgggtcaccggcgataacaacacctcttacagccgctgggctcggctcgacctcaacggagctcccttgtgcggccccctctgcgtcgccgtgtccgctgccgaggccaccgtcccttccgagccaatttgggaggagcaacagtgcgaggtcaaggctgatgggtttttgtgcgagttccatttccccgctacctgccgcccactggctgttgagcccggtgcggccgcggccgctgtcagtattacttacggaactcccttcgctgctcggggcgccgacttccaggccttgccggtcgggtccagtgcggctgtggctcccttgggactgcagctgatgtgtacagccccacccggcgccgtgcagggtcattgggcccgggaggctcctggagcttgggactgctccgtcgagaatggcggttgcgagcatgcctgcaacgccatccccggtgctccgcgctgccagtgcccagctggcgctgctctgcaagctgacggtcgatcatgcacagcgtctgccacccagtcctgcaacgatctctgcgagcatttctgcgttcccaaccccgaccaacctggcagctatagttgcatgtgcgaaacgggctaccggcttgccgccgaccagcaccgctgtgaggatgtggacgattgtatcctagaacccagcccctgcccgcagcgttgtgtcaacacccagggaggatttgagtgtcactgctacccgaactatgacctcgtcgatggcgagtgtgttgagcctgtcgatccctgcttccgtgcgaattgtgaataccagtgtcagcccctgaatcaaacttcttacctctgtgtgtgtgctgagggctttgcccctattcctcacgagccccaccgctgccagatgttctgcaaccagaccgcttgcccagccgactgcgaccctaacacccaggcatcgtgtgagtgccctgagggctacatcttggatgacggctttatttgcaccgacatcgacgagtgcgagaacggtggcttctgtagtggtgtatgtcacaatctccccggtactttcgagtgcatctgcggccccgactccgccctcgccagacatatcggaaccgattgcgattctgggaaggttgatgggggcgattccgggtccggagagccgcctccaagtcctactcccgggtctactttgactcctcccgcagtgggccttgtccacagtggtttgcttatcgggattagcatcgcatctctctgccttgtggtggcccttttggccctactttgccacttgcgtaagaaacagggagccgcccgcgcaaagatggaatacaagtgcgccgccccctccaaggaggtcgtcctccagcacgtgcggaccgaacgtaccccgcagcgtctc

SEQ ID NO: 19944 - DNA, 1725 bp, Artificial Sequence; identical to SEQ ID NO: 19891
  Description of Artificial Sequence: Synthetic coding sequence

SEQ ID NO: 19945 - DNA, 1725 bp, Artificial Sequence
  Description of Artificial Sequence: Synthetic coding sequence
atgcttggtgttctcgtgctgggggctttggcactggcaggccttggatttccagccccagcagagccacagcccggcggatcacaatgtgtcgaacatgattgctttgccttgtacccagggcctgcgactttcctgaacgcatcacaaatatgcgacggcctgcgtggacatttgatgactgtgagatcatccgtggccgccgacgtcatctctcttctccttaatggtgacggtggcgttggccgccgaaggctgtggattggcctgcagttgcccccggggtgtggggatcctaagagactgggaccactgcgcggattccaatgggtgaccggtgacaataacacctcgtactctcgctgggcaaggttggatcttaacggagcaccactttgtggacccctgtgtgtcgcagtctcggccgcggaagctactgtgccgtcggagcctatttgggaagaacagcaatgtgaggtgaaagcagacggattcctttgcgaattccacttcccagccacctgccgccccctggcagtcgaacccggcgcagcagcagctgcagtgtccataacttatggcaccccttttgcggccagaggggcagactttcaagcgctgcctgtcggatcatcggctgcagtcgcaccacttggactgcaactgatgtgtacggcgccccccggtgcggtgcaaggtcactgggcaagggaggcacctggagcatgggactgtagcgtggagaatggcgggtgtgaacatgcatgcaatgccatcccaggggcccccagatgccagtgcccagccggtgctgctctccaagctgatggacgctcctgcacggcttctgcaacccagagctgtaacgacctgtgcgagcacttttgtgtgcctaacccagatcagcctggcagctactcctgcatgtgtgaaaccggctaccgcctcgcagcagatcagcatcgttgtgaggatgtggatgattgtattctcgaaccttccccgtgtcctcagagatgcgtgaacacgcagggaggatttgaatgccactgctaccctaactatgatctggtggatggagagtgcgtcgaaccggtggatccgtgtttcagagcaaactgtgaataccaatgtcaacctctcaatcaaacctcatacctctgtgtttgtgccgaaggattcgcacccatcccgcatgaacctcatagatgtcaaatgttttgtaaccagactgcgtgccctgctgattgtgatcctaacacgcaagcatcttgtgagtgtccggaaggctacattcttgacgacggctttatctgcactgacatcgatgaatgtgaaaacggaggattttgttcgggtgtgtgtcacaatcttcctggaacctttgaatgtatttgtggtccagactcagcacttgcgcggcacattggaaccgattgtgattcggggaaggtggatgggggagactctggttccggtgagccgccaccgagccctactccaggtagcactctgacgccacctgccgtgggcttggtgcatagcggacttctcattgggatatcaattgcatccctgtgcctcgtcgtggcactcctggctctgctttgccatctgcgcaagaagcaaggggcagcccgggcgaagatggagtacaaatgtgccgccccttccaaggaagtggtgcttcagcatgtgcggactgagcgaactccccagcgtttg

SEQ ID NO: 19946 - DNA, 1725 bp, Artificial Sequence
  Description of Artificial Sequence: Synthetic coding sequence
atgttgggggtcttagtgcttggcgctttagctcttgccggcctgggatttccagcacccgcggaaccgcagccgggaggttcacagtgcgtcgagcatgattgcttcgctctataccccggtccggccactttcttgaatgcttctcagatctgtgacgggctcagaggacatctgatgacggtccgatcgtcagtcgcggctgacgtaatttctctgcttctcaacggcgacggcggcgtgggacgtcgccgactatggattggcctacagcttccgccggggtgcggtgatcctaagcgactaggccccctgcgcggattccagtgggtgacgggagacaacaacacgagctattctcgctgggccaggctcgatctgaatggggcccctctttgcggaccactctgcgtggccgtgtctgctgccgaggcaaccgttccttccgaacctatttgggaggagcaacagtgtgaggtcaaggcggatggttttctgtgtgagtttcatttccccgcgacctgtcgacctctcgcggtcgagcccggggctgccgcagctgccgtgtccattacatatgggacaccttttgccgcccggggggcggactttcaagcactgccggtcggctcgagcgctgctgtcgctcccctgggactacaactcatgtgcacagctcctccgggggccgtgcagggacactgggcacgagaagctcccggcgcctgggattgttcagtcgagaacggaggctgcgagcatgcctgtaacgccatccctggtgcaccacggtgccagtgtccagccggtgcggccctgcaagcagacggtcgatcttgcacagcgagcgccacccagagctgcaatgatttgtgtgaacacttttgcgtacctaacccagatcaacccggaagctacagctgcatgtgcgagacgggatacaggttggcagcagatcagcatcgatgcgaagatgtcgatgattgcattctggaaccgagtccgtgtccacaacgatgtgtcaacactcaggggggctttgagtgtcattgttatccaaactacgatcttgtcgacggggaatgcgtcgaaccagttgacccctgtttcagggctaactgcgagtaccagtgtcagccgttgaatcagacttcttatctttgcgtttgtgccgaaggcttcgctccaatcccgcatgagcctcacagatgccagatgttctgtaaccaaacagcttgcccagcggactgcgatcccaatacgcaagcgtcatgtgaatgccctgagggatacattctcgatgacggattcatttgcaccgatatcgacgaatgcgaaaatggcggtttttgctcaggcgtctgccataatctaccaggtacgttcgaatgcatttgcggcccagattcagcgttagctcgacacatcgggacagattgcgattcgggaaaggttgatgggggagacagcggtagtggcgaacctccgccctcaccaactccaggaagcaccctgacacctcctgccgttggcctggttcactcgggccttctcatcggtatctcaatcgccagcctttgcctggttgtcgctctattggccctcttgtgccatcttcgaaagaaacaaggcgctgcaagggctaagatggagtacaaatgtgctgcaccgagcaaggaagtcgtcctacagcacgtacgcaccgaacgcactccgcagcgcctc

SEQ ID NO: 19947 - DNA, 1725 bp, Artificial Sequence
  Description of Artificial Sequence: Synthetic coding sequence
atgctgggagtgctggtgcttggagccttagcgctagctggactgggcttcccggcccctgcggagccgcagcctggtggatctcagtgtgttgagcatgattgcttcgccttataccctggacctgccacctttctcaacgccagccagatttgtgacggcctcagggggcacttgatgactgtgcggtcctcagttgctgcagacgtcatttccttactgctcaacggggatggtggcgtgggccgacgccgactgtggattgggttacagttgccccctggctgcggtgatcctaaaagactgggccctctgcgtggttttcagtgggtgacaggggacaacaacacttcctacagccgctgggcccgattggatttgaatggagcacccctttgtggccctctctgcgtcgctgtgagcgccgctgaggcgactgtgccgagtgaaccgatctgggaagaacaacagtgcgaggttaaagctgatggctttctgtgtgaattccattttcccgccacgtgtcgtcctttggccgtggaacccggtgccgccgccgcggccgtgagcatcacttatggaacccccttcgctgcaagaggagccgacttccaggctctcccagtggggagcagcgccgctgtggcaccactcggattgcaattaatgtgtaccgctcctccaggggccgtgcagggacactgggcgcgagaagctcctggggcctgggattgttccgttgaaaacggaggatgtgagcacgcatgtaatgcaatacccggggcaccccggtgtcaatgccctgctggagcagccctacaggccgacggcaggagttgcacagcgtcggctactcaaagctgcaatgatttgtgtgaacatttctgtgtgcccaatcctgatcagccggggtcctattcgtgcatgtgcgagacgggttacagacttgccgcggaccagcaccgttgtgaggatgtggatgattgtatactcgagccatctccatgcccacagcgctgcgtcaacacacaaggtggattcgagtgccactgttaccccaactatgacctcgtggacggggagtgtgtggagccagtggacccctgtttccgggcgaactgtgagtatcagtgccagcccttaaaccaaacctcatatctttgcgtctgtgctgaaggatttgcccccattccacatgaacctcataggtgccagatgttttgcaatcaaactgcctgcccagctgattgtgaccccaacacccaggcgtcgtgtgaatgtccagagggttatattctggacgatggctttatctgcacagacatagacgagtgtgagaacggtgggttctgcagcggagtgtgtcataatttgccaggcacatttgagtgtatttgcgggcccgactctgccttggctaggcatatcgggacggattgtgatagcggtaaagtcgacggtggcgatagtggctccggggagcctcctccctcaccaaccccaggaagcaccctgaccccccctgctgtaggtctggtgcacagcgggctgttgattggtatcagcatcgcaagcctctgtctggtggtcgccctgctggcactgctctgtcacctccgtaaaaaacagggggccgcacgggctaaaatggaatacaagtgtgcggcgccatcaaaggaggttgtgctgcagcacgtaaggaccgagcggacccctcaacgattg

SEQ ID NO: 19948 - DNA, 1725 bp, Artificial Sequence
  Description of Artificial Sequence: Synthetic coding sequence
atgcttggagtgctggtgcttggagcccttgcacttgccggactcggatttcctgcacccgcagaacctcagccgggcggatcccagtgcgtggaacatgattgctttgcactttaccctggaccggcgactttcttgaatgcatcacaaatctgtgacgggcttcgcggccaccttatgaccgtccgttcctccgtggccgctgacgtcattagcctgctgcttaatggagacggcggtgtcggacgtagacgactctggattgggcttcagctgcccccgggatgtggggaccctaagagattgggccctctccgtggttttcagtgggtaaccggtgataacaatacttcctattcccggtgggcaagactggatcttaacggggcccctctgtgcgggcctctttgtgtggccgtgagcgcagccgaggcaacggtgccttctgaacccatatgggaagaacaacagtgcgaggtcaaggccgatggatttttgtgcgagtttcattttcctgcaacgtgtaggcccctggcggtggaacccggggcagcagcggccgcagtctcgattacctacggaactcctttcgctgcgaggggagcagattttcaagccctgccagtggggtcctcggcagcagttgccccgctcggactgcaattgatgtgtactgctccgccgggcgcagtgcaaggacattgggcacgggaagcaccaggtgcgtgggattgtagcgtcgagaatggcggctgtgagcatgcatgtaacgcaataccaggagccccccgctgccaatgccctgcgggagcggcacttcaagcggacggaagaagctgcactgcaagcgctactcaatcatgtaacgatctgtgtgaacacttttgtgtgccaaaccctgaccagccggggagctactcctgcatgtgcgaaacgggctacagacttgcagcagatcaacatagatgtgaagatgttgatgattgtattctggagccgtcgccttgtccacagcgttgtgtgaatacccaaggtggatttgaatgccattgttaccctaattacgaccttgtggatggcgaatgtgtggaaccggtggatccttgcttccgagcaaactgtgagtaccagtgtcaacctctcaaccagactagctacctgtgcgtgtgtgccgagggattcgcacctattccacacgaaccccacaggtgccaaatgttctgtaaccagactgcttgtcctgctgattgcgatcctaacacccaagcatcatgtgaatgcccagagggctatatcctggacgatgggttcatatgtaccgacatagatgaatgtgagaacggtgggttttgctcaggcgtgtgtcataaccttcccggaactttcgaatgtatttgtggcccggattccgcactcgcgagacatattggaaccgattgtgactctgggaaggtggatggaggcgactcgggatcgggtgaacctccaccatcgcctacccccggatcaacccttactccacccgcggtggggctggtgcactcaggactgctcattggcatctccattgcatccctctgtcttgtagtggcacttttggccttgctctgtcacttgcgcaaaaaacagggggctgccagggctaagatggaatacaaatgtgctgcgccctcgaaggaggtggtccttcaacatgtgcggaccgagagaacccctcaacgcctc

SEQ ID NO: 19949 - DNA, 1725 bp, Artificial Sequence
  Description of Artificial Sequence: Synthetic coding sequence
atgttgggagtcctcgtgctgggagcgcttgctctggcgggactggggtttccagcccccgccgaaccgcagccaggaggttcgcaatgcgtggaacacgactgttttgccctctaccctggcccagccactttcctcaatgcgtcgcaaatctgtgacgggttgaggggacacctgatgactgtgagatcctctgtggccgcagacgtgatctcactgctgctgaatggagatggaggtgtcgggagacggcggctgtggatcggacttcaactgccgccagggtgtggcgacccaaagcgccttggaccgctcagaggatttcaatgggtcaccggagataacaatacgtcttactctcggtgggcgcgactcgacctcaacggcgcaccgttgtgcggaccgctctgtgtggccgtgtcggcggccgaagccaccgtgccgagcgagcccatttgggaggagcagcagtgcgaagttaaggcagacggctttctgtgtgaattccattttcccgcaacctgtcgcccgctggctgtggaaccgggtgccgctgcggccgccgtcagcatcacttatgggaccccattcgccgctcgcggagcggatttccaagccttgcctgttggcagctccgcggcggttgctccactgggactgcagctcatgtgcaccgccccgcctggtgcggttcaaggccactgggcccgcgaagccccaggggcttgggactgctccgtggaaaatggtgggtgtgagcacgcgtgcaacgcaatccccggagcgccgcgctgccagtgccccgctggagctgcgctgcaagcggatgggcggtcgtgtacggcttcagctacccaaagctgtaacgacctctgtgaacatttctgcgtccccaacccggatcagccgggtagctactcctgtatgtgcgaaactggataccggctggccgcggaccagcatcgctgcgaggatgtggatgattgtatcctggaaccatcgccgtgcccccagaggtgtgtcaacactcaaggtggcttcgaatgccactgctaccctaactatgacctggtggatggagagtgcgtggaaccagtggacccttgtttccgtgccaattgtgaataccaatgccaaccgctgaaccaaacctcatatctctgcgtctgcgcagagggtttcgcccccatcccgcacgagccgcatcggtgtcagatgttctgcaaccagaccgcctgccccgcagattgtgacccgaacacccaggcctcatgcgagtgcccggagggatacatactcgacgacggattcatctgcactgacattgatgagtgcgagaacggcggcttctgctccggagtgtgccacaatctccctgggactttcgagtgcatctgcggacctgattcggcgttggcgcgccatatcggtaccgactgcgactccgggaaggtcgatggaggcgattcaggctcgggagagcctccgccatcgccaaccccgggttcgactctgactccgcccgctgtgggactcgtccactcgggactgctcatcggaatctccattgcctctctctgcctggtggtggctctgcttgcgctcctgtgccatctgagaaaaaagcagggagccgcaagagccaagatggagtacaagtgcgccgccccaagcaaagaagtggtgcttcagcacgtgagaacggagcgcacccctcagaggttg

SEQ ID NO: 19950 - DNA, 1725 bp, Artificial Sequence
  Description of Artificial Sequence: Synthetic coding sequence
atgctcggagtccttgtgctcggagcgctcgcacttgccggacttggttttccagcccccgccgaacctcagccaggtggttcacaatgcgtggaacatgactgtttcgcactttacccggggcctgccactttcctgaatgcatcccagatatgtgacgggctccggggtcatcttatgaccgtgcgatcatccgtcgcagcagacgtgatttcgttgctgcttaacggtgacggtggcgtggggagacgacgcctctggatcggacttcagctgcccccgggttgtggagatccaaaaagacttggacctcttagaggatttcaatgggtgaccggagataacaacacctcatactccagatgggcacgcctggatctcaacggagcacccctgtgtggtccactttgtgtggcagtgagcgcagcagaagcaactgtgcccagcgagcctatttgggaggaacagcaatgtgaagtgaaggcagacgggtttctgtgtgaattccatttccctgcaacgtgtcgtccactggcggtggaacctggcgcagcagctgcagcggtgtcaatcacgtacggtaccccttttgcggccagaggagcggatttccaagcactcccagtcgggtcgtcggcagcagtcgcacccctcggactccaacttatgtgtactgcaccaccaggagccgtgcaaggtcactgggcacgcgaagcacccggcgcatgggattgttcagtggaaaatggtggatgtgaacatgcctgcaacgcaatcccaggagcaccacgatgccaatgtccggcaggtgcagctctccaggcagacggccgctcgtgcactgcatcagccacccagagctgtaatgatctgtgcgaacatttttgtgtgcctaatcctgatcagccggggtcctactcttgcatgtgtgagactggttacaggctcgctgcagaccaacaccgctgtgaagatgtggatgattgcattctcgagccatcaccttgtccacagcggtgcgtcaatacccagggagggttcgaatgtcattgttaccctaactacgatctcgtcgacggggagtgcgtggagccagtcgacccttgttttcgtgcaaattgtgagtaccaatgtcagccacttaatcaaacgtcgtacctctgtgtgtgcgcagaaggcttcgcgcctattcctcacgagcctcacaggtgtcagatgttttgtaaccagactgcgtgtccagcagattgtgatccaaacacgcaagcgtcctgtgaatgcccagaagggtacattctcgacgatgggttcatttgcaccgatatcgatgagtgtgagaatggaggattttgtagcggagtctgtcataatctgccgggcacgtttgaatgtatttgcggccctgattcggccttggcgaggcacatcggcaccgattgtgactccggtaaagtcgacggtggggatagcggaagcggagagcctcctcccagccctactccaggatcgacgctgactcctcctgcagtgggactggtgcattccggacttctgataggaatcagtattgcctcgctgtgccttgtggtcgcactcctggcactgctttgtcaccttcgcaagaaacaaggggcagcacgggcaaagatggaatacaagtgtgcagcaccttccaaggaggtggtgctccaacatgtgcgtactgaaaggactcctcagagactc

SEQ ID NO: 19951 - DNA, 1725 bp, Artificial Sequence
  Description of Artificial Sequence: Synthetic coding sequence
atgctgggtgtgctcgtgctgggcgccctggcacttgccggattggggttcccagcacctgcggagccccagcccgggggaagccagtgtgtagaacatgattgtttcgctttgtacccagggcctgctactttccttaatgcatcccaaatatgtgatggcttgcgaggccacctcatgacagtgagaagtagcgttgccgcggatgtcattagcttgttgttaaacggcgatgggggggtgggacgtcgccggttgtggataggactgcaactgcctccaggatgtggggaccctaaacgtctgggaccactccgggggtttcagtgggtgacaggggacaataacacaagttactcaagatgggctcggcttgacctgaatggcgccccattgtgcggccctctgtgtgtggcagtgtccgccgcagaggccactgtgcccagtgagccgatttgggaagaacagcagtgtgaagtcaaagccgacggcttcctttgcgaatttcatttccctgccacttgtcggcccttggctgtggaaccgggagctgctgccgccgctgtgagtattacctatggaacaccctttgctgcaagaggtgccgattttcaggccctgccagtgggatccagcgctgcggtggctcccctgggactccaactgatgtgcactgctcccccgggagccgttcaaggccattgggccagagaggcccctggggcttgggattgtagcgtagagaacggagggtgtgagcatgcatgtaatgccatcccgggcgcaccgcgctgccagtgtcccgcaggggctgccctgcaagcggacgggaggagctgtaccgcgtcagctacccagtcctgcaatgatctgtgcgaacacttttgcgtgccgaaccccgatcaaccaggcagttatagctgtatgtgcgagactgggtatagacttgctgccgaccagcacagatgcgaagacgtggacgattgcatcttggagccctctccgtgcccccagaggtgtgtcaacacccagggcggtttcgaatgccactgttacccaaactatgaccttgtggacggcgaatgcgtggaacctgtcgacccctgtttccgggctaattgcgagtatcagtgccagccccttaaccagacctcctacttgtgcgtctgcgccgagggcttcgcaccaatcccgcacgagcctcataggtgtcaaatgttttgtaaccagactgcttgccccgctgactgtgacccaaacacccaagcctcctgtgagtgtccagaaggttacatccttgatgatggttttatttgtaccgatattgatgaatgcgagaacgggggcttctgttcgggggtgtgccacaatctgcctggaacgttcgagtgcatctgtggtccggattccgccctggctcgccatataggaacggactgcgactctggaaaggtggacgggggtgacagcggttcaggagagcctccgcctagcccgaccccagggagtactctgacaccaccagccgttggtttggtgcacagcggcctcctgatcggaattagcatcgcctccctgtgcctggtggtggcattgcttgccctcctgtgccacctccggaagaaacagggggctgccagagccaagatggagtataaatgtgcggctccatccaaggaggttgtgctgcagcatgtgagaaccgagagaacaccccagcggctg

SEQ ID NO: 19952 - DNA, 1725 bp, Artificial Sequence
  Description of Artificial Sequence: Synthetic coding sequence
atgcttggggttctggttttaggagccctggctctggctggcctgggctttccagccccggctgaacctcagcctggaggctcccagtgcgtagagcatgactgctttgcgctgtacccaggcccagccacgtttctgaatgcatcccagatatgtgatggattgcgggggcacctgatgacggtccgcagctccgtcgcggctgacgtgatttctcttctgctcaatggtgacgggggcgtgggaaggcgccgtctgtggatcgggctgcagctgccccctggctgtggggatccaaaaagacttggacctctgcgaggcttccagtgggtcacaggagacaacaatacaagctactcaagatgggcccgcctggacctgaatggtgctccactttgcggtccattgtgtgtcgcagtgtctgccgccgaagccacagttccttccgagccaatttgggaggaacaacagtgtgaagtgaaggccgacgggttcttgtgtgagttccactttcccgcaacgtgtagacccttggccgtggagccaggtgccgctgccgctgctgtgtccataacgtacggaaccccattcgcagccagaggagcagattttcaagctttgcccgtggggtcatctgcagcagtcgcccccttaggcctgcaattgatgtgtacggcacctccgggcgccgtccaaggacactgggctagggaggcccctggtgcctgggactgtagcgtcgagaacggaggctgtgagcacgcatgcaacgccatccctggagcaccccgctgtcaatgccccgcaggtgccgccttgcaggcggacggcagatcttgcaccgcgagcgcaacccagagttgcaacgatttgtgcgagcatttttgtgtgcccaatcctgaccagcctggctcctatagttgcatgtgtgagacgggctatcggttggctgctgatcagcatcgctgcgaagatgtcgacgactgcatcttggagccatcaccctgtccccaaagatgcgtgaatacacagggcggatttgaatgccactgctatccgaattacgaccttgtagacggggaatgtgtcgaaccagttgacccatgtttccgggctaattgcgagtaccagtgccagcccctgaatcagaccagctatttgtgcgtctgcgccgaaggctttgcaccgataccccacgagccgcatcgttgtcagatgttttgcaaccaaacagcctgtccggccgattgtgaccctaacacacaggccagttgcgaatgccccgagggttatatcctggacgatggcttcatctgtaccgatatcgatgaatgcgagaacggcggcttctgttccggcgtttgccacaatcttcctggcacattcgagtgtatttgcggccccgactccgccttagcccggcacatcggaacagattgtgactctggcaaggtcgatggaggggactctggatctggggaaccacctcctagccccactccaggcagcacgctgactccccccgccgtgggcctggtacattctgggctgctaattggcatttcaatcgcatccctctgcttggtagtggctctcctggcacttttatgccatttacgaaaaaaacagggagctgctagggccaaaatggaatataagtgcgctgcgccttctaaggaggtggtgctgcagcatgttaggactgaaagaacaccacaacggcta

SEQ ID NO: 19953 - DNA, 1725 bp, Artificial Sequence
  Description of Artificial Sequence: Synthetic coding sequence
atgctgggtgtcttggtgctgggggcgctggccctggcaggactgggcttccccgctccagcagaacctcagcccggaggaagtcagtgtgtggaacatgattgttttgcactgtatcccggacccgcgacattcctcaatgctagccagatctgcgacggccttaggggtcatttgatgacggtacgtagttctgtggcagcagatgtgatttcccttcttttaaacggagatggaggggtgggccggaggcgcttgtggatcggattgcagctgccccctggatgtggagaccccaagagattgggacctctcagaggattccaatgggtgaccggagacaacaacacctcttacagccgctgggcgcgactcgacttaaatggagctcctctgtgcgggcccctgtgcgtcgccgtgagtgccgccgaagctaccgtcccgtctgagcctatctgggaggaacaacagtgtgaggtgaaggcagatggctttttgtgcgaattccacttccccgctacgtgtcggcccctggcagtagagccaggtgccgccgctgccgctgttagtattacatacggtaccccattcgctgcccggggcgcagacttccaggccctgcccgtgggatccagtgcagccgtggcccctctgggtctgcagctcatgtgtaccgctccccctggcgctgtccagggacattgggcgagggaagctcctggagcctgggactgcagcgtcgaaaatggcggctgtgaacacgcatgcaacgctatcccaggggccccgcgatgtcagtgtccagccggcgcggccctgcaggctgatggcagatcctgtactgctagcgcaactcagtcgtgtaacgatctgtgtgagcacttctgtgtgcctaacccggaccaacctggttcctacagttgcatgtgcgaaacaggctaccggcttgccgccgatcaacataggtgcgaggatgtggacgattgcattttagaaccaagtccatgtccccagcggtgcgtgaatacacagggtgggttcgagtgtcattgttatccaaactacgatctcgtggatggggagtgtgtggaaccagtggacccgtgttttagggcaaattgcgaataccaatgccagcctctgaaccagaccagctacctgtgcgtgtgcgcagagggtttcgccccaatcccccacgagccgcaccgctgccagatgttttgtaatcagaccgcatgcccggccgactgcgatcccaacacccaagcgagttgtgaatgccctgaagggtatatccttgatgatgggttcatttgcacagatattgacgagtgcgagaacggaggattctgctctggggtatgtcacaacctgcctggcacatttgaatgtatctgcggcccagacagcgcgctcgcacgccacatcgggacagactgcgattctggtaaggtggatggaggggatagcggctcaggagagccaccaccctcacctacaccaggttcaacattgactccacctgccgtgggcctggttcactccgggcttctaattggcataagcattgcttccctttgccttgtggtggccctgttggccttactgtgtcatctccgaaaaaagcaaggtgccgctagagcgaaaatggagtataaatgtgccgctcctagcaaagaggttgtcttgcagcatgttcggaccgaacggactcctcagagacta

SEQ ID NO: 19954 - DNA, 1725 bp, Artificial Sequence
  Description of Artificial Sequence: Synthetic coding sequence
atgctaggtgtcctggtgcttggcgcacttgctctggccggcctgggcttcccagctcctgccgaaccgcagcctggcggcagccagtgcgtggagcacgattgtttcgccctgtaccccgggcctgcaacctttttgaatgccagccaaatttgcgacggcttgcgtggacatctgatgacagtgcgctcgtctgtggcagctgacgtaatttctctactgttgaatggagacgggggggtagggcgcaggcggctatggatcgggttgcagttacctcctggctgcggtgacccgaagaggctggggcctctgcgaggatttcaatgggtcacaggggacaacaacacttcgtattcacgatgggctagactcgacctcaatggagcccctctgtgtggcccgctgtgtgttgcggtttctgccgccgaggccacagtcccaagtgagcccatctgggaagaacagcaatgcgaagtgaaagcggacggatttctctgtgaattccactttcctgcaacttgccgaccattagcagtagagccaggggcagccgccgcggcagtgagtataacttacggaactccttttgcggctaggggtgcggatttccaggctctacctgtgggctcctcagctgctgtggccccactgggcctgcagttgatgtgtacagctccacccggcgccgtgcaggggcactgggcgcgggaagctcccggggcatgggattgctccgtcgagaacgggggctgtgagcacgcctgcaacgccatcccaggagctcctcgatgccagtgccctgccggagctgcactgcaggcggacggcaggtcttgcactgcatcagcaactcagtcttgcaacgacctctgcgagcacttttgtgttcctaatcccgatcagcccggctcatactcatgtatgtgcgaaacaggctaccgtctagccgcagatcagcatcgttgtgaggatgtcgatgattgcatcctagaaccaagtccctgtccacagagatgcgtgaacactcaggggggcttcgagtgccactgttatcctaactatgatctagttgacggggaatgtgtagagcccgtcgacccatgcttccgagcgaattgcgagtaccaatgtcagcctttgaatcagacatcctacttatgcgtctgtgctgaaggtttcgcccctattccgcatgaacctcaccgttgccagatgttctgcaatcagactgcttgtcccgcagactgcgaccccaatacccaggccagctgtgagtgtcccgaaggctatatattggatgacgggtttatttgcacagacattgacgaatgcgagaacgggggattttgctccggcgtttgccacaatctgcccggtacattcgagtgcatctgcggccccgattctgcactggcccgccacattgggaccgattgcgattcaggaaaagtggatggaggggatagtggatcgggcgagccacctccgagccctactcctggtagcaccctgacacccccagcagttgggctggtccacagcggtttgctgatcggaataagcatcgcctctctgtgtcttgtagtagctctgctggcgctgttatgtcacctccggaaaaagcaaggagcagcccgggccaaaatggaatacaagtgtgctgcaccttccaaagaagttgtgcttcagcacgtgcgcaccgagaggacccctcaacgtctc

SEQ ID NO: 19955 - DNA, 1725 bp, Artificial Sequence
  Description of Artificial Sequence: Synthetic coding sequence
atgttgggcgttctcgtgctcggcgctctggccctcgctggactcggcttccccgctcccgcagagccacaacccggcgggtcccaatgcgtcgagcacgactgtttcgccttgtaccctgggcccgcaactttcttgaatgccagtcagatctgcgacggcctgcggggacacttaatgaccgttagatcctccgtcgctgccgatgtgatctcactcctgttgaatggagatggaggcgtcggccgccgccgcctgtggatcggattgcagctgcccccagggtgcggtgatcctaagcgcctcgggcctctccggggttttcagtgggtgacaggtgacaacaatacctcttactctcggtgggctcgtctggacctgaatggcgcccccctctgtggcccactgtgtgtggcagtgagtgccgccgaggccacagtgccctccgagcccatttgggaagaacaacagtgtgaggtaaaagcagacgggtttctttgcgaatttcatttcccggctacatgccgccctctcgcggtggagccaggagctgcggctgctgccgtatcaatcacatatggcactcctttcgcagctcgtggcgccgacttccaagctctcccggtaggatccagcgcggccgtggcacctctgggactccagcttatgtgcacggctccacccggggcagtgcagggacactgggctagagaggcccccggtgcttgggactgcagcgtggagaatgggggctgtgagcacgcctgtaatgccattcctggcgctccaagatgccagtgtcctgcgggagcagctttgcaggcagatggacgatcttgcaccgccagtgccactcagagttgtaatgacctttgtgagcatttctgcgtgccaaatcccgaccagcctggctcatattcgtgcatgtgcgagacgggatatcggcttgccgctgaccagcatagatgtgaggacgtggacgattgtatcctggagccgagcccatgtccccaacgctgcgtcaatacgcagggcggcttcgagtgtcattgttaccctaactatgatctcgttgatggtgaatgcgtcgagcccgttgatccatgtttccgcgcgaattgcgagtaccagtgtcagcccctcaaccagacgagctacctctgcgtgtgtgctgagggtttcgctccgattccacacgagcctcaccgatgccagatgttttgtaatcagacagcctgccctgcagattgcgatcccaatacacaggcttcttgcgagtgtcccgaggggtacatcctcgacgacggattcatctgcaccgacattgacgagtgtgagaatggcggcttttgttctggggtttgtcataatttaccaggcacattcgagtgtatatgtggcccagattctgcactggcacggcatattggaacagattgtgattctggcaaagttgacgggggtgatagtgggtccggagaaccgccgcctagtccaacccccggatccaccttaacaccccctgctgtaggtctggtgcatagcggcctcctgattggtatttcaatagcttctctgtgtctcgtcgtagccctgctggcgctgctgtgtcacctgcgcaagaagcagggggccgcccgggctaagatggaatacaaatgtgccgctccatctaaggaggtggttctgcagcacgtgcggacggagcgaactccacaacgtttg

SEQ ID NO: 19956 - DNA, 1725 bp, Artificial Sequence
  Description of Artificial Sequence: Synthetic coding sequence
atgctaggagtactggtgcttggagccctggcccttgcaggtctggggttccccgcccctgctgaaccacagccaggcggatcccagtgcgttgagcacgactgcttcgccctgtacccgggacccgcaacattccttaatgcctcgcaaatttgtgacggactgcgcgggcacctgatgactgtaaggagcagtgtggctgccgatgttataagcctgctcctgaacggagatggcggagtcggacggcgacgcctgtggattggcctgcagctgcccccgggctgcggtgatccgaagcgtttgggccctcttaggggttttcaatgggttaccggagacaataacacaagctacagcaggtgggcacggttagacctcaacggcgctccattgtgtggaccgctttgtgttgcagtgagtgctgctgaagctactgtgccctctgagcctatctgggaggaacagcaatgtgaggtcaaggccgacgggtttctatgtgaatttcatttccctgccacttgccgcccactggcagtcgagcctggggctgccgcggcagccgtgagcattacttacggcactccatttgccgcacgaggcgcagacttccaggctctgcccgtagggagcagcgccgccgttgccccactaggattgcaactgatgtgcaccgcccctccaggagccgtgcagggccactgggcacgcgaagcacccggtgcttgggattgcagcgtcgaaaatggtggctgcgagcatgcctgcaacgctatacccggcgcccctagatgtcaatgccctgcaggagctgcactccaagccgatggaagatcctgcacagcatcagctacgcagagctgcaacgacctatgcgagcacttctgcgtgccaaaccccgatcaacctggcagttactcctgcatgtgcgagaccggatacaggcttgcggcggatcagcatcggtgtgaggatgtcgacgactgtattttggagcctagtccgtgtcctcagaggtgtgtaaacactcagggcggtttcgaatgccactgttaccctaactatgatctggtcgacggggagtgtgtagaacccgttgatccatgctttcgcgccaactgtgaataccagtgtcaacccctgaaccaaacctcgtacctgtgcgtgtgcgccgaagggttcgcccccatcccccacgaacctcaccgttgtcagatgttctgtaatcagaccgcgtgccctgcggactgtgatccaaacacgcaagcctcatgtgagtgcccagagggctacattttggacgatggctttatctgcaccgatatcgacgaatgcgagaacgggggcttttgttccggcgtgtgtcataacctgcccgggaccttcgaatgcatttgtggcccggattcagctttagcccgccacatcggcacagactgtgactcaggcaaagttgacgggggcgattctggctctggggagcctccaccctcccccacccctggatcgaccctcaccccacctgctgttggtctcgtgcactctgggctgctcatcggaatctccattgcctcattgtgtttagtggtcgcattgttggccctgctgtgtcacttgagaaaaaaacaaggcgcggcacgagcgaaaatggagtataaatgcgccgccccatctaaggaggtggtactgcagcatgttagaaccgaacgtaccccccaaaggctc

SEQ ID NO: 19957 - DNA, 1725 bp, Artificial Sequence
  Description of Artificial Sequence: Synthetic coding sequence
atgcttggagttctggtgctcggcgcattggcactggcaggactgggcttccctgcacctgcagagcctcaacctgggggatcgcagtgtgtggagcatgactgtttcgcgctctatccgggaccggcaaccttcctgaatgcttcgcaaatttgtgacggactgcgtggtcacctgatgaccgtcaggtccagcgtggccgcggatgttatatcattgctgctgaatggggatggaggagtgggacggcgcagactctggattggtttgcaactcccgcccggttgcggagatcctaagcgtctgggaccactccgggggtttcaatgggtgaccggtgataacaacacttcgtatagtcgctgggcgcgcctggatcttaatggggcaccgttgtgtgggccgctctgcgtggcggtgtcagctgccgaagcaaccgtcccaagcgaaccaatctgggaagagcaacagtgtgaggtgaaggcagacggattcctttgtgaatttcattttccagcaacttgcagaccactggcagtggaacctggcgctgccgcagccgcagtctcgattacttacgggacgccgtttgccgcacgcggtgcagattttcaagcgcttcccgttggttcgagcgccgccgtggctccgctgggtctgcaacttatgtgcacggcaccaccaggtgcagtccaaggtcattgggctcgcgaagccccaggagcttgggattgctcggtggaaaacggaggatgcgaacatgcttgcaacgccattcctggagcgcctcggtgccagtgtcccgcaggtgctgcacttcaggccgacggacgttcatgtactgcgtcagcaacccagtcctgtaatgatctttgcgaacatttttgtgtgccaaacccggaccaaccaggatcatactcctgtatgtgtgaaaccggttaccgtctggcggctgaccaacatcgctgtgaagatgtggacgattgtatcctcgagccatccccttgtccacagcggtgcgtaaacacccaaggcggtttcgaatgtcactgctaccccaactacgatttggtggatggtgaatgtgtcgaacctgtggacccttgcttccgtgcaaactgtgagtaccaatgtcagccactgaatcaaacttcgtacctttgtgtgtgcgccgaaggatttgcccctattccacatgaaccccatcgttgtcagatgttttgtaatcaaactgcgtgtccggcggattgtgaccccaacacgcaggcatcctgtgagtgtcctgaggggtacattctggatgacggattcatatgcactgatatcgacgaatgcgagaacggaggcttttgtagcggcgtgtgccataacctgcctggaacttttgagtgcatttgcggaccagattccgcactcgcgcgacacatcggcaccgactgtgactcgggaaaagtggatggaggggattccggtagcggggaaccaccaccatcgccaacgccgggatcgacccttactccccctgcggtgggattggtgcatagcggactgctgattggaatcagcatcgcctccctttgtctggtcgtggcccttttggcactcctctgtcacctgaggaagaagcagggtgcagctagagcaaagatggaatacaaatgcgctgccccatcgaaagaggtggttcttcagcacgtgcgcaccgagcggactccacagaggctt

SEQ ID NO: 19958 - DNA, 1725 bp, Artificial Sequence
  Description of Artificial Sequence: Synthetic coding sequence
atgttaggtgtattagttttaggtgcgctagcgttagcgggtctaggttttccggcgccggcggaaccgcaaccgggtggttcgcaatgtgttgaacatgattgttttgcgttatatccgggtccggcgacgtttttaaatgcgtcgcaaatatgtgatggtttacgaggtcatttaatgacggtacgatcgtcggttgcggcggatgttatatcgctactattaaatggtgatggtggtgttggtcgacgtcgactatggataggtctacaattaccgccgggttgtggtgatccgaaacgtttaggtccgttacgtggttttcaatgggttacgggtgataataatacgtcgtattcgcgttgggcgcgtctagatttaaatggtgcgccgctatgtggtccgttatgtgttgcggtttcggcggcggaagcgacggttccgtcggaaccgatatgggaagaacaacaatgtgaagtaaaagcggatggttttctatgtgaatttcattttccggcgacgtgtcgtccgctagcggttgaaccgggtgcggcggcggcggcggtttcgataacgtatggtacgccgtttgcggcgcgtggtgcggattttcaagcgctaccggtaggttcgtcggcggcggttgcgccgctaggtttacaattaatgtgtacggcgccgccgggtgcggtacaaggtcattgggcgcgtgaagcgccgggtgcgtgggattgttcggtagaaaatggtggttgtgaacatgcgtgtaatgcgataccgggtgcgccgcgatgtcaatgtccggcgggtgcggcgttacaagcggatggtcgttcgtgtacggcgtcggcgacgcaatcgtgtaatgatttatgtgaacatttttgtgttccgaatccggatcaaccgggttcgtattcgtgtatgtgtgaaacgggttatcgtttagcggcggatcaacatcgatgtgaagatgttgatgattgtatactagaaccgtcgccgtgtccgcaacgttgtgtaaatacgcaaggtggttttgaatgtcattgttatccgaattatgatttagttgatggtgaatgtgtagaaccggtagatccgtgttttcgtgcgaattgtgaatatcaatgtcaaccgctaaatcaaacgtcgtatctatgtgtatgtgcggaaggttttgcgccgataccgcatgaaccgcatcgttgtcaaatgttttgtaatcaaacggcgtgtccggcggattgtgatccgaatacgcaagcgtcgtgtgaatgtccggaaggttatatattagatgatggttttatatgtacggatatagatgaatgtgaaaatggtggtttttgttcgggtgtttgtcataatttaccgggtacgtttgaatgtatatgtggtccggattcggcgttagcgcgtcatataggtacggattgtgattcgggtaaagtagatggtggtgattcgggttcgggtgaaccgccgccgtcgccgacgccgggttcgacgttaacgccgccggcggttggtctagttcattcgggtttactaataggtatatcgatagcgtcgctatgtttagttgttgcgttactagcgctactatgtcatttacgtaaaaaacaaggtgcggcgcgagcgaaaatggaatataaatgtgcggcgccgtcgaaagaagttgtattacaacatgtacgaacggaacgaacgccgcaacgtcta

SEQ ID NO: 19959 - DNA, 1059 bp, Artificial Sequence
  Description of Artificial Sequence: Synthetic coding sequence
atggagctgaccgagctgcttctggtcgtaatgctgctgttgactgccagactgactctctcctcacccgccccaccagcttgtgatcttcgcgtgctgagcaagctccttagggactctcatgtattgcattctcgattgagccaatgcccggaggtccacccacttcctacgccggtgctgctgccagcagtggacttctccttgggcgagtggaaaacacaaatggaggagacaaaggcgcaggacattctaggagcagtgacactattgttggaaggcgtgatggccgcacgcggccaacttggcccgacctgtctgtccagcctgttgggacaactctctgggcaggtgagactgttactcggggccctgcagtccttactgggcacccagctcccacctcagggcagaaccacggcacacaaagatcccaatgcaatattcctgagctttcagcacctgctgcggggaaaagttcgctttctgatgctggtgggcggctcaacgctgtgcgttcggagagccccgcccactaccgctgtcccgagcaggacgtccctggtgctaaccttaaacgaactgcctaaccgcaccagcgggctgctggagacaaatttcaccgcaagtgccagaaccactggctcaggcctcctgaagtggcaacagggcttccgggccaagatccccggcctgttgaaccagaccagcaggagcctggaccagatacctggttacctgaacaggatacacgagctcctgaatgggacccgcgggttgttcccagggcctagcagacgtacgttgggcgctccagacatctcttcaggcacctccgacaccggatccctgcctccgaatctacaacccggttactcacccagtcccacacacccaccgaccggacaatatacactcttcccactgcccccgacactgcccaccccagttgtgcagttacacccgctcttgcccgatccctctgcccccactcccacccccacgagtccactgctcaatacctcctatactcattcacagaacctctcacaagagggt

SEQ ID NO: 19960 - DNA, 1059 bp, Artificial Sequence
  Description of Artificial Sequence: Synthetic coding sequence
atggagctcaccgaactgctgctcgtagtcatgttactactgactgcacggctcacactctcatctcccgcaccaccggcatgtgacttgagagttttatccaaattgctgcgggatagtcatgtactgcactcgagactgagtcagtgcccagaggtgcatcccttaccgacccctgtgttactgcctgccgttgatttttcattgggcgaatggaagacacagatggaagagaccaaggcccaggatattttgggagccgtgactctgttgctggaaggcgtcatggccgccagagggcagctcggcccaacgtgtctctcctcgctactgggccaactttcgggacaagtgcgattgctgttaggagccttgcagtccttactgggaacccagctgcccccccagggaaggacaactgcccacaaggaccctaatgcgatatttttgtctttccaacatcttctgcggggaaaggtgcggttcctgatgttggtcggtggatccactctgtgtgtcaggcgcgctcctccaaccactgctgtgccctcgcggacctcactggtgttgacccttaatgagttacctaacagaacttccggtctgctggagactaattttaccgccagtgcccggacaacagggagcggtttgctaaagtggcagcagggattcagggccaaaattccaggactcctgaaccagacctctcgctccctcgaccagatcccaggttatctcaaccgcatacacgaactgcttaatggaacgaggggtctctttccaggcccaagtcgacgcactcttggagccccagatatctcttcaggtacatctgatacaggctcactccctccaaacctgcaacctggctattccccctcacctactcacccacccacaggccagtacacactgttccctctgccccccaccctgcccacacccgtggttcaactgcacccccttcttccagacccaagtgcacctacaccaactcccacgtctccccttttgaatacgagttatacacatagtcagaatctctcgcaggaaggt

SEQ ID NO: 19961 - DNA, 1059 bp, Artificial Sequence
  Description of Artificial Sequence: Synthetic coding sequence
atggagctcacagagttgcttctggtggtgatgttgctgctgacagcacgactgacgttgtcctcccccgcgcccccagcctgcgatttacgtgtgctgagcaagctgctccgggacagccacgtactgcacagcagactcagtcaatgtccagaggttcacccactgcctacacccgtcctgctgcccgcggtcgatttcagcctgggagagtggaagacacagatggaggagactaaagctcaggatatcttgggggctgtaaccctacttctggagggcgttatggccgcccggggccagctggggcccacctgtctgtccagtctgctagggcagttaagtggccaggtgaggctccttttgggggcccttcaatccctgctcgggacacagttgcccccccagggaaggactactgcacacaaggatcctaacgctatctttctgagcttccagcacctacttcgtggaaaggttcgcttcctgatgctggtgggcgggtcaactctctgtgtgaggagagcaccgcccaccaccgcggtgccaagtcgcacctcccttgtcttgaccctcaacgagttgcctaatcgaacaagcggactcctggagacaaatttcacagcctctgctcgaacaacgggaagcggcttgttgaagtggcagcaaggctttagggctaagattcctgggttgctgaatcaaacttcacggtccctggatcagatcccgggttacctcaataggatacacgagcttctgaacggaaccagggggttgtttcccgggccatcacggcgcacactgggcgcccctgatatcagttccgggacatcagacacaggaagtttaccgccaaacctgcagccaggatatagcccttcaccaacccatccgcctacagggcagtacactttattcccacttccccccacattgcccaccccggtggtgcagctgcaccctctcctccccgacccatccgccccaacacctacacccacatctccacttttaaacacttcctatacccactctcaaaacctttcccaggaaggc

SEQ ID NO: 19962 - DNA, 1059 bp, Artificial Sequence
  Description of Artificial Sequence: Synthetic coding sequence
atggaattaactgagctgttgcttgtggtgatgttgcttttaactgccaggctaacattgagcagtcctgctcctcctgcttgtgatttgcgggtgctatccaaactgttgagggattctcacgtgcttcatagtcgcctgtcacagtgtcccgaggttcacccacttccgactcctgtacttctccccgccgttgacttcagcttgggcgagtggaaaacccagatggaagagaccaaagcacaagatatactgggggctgtaaccctgctgctcgaaggcgtgatggccgccagggggcagcttggtcctacatgtttgtcttcattgctcggccagctgagtggccaggtacgactgttgctgggagcattgcagtcgctactaggcactcagttgcccccccagggtcgtacaactgcgcataaggaccccaatgcgatcttcctctcgtttcagcatctcctccgagggaaggtccggttccttatgctggtgggcggatctacactgtgcgtacgccgagccccacccacaaccgctgtccccagtaggacaagcctagtactgaccctgaatgaactgccgaatagaaccagcggcctgctggagacgaattttacagctagtgcacggactaccggctccgggctgctcaaatggcagcagggcttccgggctaaaatccccggactgttaaatcagacctccagatctctggatcagattcctggctacctgaatcgaatccatgagcttttaaatggcacccgaggtttgttccccgggccatcccgaaggacgctaggagcacccgatataagtagcggaacctccgacaccggaagtctgccccctaacctgcagcccgggtatagtccctcacccacacatcccccaacaggacagtacacgctctttcccttacccccaacgcttcccacaccagtagtgcagctacatccactgctccctgatccgtctgccccgaccccaactcctacaagcccacttcttaatactagctacactcactctcagaatctgagccaggagggg

SEQ ID NO: 19963 - DNA, 1059 bp, Artificial Sequence
  Description of Artificial Sequence: Synthetic coding sequence
atggagctgactgagctgctcctagttgtgatgctgttgctgactgctcggctgactctcagtagtcctgccccgcccgcatgcgaccttagagttctcagtaagctgctcagagatagccatgtgctccactcaagactgtcacagtgccctgaggtgcaccctctgccaactccagtgctcctgcctgcggtcgacttctcattgggggagtggaagacgcagatggaagaaactaaagcccaagacattctgggggccgtcacattacttctggagggcgtaatggctgcccgagggcagctcggaccgacctgcctgtcttcactgttaggtcagctcagcggccaggtcaggctactactaggagcactgcaaagcctcttgggaactcagctgcctcctcagggaagaactacggcccacaaagatccgaatgctatttttctgagcttccagcacctattgaggggaaaggtcaggttcctgatgctggtgggaggctcgacactgtgcgtcagacgagcccctccgaccaccgcggtgccctcccggacctcactggtgctcaccctgaatgagttaccaaacaggacatcgggtttattggaaaccaattttactgctagcgcccgcacaacaggcagtggcctcctgaaatggcagcagggcttccgggccaaaatccccgggctgctgaatcagactagccgatcattggatcagatccccggatatctaaatcgcatccacgagctcctcaacggcaccaggggtctgtttcccggaccctcgcgacggactctgggggctcccgacatctcaagcggcacgagcgacacaggcagtttgcctccaaacttgcagcccgggtactcaccctcacccactcacccacctaccgggcagtacaccttgtttccgcttcctcctacacttcccacacccgtggttcaattgcacccactgctcccagatcccagtgcgccgactcccaccccgacatcgccacttctgaatacttcctacacgcacagccagaatctctcgcaggagggg

SEQ ID NO: 19964 - DNA, 1059 bp, Artificial Sequence
  Description of Artificial Sequence: Synthetic coding sequence
atggaacttactgagctgttgctggtggtcatgctcctgctgaccgccaggctgactctttcttcaccagccccaccagcctgtgatcttcgcgtgctgtccaagttgcttagggattcccatgtcctccactcacggctgagtcagtgtcctgaggtgcatccactgccaacgccagtgcttcttcctgcagtggatttttcactgggcgaatggaaaacgcagatggaggaaaccaaggctcaggatattcttggtgctgtgacccttctgttggagggcgtgatggcagccaggggccaacttggcccaacttgtctgtcatcgctccttggacagctgtcgggacaagtgcggctgctcctgggcgcacttcagtcactcctcggaacccagttgccgcctcagggtcgaaccacggcccataaggaccctaatgcaatattcctgagctttcaacatctgctgcgaggaaaggtcagatttctgatgctggtgggaggatcaaccctttgcgtgagacgggcacctcccactactgcagtgccctccaggacctcgctggtgctgactcttaacgaactgccaaacagaacttcgggtctgctggaaaccaatttcaccgcctcggctagaaccactggatccggactgttgaagtggcaacaaggctttcgtgccaaaattcctggccttctcaatcaaacttcgcgatcgttggaccagattcccgggtaccttaatcggatccacgaactgctgaatggtactagaggacttttccctggaccgagcagaagaactctcggtgcaccagatatctcctccggtaccagcgacaccggaagccttcctcctaaccttcagcccggatactccccgagccctactcacccgcctaccggacaatacacgctgtttccacttcctccaaccctccccacccctgtggtccaactccatcctctgctgcccgacccctcagcacctacccctaccccaacctcgcctctgctgaacaccagctacactcactcccaaaatctctcacaagaaggt

SEQ ID NO: 19965 - DNA, 1059 bp, Artificial Sequence
  Description of Artificial Sequence: Synthetic coding sequence
atggaacttaccgagttgcttctcgtcgtgatgcttctccttaccgcacgcctgactctttcgtcaccagcccctccagcatgtgatctgagggtgctgagcaagctgcttagagattcacatgtcttgcactcccgactctctcaatgccccgaggtccacccgctccctactcccgtgttgctgcctgctgtcgacttctctctgggagaatggaaaacccagatggaggaaaccaaggcacaggacattctcggagcggtgactctcctcctcgagggtgtgatggcggcccgtggccaacttggacctacttgcctgtcgagcctcctcggtcagctttccggccaggtgagattgctgctcggtgctctgcagtcactgctcggaacccagctgcctccacaaggaagaacgacggcccataaggacccgaacgccatctttctgtcctttcaacatttgctgagggggaaggtccgttttcttatgctggtgggcgggtcaaccttgtgtgtgagacgggcacccccgactactgcagtaccatccagaacttccctggtgctgacgctgaacgaacttccaaatcgaaccagcggcctgctggaaactaatttcaccgcaagcgcacgcactaccggaagcggattgctgaagtggcaacagggattccgggccaaaatcccaggactgcttaaccaaacctcacggtccctcgatcaaattcctggctaccttaatcgaattcacgaactgctgaatggtaccagaggtctgtttcccggtccgagccgcaggaccttgggggctcctgatataagctcgggcacgtcagatactgggagccttcccccaaaccttcaaccgggttattcgccatccccaactcatcctccgaccgggcagtacactctttttccgttgccgcctaccctcccaacgccagtggtacaactgcatccactgctccccgatccctccgcacctacgccaactcctacctcgcctcttctcaacacctcatacacccatagtcagaacctttcccaagaagga

SEQ ID NO: 19966 - DNA, 1059 bp, Artificial Sequence
  Description of Artificial Sequence: Synthetic coding sequence
atggagcttaccgagttgcttttggtagtcatgctcctgctgactgccaggctcaccttgagcagtccagcacctcctgcttgcgatctcagggtgctgtcaaagcttctccgcgactctcatgtcctccattccagactcagccagtgtcccgaagtccatcccctccctacaccggtgctcctgcccgcagttgactttagccttggcgagtggaagactcagatggaggagacgaaggctcaggacatcctgggggcggttaccttgttgttggaaggtgtgatggctgctagggggcagctggggcccacctgccttagctccctccttggtcagcttagcggtcaggttcgattgctgctcggcgctctgcagagtctgctgggcactcagctccctccccagggacgcacaacggcacacaaagatcctaacgcaatttttcttagcttccagcacttgctccggggtaaagtgcgatttctcatgctcgtcgggggcagtacactgtgtgtaagacgcgccccccccaccaccgcagtgccatcaaggacatcactggtgctgacgctgaatgagctgcccaatcgaacaagtggtttgctggagacgaattttaccgccagcgcaagaacaacaggctctgggctgctgaagtggcagcaggggtttagggctaagatccctggccttctgaatcaaacttctaggtccctggaccaaattcctggctatctcaacaggattcacgaactgctgaatggtacacgagggctgttccccggcccgtcccggagaactctgggggccccggacataagcagcggtacgtctgatacaggctccttgcctccaaacctgcagcccggatactcacctagcccaacacaccctccgaccgggcaatacacccttttccccctgccgccgactcttcccaccccagttgtccagcttcaccccttgttgccagacccctccgcccccacgccaactcctacctccccactccttaacacgagctacacccattcacagaacctgagccaggaggga

SEQ ID NO: 19967 - DNA, 1059 bp, Artificial Sequence
  Description of Artificial Sequence: Synthetic coding sequence
atggagctgaccgagttattgctggtggtaatgctgctcttaacagcaagacttactctaagctctccagcccccccagcttgtgaccttcgcgttctgtctaaactgctgagggattcccacgtgctccactctaggctttcccagtgtccagaggtccaccctttgccgactcccgttttactccctgccgtggacttctctctcggcgagtggaaaacacagatggaggaaacaaaagcacaggacattctaggcgctgtcacactgctgctggagggcgtcatggcggcccgagggcagcttgggcctacgtgtctcagcagcttgcttggacaactgtccggtcaggtccggctcctgctgggagctctccaaagtctgctgggaacccagctgccacctcagggcaggaccacagcccacaaggatcctaacgccatcttcctgagcttccaacacctcttaagagggaaggtccgattcctgatgctggtcggtggatccacactgtgtgtgcggcgggcaccccccactacggccgtccctagcaggacctctttagtcttgactctaaacgagctgcccaatcggacttccggattacttgagacaaattttacagcgagcgctcggacaacaggttctggactcttgaagtggcagcagggattcagggcgaaaataccgggcctactgaatcagacgtcccggagccttgatcagattccagggtatcttaatcggatccacgaactcctgaacgggacacgcggattgttccctggtccctctcgccggactctgggtgctccagatatctcttctggcacgtcagacaccgggtcgttgcctcctaatttacagcctggctattcaccatcacctactcaccctcccactggacagtacacccttttccctctgcccccaactctaccaaccccagttgtccagctccatccgttactgccggatccctccgctcccacacccaccccaacatcacctctgttgaacacatcatacacacactcacaaaacctctcccaagaaggc

SEQ ID NO: 19968 - DNA, 1059 bp, Artificial Sequence
  Description of Artificial Sequence: Synthetic coding sequence
atggaactcaccgaacttctgctggtcgtgatgctcctccttactgccagactgactctttcatctcccgctccaccggcgtgtgacctgagggtgctcagcaagctgcttcgcgactcccacgttctgcactcccggctttcgcaatgcccggaagtgcacccgctgcccactccagtcctccttccggccgtcgacttctcactgggagaatggaaaacccagatggaagaaactaaagcgcaggacatcctcggcgctgtgactctcttgctggagggagtgatggcggcgagaggacaactgggcccaacgtgcttgtcgtcactgttgggacaactcagcggccaggtgcggctgctgctcggagcactgcagtcgctcttgggaacccagctgccgcctcagggacgcaccaccgcccataaggatccgaacgcaattttcctgtcattccaacatctgctgcggggaaaggtgcgcttcctcatgctggtgggcggttccactctttgcgttaggagagcgccccccaccacggctgtgccatcacggacctcactggtgctgacgctcaatgagctcccgaaccgcacctccggcttgttggaaaccaactttaccgcatcggctcggaccaccggcagcggtctgctgaagtggcagcaaggtttccgcgcaaaaatcccgggacttttgaaccagacttccagatccttggatcagatccctggctaccttaatcggatacacgagctgctgaatgggacccggggattgttcccgggaccgtcgaggaggactctcggagcgccagatatctcctccggcacgtccgatacgggaagtttgccaccaaacctgcaaccaggatacagcccgtcccctacccacccgcctaccgggcaatacactctgttcccactcccgccgaccttgccgaccccggtcgtccagttgcatccgcttcttcccgaccctagcgccccgacgccgacccctacctccccactgctgaacacctcttacacgcattcccaaaacttgtcgcaggaggga

SEQ ID NO: 19969 - DNA, 1059 bp, Artificial Sequence
  Description of Artificial Sequence: Synthetic coding sequence
atggagctgaccgaactgctgctggtggttatgctcctactaacagctagactgaccctctcctcacctgcccctcccgcctgtgatcttcgcgtgctgagtaagctattgcgagattcgcacgtcctccactcccggctgagtcagtgtcctgaagtacaccccttgccaactcccgtgctgctccccgcggtagattttagtttgggtgaatggaagacccaaatggaggagacaaaagcacaagacatcctgggagccgtgactctgcttctggaaggggtgatggctgctcgaggacagttaggcccgacgtgtttgagctccctgctaggccagctcagtggccaggtacggctgctcttaggcgccctgcaaagcctgctcggaacccagctgcctcctcagggaagaactaccgcccacaaagacccaaatgctatcttcctgagtttccagcatttactgcgagggaaagttcgatttctgatgctcgtcggcggctctaccttatgtgtaaggagagcccctcctacaactgctgtgcctagccgcacatctcttgtgctcactctgaatgagttgccaaaccggacgagcgggctgctcgaaacaaatttcactgccagcgcgcgaactacgggaagcgggctgctgaaatggcagcaaggtttccgagccaagatccctgggctgctcaatcaaacctcacgaagtttggaccaaattcccgggtacctgaatagaattcacgagctgctcaatggcacaagaggcctgttccccggcccgagtagacggactctcggggcgcccgacataagctctggtacctctgatacaggtagcctgccaccaaatctgcagcccggttacagcccaagtccaactcacccacccaccggccagtacactctgttccctcttccacccactcttcccacacctgtggttcagctgcaccccctgctgcccgatccttcggctcccacccctacaccaacaagccccctactgaacaccagttacacccattcgcagaatttgtcccaggaggga

SEQ ID NO: 19970 - DNA, 1059 bp, Artificial Sequence
  Description of Artificial Sequence: Synthetic coding sequence
atggagcttactgaattacttctcgttgtcatgcttctgttgactgccagactcacacttagcagcccagcccctccagcctgcgatctgagagtgcttagcaagctcttgagagacagccacgtactgcacagtaggctgagccagtgtcccgaagtacatcctcttccaaccccagtcctcctgcctgcggtcgacttctcactcggggaatggaagacccagatggaagaaaccaaagcacaggacatactgggagcagttacgctgcttctggaaggggttatggccgcaaggggccagctgggccctacatgcctgagctctctgctggggcaactgagtggtcaggtccggctgcttctgggggccctgcagagtcttttagggactcaattgcccccacagggccgaaccacagcccataaagaccctaacgcgatatttctttcttttcagcacctactgcgtgggaaggttaggttcctgatgcttgttggaggtagtaccctttgcgtgcgcagggcacctcccacaaccgctgtcccatcccggacatcactagtgctcactctgaacgaacttcccaaccgcacatccggccttctggagaccaatttcaccgccagcgcgcgcactaccggcagcggattgctcaagtggcagcagggcttccgggccaagattccaggccttctgaaccagacaagcaggtcactggaccaaatcccgggctatctcaaccggatccacgagctgctcaatggaactagaggcctgttccctggtcccagtagacggaccttaggagctccagatatctcctccggaaccagcgataccggatcccttccgccgaacctgcaaccagggtatagccctagtcccactcaccctcccacaggacagtatacgttgtttccgctccccccaacattgcccactccagtagtgcagctgcacccactcttaccggacccgagtgccccaaccccaacacctactagccctctgttgaacacaagctacacccattcacaaaatttgagccaagaaggc

SEQ ID NO: 19971 - DNA, 1059 bp, Artificial Sequence
  Description of Artificial Sequence: Synthetic coding sequence
atggagctgaccgagctcctgctggtggtgatgctgctgctgaccgccagactgaccctcagctccccagcgcctcctgcttgcgatctcagagtgctgtctaaattgctgcgggattctcacgtgctgcactcccggctgtcgcagtgtcccgaggtgcacccgttgccaactccggtcctgctgcctgcagtcgacttctcccttggggagtggaaaacccaaatggaggaaactaaggctcaggacatcctcggcgcagttaccctgctcctggaaggcgtcatggccgccagaggacagctcggaccgacttgcctgtcatcgctgttgggacagctgtcaggtcaagtgcgcctcctcctgggcgcgctgcagtccttgcttggaacccagctcccaccccagggacgcacgaccgcccataaagatcccaatgcgattttcctttcttttcagcacctgctgcgcggaaaggtgagatttctcatgctcgtgggaggatccactctgtgcgtgcgtcgcgcccctccgactactgcggtgccgtcgaggacgtcgctggtgctcactctcaacgaacttcctaataggactagcggactcctggagactaacttcactgcctccgcgcgcaccaccggtagcggcttgctgaagtggcagcagggattccgggctaagatacctggcctcttgaaccagacttcgagatcattggaccagatcccggggtacctcaatcgcatccatgagctcctcaacggaacgcggggactgtttccggggccatccagaaggactctgggagcaccagatatctcatcaggaacgtcggatactggatccctgccgccgaacctgcagccgggatactccccatcaccaactcacccgccgactggacaatatactctgttcccgctccccccgacccttccgaccccagtggtccagttgcacccgctcctgccggacccttccgctccaacccccaccccgacctcgccccttctgaatacgtcgtacacccacagccaaaacctttcccaggagggc

SEQ ID NO: 19972 - DNA, 1059 bp, Artificial Sequence
  Description of Artificial Sequence: Synthetic coding sequence
atggagctcacagagctgttactggtggtgatgttgttgcttaccgctcgtctcacattatcctcaccggcgcccccagcttgcgacttgcgggttctatctaaactgcttagagatagccatgttttacactcacgactttcacagtgtcctgaagtgcacccactgcctacgcccgtgctgctgccggctgtcgattttagcctcggtgaatggaagacccagatggaggaaactaaagctcaggacatcttgggcgccgtcaccttgttattagaaggtgtcatggccgctcggggccagctggggccaacctgcttaagctctttgttgggacaattgtccggacaagtccggcttctgctgggagctctacagagtctcttggggacacagctacctcctcagggcaggaccactgctcacaaggatcccaatgccatcttccttagttttcaacaccttttacgaggaaaggttcggttcctgatgcttgtgggagggtcaacgctttgcgtgagacgcgccccccccactaccgctgtgccctcacgaacaagtttggttctgacgctaaacgaattgcctaaccggacgtctgggctgctcgagacgaatttcactgcttccgcccgcactacaggcagtggcctgctaaaatggcagcaagggttccgtgctaaaataccaggcctgttgaatcagaccagcagaagtctggaccagatacctgggtacctcaataggatccacgagcttctgaatggcactcgaggactttttcccggtccatctcggcgcacactgggggctccagacataagttcaggcactagcgatacgggcagtctgcctcccaatttgcagccaggttacagtcctagccccacccacccgccaaccgggcagtatactctgttccccctccccccaaccctccctacacctgttgtgcaactgcatcccctattacctgacccctccgcacctacacccacccctaccagtccgttgctgaacacctcatacacccacagccagaacctgagccaagagggt

SEQ ID NO: 19973 - DNA, 1059 bp, Artificial Sequence
  Description of Artificial Sequence: Synthetic coding sequence
atggaacttaccgaactgcttttggttgtcatgttgctgttgaccgcaaggctgactctgtcctctcccgcacctcccgcatgcgacctccgtgtactctctaagctgctgagagacagtcacgtgctccactcaaggctgtctcagtgcccagaggtccatccactgcccactcccgtcctcctcccagcagtggatttcagcctcggagaatggaaaacccagatggaagagactaaggctcaggatattctgggtgcagtaactttgcttcttgaaggagttatggctgccagaggccagctcggaccaacctgccttagcagcctcttgggacagctgtccggtcaggtaagactcctgcttggcgcactccagtcccttttgggcacccaattgccccctcagggacgcactacagcacacaaggatccaaatgccatctttctcagtttccagcatctgcttaggggaaaggtccgcttcttgatgctcgtgggcggatctaccctttgcgtgaggagagcacctcctactactgctgttccatccagaaccagtttggtgctcactttgaacgagctccccaaccgtacttctggtcttctggaaaccaatttcactgcctcagctcgcactactggttccggcctgctgaagtggcagcaaggatttcgcgctaagatccccggactcctcaaccagactagccgtagtcttgaccagatcccaggatatcttaaccgcatccatgagcttttgaacggaacacgcggtttgttcccaggacccagcaggaggaccctgggtgcacctgacattagttcaggcactagtgacaccggtagtctgcctcctaaccttcagccaggttattctccttcacccacccaccccccaactggtcagtatactctcttccctctgcctcctacacttccaacacccgtcgtgcaattgcacccccttcttcctgacccatcagcacctacacctactcccacttcccccttgttgaacacctcctacacccattcccagaacctttctcaagagggc

SEQ ID NO: 19974 - DNA, 1059 bp, Artificial Sequence
  Description of Artificial Sequence: Synthetic coding sequence
atggaactgaccgagctcctgctggtggtcatgctgctactgacggcccgattgacactgtcaagtccagcccctccagcctgcgatctgcgcgttctctctaagctgctcagagattcccacgtgctgcactctagactctcccagtgtcctgaggtccatcccttacccacaccggtgctcttacctgcagtggactttagccttggagagtggaaaacccagatggaggagaccaaggcacaggatatcttgggcgccgtgacattgctattggagggggtaatggctgcccgtggccaactaggacccacttgcctgtctagcctacttgggcaactttccggtcaggttaggctccttcttggggccctacagtctttactgggtacacagcttcctcctcagggacgcaccacggcccataaggacccaaacgcgatcttcctgtcctttcagcatctgcttcggggaaaagtgcgctttttaatgttggtgggcgggtctaccttgtgtgttcgtcgtgcccctccaaccacagctgtgccatctagaacttctctggtgttgaccctcaatgaacttccgaatcgaacgtctgggctcctggagactaacttcactgcaagtgcaaggaccaccggcagtggcctactgaaatggcagcagggcttcagagctaagatccccggtttactgaaccaaacatccaggtccctggaccaaattcctggctacctaaaccgcatccacgagctgctgaacgggaccaggggactgttccctgggccatcgcggcgcaccctcggtgcgcccgatatcagtagtggcacttctgacacaggctccctgccccctaacctgcagcctggctacagtccgtctcccacacaccccccaactggacagtatacactgttcccgctgcctccaaccctgccaacccctgttgtgcagctgcaccctctactccctgacccaagcgccccgactcccacaccaacctcgcccttgctgaatacgtcttacactcattcacagaacttaagccaagagggg

SEQ ID NO: 19975 - DNA, 1059 bp, Artificial Sequence
  Description of Artificial Sequence: Synthetic coding sequence
atggagctaactgaattactgctggtcgtcatgcttctcctgacagcccgcttgacgcttagttcaccagcgccacccgcatgtgacctgcgggtcctgagtaagttgctacgcgacagtcacgtgttgcactcaaggctgagtcagtgccctgaggtgcatcctctgcctacgccagtcctgctgccagccgtagacttcagtctgggggaatggaaaacacagatggaggaaaccaaggcccaggatatcctgggagcagttactctgctcctcgagggagtcatggccgcccgggggcagcttgggccaacttgcctatcgagtctgcttggccaactttcaggtcaagtgcgactgctattgggggctcttcagtcactcctgggaactcagctcccccctcaaggcaggacaaccgcccacaaggaccccaatgcgattttcctgagcttccagcacttgctcaggggtaaggtgcgcttcctcatgctcgttggagggtccactctctgtgtgaggagagcaccaccaactaccgctgtgccttctcgcacttctctggtgctcaccttaaacgagctgcccaacagaactagcggcctgctcgaaaccaatttcacagcctctgcacgcaccactggttctggcctcttaaagtggcagcagggctttagagcaaaaatccctggcctattgaatcagaccagtagatctctggatcagatcccaggttacctcaatagaattcatgaactcctcaatgggacccgtggcctgttccctggacctagtagaaggactctgggtgcacctgatatatctagtggaacaagcgacacagggagcctgcctcctaatctgcagcccgggtattccccatcccctactcaccctcccaccggtcagtacacactgttcccattgcccccgactctcccaaccccggtggtccagctgcatccactactacccgaccccagcgccccgacacccaccccaacaagcccattgttgaacacttcatacacgcactcacaaaatctctcccaggaagga

SEQ ID NO: 19976 - DNA, 1059 bp, Artificial Sequence
  Description of Artificial Sequence: Synthetic coding sequence
atggagcttacggaactgctgctggtcgttatgctgcttctgactgctcggttgactttgtcaagcccggcacccccggcctgcgacctgagggtattaagcaagctcctcagggattctcacgtgctgcatagccggctgtctcaatgccctgaggtgcacccacttcctactccggtattgcttcccgccgtggatttctctcttggagagtggaaaacacaaatggaggaaacaaaagcccaggatatccttggtgctgtgacactccttctggagggcgtgatggcggcccgggggcagctgggccctacttgcctgtccagcctgctgggacagctgagcggccaggtgaggctgctgctgggcgctctccagtccctcttaggcacacagttaccgccacagggaaggaccaccgctcacaaagatccaaacgcaatttttctgtcttttcagcatctgttaagagggaaggtgagatttctgatgctggttggtgggagcacactctgtgtgagaagggcccccccaacaacagccgtgcccagccgcacctccttggtactgacgctcaacgaacttcccaaccgaacctctggactacttgagaccaatttcactgcctccgcaaggacaaccgggagcggtctgctgaagtggcagcagggttttagagcaaaaattcccgggctgctgaaccagacgagtcgttcgctcgaccagattccaggatacctgaaccgaatacatgagcttctgaatggcacacgcgggttgtttcccgggccctccagacgtacgcttggtgcccctgacatcagttccggtaccagcgatacaggtagtctgcccccaaacctacagcccgggtactcaccttctccgacccatccccctacaggccaatataccctgtttcctcttcctcctaccctgccaacacccgttgtgcagctgcacccccttttaccagatcccagcgcaccaaccccgactcccacctcacctctgctcaacacgagctatacacattctcaaaacttatcacaggaaggc

SEQ ID NO: 19977 - DNA, 1059 bp, Artificial Sequence
  Description of Artificial Sequence: Synthetic coding sequence
atggagcttactgaattattactcgtagtgatgcttcttctaactgcacgtcttaccctttcttctcctgctcctccggcttgcgatcttagagttctttctaaacttctccgagattcacacgtgttgcattctcgtcttagccaatgcccagaagtgcatcctcttcccactccagtgctgttgccagccgttgatttctcactaggtgaatggaagacacaaatggaagagactaaggcacaagatatcctaggtgccgttactcttctccttgaaggtgtgatggcagctcgagggcaactcggaccaacttgcttgtctagtctccttgggcaactctctggccaggtccggttactgttgggtgcacttcagtccctccttgggacacagttgcctcctcaaggtaggactacagcccataaagatccaaacgcaatttttcttagcttccaacacctcctgagggggaaggttcgctttcttatgttagttggtgggagtacactctgcgttaggagagcaccacccactactgctgtgccttctcgtacatcattagttctgactctaaatgagttgcctaacaggacttctggattgttggagactaactttacagcttccgcaagaactactggttcgggtttgcttaagtggcaacagggatttagggcaaagattcctggtcttctcaaccagacttccaggtctcttgatcagatccctggatatctaaatcggatccatgaattgctcaacggcactaggggtctgtttcctggaccatctcggaggactttgggtgctcctgatatcagtagtgggacgtcggacactggtagtctccccccaaatctgcagccggggtatagcccaagtccaacccacccgcctacaggtcaatatacattgtttcctcttccgcctacattaccaactccagttgtccagcttcatcctctacttcctgatccatccgctcctacacccacccccaccagcccgctcttaaatacctcttacacccattcacagaatttatcacaggaagga

SEQ ID NO: 19978 - DNA, 1059 bp, Artificial Sequence
  Description of Artificial Sequence: Synthetic coding sequence
atggagctcaccgaactcctgctcgttgtgatgctgcttctgacggcccggctgacccttagctcgcccgcgccaccagcctgcgacttgagggtgttgtcgaagctcttgcgcgattctcatgtgctgcactcgcggctctcgcagtgtccagaagtgcacccgctcccgaccccggtcctccttcctgcggtggacttctccctgggagaatggaaaacccaaatggaggaaaccaaggcccaggacattctgggggctgtgaccctgctgctcgaaggagtgatggcagcacggggacagctcggccccacctgcctgtcatccctgctgggacaactctcagggcaggtgagactgctcctgggtgcactgcagtcactcctcggaacccagctgcctccgcagggtcgcaccactgcccacaaggatccgaacgcgatcttcctgagctttcagcacctgttgcgggggaaggtgcgctttctgatgctggtgggcggatcgaccctttgcgtccggcgcgccccacctaccactgctgtccctagccgcacctcgctcgtcctgaccctgaatgaacttccgaacaggacctcgggcctgctcgagacgaacttcaccgctagcgcacgcactactggatccgggctcttgaagtggcagcaaggtttccgagcgaaaatccctggactgttgaaccaaacgtccagatcgctggaccagatccctggctacctgaacagaatccatgagctgctcaacggcacgagaggcctgttcccgggaccgtcccggcgcactctgggagcccccgacatctcctcaggtacctcagatactggatctctgcccccaaatctccaacccggctacagcccgtccccgactcatccaccaactggacaatacaccctgttccctctgccgccaactctgccaactccggtggtccaactccatccgttgcttccggatccaagcgcccctaccccgactccgacttccccgcttctgaatactagttacactcactcgcagaatctgagccaggaggga

SEQ ID NO: 19979 - DNA, 1059 bp, Artificial Sequence
  Description of Artificial Sequence: Synthetic coding sequence
atggagctgactgagctgctcttggtcgttatgctgctgctcactgcccgtctgacattgtcatcgcctgcacctccagcctgcgacttgcgcgtgctttctaaactgctccgagattcacatgtactccattctcggctttctcagtgtcccgaagttcaccctctgccaactccagtgttgcttcctgcagtggatttctcacttggtgagtggaaaacacagatggaggaaactaaggcgcaggatatcctgggcgctgtaacccttttactggaaggagtgatggcggctcgcggccagctagggcctacttgtctgtcttcactgctgggccagctcagtggccaggttaggctgctgctgggagctctccaaagtctccttggtacccagttacccccacagggcaggaccacagcccataaggacccgaatgctattttcctaagtttccagcatctcctgcggggcaaagtgaggttcctgatgctggtaggaggctctacactgtgtgtacgccgcgccccacctactaccgctgtgccatcacgtacctcgctggttcttactctgaacgaactgcccaatcggaccagcggactgttggagactaattttaccgccagcgcacgaactactggctctggattgttgaagtggcagcagggtttcagggcaaagattcccggcctgctgaaccagacgagtcgtagtcttgatcaaattcctggatatcttaatcgcattcacgagctacttaatgggacccgcggtctgtttccaggcccttcgcggcggacgttaggcgctcccgacattagttccggtacatccgataccgggagcctccctccaaatttgcaacctggctatagtccatcccctacacacccccctacgggccaatatacgctctttcctctccctcccactttgcctacacctgtggtgcagctccatccactgcttcctgatcccagcgcacctacgcctacaccaactagccccttgcttaacaccagctatacgcacagccagaacctttctcaggaggga

SEQ ID NO: 19980 - DNA, 1059 bp, Artificial Sequence
  Description of Artificial Sequence: Synthetic coding sequence
atggagctcactgaactcttgctcgtagtcatgttgcttttgactgcccgcctcaccttgtcctcccccgcacccccagcatgcgatctgcgtgttctctccaagctcctgcgggattcgcacgtgctgcattcaagattgtcgcaatgccctgaagtccatccactgcctactcctgtgttgcttccagcagtggatttttcacttggtgaatggaaaacccagatggaggaaaccaaagcacaagacatacttggagccgtgactctgttgctcgaaggcgtcatggcagcgcgcggacaactcgggccaacctgcctgtcctcactgctcggacagctttccggacaggtgcggctgcttctcggagcccttcaatcacttctggggactcagctgccaccccaagggagaactaccgctcacaaggatccaaacgcgatatttctgtcgttccagcatcttctgcgagggaaagttcgatttctcatgctggtgggtggatcgaccctttgtgtgcgaagagcacctccaaccaccgctgtgcctagccgcaccagcctcgtcctgactcttaacgagcttcctaaccgaacttccggtctgctggaaacgaactttaccgctagcgcacggaccacgggatccgggcttcttaagtggcaacaaggctttcgggccaaaatccccggactgcttaatcaaactagcaggtcgcttgaccagattcctgggtacctgaatcgcatccacgaacttcttaacggaaccagagggcttttccctggtccttcccggaggactctgggagcgccagacatttcgagcggaacctccgatactggtagccttccacctaatctgcagccaggatacagccctagccctacccacccacccaccggtcaatacactctgtttcctctgcctcctactctgccaaccccagtggtgcaattgcatccactgcttccagacccatcagcacctactccgactcctacttcgcctctgctgaacactagctacacccactcccagaatctgtcccaggaggga

SEQ ID NO: 19981 - DNA, 1059 bp, Artificial Sequence
  Description of Artificial Sequence: Synthetic coding sequence
atggaattgacagagctgcttctggtcgtcatgctgcttctgaccgcccgacttaccctcagctcgcccgccccacccgcgtgcgacttgagggttttaagcaaactgctgagggacagccacgtcctgcactcgagactgtcccaatgcccagaagtgcatccgctccccacacctgttctgctgcctgcggtcgacttctctcttggcgagtggaaaacacaaatggaggaaactaaagcacaggacattttgggtgcggtgacattgctcctggagggggtgatggcagctagaggccagcttggccctacctgcctgtcctctctgctgggccagctgtccgggcaagtacgtttactactgggagcgctacagtcactcctggggacccagctccccccccagggaaggactactgcccacaaggaccctaatgctatctttttgagttttcagcacctcttgaggggaaaagtcagattcctgatgttagtcgggggcagcacgctgtgtgtccggagagctccacccactaccgcggtgccttcccggactagcctggtgttgacattgaacgaactgccgaatcggacttctgggctgctagaaacgaatttcactgcaagtgctaggaccacaggatccggcctgctgaagtggcaacaggggttccgagccaaaatacccggcttgctgaaccagactagtaggagcctcgaccagatccccggctatctcaaccgcatccacgagcttctgaatgggacaagggggctgttccctggcccttcacgtaggaccctgggagctcctgacatttcgagtggcacgagcgacacaggtagcctgccccccaatttgcaacctgggtatagcccctcccctacacaccctcccacaggacagtataccctattccccttacctcccaccttacccactccagtggttcagttgcatcctctgctcccggatccaagtgcgcctactcctaccccaacctcccctctcttgaatacgagctacactcactcgcagaacctgtctcaggagggc

SEQ ID NO: 19982 - DNA, 1059 bp, Artificial Sequence
  Description of Artificial Sequence: Synthetic coding sequence
atggaattgaccgaactcctgcttgtggtcatgctgcttctcaccgcacggcttacccttagctctccggcacctccagcctgtgatctgcgagtgctgtcgaagctgctgcgagattcgcatgttctgcactcccgcctctcccagtgtccagaagtccatccactgcctacgccagtgcttctgcctgccgtggatttttcactgggggagtggaaaacccagatggaagaaactaaggcgcaagacattcttggcgcagtgaccctgctgctcgagggcgttatggccgcaagagggcaattgggccccacctgcctgtcatcactgctgggtcaactgtccggtcaagtcagactgctgctcggagcactgcagtcgctccttggtacccagttgcccccacaaggaaggactacggcccataaagacccaaatgctatcttcctttcgtttcagcacttgctgaggggcaaggtccgttttctcatgcttgtgggtggctcgactctttgtgtgagacgggcaccccccaccaccgcagtgccttcgcgtacttctctggtcctcactctgaatgagctcccaaataggacctccggattgctcgaaactaactttactgcatcggcccggaccactgggtcaggacttcttaagtggcagcagggattcagagccaagattccgggacttctgaaccagaccagcagatccctggaccagattcctggatatctgaaccggatacatgaactgctcaacgggacccgagggctcttccctggcccctcaaggcgcacgctgggagcccctgatatctccagcggtacttctgataccggatcccttcccccaaacctccaaccaggatactccccttcccctacgcatccgccaactggccaatacaccttgtttccactgccacctactcttcctacccctgtggtgcaattgcatccactgttgcctgacccctccgctccgacccctactccaactagccctcttctgaatacttcatatacccactcgcaaaatcttagccaagagggc

SEQ ID NO: 19983 - DNA, 1059 bp, Artificial Sequence
  Description of Artificial Sequence: Synthetic coding sequence
atggaacttactgaattattattagttgttatgttattattaacagccagacttactcttagttcaccagcaccaccagcttgtgatcttagggttttaagtaaattacttagagattctcatgtgcttcattcacgtttatcacaatgtccagaagtacatccacttccaactccagtcttattaccagctgtagatttctcccttggagaatggaagacacaaatggaagaaacaaaagcacaagatattttaggagcagttactcttttgttagaaggtgttatggctgctagaggacaattaggaccaacatgtttgtcttctctattaggacagttatctggtcaagttcgacttttattaggagctttacaatcattgttaggaacacaattaccaccacagggacgaactacagctcataaagacccaaatgctatttttttatcatttcaacatcttttaagaggtaaggtcagatttcttatgcttgtaggagggtcaacattatgtgttagaagagcaccacctactaccgcagtaccatcacgaacatcattagttttaacacttaacgaacttccaaacagaacctctggattgttagaaactaatttcactgcatcagcaagaactacaggatctggattacttaaatggcaacaaggatttcgtgcaaaaattccaggattgcttaatcaaaccagtcgttctttagaccaaataccaggttatttaaatagaattcacgaacttttaaacggaactagaggtttatttccaggaccatctagaagaacacttggtgcaccagatattagttcaggaacatcagatacaggtagtttgccaccaaatcttcaaccaggttattctccatcaccaacacacccaccaacaggacaatacacattatttccactaccaccaacacttccaacacctgttgtacaacttcatcctcttttaccagacccttcagcaccaactccaacaccaacatcaccattgttaaatacatcatatacacattctcaaaatttatcacaagaagga

SEQ ID NO: 19984 - DNA, 1059 bp, Artificial Sequence
  Description of Artificial Sequence: Synthetic coding sequence
atggaattaactgaactgctgctagtcgtgatgctgctgctgaccgcaagactgaccctgtcctctccagcccctccagcctgtgatttaagagtgctatccaaactgctgcgggattctcacgtgctgcactcacggctgtctcaatgcccagaagttcacccattaccaaccccagttctgctgccagctgttgatttcagcctgggagagtggaagacccagatggaagaaacaaaggctcaggatattctcggagccgtgactctattactggagggggtgatggctgctcgtggccaactaggaccaacatgtctgagctccctgttgggccagctctccggccaggttcgcttactactgggcgcactgcaaagcttgcttggcacacagctaccccctcagggtaggactaccgctcataaggacccaaatgctatctttctgtccttccagcatttactgagggggaaggttcggtttctgatgctcgttggtggcagcacactgtgcgtcaggagagctccaccaactactgccgtgcctagcagaacttctttggtcttgacattaaatgaattaccaaaccggaccagtggcctgctggagaccaatttcaccgcctctgccaggaccactggatctgggctgttaaagtggcagcagggcttcagggctaagatacccggactattgaaccaaaccagccgctccctggaccagataccagggtatctgaatcggatacacgaactgctgaacggcacacggggcctgttccctggaccaagtcgccgtactctgggggccccagacattagcagtggaaccagtgacaccggttccctacccccaaatctgcagccaggctatagcccaagccccacccaccctccaacaggccaatacacactgtttcccctcccccccacactcccaaccccagtggtgcagctgcaccctctgctgcccgacccttcagcaccaacccctacaccaacatcccctctgttgaacacttcctacacccattctcaaaacctgtcacaggagggc

SEQ ID NO: 19985 - DNA, 1059 bp, Artificial Sequence
  Description of Artificial Sequence: Synthetic coding sequence
atggagctgactgaactccttctcgttgtcatgctactgcttacagcacgacttaccttgtccagtcccgcgccaccagcctgtgatctgagagttctgtccaaactgcttcgagacagccatgtcctccactctcgactgagtcagtgccctgaggttcacccgctcccgacacctgtcctgctcccagctgtggattttagcctaggagagtggaagacccagatggaagagaccaaggctcaggatattctgggcgccgtgacccttctcttagaaggggttatggcagccagaggccagttgggaccaacctgtctctctagcttgttggggcaactgtctggacaggttaggctcctgctaggtgctcttcagtccctcctggggacacagctacccccacaagggagaacaaccgcccataaggatccaaatgccatcttcctcagtttccagcacctgctgagggggaaggtacgctttttgatgctcgtcggtgggtccaccttgtgcgtgcgaagagcgcctcctactactgctgtcccctctcgaacatctctggtgctcaccctcaatgagttacccaatagaacctccggtttgctcgagacaaattttacagcctcagctcggactacaggttccgggctgcttaaatggcagcaggggttcagggcaaaaataccaggtttgctgaatcagactagtcgatccctggaccagatacccgggtatctcaatagaatccacgaattgctgaacggtacccgaggtctctttcccggcccaagtcgacgcacactgggggccccagacatatctagtggcaccagtgacaccggctcccttcctcctaacctccagccgggatattccccctcacccacacaccctccgacaggccaatacaccttatttcctttacctccgactcttcctacgccagtggttcagctgcacccgttactgccagaccccagtgctcccacccccactcccacctccccactcttgaatacatcctacacacactcacagaatctgtcccaggaaggg

SEQ ID NO: 19986 - DNA, 1059 bp, Artificial Sequence
  Description of Artificial Sequence: Synthetic coding sequence
atggaactgacagagttactcctggtggtgatgctgcttttaaccgctcgtctgacgctgagctcaccagccccccccgcctgcgacttgcgtgttctctccaagctgttgagggattctcacgttcttcacagtcgactgtctcaatgtcctgaagttcatcccctgccaacccccgtgctcttgccggcagtggattttagcttaggcgaatggaaaactcagatggaagagaccaaagcacaggatatcttgggcgcagtaacccttctgcttgaaggtgtcatggccgcgaggggccagctggggcccacttgcctttcctccctgttagggcaactgtctggtcaggtcagactgctgttgggggcactccaaagtctcctgggaacgcagttacctcctcaaggccgaactacggcccataaagatcctaacgccatattcctttcattccaacacttgctgaggggaaaggtccggttcctgatgctggtggggggttcgaccctttgtgtcagacgtgctcccccaactactgccgtaccctctaggacatcacttgtgcttacactgaacgaactccccaatagaacgagtggcctgcttgagactaacttcacagcgtcggcccgaaccaccggatccggactcctaaagtggcagcagggtttcagggctaaaattccgggtctcctcaatcagacatcgcgcagcctagaccagataccaggatatctcaaccggatccacgaattgctgaacggcacccgcgggctgttccccggaccttccagaaggacactcggcgcgccggacatatccagtggtacctctgacaccggcagccttcccccaaatctgcaacctggctattccccatctcccacgcatcctcccaccggacagtatacactctttccgctcccacccaccttgccaacgccagtggtccaactgcaccccctactacctgatccttctgctccaacacctacccctaccagccccctactgaatacatcgtacacccattcacaaaatttgagtcaggaaggt

SEQ ID NO: 19987 - DNA, 1059 bp, Artificial Sequence
  Description of Artificial Sequence: Synthetic coding sequence
atggagctgaccgaactgttgctcgtcgttatgctgctcctcacggcgcggctgaccttgtcctcgccggctccgccggcgtgcgatcttcgcgtgctctcgaagctgctccgcgattcccatgtgcttcattccaggctgtcgcaatgccctgaggtgcacccactgccgacgcccgtgctccttcctgcggtcgacttttctttgggggaatggaaaactcaaatggaggagactaaagctcaggatatactcggagccgtgactctgctccttgaaggtgtgatggccgcacgcggccagctcggccccacctgcctttcctcactgctgggacagttgagcgggcaagtccggctgttgcttggagccttgcagtcattgctcggtactcaactgccaccacagggccgcaccacggcacacaaggatcctaacgcaatcttcctgtcgttccagcacctcctgagaggaaaggtccggtttctgatgctggtcgggggatccactctgtgtgtcagacgggctccgccaaccaccgcagtgcctagtcggacgagcctcgtgttgaccctgaacgaactgccgaatagaacctcaggactgttggaaaccaacttcacggccagcgcccgcactaccggatcaggcctcctgaagtggcaacagggtttccgagccaagattcctgggctgttgaatcagacctcacggtcgctcgaccagatccctgggtacctcaacagaatccatgaactgctcaatggcaccagaggactcttccctggaccctcccgtaggaccctgggtgcgccggacatttcgagtggaacctccgacactggtagccttccgccgaacctgcaaccggggtacagcccaagcccgactcatcccccaactggccaatacaccctgttcccacttccgcctactcttcctactccagtggtgcagctccaccccctgctgcctgacccctcggcaccgaccccaactccaaccagtccgctccttaacacctcgtacacccactcgcagaatctgtcacaggaggga

SEQ ID NO: 19988 - DNA, 1059 bp, Artificial Sequence
  Description of Artificial Sequence: Synthetic coding sequence
atggaattgaccgaactcctgctggtggtgatgctgctgctcactgctcggttgaccctgagctcgccagccccgccagcttgcgacttgcgggtcctgtcaaagctgctccgcgactcgcacgttttgcatagtcggttgtcgcaatgcccagaagtgcacccgttgccgactccggttctgctcccggcggttgattttagcctcggcgagtggaaaactcagatggaagagactaaggcccaagacatcctgggagcagtgaccctcctgcttgagggagtgatggcggccagggggcagctgggaccgacgtgcctgagctcccttttgggacaactgtccggacaagtgagacttctcctgggggcacttcagagcctgctcggaacccaactgccacctcagggacggaccaccgcccataaagacccaaacgctattttcctttcattccaacacctccttcggggtaaggtcagattccttatgctggtcggaggctcaactctctgcgtgagacgggcaccacctactactgctgtgccctcgcgaaccagcctggtgttgactctgaatgaactgccgaaccgcacttcgggcctgctggaaaccaatttcaccgcctcggcacgcactactgggtcgggacttctgaagtggcagcagggatttcgcgccaagatccctggtctgctgaaccaaaccagcagaagcctcgaccagatcccgggatacttgaaccggatccacgaactgctgaatggtaccagaggactgtttccaggaccgtcacggcgcactctgggtgcgccagatatctcctccggaacttcagatacgggaagccttccgccgaacctgcagccaggatactcgccttctccaactcatccgccaaccggtcaatatactttgttccccctgccgcccactctgccgaccccggtggtgcagttgcacccccttctgccagatccgtcggcgccaactccaaccccgacctccccgttgttgaacacctcctacactcacagccagaatctgtctcaagaggga

SEQ ID NO: 19989 - DNA, 1059 bp, Artificial Sequence
  Description of Artificial Sequence: Synthetic coding sequence
atggagctgacggagctgctgcttgtggtgatgctccttttgacagccagacttaccctgtcatcacctgccccaccagcctgcgacctgagggtgctgtctaaacttctcagggactctcacgtcctgcacagcaggttgtcacagtgtcccgaagttcaccccctgcccacacccgtgcttcttccagcagtggatttcagtttgggcgagtggaagacccagatggaagagaccaaagcacaggacattctgggtgcagttacactcctgctggaaggtgtcatggcggctcgaggacagctggggcctacctgcttgagttccttgctcggccagctgtcaggccaggtgcgcctgctgctgggggccctgcaaagtctgcttgggacccagttgcctcctcaggggagaaccacagcccacaaggaccctaacgctatttttttgagtttccagcatctgctgcggggtaaggtgcggtttctcatgctggtcggagggtccacgctctgcgtcagaagagcccccccgacaacagccgtcccatccaggacatccttggttcttactctgaatgagctgcctaacaggacttccgggctgttggagacgaatttcacggcatccgccaggacaacagggagtgggttgctgaagtggcagcaggggtttcgggcaaaaatccccgggctgctcaatcagacatcaagaagcctcgatcaaatccccggatatctgaatagaatccatgagttgctcaatggcacgaggggtctgttccccggcccctcccggaggactctgggagcccctgatatttccagcggcacatccgatacagggagcctgccgccgaatctgcagccaggttacagcccgagcccgactcaccctccaaccgggcagtacacactgttccccctgccaccgacgttgcccacacccgtggttcaattgcacccacttttgccagaccctagcgctccaacaccgacacctacttctccgctgctgaataccagctacacccattctcagaacctttcccaagagggc

SEQ ID NO: 19990 - DNA, 1059 bp, Artificial Sequence
  Description of Artificial Sequence: Synthetic coding sequence
atggaactgactgaactgcttcttgtcgtgatgctgcttctgactgcgcgcctgactctgtcatcgccagcaccgccagcttgcgatctgcgggtcctgtccaagctgctgcgcgattcacatgtgctgcactcgcgcctgtcccaatgtcctgaagtgcatccgctgccgaccccggtcttgctgccagcagtcgatttctcactgggagaatggaaaacccagatggaagaaactaaggctcaggacatcctgggggcggtgactctgttgctcgagggcgtcatggctgcgagaggacaactggggccgacgtgcctcagctcactcctcgggcagctctcgggtcaggtgcgcctgctccttggagccctccagtcgctcctgggcacccagctccctccacaaggccgcaccacggctcataaggatccgaacgccatctttctgtccttccaacacttgctgcggggaaaagtgaggttcctgatgctggtgggcggcagcacgctgtgcgtcagacgcgcgccccctacgaccgcggtcccttcaaggactagcttggtgctgactctcaatgaactgccgaaccggacctctggactgttggaaacgaacttcaccgcgagcgcacgcactaccggctcgggcctccttaagtggcagcaaggattccgcgctaagattcctggcctgctgaaccagacctcacgcagcctggaccagatcccggggtacctcaatagaatccacgaactgctcaacgggactcggggactgtttccaggaccgtcccgccggactctcggagcaccagatatctcctcggggacttccgatactggttcgctgccccctaacttgcaaccaggctactcgccgtcgccaactcatccgccaaccggacaatacactttgtttccgcttccaccaaccctgccgacccctgtggtgcaactgcaccctctgttgccggacccgagcgctccgacgccgacccctactagcccgctgctcaatacttcctacactcactcacagaacctgtcgcaggaggga

SEQ ID NO: 19991 - DNA, 1059 bp, Artificial Sequence
  Description of Artificial Sequence: Synthetic coding sequence
atggaactcacagagctgttgttggtcgtgatgctgctactgacagccagactaacattatcctcacccgcccctcccgcctgcgatttgcgagtgctgagtaagctcctgcgggatagccacgtgctccattcccgtcttagccagtgtcctgaggttcaccccctgcctactccagtgctactgccagctgtagactttagccttggagaatggaaaacccagatggaggaaacgaaggcccaagacatcctcggagctgtgacattattgctcgaaggcgtgatggcggcaagggggcagctgggtcctacttgcctgtctagccttctcggccagttatcaggccaggtgcgcctcctgctaggtgctctccaatccctcttgggaacacaattgccacctcagggcagaaccaccgcccacaaggatcccaatgctatcttcctgtcctttcagcacctgctgcgggggaaagtgcgattcctgatgctcgtcggaggatccactctctgtgtaagacgcgccccaccaaccactgctgtgccaagccgcacatccctggtgctgacactgaacgaattgcctaatcgcactagtggcctgctggagaccaacttcacagcatcagccagaacgaccggtagcggcttgctcaagtggcaacagggattccgggctaaaatccctgggcttctgaatcaaactagtagaagtctcgatcagatccctggctatctgaataggatccacgagcttctaaacggaactcgcgggctctttcccgggccttccagaaggacactgggcgctcccgacatatctagcggtacctccgatactggctccctgccgcctaacctgcagcctgggtacagcccttcccctacccatcctcccaccggccagtatacactattccccctcccacccacactcccaacgcctgttgtgcagctgcaccccctcctgccggatccctccgctccaacacctacacctactagtccactcctgaacacatcatacacacactcgcagaacctatcccaggagggc

SEQ ID NO: 19992 - DNA, 1059 bp, Artificial Sequence
  Description of Artificial Sequence: Synthetic coding sequence
atggaattaaccgaactgctgttggtggtgatgctgctgttgacggctcgattgaccttgtcttccccagcgccacctgcctgtgacctccgagtattatccaaacttttgagagatagccatgtactccacagtcggctctcacagtgtccagaggtgcatccgctcccgactcccgtgctacttcctgccgtggatttcagcttgggggagtggaagacgcagatggaggagaccaaggcgcaggacatacttggcgctgtcaccttgttactggaaggcgtgatggctgcgcggggccagctgggcccaacatgcctatccagtctgctgggacagctgtctggccaggttcgccttctgttgggcgcactccaatctctgctcggaacacaattgcccccccagggcaggacaactgctcacaaggatccaaacgctattttcctaagctttcagcacctgctgagaggaaaggttaggttcctgatgctggtgggtggctcgaccctatgtgtgaggagggctccccctaccacagccgtaccctccagaacatctctggtgctgaccctaaacgagttgcccaatcggacctctggactgctcgaaactaattttacagcctccgctcgtaccactggttcgggacttctgaagtggcagcagggctttagagccaagataccaggattactcaatcagacttctcgaagcctggaccagatccctgggtacctgaatagaattcatgagctcctgaacggcactagaggtctgttccctggaccttctcgtcgtactctcggagccccggacatcagctccggtacgtccgataccggaagtctgccacctaatctccagccagggtattcaccgagccccacccatccccccactggtcagtacactctattccctctgccgcctaccctgccaacacctgtagttcagctgcaccctcttctccccgaccccagcgctcctaccccaacgcctacatctcccttgctgaacacctcatacactcactcccagaatttatcccaggagggt

SEQ ID NO: 19993 - DNA, 1059 bp, Artificial Sequence
  Description of Artificial Sequence: Synthetic coding sequence
atggaactgacggagctcctgctggtcgtgatgctgctcctcaccgcaagacttactcttagcagcccagcacctcctgcctgtgatttgagagtgctgtcgaagctgcttagagactctcatgtgcttcattcccggctgtcccaatgcccagaggtgcacccactgcctactccagttctccttcctgccgtggacttttcgctgggcgaatggaaaactcaaatggaggagactaaagcccaggatatactgggagcagttactcttttgctcgaaggggtcatggcagcccgcggtcaattgggacctacctgtctctcctcactccttggacaactttctggtcaagtgcgtttgcttctgggtgcactgcagtcgctgctgggtacgcagctgccgccacagggacgcactacggctcataaggatccaaacgccatcttcctgtcgtttcagcatcttcttcggggtaaggtgcgattccttatgcttgtgggtggttcaaccctgtgcgtgagaagggctcctccgactaccgccgtgcctagccgcactagcctggtgctgaccctgaacgaactgccaaatcggacttcgggacttttggaaaccaactttaccgccagcgccagaaccactggttcgggactgcttaagtggcagcagggttttcgagcaaagattcccggacttcttaaccaaacgtcgcgatcactcgaccagatccccgggtatctcaaccggatccatgaactgctgaatggcaccagggggctgtttcccggaccttcgagacggacgcttggagcacccgatatctctagcggcacttcggatactggaagcctgccacccaacctgcaaccaggctacagcccaagccccactcatccgccaactggacagtacactcttttccctctgcctcccactcttccaaccccagtggtgcaactgcatcctctgttgccagatccttccgcgccaacccctacccccacttccccactgcttaatacttcatatacgcactcacagaacctttcacaggaagga

SEQ ID NO: 19994 - DNA, 1059 bp, Artificial Sequence
  Description of Artificial Sequence: Synthetic coding sequence
atggaactgactgaactgctgctggtcgtcatgttgctgctgaccgctagattgaccttgtcaagtccggctcctcctgcctgtgaccttagggttctgtctaagctgctcagagacagccacgtccttcacagccgcttgagtcagtgtccagaggtccatcctctgcctacccctgttctgctccctgcagtcgactttagcttgggagagtggaagactcagatggaggagaccaaggctcaagacatcctgggcgctgtgacccttctcctcgaaggtgtgatggccgcaagagggcagttgggaccaacctgccttagttccttgctcggtcagctctcaggacaagtgaggctgctcttaggggcattgcagagtctcctcggaacacagcttccccctcagggacgcactacagcacacaaggatccgaacgccatcttcctgtcatttcagcaccttctcagaggtaaggtgaggttcctgatgctcgtcggagggagcaccctgtgcgtccgtcgcgctccacccactacagcagtaccaagtcggacgtctctggtgctgacactcaatgagttgcctaacaggaccagcggcttgttggaaaccaattttaccgcttcagctcgcacaaccggctcaggattgcttaaatggcaacagggtttcagggcaaagatcccaggactgttgaaccagacctcacggtccctcgaccaaatccctgggtacttgaacaggattcacgaactgctgaacggcacccgtggtctgttccctggcccatcccggaggacgctaggagcacccgatatcagcagtggcacttctgatacaggatcgctgccacccaaccttcaacccggttacagcccttctccaacccaccctccaactggacagtacacactgtttccacttccacctacccttccaacaccagtcgtccagctgcaccccttgttgccagatcccagcgctcctacccccacgccgacctctcctttgttgaatacaagctacacccatagccaaaacttatctcaagagggg

SEQ ID NO: 19995 - DNA, 1059 bp, Artificial Sequence
  Description of Artificial Sequence: Synthetic coding sequence
atggaattaacggagttactgcttgttgtgatgcttctcctgaccgcacgactgacgctgtctagtccggcacccccagcttgcgatttgcgtgtcctcagcaagctcctccgtgatagtcatgttcttcactctcgtttatcacagtgcccagaggttcacccactgccgacccccgtgctcctgccagccgtagacttttcattgggtgagtggaaaactcaaatggaagaaaccaaagctcaagatattcttggagcagtaactcttctgttagaaggagtgatggcagcaagaggacaactcggacctacatgtttatcttcactccttggccaattgtcaggtcaagtgaggctccttttaggcgctcttcaaagtcttctgggaacacagcttcccccgcaaggacgtactactgcacacaaggacccaaatgcaatcttcttgagctttcaacatttattgcgaggaaaagttcgatttttgatgctagtcggtggaagtaccctctgtgttcgacgggctccaccaaccacagcggttccgagccgtacttcacttgttctcaccttgaatgaactgccaaataggacctcaggacttttggaaacgaattttacagccagtgcccgaacaactggttcgggcctgttgaaatggcagcaaggattccgcgctaaaatcccagggcttctcaaccaaacgagtcgcagtcttgatcaaatcccaggatatctcaatcgcatccacgaactgcttaatggaacgagaggattatttccaggaccgagtcgaagaactttgggagcaccggatatatcctctgggacttctgacaccggatcccttccgcctaatttacagccaggatatagtccgagtccaacacacccaccaacaggccaatatacccttttccctttaccaccaacattgccaactcctgttgtgcaattgcacccacttcttccagatccttccgctccaactcctacaccaacatcaccactgttgaatacttcttacacacactctcagaatctcagtcaagaagga

SEQ ID NO: 19996 - DNA, 1059 bp, Artificial Sequence
  Description of Artificial Sequence: Synthetic coding sequence
atggagctgaccgagctactattagtggtgatgttgctcctgacggcccgtctgacactcagctcccccgctccccctgcctgtgatctgagagtactcagcaagcttctgcgggactcgcacgtgctgcactcgcggctttcccaatgcccagaggtgcacccgctgcctacaccagtgctgctgcccgccgtcgatttctctttgggcgaatggaaaacgcaaatggaagaaacaaaagcacaagacatcctgggagccgtgaccctgcttctcgagggggtgatggctgcccgcggacagctggggccgacctgcctatcaagcctactgggccagctgtcaggtcaggtccgcctgctgctgggagccttgcagagtctgctcggaacccagctgccaccacaaggacggacgacagcccataaagacccgaacgcaatatttttgagtttccaacacctgctgcgcggcaaagttaggttcctgatgctagtaggcggtagtactctgtgtgtcaggcgcgcccctcctactacagcggtccccagccgaaccagcttggtgctaaccctgaatgagctccctaacaggacttccggactgcttgagactaatttcactgctagtgcacgtacgactggctcaggattgctgaagtggcagcagggatttagggctaaaatcccaggactgttgaaccagacaagtcgctctcttgaccagatccccggctacctgaataggattcatgaattactgaacggtacccggggactgttccccgggccatccagacgcacccttggagcaccagacataagcagcggaactagtgacacaggatctctgcctcctaatctccagcctggctattcccctagtccgacgcacccccctacgggtcagtacactcttttcccactgccgcccactctgccgacaccagttgtccagctacatccattacttcccgacccatcagccccaactccgacccccacctctcctctgctgaacacctcatatactcacagtcagaatctgtctcaggaaggc

SEQ ID NO: 19997 - DNA, 1059 bp, Artificial Sequence
  Description of Artificial Sequence: Synthetic coding sequence
atggagcttaccgagctgttgctggttgtgatgttgctgctcactgcccgactgacactgtcttcgcctgcccctccggcgtgtgacctgcgtgtgctgtcgaagctgttgagagactcccacgtgcttcactcaagacttagccaatgtccggaagtccaccccttgccgacgccggtcttgctccctgcggtagacttctcacttggtgagtggaagacccagatggaggaaacaaaagcacaggatattctgggcgcggtgacgctgctgcttgagggcgtaatggcagctcgcggtcagctgggtccgacatgcctgtctagcctgctgggtcagctgagcggtcaggtgagactgctgctcggcgccctgcagtccttgctgggtacccaactaccgcctcaaggtcgaacgaccgctcacaaagatcctaacgctatcttcctgtccttccagcaccttctgcgcggtaaagttcgatttctgatgttggtcggcggcagcacgctgtgcgttcgccgtgcgccgcctaccactgcagtgcccagtcgcacgagcctagtgttgactctgaatgagctgcctaaccgcacttctggcctgttagaaactaactttaccgcctctgcgcgtacgacgggtagcggtctgctgaagtggcagcaaggctttcgcgctaagatccctggtctgttgaaccagacaagccggtcgctggatcaaattcctggttatttgaatcgaattcacgaattactgaatggtacgcgcggcttattccccggccctagtcgccgcaccctgggagcaccagacatctctagcgggaccagcgataccggcagcctgcccccgaacttgcagccaggatatagcccctctcctacccacccaccgaccggtcagtacaccttgtttccactgcctcccactctgccgaccccagttgtgcagctgcacccgctgctgccagaccctagcgcacctactccaaccccgacctcaccattgctgaataccagttacactcatagccagaatctctctcaggaaggc

SEQ ID NO: 19998 - DNA, 1059 bp, Artificial Sequence
  Description of Artificial Sequence: Synthetic coding sequence
atggagctgactgaactcctgttggtggtgatgctgctccttactgctagactgaccctgtccagcccggcaccgccggcgtgcgacttgcgcgtgctttcgaaactcctcagagacagccatgtgctccacagccgcttgtcgcaatgccctgaagtgcacccgctgccgactccggtgctgctccctgcggttgacttctcactgggagagtggaaaacccagatggaggaaaccaaggctcaggacattctcggtgccgtcactctgctcctggagggagtaatggccgccaggggccaactgggaccgacttgcctttcttccctgctcggacagctgtcgggccaggtgcgcctgctgctgggggccctccagtccctcctgggcacccaactgccaccccaaggtagaaccactgctcataaagatccgaacgcaatcttcctgtcatttcaacatcttcttcggggaaaagtcagattcctcatgctggtgggaggaagtactctctgcgtgagacgcgcccctccaactactgcagtgccctcgagaacttcccttgtgttgacgctcaatgaacttccaaatcgcacgtcaggcctgcttgaaacgaactttacggcgtccgctcggaccactggttccggcttgctgaaatggcagcagggattccgcgccaagatcccgggactcctgaaccagaccagccgatcactcgaccagatccctggatacctgaaccgcatccatgagctgctgaacggcaccagaggacttttcccaggtccgtcgcgccgaaccctgggcgcacccgacatctcctctgggactagcgatactgggtcgctgccgccgaatttgcaaccgggctattccccctccccgactcacccacccaccggacaatacacgctcttccctctcccgcctactcttcccactccggtcgtgcagctgcatccgctgctgcctgacccatcggcaccgacccctactcctaccagcccgttgctgaacactagctacacccattcgcaaaatctgtcgcaggagggc

SEQ ID NO: 19999 - DNA, 1059 bp, Artificial Sequence
  Description of Artificial Sequence: Synthetic coding sequence
atggagctcactgaattgctcctggtggtgatgctgcttctgactgccagactgactctgtctagcccggcgccgccagcatgtgacctgagggtgctgagcaagctgctgcgcgactcacacgtcttgcactcccggttgagccaatgtcctgaagtgcatccgttgccgaccccagtcctgctgccagccgtcgacttctcgctgggtgaatggaaaacgcaaatggaagaaaccaaagctcaggacatcctcggcgctgtcactctgctgttggagggagtgatggccgcgagaggacagctgggcccgacctgcctctcgtcattgctgggccagctgtcgggacaagtgcgcctgttgcttggtgctttgcagtcactgctggggacgcagctgcctccgcaggggagaactaccgcacacaaagatcctaacgccatcttcctctctttccagcatttgctcaggggcaaggtgagattcctcatgctcgtgggcggaagtactctgtgtgtgcggcgggcgcctcctactaccgcagtgccttcaagaacctcactggttctgactctgaacgagttgcctaatcgcacttccggactgctggaaaccaactttaccgcctcggcgcggaccaccggatccggattgctgaagtggcaacaggggttccgcgcgaagattccaggcctgctcaatcaaacttcccgctccctggatcaaattccgggatacctgaatcggatccacgaactgctcaacgggacgaggggactcttcccaggtccttcgcgcagaaccttgggagccccggatatctcgtccgggactagcgataccggatcgttgccgccgaatttgcagcctggctactcgcccagcccgacgcatccacccacgggacagtacacccttttccctctcccgccaacgctgccaacccctgtggtgcagttgcacccactcctcccagatccttcagcgccgaccccgactccaacctcaccgctcctcaacacttcatacacccactcgcagaacctgtcgcaggaggga

SEQ ID NO: 20000 - DNA, 1059 bp, Artificial Sequence
  Description of Artificial Sequence: Synthetic coding sequence
atggaacttacagaattacttctggttgtgatgctgttacttaccgcgagacttaccctttcgagtccggcgccccccgcttgcgacctaagggtgctcagtaagctcttaagggatagccatgtgctacactcaagactgtcccagtgtcctgaggttcaccccttgcccacgcctgtcctgttgcccgccgtagatttttccctaggtgagtggaagacacagatggaagagaccaaggcccaggacattctaggcgccgtcactctgctcctggaaggcgtgatggcagctcgcggacagctggggcccacttgtctgtccagcctccttgggcagctgagtggccaggttagattacttctaggggctctccaaagtctgttggggacccaactgcctccccaaggccggactactgcccataaagaccccaatgccatattcctgagtttccagcacctgcttagggggaaagtgaggtttctcatgctggtcgggggctccaccttatgcgtccgacgagcgccccctaccactgcagtcccatcgcgcaccagtctcgtactgacgctcaatgaacttcctaaccggacatcggggctgcttgaaacgaacttcaccgctagtgcccggactacgggaagcggactgcttaagtggcagcaaggcttcagagcgaagatcccaggtctgttgaaccaaacgagcaggagtttagatcagattcctggctacctcaaccgcatccatgagctgcttaacgggacacgcgggctgttcccagggccatcacggcgcacactgggggcgccagatattagttccggaaccagtgacacgggttctttacctcctaacctgcaacctggttacagtcctagccccacacatccaccaaccggccagtacacgttatttcctctccctcccacacttccaactccagtagtccaactacaccccctattgcccgatccatccgctcccacgcctacccctacgagtcccttactgaacacatcttatacacacagtcagaacctgagccaagaggga

SEQ ID NO: 20001 - DNA, 1059 bp, Artificial Sequence; identical to SEQ ID NO: 19972
  Description of Artificial Sequence: Synthetic coding sequence

SEQ ID NO: 20002 - DNA, 1059 bp, Artificial Sequence
  Description of Artificial Sequence: Synthetic coding sequence
atggaacttacggagctccttctcgtggtcatgctcctgctgaccgcacgtcttaccttgtcatcaccagcgcccccagcctgtgacctccgagtcttgtcaaaactcctgcgagacagccatgtgctgcattcaagactcagccaatgcccagaagtgcatccgctgcccacccccgtgctgcttcctgccgtggatttctccttgggtgagtggaaaacccagatggaggaaactaaagcacaggacattttgggtgccgtgactcttcttcttgagggcgtgatggcagcacgcggacaactcggtcctacttgtctttcgtcgctgcttggacagctgtcgggacaagtgagactgcttctgggagcactgcagagcctgctcggaacccaacttccgccccaaggtcgtactactgctcacaaggatcctaacgcaatctttctgtcgtttcaacatctgttgagggggaaggttagattccttatgcttgtcggcggatcaactctttgtgttcggagagcacctcctaccactgcggtgccttcacgcacctccttggtgctgaccctgaatgaactgcctaatcgtaccagcggcctgcttgagacgaactttaccgcgagcgcacgcaccaccggttcagggctcctgaagtggcaacaggggttccgggcaaagatccccggactgctgaatcaaacctccaggagcctcgatcagattcctgggtacctgaacaggatccatgaacttttgaacggaacccgtggcctttttcctggcccttccagaaggactttgggcgcaccagatatttcctcgggtacctcggacactggatccttgcctccaaacctgcagccgggctactccccttcacctacccacccacccactgggcagtacaccctgttcccgcttccacctactcttcccaccccagtcgtccagctgcacccccttttgccggatccttctgcaccaactccgacgccaactagccccctgcttaatacttcgtacacccattcacaaaacctctcacaggaagga

SEQ ID NO: 20003 - DNA, 1059 bp, Artificial Sequence
  Description of Artificial Sequence: Synthetic coding sequence
atggagctgactgaactcctgctcgtggttatgcttctccttacggcccgcctcaccttgtcgtctccggctcccccggcctgcgatctcagggtcctgtccaaactgttgcgtgatagccatgtcttgcactctcggctgtcccagtgtccggaagtccacccgttgcctacccctgtgctgctgcctgcagtggacttctccctcggcgagtggaaaacccaaatggaagagactaaggcccaggacatcctcggggctgtcactctcctgctcgaaggtgtcatggccgctcgcggccaactcggaccgacctgcctgtcctcactcttgggtcaactgtctggccaagtgcggctgcttttgggtgcactccagtcccttctcggcactcagctgcccccacaagggcgcaccactgctcacaaggatccaaacgcgatctttctttccttccagcacctgctgcggggcaaggtgcggtttctgatgctggtggggggatccactctctgcgttcgccgggccccgccaaccactgcagtcccgtcgcgcaccagccttgtcctgaccttgaacgagctgcctaataggacctcaggcctcctggaaaccaatttcacggcctccgcgagaactactggctcgggactgttgaagtggcagcagggatttcgcgccaagatcccaggactgcttaaccagacctcaagatcgctggaccaaatcccaggatacctgaacagaatccacgaacttctcaacggaactagaggactgttcccgggaccttcaagacgtactctcggagcgcctgatattagcagcggaaccagcgacacgggatcactgccgccaaatctccagccgggctactcgccctcgccgacgcatccgccgactggtcagtacaccctcttccccctcccaccgactttgccgacgccggtcgtacagctgcatcctcttctcccagacccatctgcacccactcctaccccgacctccccattgctgaacacttcctatacccattcacaaaatctgtctcaggaggga

SEQ ID NO: 20004 - DNA, 1059 bp, Artificial Sequence
  Description of Artificial Sequence: Synthetic coding sequence
atggaactaacggaactattactagttgtaatgctattactaacggcgcgtttaacgttatcgtcgccggcgccgccggcgtgtgatttacgagttctatcgaaattattacgagattcgcatgtattacattcgcgattatcgcaatgtccggaagtacatccgttaccgacgccggtattattaccggcggttgatttttcgctaggtgaatggaaaacgcaaatggaagaaacgaaagcgcaagatatactaggtgcggtaacgttattattagaaggtgttatggcggcgcgaggtcaattaggtccgacgtgtttatcgtcgttattaggtcaactatcgggtcaagttcgactattattaggtgcgctacaatcgttattaggtacgcaattaccgccgcaaggtcgaacgacggcgcataaagatccgaatgcgatatttttatcgtttcaacatttactacgtggtaaagttcgttttctaatgttagtaggtggttcgacgctatgtgtacgtcgagcgccgccgacgacggcggtaccgtcgcgtacgtcgctagtattaacgttaaatgaactaccgaatcgtacgtcgggtttactagaaacgaattttacggcgtcggcgcgtacgacgggttcgggtctattaaaatggcaacaaggttttcgtgcgaaaataccgggtttattaaatcaaacgtcgcgatcgttagatcaaataccgggttatttaaatcgtatacatgaactactaaatggtacgcgtggtttatttccgggtccgtcgcgtcgtacgctaggtgcgccggatatatcgtcgggtacgtcggatacgggttcgctaccgccgaatctacaaccgggttattcgccgtcgccgacgcatccgccgacgggtcaatatacgttatttccgctaccgccgacgttaccgacgccggtagtacaattacatccgttactaccggatccgtcggcgccgacgccgacgccgacgtcgccgttactaaatacgtcgtatacgcattcgcaaaatctatcgcaagaaggt

SEQ ID NO: 20005 - DNA, 1059 bp, Artificial Sequence
  Description of Artificial Sequence: Synthetic coding sequence
atggaattgactgagctactgttagtggtgatgctgttgcttacggcccggctcacgctgtccagtccagctcctcccgcatgcgacttgagggttttatctaagttgcttcgggattctcacgttctccacagtcgcctctcccagtgccccgaggtgcaccccctgccaacaccggtcctacttcccgcagtcgactttagcttgggcgagtggaagacccagatggaggaaacaaaagcgcaggacatcctgggcgcagtgactttgcttctggagggagtcatggccgcaaggggtcagctcggccctacctgcctatcaagcttactgggccagttgagcggacaggtccgcctgctgcttggggccttacagtctctgttgggcacgcagttaccgccacagggcagaactaccgcacacaaggatcccaatgcaattttcctgtctttccagcatttgctccggggaaaggtgagatttctcatgcttgttggaggttctacgctatgtgtgagaagagccccacccacgaccgccgtgccctcccgcacctctctcgtcctgactctcaatgaacttcccaaccgcacttccgggttgttagagaccaatttcaccgctagcgctaggacgacaggtagcggactgcttaaatggcagcagggcttcagggctaaaatcccaggcttgctgaatcagacaagccgaagtctggaccagattcccggctatctcaatcggattcatgagctgctgaatggcacgcgaggattgttccccgggcccagtagaaggacgctgggagctccggacatcagcagtggtacctccgacacaggaagcctgccaccaaatctacagcctggctattctcctagtccaacacacccccccaccggacagtacactctcttcccactgccacccacacttcccacaccagtggttcagctccatcccctgctgcctgacccaagcgccccaacccccacaccgacatcacctttgctaaatacttcgtacacccacagccagaatctctctcaggaggga

SEQ ID NO: 20006 - DNA, 1059 bp, Artificial Sequence
  Description of Artificial Sequence: Synthetic coding sequence
atggagctgacggaactgctcctggtggtgatgcttctactgactgccagactgactctttcttcacccgcgccgccggcttgcgacttgcgtgtgctgtctaaactgttaagggatagtcatgtgctgcacagtaggctcagtcagtgccccgaagtgcacccccttcctactccagtgcttctgcccgctgttgatttttccctaggcgaatggaaaactcagatggaggagacgaaagcacaagacatcctcggcgctgtgacactccttttagagggcgtgatggcggcaagaggacagctgggccctacctgcctaagttccctgctgggacagctgagcggtcaagtccgtctgctgttaggcgcccttcagagcctgcttggcacccagctgccgcctcaaggacgcactacagcccataaggacccgaacgctatatttctgtcttttcagcacctgctgcgggggaaagtgaggtttctgatgcttgtgggcggctctactctgtgtgtgcgtcgggcccctccaacaacggccgtcccaagtcgaacgtccctggtcttgaccttaaatgagctcccgaatcgaacctccggtctgctggaaacaaactttacggcatctgcccgcacaactggctcggggctattaaaatggcagcagggttttcgggctaaaatccctggcttactaaatcagacttctcggtcactggatcagatacctggatatcttaaccgcatccacgaactgctcaatgggacccgagggctgtttccgggaccctctcgacggacactgggcgccccagatatatcctccgggaccagcgacacaggaagcctacccccaaacctgcagcctggatactccccttcacccactcaccctcctactggccaatacaccctattcccgcttcccccaacactgcctacacccgtcgtacagctgcatccactactgccagatccctccgcccctacaccgacgccaacttccccgctgcttaatacgtcctatacacacagtcaaaatctgagtcaggaagga

SEQ ID NO: 20007 - DNA, 1059 bp, Artificial Sequence
  Description of Artificial Sequence: Synthetic coding sequence
atggagctgactgagctcttgctggtcgtgatgctcctcctgaccgctcggttgactctgtcgtccccggcacctccagcctgcgatctgagagtgttgtcgaagctgctgcgtgattcgcacgtgctccactcgcggctctcccagtgcccagaggtccacccccttccgacccctgtcctgctcccagccgtggacttttcgttgggagagtggaaaacccaaatggaagaaactaaggcacaggacatcttgggggcagtgaccctgctcctcgaaggagtgatggctgcccgaggccagctcggaccgacgtgtttgtcatccctcctggggcagctttccggccaagttcgccttctgctgggggcgctgcaatcacttctggggacgcaactgccaccgcagggaagaaccactgcccacaaggacccaaacgcaatcttcctctcattccagcatcttctgagaggaaaggtgcggttcctcatgttggtcggaggcagcaccctctgcgtgcgcagagcgcctccgaccaccgctgttccttcgcggactagcctggtgttgacccttaacgagctgccgaaccgcacttcgggattgctggaaactaacttcactgcgtcggcaaggaccaccggatctggtctgctcaagtggcagcagggctttcgggccaaaatccccggcctccttaatcaaacctcacgcagcttggaccagatcccaggatacctgaaccgcatccatgaattgcttaatggtactcgagggctgttccctggaccttcaagacgcactctcggagccccagacataagcagcggtacttcagacactggaagcctccccccgaatttgcagccgggctactccccttcgccgacccacccccctactgggcagtacactctgttccccctgcctccaaccctgccgactccggttgtgcagctgcatcctctgttgccagatccgtccgctccgaccccgaccccgacgtcacccctgctcaatacttcgtacacgcattcgcagaacctctcccaagaagga

SEQ ID NO: 20008 - DNA, 1059 bp, Artificial Sequence
  Description of Artificial Sequence: Synthetic coding sequence
atggagctgactgaacttctcctggtcgttatgctgcttctgaccgctagactgactctgtcctcgccagccccaccggcatgcgacctgcgtgtcctgtcaaagctgctgcgcgattcgcacgtgttgcatagcagactgtcccaatgcccagaggtgcacccgctccccactccggtgcttttgcccgcagtggacttctccctgggcgagtggaaaactcagatggaggaaaccaaggcccaggatatccttggagccgttaccctgttgctggaaggggtcatggcagctcggggacagctcgggccgacgtgcctctcctccctgctgggacaactgtccggtcaagtgcgcctgctcctcggagctctgcagtccctgctcggaacccagctgccacctcaaggaagaacgaccgcccacaaggatccgaacgcgatctttctctcattccaacacctgttgagaggaaaagtgcgctttctcatgcttgttggggggagcactctctgcgtgcgccgggcaccgccgaccaccgcggtgccatcgcgcaccagcctggtgctgactctgaacgaactgccgaatcggacttcggggctgctggaaaccaactttaccgcgtccgcccggaccactggctcgggactcctgaagtggcaacagggattccgcgcaaagatcccaggactcctcaaccaaaccagcaggtcgctggaccaaatcccgggatatctgaaccggatccatgagctgctgaacggaacccgcgggctgttccccggaccgtcgcggcgcactctgggtgcgccggacatcagctcaggcactagcgacactggctccttgccgcccaacctccaacctggatactctccatctcccactcatccgccaaccgggcagtacacgctgtttcctctgcctccgactctgccaactcctgtcgtccagctgcatccgctgttgcctgacccgtccgcccctaccccaaccccgacgtcacccctgctgaatacgtcgtacacgcactcgcagaatctgtcacaggaaggc

SEQ ID NO: 20009 - DNA, 1059 bp, Artificial Sequence
  Description of Artificial Sequence: Synthetic coding sequence
atggaactcaccgaacttctcctggtcgtgatgctccttctgaccgcccgccttaccctctccagcccagcacctcctgcatgcgatctcagagtcctgagcaagttgctgcgtgatagccatgtgttgcattcacgactgtcccaatgtccagaagtgcatcccctgccgactccagtgctcctgcctgcagtggacttctcactcggtgaatggaaaactcagatggaggagactaaagcccaagacattttgggtgctgtcaccctgttgctcgaaggtgtaatggcagcgcggggccaacttggccccacttgtctttcgtccctgcttgggcaactttctggccaagtgcgacttcttctcggtgcactccaatcccttctcgggacccagctgcctcctcagggacgtaccaccgcgcacaaggatcctaatgctattttcctgtcatttcaacatctgctgcgggggaaagtcagatttctcatgcttgtgggcggcagcacgttgtgtgttcggagagcgcctccaacgacggcggtcccttcacggacttccctcgtgctgactcttaacgaacttccaaatagaacttcgggacttctcgagacgaactttaccgcatccgcaagaactaccggcagtggtctgctgaagtggcagcaggggtttcgggcaaagatccccggactgcttaatcagacttcgcgctcacttgatcagataccaggataccttaaccgtatacacgagcttctgaacggaactaggggtctgtttcccggaccatcccgacgaaccctcggtgcacctgatatttcgagcggcaccagtgataccggatcacttccgccgaaccttcagcctggatatagtccttcgccaacccatccacccactggacaatacactctcttcccccttccccccaccttgccaactcctgtggtgcaacttcaccccttgctgcccgacccgagcgccccaacgcctactcctacttccccactgctgaacacctcatacacccattcgcaaaacttgtctcaggaagga

SEQ ID NO: 20010 - DNA, 1059 bp, Artificial Sequence
  Description of Artificial Sequence: Synthetic coding sequence
atggagttgactgaactgctgctggtggtgatgctgcttctgaccgcgcgtctgaccctctcgtctccagcgcctcctgcttgtgatttgcgcgtcctcagtaagctcttgcgcgattctcatgtcttgcactcgcgtctgtcccagtgcccggaggtccacccactgcctacccccgtgctgttaccggccgttgacttctcgctcggtgagtggaagacccagatggaagagacaaaggcccaggatatcctgggtgccgttacactgttgttggagggtgtgatggctgcccggggccagctggggcctacgtgtctgtcttccctgctgggccagttaagcggacaagtgcgtcttcttctcggcgcgctacagtcgctcctgggtacccagctgcctccccaaggccggaccaccgcccacaaggacccgaatgctatcttcctgtctttccagcatctcctgcgaggcaaggtgcgcttcctcatgttggtcggcggctccaccctctgcgtccgccgggccccccccacaaccgcagtaccgagccgcacttccctggtcttgacccttaatgagctgcctaaccgtacttccggattgctcgagacaaatttcaccgcttccgcccgtaccacgggcagcggattgctcaagtggcagcagggcttccgtgccaagatccccggactgttgaaccaaacgtccagatcattggatcagatcccaggttacctcaaccgaatccacgagttacttaacggtacccgcggccttttccctggtccaagtcgtaggacgctcggcgctcctgacatctcctcgggtacttccgataccggatctctgccccccaacctacagccgggctactccccctctcccacgcatccgcctacgggccagtatactctgttcccactgcctcctaccctcccaacgccggtcgtacagctgcaccccctgctccccgatcccagcgctcccacccccacaccgacgagcccgctcctgaacacgagctacacccacagccaaaacctgagccaggagggc

SEQ ID NO: 20011 - DNA, 1059 bp, Artificial Sequence
  Description of Artificial Sequence: Synthetic coding sequence
atggagctgactgagctcctgttggtggtcatgctgctcttgactgcccggctgacgctctcgagccctgccccgccagcgtgcgacctcagggtgttgtccaaactcctccgcgattcccatgtcctgcactcgagactctcccaatgcccggaagtccacccactgccgactccggtgctgctccctgctgtagacttctcgcttggcgaatggaaaactcagatggaggaaactaaagcacaagatatcctgggcgccgtgactctcctgctcgaaggcgttatggctgcgcgggggcaactgggaccgacttgtttgtccagcctcttgggacagctgtctggacaggtgcgcctcctcctcggcgccctgcaatcgttgctgggaacccagcttcctccacagggaagaaccactgctcacaaggaccccaacgccatcttcctgtcgtttcaacacctgctgcggggtaaggtgagattcctgatgctcgtcggcggttctaccctctgcgtgcgccgcgcgccgccgacgactgcggtgccgtcgagaacctcactcgtcctcactctgaatgaactccctaaccggacttcaggactcctggaaaccaacttcaccgcctccgcccgcactactggcagcggactgctgaagtggcagcaaggcttcagagccaagatcccaggacttctcaatcagacttctaggtccctggaccagatccccgggtacctgaaccgcattcatgagctgctgaatggaactcgcggcctcttccctgggccatcaaggcggacgctgggcgctcctgatatttccagcggaacctcggacactggaagcctgccgcctaacctgcagccagggtactccccttcgccgactcacccgccgaccgggcaatacaccctcttcccgctccctccaactctcccaacccctgtggtccagttgcatccgctcctgccggatccgagcgcccctacgccgacccctacgagccctcttctgaacacgagctacacccactcacagaacctgtcccaggaagga

SEQ ID NO: 20012 - DNA, 1059 bp, Artificial Sequence
  Description of Artificial Sequence: Synthetic coding sequence
atggaacttaccgagctgctgctggtggtgatgctgctcctgacggcgcgccttaccctctcgagccccgcgccacccgcgtgtgatctgcgagttctttcaaaacttcttcgggattcacatgtgcttcactcgaggctctcacaatgcccagaagttcatccacttccaacccctgtactgctgcccgcagtcgatttttcgttgggtgaatggaaaacgcaaatggaagagactaaggcacaagacatcctgggcgcagtgactctgctcctcgaaggtgtgatggcagcaaggggacaattgggacctacttgtctgtcctcgctgttgggtcagctgtcgggacaggtgagacttctgcttggggcccttcagtcactgctcgggacccaactgcctccccagggtaggactacggctcataaggaccctaatgctatattcttgtcctttcaacatcttcttaggggcaaggtccggtttctcatgctcgtgggcgggtcgaccctttgtgtgcgtcgcgctcctcctactacggcagtgccatcgagaacttcgcttgtgctcacccttaacgaattgccgaaccgcacttcggggcttctcgagactaatttcaccgcatccgcaaggactaccggctcgggccttcttaagtggcagcaaggattcagagcaaaaatccctggacttttgaaccaaacttcccggtcactggatcagatccctggttacctcaaccgcatccacgaacttcttaatggtaccagaggacttttccctggaccctccagacgaaccctgggtgctccagatatatcatccgggacctccgacaccggtagcctgccacccaatctccaaccagggtacagcccatcgccgacgcaccctccaacgggacagtacactctctttccactgccacccactcttccgactcccgtggtccaactccatcctctgctgcctgatccttccgcgccaaccccaacgccaacgtccccgctcctgaacacctcatacacgcacagccaaaacctgtcacaggagggt

SEQ ID NO: 20013 - DNA, 1059 bp, Artificial Sequence
  Description of Artificial Sequence: Synthetic coding sequence
atggaactaacagaactgctcctagtagtaatgctgctccttacagcacgattgactttgtcatcccctgctccaccagcatgcgacctgagggtgttgtcaaaacttctgcgcgattcccacgttttacatagtaggctgagtcagtgtcccgaagtacaccctctacccactcctgtcttgctccctgcagtggatttctcactaggggagtggaaaacacagatggaggagacaaaagctcaggatatcctgggggctgtgactcttcttctggaaggggtgatggctgctagaggacagcttgggccaacttgccttagttcactgttaggacaacttagtggacaggttaggttactcctgggagcactccagtcactccttgggactcagctcccaccccaggggcgaactactgctcataaagatccaaatgctatcttcctcagtttccagcacctgctacgggggaaagtgaggtttctaatgcttgtgggagggtctactttatgcgtgcggagagctccccctactacagcagtgccgtcaagaacatcgcttgtgctcactctgaatgagctacccaacaggacttcagggctcttagaaacaaacttcacagcatctgcaagaactactgggagtgggctactaaaatggcagcaggggttcagagctaaaatacccgggctactgaaccagacttccaggtccctggatcaaataccagggtatctgaatcgtatccatgaactgctaaatgggacacgggggctgttccccggaccttctagacggactctcggggctccggatatttcttctgggacatccgatactggaagtctgccaccaaacctgcagcctgggtactctccctcccctacacatcccccaactgggcaatatactctttttcctctaccaccaactctacctacacctgtagtccagctgcatccacttctccctgacccttcagcccctactccaactcctacttcccccctcctcaacactagttacacacactcacaaaatctttctcaggaagga

SEQ ID NO: 20014 - DNA, 1059 bp, Artificial Sequence
  Description of Artificial Sequence: Synthetic coding sequence
atggagctgaccgaacttctgctggtcgtgatgctgctactgacagcacgtttgacgctgagctcccctgcccctccagcctgtgacctccgggtgctttccaaactcctgcgcgactcccatgtcttacacagtcgcctttcccaatgccctgaggttcaccccctgccgactcctgtgctgctccccgcggtggacttctcactcggggagtggaagacccagatggaggaaaccaaggcacaggatatcctgggagccgtaacactattgttggagggcgtaatggctgctagaggacagctaggaccaacctgtctcagctctctcctgggtcagttgagcgggcaggtgcggctgttactgggcgccctgcagtcactactgggcacacagttacccccccagggccgcactactgcccataaagatcccaacgccatctttttaagcttccagcacttgctcagggggaaagtgcgattcttgatgctggtcgggggttccacactttgcgtgaggagagccccccccaccacggcagttcccagtcggactagcctggtgttgacattgaatgaactgcctaaccgcacttcgggcctgctggagacgaatttcacggcttcagctagaaccaccggctcggggctgctcaaatggcagcaaggctttagggccaagattcctggcctactcaaccagacgagcagatcgctggaccagatcccggggtatctgaatcgtattcacgaacttctcaacggaactaggggtcttttcccaggcccttctcgaagaaccctcggcgctcccgatatcagttccggcacgagcgatacgggttcacttcctccgaatctgcagccaggctactctcccagtcctacgcaccccccgaccggacagtataccctttttcctctgccgcccactctgccaacccctgttgttcagttgcacccactccttcctgatcccagcgcacccacacctacccccacttctccactgctgaacacaagctacacgcactcccaaaatctatctcaggaggga

SEQ ID NO: 20015 - DNA, 1059 bp, Artificial Sequence
  Description of Artificial Sequence: Synthetic coding sequence
atggagctcactgagcttctgctggtggtgatgctgctcctgaccgcacggctgactctctcttcgccggcaccaccagcgtgcgacctccgggtcctctccaagctgcttcgggactcccacgtcctccactcccgcctgtcacagtgtcctgaagtgcatcctctcccgacgcctgtcctgctgccagccgtcgacttctccctcggagagtggaaaacgcagatggaagagactaaggctcaagacattctgggagcggttactctgctgcttgaaggagtcatggccgcgcgcggacagctcggaccaacctgcctctcgtccttgctggggcagctgtcgggacaagttcgccttctgctgggggctctgcaatcgctgctcggcacccagttgcccccgcaggggagaaccaccgcgcacaaggatccaaacgcgatattcctctcattccagcacctgctgcgcggaaaggtgcgcttcctcatgctggtgggaggctcgactctgtgcgtgcggcgcgcgcctccaactaccgcagtgccgagccgtacctcactcgttctgactcttaacgagctgcctaatcgcacgtccgggctgctcgagactaactttaccgcctcggcaagaaccaccggctccggattgctgaagtggcagcagggatttcgggccaagatcccaggcctcttgaatcagacttcgcggtcgctcgatcaaatccccggatacctgaaccggatccatgagctgttgaacggtactcggggactcttccccggaccgtcccgccgcactctgggagcgccggacatcagcagcggtaccagcgatacgggatcgctgccgccaaatctccagccgggctacagcccgtcaccgactcatccgcccaccgggcagtacaccctgtttcctctcccgcccactctgcccactcctgtcgtgcagctgcatccactgttgccggacccgtcagcgccgaccccaacgccaacgtcaccgctccttaatacttcatacacccactcgcagaatctctcccaagagggg

SEQ ID NO: 20016 - DNA, 1059 bp, Artificial Sequence
  Description of Artificial Sequence: Synthetic coding sequence
atggagttgaccgaactgctgttggtagttatgctcttgctaactgccaggttgacactgagctcccccgctccccccgcgtgtgacctgcgagtactctccaaattattgcgtgactcccacgtccttcacagccggttgtcccagtgccctgaggttcatcccctaccgacgccagtgttgctacctgccgtagacttctcccttggggaatggaagacacaaatggaggaaaccaaggcgcaggatatcctaggggcggtcactctcctccttgagggcgttatggcagcgcggggacagctgggccccacctgcctctcctccctccttggacaactatccggacaagtccgtttactgctaggcgcgttacaatcattgcttggtactcagctcccaccccaagggagaacgacagcgcataaagacccaaacgcaatattcctctcctttcagcacctgttgcgagggaaagtccgttttcttatgttggttggggggtcaacgctgtgtgtcaggagagcgccgcccacaaccgcagtaccgagtcgaacatcactggttctcacgctaaatgagctccctaatagaacctctggtctgcttgagaccaacttcactgcttcggcgaggaccactggctctggcctgcttaagtggcagcagggtttcagagcaaaaatacccgggttgctgaaccagacttctcgcagtctggatcagatccctggttacttgaatcgcattcacgagttgctaaatggcacccgcgggttatttcctggtccttcgcgaagaacactaggggcacccgatataagttcgggcacaagtgacacgggatcactccctccaaatctccaaccaggctactcgccgtcgccaacgcacccgccgacagggcagtacactttgttccccctaccaccaacgctccccacccctgtggttcaactgcaccccttgcttccggacccttccgcacccactcccacgcccacctccccgcttttgaatactagctatacgcatagccaaaatctttctcaagagggt

SEQ ID NO: 20017 - DNA, 1059 bp, Artificial Sequence
  Description of Artificial Sequence: Synthetic coding sequence
atggaactgaccgagctgcttctggtggtcatgctgcttctgaccgccaggttgaccctttcgtcgccagcgccgccagcgtgcgacctgcgggtgctgtcgaagctgctgcgggatagccacgtgctgcactctcgcctgtctcaatgtccggaggtgcatccgctgcctacccctgtgctcctcccagcagtcgacttctctctcggagaatggaaaacgcaaatggaagaaactaaggcgcaggacatccttggcgcggttaccctcctcctggagggcgtgatggcagccagagggcagctcggacccacttgcttgtcaagcctcctggggcaactgtcgggacaggtgcgcctgctgctgggtgcgctgcaatcgctcctgggcacccagctgcctccgcagggacgcaccaccgcccataaggacccgaacgccatcttcctgtcattccaacacctgctgcgggggaaggtcaggttcctcatgctggtgggtggctcaaccctctgcgtgagacgggcgccaccaactactgccgtgccgtcgagaacttccctggtcctcaccctgaacgaactgccaaatcggacctccggacttcttgagactaacttcactgcttccgcacgcactaccgggtcgggactgctgaagtggcaacagggcttccgggcgaagatcccgggactgctcaaccagacttcccgctcgctggaccagatccccggatacctgaatcgcattcatgaactgctgaatggaactagaggactgtttccgggaccttccagacgcacgctcggagccccggacatctcatccggaacgtcagacacgggctcccttccgccgaatttgcagccgggatacagcccgtcaccgacccaccctccgacgggacaatataccctgtttccgctccctcctacgctccccaccccagttgtgcagctgcatccgttgcttccagatccttctgcaccgaccccgactccgaccagccccctgctgaatacctcgtacacccactcacagaatttgtcacaggaagga

SEQ ID NO: 20018 - DNA, 1059 bp, Artificial Sequence
  Description of Artificial Sequence: Synthetic coding sequence
atggaacttaccgaacttctcttggtcgtgatgttgctgctcacggcacggcttactctttccagtcctgctccacctgcctgtgatctgagggtcttgtctaaactgctgcgggactcacatgttcttcatagccgtctttcccaatgccctgaagtgcatcctttgcctactcctgtccttcttccggcagtagattttagtctcggtgaatggaaaacccagatggaggagacgaaggcccaggacatccttggggcagtcaccctcctgcttgaaggcgtgatggcagctcgaggacagcttggtccaacgtgcctttcatcccttcttggacagctgtcgggacaggtaagacttctgctgggtgcgcttcaaagccttttggggacccaactgccccctcaaggtcgcaccactgcacataaggatcccaacgcgatttttctgtcctttcagcaccttctgagaggaaaggtgcggtttcttatgctggtggggggttcgaccctgtgtgtgcgcagagcaccgcctactactgccgtgcctagccggacttccctggtgctgactctcaacgagctcccaaaccgaacctcaggacttctggagactaacttcacggcatccgccagaaccaccggaagcggacttctgaagtggcagcaggggtttcgcgcaaagatcccgggattgctgaatcaaaccagccgttcgctcgatcaaattccaggatacctgaacaggatacacgaattgctgaacggaactaggggtctgttcccggggccgtcgaggagaactctgggcgccccggatatttcgtcaggcacctccgacactggaagccttccacctaatctccaacctggctattcaccctcaccaacgcatccccccaccggacaatacacgctgttcccacttccacctaccctgcccacgccagtggtgcaacttcaccctcttctgcctgatccatcggcaccgacccccacccctacttcgccacttctgaatacttcgtacacccattcgcaaaatctgtcccaagaaggc

SEQ ID NO: 20019 - DNA, 1059 bp, Artificial Sequence
  Description of Artificial Sequence: Synthetic coding sequence
atggaactcacagagctgctgctcgtcgtgatgctgttgctgactgctcgattgaccttgagtagccctgccccccctgcatgtgacctaagagtgctgtccaaactcctgcgcgactctcatgttctccatagcagattgtcccaatgtccagaagtgcatcctttgcccacgcctgttttgctgcctgctgtggacttttcccttggtgagtggaaaactcagatggaggagaccaaagcacaagatattctgggagccgtcacgctcttgctggaaggagtgatggccgccagaggccagctaggtcccacctgtttgagctcgttgctgggccaattgagtggccaagtgcggctcctgctcggtgctcttcaaagccttttaggcacacagctacctccgcaggggcgtactaccgctcacaaagaccccaatgccatctttctatcttttcaacatttactgcggggtaaggtgcggtttctgatgctggtgggtgggtccaccttgtgcgtgcgtagagcgccccccaccacagcggttccatcgaggacatccctggttcttacactgaacgaacttccaaataggacatcaggactgctggaaactaacttcacggccagtgcgaggactacaggctccggcctactgaagtggcagcaggggtttagggctaagatccctgggttactcaatcaaacgtcccggagtctggaccagatccccgggtacctgaatagaattcatgagctcctcaatggcactagggggctgtttccgggcccaagccggcgcacactcggtgcacccgacatcagcagcggtacatccgatacagggagcctgcccccgaatctgcagcctggctattcaccttccccaacccaccccccgaccggacagtacactctttttccccttcccccgacgctgccaaccccagtcgtgcagctgcacccattactgcctgatcctagcgcgcccaccccaaccccaaccagtcccctgttaaacactagctacactcatagccagaatctttctcaggaagga

SEQ ID NO: 20020 - DNA, 1059 bp, Artificial Sequence
  Description of Artificial Sequence: Synthetic coding sequence
atggaattgacggaactgctccttgtggtgatgctgctgctcaccgcgagactgacactcagcagtcctgctcctccagcatgtgatttgagggttctatccaagctgttaagggacagtcacgtgctgcattccagacttagccaatgcccagaggtgcaccccctgccaacccccgtgcttctcccggcggtcgacttttccttgggcgaatggaagacccaaatggaggaaaccaaagcacaggacattcttggagcagtcaccctgttgctagagggcgtaatggccgcccgggggcagctcggccccacttgtctgtcttccttgctgggccaactcagtgggcaggtgagactgctgctcggtgctttgcaatctctgttgggtacacagctccctccacagggccggacaaccgcgcataaggaccctaacgctatcttccttagcttccaacatcttctgagaggcaaagtgcgcttcttgatgctggtgggaggctccacactatgtgtgagaagagcgccccccaccaccgcagtgcctagtagaacctcgttagtattgacactgaacgagctgccaaatcggacctccggtctcttagagacgaactttacggcttcggcgagaacaaccggatcgggcttgcttaagtggcaacagggcttccgggccaaaatccccggattactgaaccaaacgagccggtccttggatcagattcccggttatctgaacagaatacatgaactgttaaatggcacacgcggcctgttccccggaccaagtaggcgcacattgggagcacctgatattagctcggggacgtccgacacagggagcctccctcccaatttgcagccaggttattctccaagccccacgcacccccctacaggtcagtatacactattccccctgccaccaaccctgccaaccccagttgtccaattacatccactgcttccagacccatctgctcccacgcctaccccaacgagtcccttactcaacacaagttatacacacagccagaacttgtcccaagaaggg

SEQ ID NO: 20021 - DNA, 1059 bp, Artificial Sequence
  Description of Artificial Sequence: Synthetic coding sequence
atggagctgactgagctcctcctggtcgtgatgctcttgctgacggcaagactgactctgtcatcaccggcaccaccagcttgcgacttgagagtcctgtcaaaactgctccgggattcgcacgtgctgcactccaggctgtcgcagtgcccagaggtgcacccactgcctaccccagtcctcctgcccgctgtggacttctcactcggcgaatggaaaactcagatggaggaaaccaaggctcaggacatcctcggcgctgtcaccctgctcctggagggagtgatggcggcacgcggacagctgggaccgacctgcctctcgtctctgttgggccagttgtcaggacaagtgcggcttctcctgggcgctctccaatccctcctggggactcagctgcctccgcagggcagaactaccgcccacaaggatccgaacgcaatcttcctgagctttcaacatctgctccgcggaaaggtgcggttcctgatgctcgtaggggggtcaaccctttgcgtgcggagggccccaccgaccaccgctgtgccgtcccgcacttccctcgtgcttaccctcaacgaactgccgaatcgaactagcggactgctcgaaaccaacttcaccgcctccgccaggacgaccgggtccgggctgctgaagtggcagcaaggttttcgggcgaagatcccgggactgctgaaccaaacctcgcggagcctggaccagatccccggctacctgaaccggattcatgaactgcttaatggaacccgcggactgtttccgggaccgtcgcgaagaacccttggagcgcctgacatatccagcggtacctcggacacgggatcccttccacccaatctgcaacccggatactcacctagcccgacccacccgccgactggccaatacaccctctttccgctgccgcctactctgcctactccggtcgtgcagctccatccgctgctgccagatccgtccgcccctaccccgacgccgactagcccattgcttaatactagctacacccacagccagaacctctcccaggagggg

SEQ ID NO: 20022 - DNA, 1059 bp, Artificial Sequence
  Description of Artificial Sequence: Synthetic coding sequence
atggagctcaccgaacttcttctggtcgtgatgcttcttctgaccgctaggcttactctgtcgtcacctgcacctcctgcatgtgatctgagggtcctttcaaaacttttgcgggattcccatgtgctgcactccagactgtcgcaatgtccagaagtgcacccgctgcccaccccagtgctgctcccagcggtcgacttctcgctcggtgagtggaaaacccaaatggaggaaaccaaggcccaggacatcctgggcgccgtcaccttgctgctggagggggtgatggccgcaaggggacaattgggtcctacttgtttgtcctctctgcttggtcaactctcgggacaggtccgcttgcttcttggcgccctccaatcgcttctcggaactcagctgcctcctcagggaagaaccactgcacataaggacccgaacgcaattttcctgtcctttcaacatcttctccgtggaaaggttcgctttctgatgcttgtgggtggctcgaccctctgtgtgagaagggcacctccaaccaccgccgtgccttcgagaacctcccttgtgctgactcttaatgaactgcctaataggacctcaggccttctggaaactaactttacggcgagcgcccgaacgaccggatccggactcctgaagtggcagcagggatttcgggcaaagattcccggacttttgaaccagactagccgctcccttgatcaaattcctgggtacctgaatcgcattcacgaactcctcaatgggacccggggtctgttcccaggtccctcaagaagaaccctgggtgcccctgatattagcagcggtacttccgatactggtagccttcctccgaaccttcaaccagggtacagccccagcccgactcatcctcctactggtcagtacaccctttttcctcttccacctacccttcccaccccggtggtccagctccaccccctgcttcctgacccatctgcacctacccctactcctacctcacccctgctcaatacctcgtacacccattcacaaaacctttcacaggagggc

SEQ ID NO: 20023 - DNA, 1059 bp, Artificial Sequence
  Description of Artificial Sequence: Synthetic coding sequence
atggaattgactgaactgttgcttgtggtgatgcttctgcttaccgcaaggcttaccctgtcatcaccagcccctcccgcttgtgacctgagagtgctgagcaaacttctccgggattcacatgtgttgcactcgcgcctctctcaatgtcctgaagtgcacccccttcctaccccagtgcttcttcccgcagtggacttttcgctgggagagtggaaaactcaaatggaagagactaaggcccaagatattcttggcgcagtcaccttgctgcttgaaggagtcatggctgccagaggtcaacttggaccaacttgcctgtcgtcgctgcttggacagctttcgggccaggtgagactccttcttggagcactgcagtcgctgctggggacccaactgcctccacaaggtcgaacgactgcccataaggatccaaacgcaatctttctctcatttcaacatcttctgcgcgggaaggtcagattccttatgctggtgggcggtagcaccctttgtgtgcgacgagctccaccaactactgcagtcccgtcgcgaacctccctggtgttgacccttaatgaacttcctaacaggacttcaggtctgcttgaaaccaactttactgcatctgcaaggacgaccggaagcggactgctcaagtggcaacagggcttccgagccaagatacctggattgctgaaccagacgtcacgatccctcgatcagattccaggatacctcaatcggatccacgaacttttgaacggaaccagaggacttttccctggcccatcccggagaactctgggagcacccgacatttcgtcaggtacgtccgatactggttccttgcctcctaacctgcagcctgggtattccccatcacctacgcacccgccgactggacagtacaccctgtttccgctgccccctacgcttccgaccccagtggtgcaactccatccactgttgccggatccttccgcaccaacccccactccaacgtcgccgctgctgaataccagctacactcattcccagaatctgagccaggaaggg

SEQ ID NO: 20024 - DNA, 1059 bp, Artificial Sequence
  Description of Artificial Sequence: Synthetic coding sequence
atggaactcaccgagctgcttctggtggttatgctactactgactgcacgactcaccctttcttcaccggccccccctgcgtgcgacctccgggtcttgagcaagctcctgagggactctcacgttctgcacagcaggctaagccagtgcccggaagtgcaccctctgccaacaccagttctgctcccagccgtggacttctccctgggggaatggaaaacccagatggaagagaccaaagcccaggacatcctgggtgcagttactcttcttttggagggcgtgatggcagcacgtgggcagcttgggcctacctgcctgtcttcactacttggtcagctgagcgggcaggttcggctgcttctaggggctctgcagagcctcctgggcactcagcttcccccacagggcagaacaacagcacataaggatccgaacgctatttttctatcattccagcatcttctgagaggcaaggtgcgttttctgatgctggtggggggctctaccctgtgtgtgcgtagggcaccccccacaaccgctgtaccttcccgcacatctctggtattgacccttaatgagctccccaaccggacgtcagggctactggaaacgaactttacagcctctgcacggacaacaggatccggtcttctaaagtggcagcaaggttttcgggccaaaatccccggtttgctcaatcagacctctcgaagtcttgatcagatacccggctatctaaacagaatacacgagcttcttaacggaaccaggggtctctttcctggccctagcaggcggactctgggcgccccggacattagttctgggacatccgacaccgggtcgctccctcctaacctgcagcccggctattcgcctagtcccacacacccaccaactggccagtacacattatttcccctgccgcccactctgcccacccctgtggtccaactgcatcctctactgccggaccccagtgcacctacacccactcctacttccccgcttcttaatacttcctacacacattcgcagaatctgtctcaggagggg

SEQ ID NO: 20025 - DNA, 1059 bp, Artificial Sequence
  Description of Artificial Sequence: Synthetic coding sequence
atggagctgactgaacttctgttggtcgtgatgctcttgctcaccgcccgtttgaccctgagtagccccgcaccccccgcatgcgatttgagggtgctcagtaaactgctgcgggacagccacgtgctgcacagccggttgagtcagtgtcctgaagtgcatcccttgccaacccctgtcctcctgccagctgtagattttagcttgggagaatggaagacccagatggaagaaacaaaagctcaggacatacttggggcagtcacattgcttttggaaggagtcatggcagcacgtggacagctaggacccacctgcctctcgtcattgctgggtcaactgtctggacaggtcaggctcttgctgggagcattgcaaagcctgttggggacacagttgcccccacaggggcggacaacagcccacaaagatcctaacgccatttttctgtctttccagcacttattgcgtggaaaagtgcgctttttaatgttggtgggaggcagcaccctctgcgtccggcgggctccccctacaacagccgtacctagtaggacttctttggtccttactttgaatgagctgcctaacagaacctcaggactgctagagaccaactttactgcatcagcccggactactggctccgggctgctgaaatggcaacagggctttagagccaagatcccaggcctgcttaatcagaccagtcgctccctcgatcagattcccgggtacctcaataggattcatgaactgctcaacggcacgagagggctgttccctggaccgtctaggcgaaccttgggggcccccgacatttcatctggtacgtcagacactgggagtctgccacccaatctccagcctggatatagcccctcgccaacacaccctccaacgggtcaatatacattgttcccactgcctcctacactccctacaccggtggtacagctacatcctctcctgcccgatcctagcgcgcctacgccaactcctacttcacccctgttgaacacatcctatactcacagtcagaatctgagtcaggaggga

SEQ ID NO: 20026 - DNA, 1059 bp, Artificial Sequence
  Description of Artificial Sequence: Synthetic coding sequence
atggagctgactgagctgctgcttgtcgtaatgcttctcttaacagcgcgccttactctgtcgtcccctgcccctcctgcttgtgacttacgcgtgctgtccaagctgttgagggacagccacgtgctgcactcacggttgtcccagtgccccgaggtgcatcccctaccgactcccgtgctgttacctgccgtagacttctctctgggcgagtggaaaacccagatggaggagactaaagcacaagacatactcggggctgtgacacttctgctcgaaggggtaatggccgccagaggtcagctcgggccgacatgcttatccagccttcttggacagctgtcaggacaggttaggttactgctcggggcccttcaaagcctccttggcacccaattaccaccccaaggccgcacaacagctcacaaagacccaaacgcaattttcctgagtttccaacacctgcttagaggcaaagtccggtttttgatgcttgtgggaggatcgactctttgcgtgcgaagggcgcctcctactactgcagtcccatctcgcacctccttagttctgacactcaatgaactgccgaatagaacaagcgggctgctggagaccaacttcaccgcctctgctcggacgactgggagtgggcttctgaaatggcaacaggggttcagagcgaaaatccctgggctgctcaatcagacctcccgtagcttggaccagatacctggctatctgaataggatccatgaactcctgaatggcacccggggcctcttccccggtccttccaggcgaactctcggggcgccagacatcagcagtggtacttcggatacgggttcgctgccacccaatttgcaacctggttattcacctagccccacacatccccctaccggccagtatactctgtttccattaccccccaccttgcccacgccagtagtacagttgcatcctttactccccgaccccagtgcgcctactcccacgcccacctccccattacttaacacaagctatacacactctcagaacctgagccaggaggga

SEQ ID NO: 20027 - DNA, 1059 bp, Artificial Sequence
  Description of Artificial Sequence: Synthetic coding sequence
atggagctcacggaacttctgctcgtggtgatgctcctccttaccgccagactgaccctgagctcgccggcgccgcctgcctgcgatctccgcgtgctgtccaagctgttgagggactcgcacgtgttgcattcacgactttcccaatgccccgaggtccatccactcccaactccggtgctcctccctgccgtggacttcagtctcggggagtggaaaacccagatggaggaaacgaaggcccaagacatcctcggagcagtcaccctgctgcttgagggcgtcatggccgcccggggacaactgggacccacctgcctgtcatccctcctgggacaactgagcggacaggtgcgcttgctccttggagcccttcagtcgctgctgggaactcaactgccgccccaagggagaactactgcccacaaggatccaaatgctatcttcctttcattccagcacctgttgagaggaaaggtgaggttcctcatgcttgtgggaggttcaaccctgtgtgtcagacgcgccccgccgaccaccgctgtcccgtcaagaacctcgctggtgttgactctgaatgagctcccgaataggaccagcggacttctggaaaccaacttcactgcctccgcaagaactaccggatcgggcctcctgaaatggcagcagggtttccgagctaagattccggggcttctgaaccaaacctcgcggtcgctggatcagatccctggatacctgaacagaatccatgaactgctgaatggtacccgcggcctgttcccggggccttcgcgcaggaccctgggggccccggatatctcgagcggaacttcggacactggatccctcccaccgaatcttcaacctggatacagcccatcgccaactcaccctcctactgggcagtacaccctttttccgctgcccccgactctcccgaccccggtggtgcagctccacccgctgctcccggacccatctgcgccaactccaactccgacctcaccgctgctgaatacttcgtacactcactcacagaacctctcccaggaaggg

SEQ ID NO: 20028 - DNA, 1059 bp, Artificial Sequence
  Description of Artificial Sequence: Synthetic coding sequence
atggaacttactgaacttcttcttgtggtgatgctgctcctgaccgcaagactcaccctttcctcacctgcaccaccagcctgtgacctgagagtgttgtcgaagctcttgagagactcccacgttctgcactcccgcttgtcgcaatgccccgaagtgcatcctttgcctaccccagtcctgcttccagcggtggatttcagcctgggagagtggaaaactcagatggaggaaaccaaggcacaagatatactgggtgccgtgactctcctgcttgaaggcgtcatggcagctagagggcagctggggcccacttgtctttcctcgttgctcggtcaactctcaggccaagtccgccttctgctcggagcgttgcaatcgcttctgggcacccagctgcctccacaaggtagaaccaccgcacacaaggatcctaacgcgatttttctgtcatttcaacatcttctcagaggaaaagtgcgctttctgatgcttgtcggggggtctacgctgtgtgtgcggcgtgcaccaccgactaccgcagtgccatcccgaacttcgcttgtgctgaccctgaacgaactgcctaatcgaactagcggcctcctcgaaaccaatttcaccgcctccgcaagaaccactggatcgggcctgcttaaatggcaacagggttttcgtgctaagataccagggttgcttaaccaaacttcgcgctcccttgatcagattcctggatacctcaatcgcattcatgaactccttaatggaactcgcggcctctttccgggacctagccgaagaactctgggcgcacccgatatttccagcggcacctccgacactgggtcgctgccacctaacctccaaccgggctactcaccatcccccacccatcctcccactgggcagtacaccctcttcccattgccacccacgcttcctactccagtggtccaacttcatcctttgctgccagatccttccgcgcctactcccactcctacttcgccactccttaatacttcatacactcacagccaaaacctctcgcaagaaggc

SEQ ID NO: 20029 - DNA, 1059 bp, Artificial Sequence
  Description of Artificial Sequence: Synthetic coding sequence
atggagctgaccgagctgctgctggtcgtgatgctccttctgactgcacgcctgaccctgtcgtcccctgcaccgcctgcttgtgatctgagagtcctgagcaaacttctgcgcgattcgcacgtgctgcactctcgactctcgcaatgcccggaggtgcacccgctgccgacgccggtgctgctgcctgcagtggatttctccctcggcgaatggaaaacgcaaatggaagagactaaagcgcaggatatactgggagcagtgacgctgctgctggaaggagtgatggctgccagaggacagctggggccgacttgcctgagctcgctcctggggcagctctccggacaggtcaggctcctgttgggcgcactgcaatcactcctgggtactcagctgccgccgcaaggacgcactacggcccacaaagaccctaacgccatctttctcagcttccaacatctgctgcggggaaaggtcaggttcctgatgcttgtcggaggatcgacgttgtgtgtgcggagagctcccccaaccaccgctgtgccatcgcgcacgagtctggtgctcacccttaacgagctgcccaacagaacctcggggttgctggaaactaactttactgccagcgcccggactactggcagcggacttctcaagtggcaacagggtttcagggccaagatccctgggctgctcaaccagacttcgcgcagcctggaccagatccctggctacctgaacagaatccacgagctcctcaacggaacccgcggtcttttccccggaccgagccggaggactctgggggccccagacatctcatcagggacgagcgacaccggctcactgcccccgaatctgcagcccggctactccccgtcgccgacccacccgcctactgggcagtacactctcttccccctgccgcctaccctgcctactccagtcgtgcagttgcatccactcttgcccgacccatccgctccaactccgactccaacctccccgcttctcaataccagctacacccacagccagaatctctcgcaggaagga

SEQ ID NO: 20030 - DNA, 1059 bp, Artificial Sequence
  Description of Artificial Sequence: Synthetic coding sequence
atggaattgactgaacttcttctcgtggtgatgctgctgctgactgcacgtcttactttgagctccccggcacctccagcatgtgacctcagagtgctttccaaacttctgagagattctcacgtactccactcgagactttcacagtgtcctgaggtgcatccactgccaactcctgtgctgctgcctgctgttgacttctctcttggagaatggaaaacgcagatggaggaaaccaaggctcaggacattttgggagcagtgaccctgcttcttgaaggagtgatggcggcccgtggtcaactgggtcccacctgccttagctcgttgctgggccagctctcgggtcaagtcagacttctgcttggtgcacttcaaagcctgcttggaactcagcttccaccccagggtcgcactaccgcccataaggatcctaatgccatatttctgagcttccaacatcttctccggggcaaggtccgatttcttatgttggtgggaggatccaccctgtgtgtcagacgcgccccaccgactaccgcagtcccaagccgcacctcgcttgtgctgactcttaatgaactgccaaatcgcactagcggactccttgaaactaactttaccgcaagcgcacggaccaccgggtcagggctcctcaaatggcagcaaggctttcgagcaaagattcccggactgctgaaccagacctctcgttcgttggatcaaatccccgggtacctgaatcgaatacacgaattgctgaacggcactagaggactctttccgggtccgtcgcggcgtactctgggtgcacctgatatctcgtcaggaacctctgacacgggatcgcttccccccaaccttcagccaggatactcgccgtcgccgactcatccaccaacgggccaatacacgctgttcccgctgcctccaacgcttcctacccccgtcgtgcaacttcacccactcctgcctgatccatcggcacctaccccaactcctacctcgcccctgttgaacacttcgtacacccattcccaaaatctcagccaggaaggt

SEQ ID NO: 20031 - DNA, 1059 bp, Artificial Sequence
  Description of Artificial Sequence: Synthetic coding sequence
atggagctcaccgagctgctgctggtcgtgatgctgctcctgaccgcacgacttaccctgagtagtcccgcacctcccgcatgtgaccttagagtcctcagcaaactcctccgcgactctcacgtcttgcactcccgactgtcccaatgccccgaggtgcaccccttgcctacccccgtactgttgcctgctgttgacttttctctcggtgaatggaagacccaaatggaagagacaaaggcgcaggacatactgggggccgtcaccctgctgctggaaggtgttatggcagctagaggacagctgggccccacgtgtctttccagtctgcttggccaactgagcgggcaggtgcggctgctcctgggcgcactgcagagcctgctcggaacacaattgccaccccaggggagaactaccgctcacaaagaccctaacgctatctttctgtctttccaacacctgcttaggggaaaagtccgcttcctgatgcttgtgggagggagtacactttgcgttagacgggcaccgccgaccactgccgtgccctccaggacctcactggtcctcactcttaacgagctccccaacaggaccagcggccttctggagactaactttaccgcatctgccaggaccaccggatctgggctgcttaagtggcaacagggatttagggctaagatccccgggctgctgaaccagaccagcagaagtttggatcagatcccaggatatctgaaccggattcatgaactgctgaatggcacaagggggctgttcccagggcccagcagaagaacactcggggcacccgatatctccagtgggaccagtgacacagggtcccttccacctaacctgcagcctggttatagtcccagtcccacccaccctccaactggtcagtatactctgttcccactcccacctacccttccgaccccggtggtgcagcttcatcccctgctgcctgatcccagtgctcctactccgacccctacctcccccctgctgaacacgtcatacacgcacagtcagaacctctcacaggagggg

SEQ ID NO: 20032 - DNA, 1059 bp, Artificial Sequence
  Description of Artificial Sequence: Synthetic coding sequence
atggaactgactgagctgctgctggtagtgatgctgttgcttacagctcgtctgacactgtcctctccagctccacccgcgtgtgacctccgagttctctccaagctgctgcgggattcccatgtgctccactcccgactgtcacagtgtcctgaggtacatcccctgccaacccctgtgttgctcccggccgtggacttctccctgggtgaatggaagacccaaatggaggagacgaaagcgcaggacattttgggggccgtgaccctgcttttggagggggttatggccgcaagaggacagctcggacccacttgcctcagctcgctcctgggccagctttctggccaagtgaggctgcttctgggcgctctgcaatctctgttggggacgcagctcccaccccaagggaggactactgcccataaggaccctaatgctattttcctgtcgtttcagcacctgctgcgaggaaaagttcggttcctgatgctggtcgggggatcaacactttgtgtgagacgcgctcccccgacaacagccgtgccaagccggaccagtttggtcctgactctcaacgaattgccaaacaggacctcaggactcctggagactaattttaccgcatctgcacggacaaccggttcaggcctactcaaatggcagcagggttttcgagcaaagattcctggtcttttgaaccagacatccaggtctctggaccagatccctggctacttgaataggatccatgaactcttgaatggcacccggggcctgttccctggaccttcccggcgaactctgggggcccctgacatcagctctgggacaagtgacacgggttccctccccccaaacctgcagcctgggtattctccaagcccgacccacccaccaacagggcagtataccttgttccccttgccgccgaccctccccacacccgtggttcagctgcatcctctgctgcccgacccctctgcgcccactcctactccgacatccccgctgctgaataccagctacacacactcacagaacctcagtcaagaagga

SEQ ID NO: 20033 - DNA, 1059 bp, Artificial Sequence
  Description of Artificial Sequence: Synthetic coding sequence
atggaacttacggagctcttgctggtcgttatgcttctgcttactgctcgcctaactctgagctcacccgccccgcctgcatgtgatctgagggtactgagtaaactgcttcgtgacagtcatgttctgcattctcgactgtcccaatgccccgaggtgcatccccttccaacccccgtccttctccccgccgtggacttctccctgggcgagtggaagactcagatggaagaaacaaaggcccaggatatcctgggtgcggtgactctcctgctggagggggttatggctgctagggggcagctaggaccaacatgcctttcgtcccttctgggccagctgtccggacaggtgaggttgttgctgggggcacttcagtctctgctgggtacacagttgccacctcaggggagaactaccgcccacaaggacccgaacgccatcttcctgagctttcagcacctccttcgaggaaaggttaggttcctgatgctggtggggggttccacactttgcgttcgaagagccccgcctactaccgccgtaccctctagaacgtcccttgtcctcaccctgaacgagctcccgaacaggacatcaggtctgctcgaaactaattttaccgcctccgcacgcacaactggatcaggcctcttgaaatggcagcagggctttagggcaaagatccccggactgctaaatcagacttcccgaagcctggaccagatcccaggctatctcaaccgaatccatgaactcctaaatgggactcgaggtctttttcctggcccatctaggcgcaccctgggtgctccggatatttctagcgggaccagtgatacagggagcctgccgcccaacttacagcccgggtacagcccctcccccacacaccctcccacaggccagtataccctcttccccttgcctcccaccctgcccaccccggtcgtacaattgcatcccttactacccgacccatccgctcccacgccaaccccgacttctccattactcaatacaagttacacccatagccaaaatttgagtcaagaggga

SEQ ID NO: 20034 - DNA, 1059 bp, Artificial Sequence
  Description of Artificial Sequence: Synthetic coding sequence
atggagttgacggaactgttgctggtggtgatgctgctgcttactgcgcggctgacgctctcgtctccggcaccgccggcttgtgaccttagggtgctttctaagctgctgcgcgattcccacgtgttgcactcgcggcttagccaatgccctgaggtgcatcctctgcctactccggtccttctgccggccgtggacttctcgctgggagaatggaaaacccagatggaggaaaccaaggcccaggatatcctcggagccgtgacccttctcctggagggtgtgatggccgcccgcgggcaactgggcccgacttgcctgtcctcgctgcttggtcaattgagcggacaggtgcgcctcctcctgggcgcccttcagtcgctgctcggcactcaactcccgccacaaggacggaccaccgcacataaagacccgaacgcgatcttcttgtcgtttcaacatctgctccggggaaaggtgcggtttttgatgcttgtggggggatccaccctctgcgtgcgccgcgccccgcccaccactgccgtgccttcccgcacttcgctggtcctcacgctgaacgaactgccgaaccgcactagcggcctcctggaaaccaatttcactgcctcggcccggactactggatcgggactgctgaagtggcagcagggcttccgcgcaaagatcccgggattgctcaaccagacctcacggtcgctcgaccaaatccctggatacctgaaccgcatccacgagctgctgaacggcacccgaggactcttccctgggccgtccagaaggaccctcggcgccccggacatcagctcaggaacctcagatactggttcgctgcctccgaacctccagccgggctacagcccatcaccgacccaccctccaactggccaatacacccttttcccgttgcccccgacgctgccgacgccggtggtgcaactgcatccactgctgcctgacccgtccgccccgaccccgaccccaacgagccccctgttgaatacctcgtacacccactcgcagaatcttagccaggaggga

SEQ ID NO: 20035 - DNA, 1059 bp, Artificial Sequence
  Description of Artificial Sequence: Synthetic coding sequence
atggaacttacagaattgttgttggtcgtgatgttactccttacagcacggcttacactttcatcaccagcgccgccggcgtgcgatttgagagtcctctcaaaactgttgcgcgattcacatgtgctgcattccagattgtcacaatgcccagaagtgcatccattaccaactccggtcctgttgccagcggttgacttctcccttggcgagtggaaaacgcaaatggaagaaacgaaagcacaggacatcctgggtgctgtcacgctactgcttgaaggagtgatggctgcgagaggtcagctggggccgacgtgcttatcttctttacttggccagctgtccggacaggtcagactgctgttaggggcccttcaatcactgttgggtacacagcttcccccgcaggggcgcacgacagctcataaagatcctaatgctatctttctttcttttcagcacttattacgcggaaaggtccgattcttaatgttggtggggggatcgacgctgtgcgtacgaagggcccctccaaccacagccgttccctcgcgaacatcactggtgttgacattaaatgagctgccgaacagaacgtcaggcctgctggagaccaatttcacggcgtccgcacgtacgactggttcggggctgctgaagtggcaacaaggatttcgggcgaaaattcctggattacttaatcagacatcgcgttctttggatcaaataccgggttatctgaatcggattcatgaattgctgaatggaacacgaggattatttcctgggccgtcacggcgaacattgggcgctccagatatttcttctggcacgtcggatacaggttcacttcccccgaatcttcagccgggatatagcccgtccccgacgcacccgccgaccggtcaatacacgctattcccgttaccgcctacattgccgacacctgtcgtccaactccatccgttgttaccggatccgtccgctccgacgccgacgcccacttcacctttactgaacacttcctatactcatagccaaaatctgagtcaagaagga

SEQ ID NO: 20036 - DNA, 1059 bp, Artificial Sequence
  Description of Artificial Sequence: Synthetic coding sequence
atggaattgaccgagttgctgctggtcgtaatgctcttgctcactgccaggttgaccctttcctcaccggcaccccccgcatgtgatctgagggtgctcagcaagctgctgagggactctcacgtcctccattctcgcttgtcacaatgtccggaggttcaccctctgcccacacctgtccttctgccagctgtcgacttcagcctgggcgagtggaaaactcaaatggaagagactaaggcccaggacatcctgggtgccgtcaccttgctgcttgagggtgtaatggccgctagaggacagcttggtccaacatgccttagcagtctgttgggacagctcagtggacaggtgagactcctgctgggcgcgctccaatcccttttgggaacacagctccctccacagggtaggacaacggcacacaaagacccgaacgcaattttcttgtctttccagcatctcctccgcggcaaagtaagatttctgatgctcgttggcggctctaccctgtgcgtgaggcgcgcgccacctacgaccgcagtgccctccaggacctccctcgttctgactcttaacgagttgcccaataggacttccggcttgctggagaccaactttactgcctctgcgaggacgaccggatcaggattgctgaagtggcagcagggctttagagctaaaatacccggtctcctcaaccagacctcacgcagccttgaccaaattcctggctacctgaacaggatccacgaactcttgaatggaaccagaggtctcttccctggacctagcagacgcacccttggcgctccggatatctccagcggtacaagcgacaccggaagccttcctcccaacttgcagccaggttactcaccctctccgacccacccccccacaggtcagtacacactgttcccgctcccccccaccctgcccacaccagtcgtccagttgcaccccctgcttcctgacccatccgctccaactcccacacccacttctcctcttctgaacacctcttatactcatagccaaaatcttagccaggaggga

SEQ ID NO: 20037 - DNA, 1059 bp, Artificial Sequence
  Description of Artificial Sequence: Synthetic coding sequence
atggaattaacagaactgctgcttgtggtaatgctccttctaacggctaggctgacacttagttctccggcccccccagcctgtgatctacgggttctctccaaactgctcagggattcacacgtgctgcactctaggctttctcagtgtccagaggtgcaccccctgccgacacccgtccttctaccagctgtcgatttttcactcggagaatggaaaacacagatggaagaaactaaagctcaggacatcttaggggcagtcactctactgctcgagggggtcatggctgctcgcgggcagttggggccaacttgcctctcctctcttttaggacagctctctgggcaggtgaggttactgcttggagctttgcagtcgttattaggaacacagctccctccccagggacggactactgcacacaaagaccccaacgccatcttcctgagtttccagcatctcctgcggggaaaagtaaggtttctgatgctcgtgggagggtctactttatgcgttcggcgggctcctcctacaacagccgtccctagtcggacttccttggttttaacactcaatgaactacccaatagaacatcagggctactggaaactaactttactgcttccgctcgcacaacaggatcagggctccttaaatggcagcaggggtttagggctaagatccccggactgttaaatcagacttctaggtcactggaccagataccagggtatctgaaccggatccacgaactactcaatgggacaagaggattatttccaggaccctcacgcaggactctaggggctcctgatatctcatctggaacatctgatactggatcactcccacccaatcttcagcccggatattccccctcacccacacatccacctacagggcagtatacactcttcccactaccaccaactctccccactccggtcgtgcagctgcaccctctgctgcctgacccatccgctcccactcctactccaacatctcctcttctcaatacttcttatactcactctcagaatctatcacaggaaggg

SEQ ID NO: 20038 - DNA, 1059 bp, Artificial Sequence
  Description of Artificial Sequence: Synthetic coding sequence
atggaactcaccgaactgcttctcgtggtgatgctgctgcttacagcacgtctcacgctgagctcaccagcccccccagcttgcgatcttagggtactctccaaattactcagagatagccatgtgctccacagccggctgtctcagtgtcccgaggtccaccccctgcctactccagtccttcttccagctgtggatttctctttgggcgagtggaagacccagatggaagagaccaaagcccaggatatcttgggcgcagtgactctgctcctggagggagtaatggccgcccgtggacagcttggaccaacatgtctctcttcgctgctaggtcaattgtcaggacaggttcgtctgttactgggcgcgctgcagtcactgctcggtacacagctccctccgcagggaaggaccacagctcacaaagatcctaacgccatattcctgtcgtttcagcacctactgagaggtaaagtgaggtttcttatgctggtcggagggtcgacactgtgcgtccgccgcgcaccccccacgactgccgtacctagtcgaacaagccttgtgctgacacttaacgagttgccgaataggacctcaggcctcctagaaacaaacttcacggcctcagcacggacaaccggatctggcctccttaaatggcagcaaggcttccgcgccaagatccccggcttacttaaccagacctcgagatcattggatcagattcctgggtatttaaaccggatccacgaactgctcaatggcactcgcggcctgtttcccggaccgtcccgccggactctgggcgcgccggacataagctcgggaacttcggacacaggctccctgcccccgaatctgcagcctggctatagtcccagcccgactcatccccctacgggccagtacacccttttcccgctgcccccaacgttgcctacgcccgtggtgcagctgcacccattgttgcctgacccttccgcccctaccccaacccctacctcccctctgctgaatacctcgtatacgcactctcagaatctatcccaggagggc

SEQ ID NO: 20039 - DNA, 1059 bp, Artificial Sequence
  Description of Artificial Sequence: Synthetic coding sequence
atggagctgacggaacttcttctcgtggtcatgctgcttctcactgcacgcctgaccctttcaagcccagccccaccagcttgcgaccttagagtgctgtcgaaactccttcgagactcccatgtgcttcactcgcgtctgtcgcagtgccctgaagtgcatccactgcctacccccgtgcttctgcctgcagttgatttctccctgggggaatggaaaacccagatggaggagactaaggcacaggacatccttggagcggtcacccttttgctggaaggtgtgatggccgcaagaggacaactcggccccacctgtctgagctccctcctgggacaactttcgggacaagtgagactcctgctgggtgcccttcagagcctcctgggtacgcaactgcctccacagggccggactacggcacacaaggatccgaacgcgatatttctgtcattccagcatctgttgagaggaaaggtgagattcctcatgctcgtcggcggctccaccttgtgtgtcagaagagcgcccccgactactgcagtgccctcccggacctcgttggtgctcaccctgaacgaattgcctaaccgtacgtccgggctgctggaaacgaactttaccgcgagcgctcgaaccaccggttccggactgctgaaatggcaacagggctttcgtgcaaagattcctggtctgctgaaccagaccagtagatcccttgaccaaattcctggataccttaatcgaattcatgagctgctcaatggcaccagaggcctcttccctggtccctcacgcaggactcttggtgcgcctgatatctcgagcggaacctcggatactggttcactgccccctaatctccaacctggctactccccttcccctacgcatccccctaccggtcagtacaccctgtttccactgccgccaacgctgcctaccccggtggtccagcttcatcctttgctgcctgatccttctgcacctactcctaccccgactagcccactcctgaatacttcttacacgcatagccaaaacctgtcgcaagagggg

SEQ ID NO: 20040 - DNA, 1059 bp, Artificial Sequence
  Description of Artificial Sequence: Synthetic coding sequence
atggagctgactgaactcttgctcgtggtcatgttgctgctgaccgctcgcctgaccctctcctctccagctccacctgcgtgcgatctgcgcgtcctgagcaagctcttgagggactcccacgtgctccactcgcgcctctcgcagtgtccggaagtccacccgcttccaactccggtgctcctcccggccgtggatttttccctgggggagtggaaaactcagatggaggaaactaaggcgcaagacatcctgggagccgtcactcttctgttggaaggcgtgatggccgctcgcggccaactcggtccgacgtgcctttcatcgctgcttggtcagttgtcaggacaggtccgcttgctccttggagcacttcaatccctgctgggcacccagctgccgccccaagggcggaccactgcccacaaagaccccaacgccatcttcctgagcttccagcaccttctgcgtggaaaggtgaggttcctcatgctggtgggcggatccaccctgtgtgtgcggagggcaccgccgaccactgccgtcccgagccgcacctctctggtgttgacgctcaatgagctgccgaaccgcacttccggcctgctcgaaacgaacttcaccgcgtcggctcgaacgaccgggtccggccttctcaaatggcagcaaggatttcgggccaagatccctggcctcctgaaccagacgtcccgctcgttggaccagatcccaggctatctgaatagaatccatgaactcctgaacggaacgcgcggcttgttccctgggccatcgaggcgcaccctcggagcgccagacattagctcgggaacctcagatacggggtccctgccaccgaacttgcagccgggctactccccatcaccaacccatccgcctaccggacagtacacccttttcccgctcccgcccactctgcctacgccggtcgtgcagctccaccccctcctgccggacccctcggcaccgaccccgactccgacctccccactgctgaatacctcatacacgcactcccagaacctgagccaagagggg

SEQ ID NO: 20041 - DNA, 1059 bp, Artificial Sequence
  Description of Artificial Sequence: Synthetic coding sequence
atggaactgaccgaactcctccttgtggtcatgctcttgctgactgcccgtctgactctttcgtcccccgcgcctcctgcatgtgatcttcgtgtcctttcaaagctcctccgagactcgcatgtgctgcattccaggctttcacaatgccctgaggtgcatcccctgccaactccagtcctcctccctgcggtcgatttttccctcggcgagtggaaaacccagatggaggaaaccaaggcacaagatattctcggcgcagtgactcttcttcttgaaggcgtcatggctgcaagggggcagctggggccaacctgtctcagctcgctgttgggtcagctgagcggacaagtccgtctgctgctgggggcccttcaaagccttctcggcacccaacttcctcctcaggggcggaccaccgcacataaggacccaaatgctatctttctttcgtttcaacacctgctcagagggaaggtgcgatttcttatgctggtgggtggatcgacgctgtgcgtgcggcgggcgccaccaaccaccgcagtaccttcgcggacctcgctggtgcttactcttaatgaactccccaatagaactagcggactgctcgaaaccaactttacggcaagcgcacggactaccggatcggggctccttaaatggcaacaggggtttcgagccaaaatacctggtttgctgaaccaaacctcacggtccttggaccaaattcctggttacctcaaccgcatacacgagctccttaatggaaccagaggcctgttcccaggcccttcgaggcgcaccctcggagctcccgatatctccagcggaaccagcgataccggctccctgcctccgaatctccagcccggatactctccttcccctacgcaccctcctaccggtcagtacactcttttcccattgcccccaactcttcccactccagtcgtccagttgcaccctctgcttcccgatccttccgcacccacccccacgccaacctcgcctttgcttaatacttcgtatacgcattcgcagaacctttcgcaagaagga

SEQ ID NO: 20042 - DNA, 1059 bp, Artificial Sequence
  Description of Artificial Sequence: Synthetic coding sequence
atggagctgacggaactgctgctggtggtgatgctgctgctgacagcgcgattgacattgtcaagccctgcaccacccgcatgcgatctccgtgtgctttctaaactgctgcgggattctcatgtgctgcactctcgattgtcccagtgcccagaggtacacccgctaccaacccctgtactgcttcccgccgtggatttctcactcggcgaatggaaaacccagatggaggagacgaaagctcaagatatattaggggccgtgacgcttctcctggagggggtgatggctgcccggggccagcttggacccacttgcttgtcgtcattgctaggccagttaagtggacaggtaagactgctactgggagctctacagagcctgcttgggacgcaattgcctccacaaggaaggaccacggcccataaggatcctaatgctatcttcctgtccttccagcaccttctccgagggaaggtgcggttcctgatgttggttggtggctccactctttgcgtcagaagggcccctcctacaaccgcggtcccgtcacgcacatccctcgtgctcactttgaatgaactacccaaccggacctcaggtctgctggagaccaattttaccgcttccgctcgtaccaccggttcaggactcctcaaatggcagcagggattccgagccaagataccaggactgctgaatcaaacaagcaggagtctggatcaaataccggggtatcttaatcggatccacgagttgctgaacggcactcggggattgtttcctgggccttcccgaagaactctgggggccccggatatctctagtggaacctcggatactgggagccttcctcctaacctgcagcccggctattcaccaagcccaacccatcccccaaccgggcagtacacgctgttcccactgcctccaacactcccaacccccgttgtacaattgcatcctctactccccgacccttctgcccccacaccaacccccacgtcccccctgctaaatacgagctacacgcactcccagaacctgtcacaggaaggc

SEQ ID NO: 20043 - DNA, 1059 bp, Artificial Sequence
  Description of Artificial Sequence: Synthetic coding sequence
atggagcttactgagttgcttttggtggtgatgctcctcctgactgcacggctgaccctttcgagcccagcaccgcccgcatgtgatcttcgggtgcttagcaagctcctccgcgactcccacgtccttcactcccggctgtcacaatgtccggaagtgcaccctctcccgacgcctgtgctccttcccgcagtcgactttagcctcggcgaatggaaaactcagatggaagagactaaggcacaagacattttgggggcggttacccttctcctcgagggagtgatggcagccagaggacaactcgggcctacctgtcttagctccctgctgggccaactgtcgggccaagtcagactgctgctgggagccctccagagcctcctggggactcagctcccgccacaggggcgcactactgctcacaaagatcccaacgcaatctttctgtcattccagcatctcttgagaggaaaggtgcggttccttatgctggtcggcggaagcaccttgtgtgtgaggcgtgcacctcctactaccgcagtgccgtcccgtacctcgcttgtcctgacccttaatgaactgccaaaccggactagcggcctccttgaaacgaactttaccgcatcagcacgtacgactggctccgggctgctgaagtggcagcaaggcttcagggctaaaatccccggccttctgaaccagacctcacgctctcttgatcagattcctgggtacctcaacagaatccacgaattgctgaacgggactaggggtttgtttccaggcccctcacgaagaactctcggagctcctgacattagctccggcacgtccgataccggttccttgccacctaatcttcaaccaggatactcgccatcacctactcatcccccaactggacagtacactctgtttcctctccctccgactcttcctacccccgtcgttcaactgcatcctcttcttcctgatccatcagcccccacccctaccccaacctcaccccttcttaatacttcctacactcattcccaaaacctgagccaagaaggc

SEQ ID NO: 20044 - DNA, 1059 bp, Artificial Sequence
  Description of Artificial Sequence: Synthetic coding sequence
atggagctgactgaactgctcctagtggtcatgcttctacttacggctcggctgacgctgtcttcgcccgcgccaccggcatgtgacctgcgggtgctgagcaaactattgagagattcgcatgtcctgcacagccgcttgagtcaatgtcctgaggtccaccccctgccaactcctgtgctgcttcccgcggtagatttttctctcggcgagtggaagacacagatggaggagactaaagcccaggatattctcggcgccgttaccttgttgctggagggcgtcatggccgctcgcggacagctcggccccacatgcctgagctccctgttgggccagctgtccggtcaggtgcgcctgctgttgggcgccctacagtcattgctaggcactcagttgccgccacaaggccgcaccacggcgcacaaagatcccaatgccatctttctgtctttccagcatcttctgcggggcaaggtgcgattcctgatgctggtaggcggctcgaccctttgcgtacggagggccccgccaacaacggccgtgccgtcccgaacaagcctggtgcttacactgaatgagctcccgaacagaactagcggcctcctcgagacgaattttaccgcctctgcgagaacgactggcagcggtctgctgaaatggcagcagggcttccgtgccaagatcccaggattgctgaaccaaacatcgcggtccttagaccaaatcccgggttacttgaatcggatacacgaattgcttaacggtactcgcggcctctttcccgggccctctcgacgcacgttgggcgcgcccgatatctcgtcgggaacgtcggatacgggatcgctgcccccaaatctacagccaggatatagtcccagtccaacccacccaccgaccggccagtatacgctgtttccacttccacccacactgcccaccccggtggtccagctgcatcccctgctgcccgatccctccgcgccgacacctacccccacctcacccctgttgaacacttcgtacactcactcccagaacttgtcccaggagggt

SEQ ID NO: 20045 - DNA, 1059 bp, Artificial Sequence
  Description of Artificial Sequence: Synthetic coding sequence
atggagcttaccgaattgcttctggtcgtgatgcttctgctcaccgctcgcctcaccctctccagcccagcacccccagcatgtgacttgagagtccttagcaagctgctgcgtgactctcatgtgttgcattcgagactctcgcaatgtcccgaagtgcatccactgcctactccggtcttgcttccggcggtggatttctcactgggagaatggaaaactcagatggaggagacgaaggctcaggacatcctgggtgcagtgactttgcttctggaaggcgtgatggctgcccgagggcaactcggccctacttgcctctcctccctcctgggtcagctgtcgggacaggttagacttctgctgggagcactgcaatcactgcttgggactcagctgccaccacaaggtcgcactaccgcccacaaggatccaaacgcgattttcctctcctttcagcatcttctgagggggaaagtgcgttttctcatgttggttggtgggtcaactctgtgtgtgcgaagggcacctccaacgactgccgtgccatcccgaacctccctggtccttactctgaacgaacttcctaaccgtaccagcggacttcttgaaacgaactttactgcatcagcgcggacgactggctccggacttcttaagtggcagcaaggtttccgggcaaagattcctggattgctcaaccaaacgagccggtcattggaccagattccaggatacctcaatcgaatacacgaattgttgaacggcactcggggtctttttcctggacctagccgcaggaccttgggcgcaccggatatctcgtcgggaacctcagataccggttccctccctcctaatcttcaacccggttacagcccatctccgacccatccgcccacgggacaatacacgttgttcccactgcctcctacgctgcccacccctgtggtgcaacttcaccctctgctccccgaccctagcgccccaacccccacccctacttccccacttctgaatacctcgtacacccattcccagaatctgtctcaagagggc

SEQ ID NO: 20046 - DNA, 1170 bp, Artificial Sequence
  Description of Artificial Sequence: Synthetic coding sequence
atgcccccttccggactgcggctactccctctgcttctcccactgttgtggctacttgtgctcaccccaggtcgcccagctgcggggctgtcaacgtgcaagacaattgatatggagcttgtcaaaagaaaacgcatcgaggcaatcagggggcagatccttagtaaacttaggcttgcctctcccccgtctcagggagaggtccctccaggacccctccccgaagccgttctggctctgtacaattcaaccagggacagggtcgcaggagagtccgctgaacctgaaccagaacccgaagccgactattatgctaaagaagtgacccgggtgttgatggtggagacacacaatgagatctatgacaagtttaagcagtctacccactcaatttatatgttctttaacaccagcgaactacgcgaggcagtacccgagcccgtgctcctgtcgagggccgaactgaggctcctcagacttaagttgaaggtagaacagcatgtggaactgtaccaaaagtatagcaacaatagctggagatatctgagtaacagactgctcgctccttcagactcaccagagtggttgtccttcgacgttaccggagtagtccggcagtggctgtcccgggggggagagattgagggttttaggctgtcagcacattgttcttgcgactccagagacaataccctgcaggtggatattaatggctttacaactggccggagaggtgacctcgctactatccatggcatgaatcgcccctttctgctccttatggccacccccttggagagagcccagcacctacagtctagccgtcacaggcgcgccctcgacaccaactattgtttctccagcactgaaaaaaattgctgtgttaggcagctctacatcgattttcgcaaagatttgggctggaaatggatccatgagccaaagggatatcatgccaatttctgcctgggcccatgtccttacatctggtccttggatactcagtactctaaggttcttgcactttataaccagcacaatccaggcgcctctgccgcaccgtgttgtgtcccccaggccttagagcccctccccattgtatattacgtgggtcgaaaaccaaaggtagagcagctctcaaacatgattgtgaggtcctgtaaatgtagc

SEQ ID NO: 20047 - DNA, 1170 bp, Artificial Sequence
  Description of Artificial Sequence: Synthetic coding sequence
atgccaccttccggcctgcggctgcttcctctgctgctcccattattgtggcttctcgtgctgactccggggcggcctgccgcaggcctgtccacatgcaaaaccatagacatggaactagtgaagcgaaagcgtattgaagctatacggggccagatcctttccaaactccgtcttgcgtccccgccctctcaaggtgaggttcctcctggcccactgcccgaggccgttttagctctatataactccaccagggaccgcgtagcgggggaatcagccgaaccagaaccggagcccgaggctgattactatgccaaagaagtgaccagagtgctgatggtggagacgcacaatgaaatctacgacaaattcaaacagtcgacccactctatatacatgttctttaatactagcgagctgcgagaagccgtgcctgagcccgtgctgctttcaagggcggagctgcgtctcctgaggctgaagctgaaagtggagcaacacgttgaactttaccagaaatacagcaacaactcctggaggtacttgtctaatcgtctcctggcaccaagcgattccccagaatggttgtcattcgacgtgaccggggtagtgcgacagtggctgtcaaggggcggcgagattgaggggtttcgtctctccgcacattgttcttgtgacagtagggataatacgctgcaggtcgacataaacggcttcacaacaggcaggcgaggtgatctggctacaattcacggcatgaataggccattcctgctccttatggctacaccactagaacgtgcccagcacctccaaagctcacgccatcggagagcactcgataccaactactgcttttcgtctacggaaaaaaactgttgcgttcgccagctctacattgattttcggaaagacttgggttggaagtggattcatgaacctaaagggtaccatgcaaacttctgcctgggcccttgcccctacatttggagcctggatacacaatacagtaaggtgctggccctctacaatcaacataatcccggagctagcgcagcaccttgttgtgtcccgcaggctttagagccattgcccatcgtgtactatgtgggcagaaagcccaaggttgaacagctctccaatatgatagtccggtcttgcaagtgttca

SEQ ID NO: 20048 - DNA, 1170 bp, Artificial Sequence
  Description of Artificial Sequence: Synthetic coding sequence
atgccaccgtccggactccgcttgctcccgctgctcctgccactgctgtggctgctcgtgttgaccccgggcaggccagcggcgggactgtcaacctgcaaaactatcgatatggaattggtgaagagaaaacgcatcgaggccatcaggggacaaattctgtccaagctgcggttggcctccccgccaagccaaggagaagtgcccccaggtccactgcccgaggccgtgctcgccctgtacaacagcactcgcgaccgcgtggcaggagagtccgcagaaccggagccagaaccggaagcagattactacgcgaaagaagtgactagagtcctgatggtggaaactcacaacgagatctacgataagttcaagcagtcaacgcacagcatctacatgttcttcaatacctccgaactccgagaagccgtcccggaacccgtcctgctctccagagccgaacttcgcctcctgcgcctgaagctgaaggtggagcagcacgtggagctctatcagaagtactcaaacaattcgtggaggtacctgtccaacaggctgctggccccgtcggactcccctgaatggctcagtttcgacgtgaccggagtcgtgaggcagtggttgagccgcggaggagaaatcgaaggattcagactgtcggcacactgttcctgtgactctcgcgacaacaccctgcaagtggatatcaacggatttaccaccggccgccgcggggatctggcaactatccatgggatgaaccgcccattcctgctgctgatggcaacccctcttgaacgcgcccagcatctccagtcgtcccggcaccggcgcgcgctggacaccaactactgtttcagctcgactgaaaagaattgttgcgtcagacagctgtacatcgatttcagaaaggatctcggctggaaatggatccacgagccgaagggataccacgctaacttttgtcttggcccgtgtccgtacatctggtccctggacactcagtattccaaggtgctggccctctataaccaacataatccaggagccagcgctgcgccatgctgcgtcccacaggcactggaaccgctgccgattgtgtactacgtgggaaggaaaccaaaggtcgagcagctctctaacatgatcgtgcggtcatgcaaatgctcg

SEQ ID NO: 20049 - DNA, 1170 bp, Artificial Sequence
  Description of Artificial Sequence: Synthetic coding sequence
atgccgccctcaggcctcaggctgttgccactgctgctgcccttgctctggcttcttgtgctcacccctggaagaccagccgccggactgtcgacatgcaagacaattgatatggagctggtgaaacggaagagaatcgaagctataaggggacaaatcctttcaaaactcaggttggcctctccaccctcccagggggaggttccaccgggacctctgcctgaggctgtgctggccctatacaacagcacaagggacagagttgctggcgaatctgctgaacccgagcccgaaccagaagctgattattatgctaaagaagttacccgagtgctgatggtggaaacacataacgaaatttatgacaaattcaagcagagtacccacagcatttacatgttctttaacactagcgagcttagggaagccgtacctgagcctgtgctcttgtcgagagctgaactccgtctgctgcgacttaaacttaaagtggagcagcacgtcgagctgtatcaaaagtactctaataacagttggagatacctctctaacagactgctagcacccagcgactcacctgaatggctcagttttgacgtgacaggcgtggtccgccagtggctcagtaggggaggagaaatcgaaggatttaggctgagcgcccactgctcgtgcgacagtagagataacaccttgcaggtcgacataaacggtttcactaccggaagaaggggggacctcgccacaatccatggaatgaaccggcccttccttctcctgatggccacaccgctcgagagagcccaacatctgcagtcaagccggcataggagggcgctggacactaactactgttttagcagtacagaaaaaaattgttgtgtccgtcaactctatatagattttcgcaaggatctcggatggaaatggatccacgagcccaagggatatcacgctaacttctgcctggggccgtgcccctatatttggagcttggatactcaatatagcaaagtactggctctgtacaatcaacacaatcccggagcttccgctgctccgtgctgcgtaccccaggccctcgagccactacccattgtatactatgttggtagaaaacctaaagtggaacaactgagcaatatgatcgtacgcagttgcaagtgctca

SEQ ID NO: 20050 - DNA, 1170 bp, Artificial Sequence
  Description of Artificial Sequence: Synthetic coding sequence
atgccgccatccggacttaggctgctgcctctgcttcttccgctgctgtggctgttggtactgactccgggccggcctgcggcgggtctgtcgacgtgcaaaaccatcgacatggagctggtcaaacggaaacgcatagaagcaattcggggtcagatcctgagcaagctcagactggcttcgcccccctcccagggtgaagtgcctccgggaccgcttcctgaagctgtgctcgctttgtacaatagcacccgggacagggtcgctggagagtcggccgagcccgagccagagccagaggccgactactacgcgaaagaagtcacccgagtgcttatggtggaaactcacaatgagatctacgataagtttaagcaaagcactcattcgatatacatgttcttcaatacttccgagctcagggaagctgtcccagaaccagtgttgttgtcacgggctgaactgcggctgctgcgcctgaagctcaaagtggaacagcatgtcgaactgtaccagaagtattcaaacaacagctggcgctacctgtctaaccgactgctggcccccagcgactccccggagtggctgagctttgacgtgactggagtggtccgtcaatggcttagccgcggcggagaaatcgaagggtttagattgtccgcccactgttcatgcgactcaagagataacaccctgcaggtcgacattaatggcttcaccaccgggcggcgcggagatctggcaactattcacggcatgaaccgcccgtttctgcttctgatggccacgcctctggagcgggcgcaacatctgcaatcaagtagacaccgccgggccctggacaccaactattgcttctcgtccaccgagaagaactgttgtgtcagacagctgtacatcgattttcgcaaggatctcggttggaagtggatccacgaaccaaagggctaccatgctaatttctgcctcggaccgtgcccgtacatctggtccctggacacgcagtacagcaaggtgctcgccctgtacaaccaacataatcctggtgcaagcgccgccccgtgctgcgtgccgcaggctctggagccgctgccgatcgtttactacgttggacgcaaaccgaaggtggaacagctctcaaatatgatcgtccggtcctgcaagtgctcg

SEQ ID NO: 20051 - DNA, 1170 bp, Artificial Sequence
  Description of Artificial Sequence: Synthetic coding sequence
atgccaccgtccggcctccgccttctgcctttgctcctgcccttgctgtggctgcttgtgttgacgcccggcagacctgcggcgggcctttcaacctgtaagactattgacatggaactggtgaagcgcaaaagaatcgaagcaatcagaggacagattctttccaagctgcgacttgcctcacctccatcacagggggaggtcccaccaggacctctgccagaagcagtgctggccctgtacaattcaacgcgtgaccgtgtggcgggggagagcgccgagcctgaacctgaacccgaggcggactactacgcaaaagaggtgactagagtgctcatggtcgaaactcataacgagatttacgacaagtttaagcagtccacccatagcatctacatgtttttcaatacttcagagctccgggaagctgtgccagaaccagtgttgctttcgcgtgcagagcttcggcttctgcgcctgaagttgaaggtcgagcaacacgtggaactgtaccaaaagtactcaaacaattcgtggcgatacctttcgaaccggttgcttgcaccttcggatagtccagagtggctctcatttgatgtgaccggagtcgtcagacagtggctctcgcggggtggagaaattgaaggttttcggctctcggcacattgttcctgtgactccagggataatactctgcaagtggacattaacggatttacgactggacgcaggggcgatctggcaacgattcacggaatgaatcggccatttcttcttttgatggcaaccccacttgagcgagcacaacatctgcagtcgtcgcgtcatcgccgggctcttgataccaattactgcttttcgtcgaccgaaaagaactgttgtgtcaggcaattgtacattgactttcggaaagatcttggttggaaatggatccatgaacctaaagggtaccacgcaaatttctgtctgggtccttgtccatacatttggtccctggatacccagtattcaaaggtgcttgccctttacaaccagcacaatccgggggcctccgctgcgccatgttgcgtgccccaagcacttgagccccttccgattgtctactacgtgggaagaaagccaaaggttgagcaacttagcaacatgattgtgaggtcctgcaaatgttcg

SEQ ID NO: 20052 - DNA, 1170 bp, Artificial Sequence
  Description of Artificial Sequence: Synthetic coding sequence
atgcctccatccgggctcagactcctaccactgttgcttccattgttatggctcctcgttttgactcctggaagacctgccgctggactttctacatgcaaaacaattgatatggaattagtgaaacgtaaacgcatcgaagcaatccgggggcagatactctccaagctgcgcctcgccagtcctccctctcagggggaggtgccaccaggaccactccctgaagccgtgctcgctctatacaactcaactcgggatagggttgctggggaatcagctgaacctgaaccagaacccgaagcggattattatgcaaaagaagttactcgggtgctcatggtagaaacacataatgaaatctatgataaattcaaacagtctacacattctatatatatgttcttcaatacatccgaacttagagaagctgtgcccgagcccgtactcctctcacgagctgaactccggctcttacgcctcaaactgaaggtagaacagcatgtagaactttatcagaaatattcaaacaactcttggaggtatctttcaaataggttgctcgcacctagtgattcaccagagtggctgtcgtttgatgtgacaggagttgtgcgacagtggctctcaagagggggagaaatagagggatttcggctgagtgcacattgttcgtgtgatagtagggataatacactccaggtagatatcaatgggttcacaactgggcggcgcggggatcttgcaacaatacacggaatgaatcggccttttcttttattaatggccactccattagaacgcgcccagcacctgcagagttcccggcacagacgtgccctggatacaaactactgcttttctagtactgaaaaaaactgttgtgttcggcagctttatatagattttaggaaggatcttggatggaagtggatccacgagcctaaaggatatcacgcaaatttttgcctagggccctgcccttatatatggagtcttgacactcagtacagtaaagtgctcgctctctacaatcagcacaacccaggagcttcagcagccccctgctgtgtccctcaggcattagaaccgctacctatagtgtattatgtggggcggaaacctaaggtagagcagctctccaatatgatcgtgcgaagttgcaaatgttcc

SEQ ID NO: 20053 - DNA, 1170 bp, Artificial Sequence
  Description of Artificial Sequence: Synthetic coding sequence
atgccgccatccggactgcggctgctcccactgcttctcccccttctgtggcttcttgtgttgactcctggacgcccggccgccgggctctcgacctgcaagacgatcgatatggagctggtgaaacggaagcgtatcgaggcgatcagaggacaaatcctctcgaaactgagattggcttcccctccatcccagggagaagtgccgcctggaccactgcctgaagccgtgcttgctctctacaattcgactagagatcgggtcgctggagaatcagcagaacctgaaccggaaccggaagccgactactacgctaaggaggtaaccagagtgttgatggtggagactcataacgaaatctacgataagttcaagcaaagcacccacagcatttacatgttcttcaacacctccgagctccgcgaggcagtccccgagcctgtgctcttgagcagagctgagctgcgtctgttgaggctgaagctgaaggtggagcaacatgtcgaactctaccaaaagtactcgaataattcatggcggtacctctcaaacagattgctggctccgtctgactcgccggaatggctctcgttcgatgttactggagtggttagacagtggttgtcacggggcggagaaatcgaaggatttcgcctgtcggcccactgtagctgcgatagtcgggacaatacccttcaggtggacatcaacggattcaccaccggccggagaggggacctggccacgatccacggaatgaacaggccattcctgcttctcatggcgacccccttggagcgcgcccaacaccttcagtcctcacgacacaggagagcactcgataccaactactgcttttcaagcactgagaagaactgctgcgtgcgccagttgtatatagacttccgcaaggacctcggctggaagtggatccatgaaccaaaaggataccatgctaatttctgcttgggcccctgtccatatatctggtccctggatactcaatacagcaaagtgctggccctgtacaaccagcacaacccgggagcctcagccgccccatgttgtgtcccacaagcgctcgaaccactgccgatcgtgtattacgtggggcgcaaaccgaaggtggaacagctctcgaatatgatcgtgcgatcctgcaagtgctca

SEQ ID NO: 20054 - DNA, 1170 bp, Artificial Sequence
  Description of Artificial Sequence: Synthetic coding sequence
atgccgcccagcggactaaggttactgccattgctcttgcctcttctttggcttttggttctgaccccaggacgacccgccgccggcctcagcacttgtaaaaccattgacatggaactggtcaaacgtaagcggatcgaggccataagggggcagattttgtccaagctcaggctagcatcacccccatcacagggcgaggtgccacctggtccactgccagaagctgtgctggcactctataattcaactagagatagggtggctggcgagtccgccgagccagaacccgagcccgaggctgactattacgccaaagaagtcactcgggtcctgatggtagagacccataatgaaatctatgataagttcaaacagagcacacactccatatacatgtttttcaacacttccgaactgcgcgaagccgtaccagagcccgtccttttatcaagggccgagctgcgtctgttaaggctgaaactcaaggtcgaacaacacgtcgagctgtatcagaagtattctaacaattcctggaggtacctgagtaatagattgctcgctccctccgattcccccgaatggctgtcgttcgacgtgaccggagtggtccggcagtggctttcgagggggggcgaaattgaaggctttcgcttgagcgcacattgctcctgcgatagccgggataatacactgcaggtggatataaatgggttcaccacaggcaggaggggagacttggctaccattcatgggatgaatagaccattcttactgcttatggcgacccccttggagagggcacaacacctgcaaagttcaaggcacaggcgtgcactagatactaattactgtttcagctcaacagagaagaattgctgcgtgcggcagttatatatcgattttaggaaggacctgggatggaaatggattcacgaaccaaagggttaccacgccaacttttgtctcgggccgtgtccctacatttggtcccttgatacccaatattcaaaagtgttggctctctacaaccagcataaccccggcgcctccgcagccccctgctgcgtacctcaggctcttgaacctttgcctatcgtgtattacgtaggccgaaaacccaaagtagagcagctctccaacatgatcgtgaggagttgtaagtgtagc

SEQ ID NO: 20055 - DNA, 1170 bp, Artificial Sequence
  Description of Artificial Sequence: Synthetic coding sequence
atgcctccaagtggccttagactccttccgctacttctgccactgctgtggctgctggttctgacacctggcagacctgccgctggcttgagcacatgcaagacaatcgatatggaactagtcaagcgcaaacggattgaggctatccgggggcaaattctttccaaactgagacttgcaagcccaccatctcagggcgaggttcctccagggcctctgcccgaggccgttttagccctgtacaactcaaccagggaccgcgtcgccggagagagcgccgaacctgaacctgagcccgaagccgattactatgctaaagaagtcaccagagtactgatggtcgagacccacaacgagatatacgataagttcaaacagtctacacatagcatctacatgttcttcaacacttctgagctgagagaggctgtgcccgaaccagttctgctcagccgcgcagagttacggctgttacggctgaagctgaaagtcgaacagcacgtcgagctataccagaaatacagtaataattcatggcggtatttgtctaaccgcttacttgcccccagcgactcccccgaatggctatccttcgacgttaccggcgtcgtgaggcagtggctaagtcgcggaggggagattgaggggttccggctgtccgcccactgctcttgtgattcccgcgacaatactctgcaggtggacatcaacggatttacaaccggccgccgaggcgacctggctaccatccacggcatgaacagacctttcctgctgcttatggccacacccctggaacgggcacaacacttgcagtcctccaggcaccgccgggccctcgataccaattactgcttctcttctacagagaaaaattgttgcgtgcgccagctatatattgacttcagaaaggacctgggatggaagtggattcacgaacctaaaggctaccacgcaaatttttgcctgggtccttgcccctacatttggtctctggatacacagtacagcaaagttcttgccctgtacaaccagcataatcccggcgcaagcgccgccccttgttgcgttcctcaggctctcgaaccacttcccatcgtgtattatgtcggccgcaaacctaaagttgagcaactcagcaacatgattgtcaggagttgcaagtgttct

SEQ ID NO: 20056 - DNA, 1170 bp, Artificial Sequence
  Description of Artificial Sequence: Synthetic coding sequence
atgccgccgagcggtctgcgccttctgcctttgctgttaccactgttatggctcctggtgctgacgccgggtcgccccgctgctggtctaagcacctgcaagacaatagacatggaactggtgaagcgcaaacgcattgaggcgattcgcggccaaatactgtctaagctgagattggcttctcctccgagccaaggtgaagtccctccgggcccactgcctgaagcagtattggcgctgtacaacagcacacgtgatcgtgtcgctggtgaatccgcagagccggaaccggaacctgaggcagattattatgcaaaagaagttacgcgcgtgctgatggtggagacgcacaatgagatatatgataaattcaaacagtccactcatagcatctacatgttctttaatacgagcgagttgcgcgaggcagtgccggagccggtccttctttcccgcgcagagctgcgtctgttacgcctgaaactcaaggtggaacaacacgtggaactgtatcaaaaatatagcaacaatagttggcgctatctgagcaacagactgttagcgccttctgattctccggaatggctgagcttcgacgttactggtgttgttcgccagtggctgagccgcggtggggagatagaagggtttcgcctgtctgcacattgtagttgtgacagcagagacaataccctgcaggtagacatcaacggtttcactaccgggcgcagaggtgatctggccaccattcatggcatgaatcgcccttttctgttgctgatggcaactccgctggagcgcgcccagcacttgcaaagcagccgccaccgtcgcgcgcttgatacgaattattgctttagctctacggagaaaaattgttgtgtgaggcagttatacattgacttccgtaaagatctgggctggaagtggatccatgaaccaaagggctaccatgctaatttctgtctggggccatgtccgtacatttggagcctcgacacacagtactctaaagttcttgcgctgtataaccaacacaatcctggtgcgtctgcagcgccatgttgtgtcccgcaagcgctggagccactgccaatagtgtactacgttggtaggaagcctaaagttgagcagctgtcgaacatgattgtgcgcagctgtaaatgcagc

SEQ ID NO: 20057 - DNA, 1170 bp, Artificial Sequence
  Description of Artificial Sequence: Synthetic coding sequence
atgcccccctccggtttaagattgctgccactcttactgccactgctgtggttgttggtcttgacaccaggaaggccagcagcaggcttgagtacttgcaagaccatcgacatggagctcgtgaagagaaagcgcattgaagccatccggggacaaatcctgtcgaaacttcgcttggcttcgcccccaagtcaaggtgaggtgcccccagggccactgcctgaggccgtgctggctttgtacaactctacgagagacagggtggctggcgaatcagctgaaccagaaccagagccggaggccgattactacgccaaagaggtaacgcgggtcttgatggttgagacacacaacgagatatacgacaagtttaagcaatccactcatagtatatatatgttctttaatacatccgagctgcgagaagccgtcccagagcccgtgctcttgtcacgggccgaactgaggctcctgagattgaaactaaaagtcgagcagcatgttgagctctaccaaaagtactctaacaactcatggcgatatctctcgaacaggctcctggcccctagtgattcccccgaatggctgtcatttgacgtgaccggagtagttagacagtggctgagcagaggcggggagatcgaggggtttaggttatccgctcactgcagctgcgattctagagataacacattgcaagttgacatcaacggcttcactaccgggcgccggggtgatctcgcgaccatccatggaatgaacagaccatttctactactgatggctacaccattggaacgtgctcagcacctacagagttcacgtcataggagggcacttgacacgaattactgctttagctcaaccgaaaagaattgctgcgtgcgccagctatatatcgacttccggaaggatctgggatggaagtggatccacgagcccaaagggtaccacgctaacttttgccttggcccatgcccctatatttggtctttggatacccagtatagtaaggtcctggccctctataaccaacataacccaggggcatcggctgcgccatgttgcgtcccacaggccctcgagccgctgccaatagtttactacgtgggcaggaagcctaaggtggagcagctgtctaacatgattgtgcgttcctgtaaatgctca

SEQ ID NO: 20058 - DNA, 1170 bp, Artificial Sequence
  Description of Artificial Sequence: Synthetic coding sequence
atgcccccgtccggactgcgcttgctcccgctgcttctgccactgttgtggttgctggtgctgacgccagggcggccagccgcaggcctttccacctgtaagactatcgatatggagctggtgaaacgcaaacggatcgaagcaatccggggacaaatcctgagcaaactgaggctcgctagccctccatcccagggtgaagtcccaccggggccgcttcccgaagcagtgcttgcactctacaattctactcgggacagagtggctggagaatcggcggaacccgagccagagccagaagcagactactacgcaaaagaggtcaccagggtgctgatggtggaaactcataacgagatctacgataagttcaagcagtccactcactccatttacatgttcttcaatacttccgaattgcgcgaagcggtcccagaacctgtgttgctgtcccgcgcagagctgagacttttgaggcttaagctgaaagtggaacaacatgtggagctttaccaaaagtactcaaacaattcctggcggtatctctccaatcgcctcttggcccccagcgattcgcctgaatggctttcgttcgatgtgaccggagtcgtccggcaatggctgtcacgtggaggggaaatagaggggtttaggcttagcgcacattgttcgtgtgattcacgggacaataccctgcaggtggatatcaacggattcaccacgggaaggagaggggatctcgcgaccatccatggcatgaatcgtccttttctgctccttatggcaactcctcttgaacgcgcgcagcaccttcagtcatcacgacatagaagagcccttgacacgaactactgcttttcgtcgaccgagaaaaactgctgtgtccgccaactgtacatcgactttcggaaggatcttgggtggaaatggattcatgaacctaagggttaccatgcaaatttctgtctgggaccgtgtccatacatctggtcgctcgatacccaatactccaaagttcttgccctgtacaaccaacacaacccaggagcctcagcagccccttgctgcgtgccacaagcacttgaacccctcccaattgtgtattacgtgggacgcaagcctaaggttgagcaactctcgaatatgattgtccggtcgtgtaagtgttcc

SEQ ID NO: 20059 - DNA, 1170 bp, Artificial Sequence
  Description of Artificial Sequence: Synthetic coding sequence
atgcctccatcggggctcagactgcttccactgcttctccctctgctttggctcctcgtgctgaccccagggcgtcccgcagcaggactgtcgacgtgtaagaccattgatatggaactcgttaaaaggaaaaggattgaggcaatccgcggtcaaattctctcgaagctgcggctggcgtcgcctccctcgcaaggagaagtgcctcctggacctctccctgaagccgttctcgcactttacaactccactcgggaccgcgtggccggggaatctgccgagcccgaacccgaacctgaagcagattactatgcaaaggaagtcactagagttcttatggtcgagacgcacaacgagatttacgacaagtttaagcagtccactcattccatatacatgtttttcaatacctccgagcttcgggaagccgtgccagagcccgtgcttctgagccgcgcagagttgcgccttctcagactgaagctgaaagtggagcagcacgtggaactgtaccaaaagtattccaataactcatggaggtatctctcaaatcgactcctggctcccagcgattcacccgaatggctttcctttgacgtaaccggcgtcgtcaggcagtggctgtcacgtgggggtgagatagaaggattccgcctgtccgctcactgttcctgtgacagccgtgataacactcttcaggtcgatatcaatggattcaccaccgggcggcggggtgatcttgcaaccattcacggaatgaatagacctttcctgcttctgatggcgacccctcttgaacgggcccaacatctgcagagctccaggcatagacgcgcccttgataccaactactgcttttcatccactgaaaagaattgttgtgtgcgccaactgtacatcgatttccgaaaggatctcggttggaagtggattcatgaaccaaaggggtaccatgcaaacttctgtcttggtccatgtccatacatatggtctttggacacccaatactcaaaggtgcttgccctctataaccaacataaccccggagcatcagcggccccatgttgtgtgccacaggccctggaaccccttcctatcgtgtactacgtgggtcgaaaaccaaaggtcgagcagctgtcgaatatgattgtgcgttcatgtaagtgttcc

SEQ ID NO: 20060 - DNA, 1170 bp, Artificial Sequence
  Description of Artificial Sequence: Synthetic coding sequence
atgccgccgtcagggctgcgcctgctgcccctgctgctgccgttgctctggctgctcgttctgacgccgggacgacctgccgccggactctcaacttgcaagactatcgacatggaattggtcaagagaaagagaatcgaagccattagaggacagatcctctctaagctgcggctcgcctctcccccgagccaaggagaagttccaccggggccgctgcccgaagccgtcctggctctgtacaacagtacccgcgatcgcgtggctggggaatccgcagagccagaacccgagccggaagctgactactacgcgaaggaagtgactcgggttctgatggtggaaactcacaacgagatctacgataagttcaaacagagcacccactccatctacatgttcttcaatacttcggagctgagggaggctgtgccagagcctgtgctgctgtccagggcggagttgcggctccttagactgaagctgaaagtcgaacaacacgtggagttgtaccagaagtacagcaataactcctggcggtacctgagcaatagactgctcgcgccgtccgactccccagaatggctcagctttgatgtgactggagtggtgagacagtggctgagccgcgggggcgagatcgagggattcaggctttctgcgcactgttcatgcgactcgcgcgacaatactctgcaagtcgacataaacggatttaccactggcagacggggagatctcgccaccatccacggaatgaatcgcccgttcctcctcctgatggcgaccccgctggagcgcgcacagcacttgcagagctcacgccacagaagggcgctggacaccaattactgcttctcgtcaaccgagaaaaactgctgcgtcaggcaactgtacatcgatttcagaaaagatctcggatggaagtggatccacgaacccaaaggctaccacgctaacttctgcctcggaccatgcccgtacatctggtccctcgacactcaatactcgaaggtcttggccctctacaaccagcataatccgggagcgtcagcggcaccatgttgcgtcccacaggctctcgaaccgctgcccatcgtgtactatgtggggcgcaagcctaaagtggaacaactctcaaacatgatcgtgcggtcctgcaaatgtagc

SEQ ID NO: 20061 - DNA, 1170 bp, Artificial Sequence
  Description of Artificial Sequence: Synthetic coding sequence
atgccgccatcaggactgagactgctgcctctcctgctgcctctgctgtggttgctcgtgctcactccaggacgcccagccgcgggactgtcaacttgcaagactatcgacatggagcttgtgaagagaaagcgcatcgaagctatccgcggacaaatcctcagcaagctgcggctggctagccccccatcgcagggtgaagtgccaccgggaccactgcccgaagccgtgctggcgctgtacaactccacgcgggatcgcgtggccggagagtccgccgaaccagaacccgagcccgaagcagactactacgctaaggaagtgacgcgggtcctcatggtcgagactcacaacgagatctacgacaaattcaaacaatccacccactcgatctacatgttctttaacacgagcgaactgagggaagccgtgcctgagccagtgctgctgagccgcgcggagctcagactccttcgcctcaaattgaaggtcgagcagcatgtggaactgtaccagaagtactcaaataactcgtggcggtacctgagcaaccggctgttggccccttctgattccccggagtggctgtcctttgacgtgactggagtggtccggcagtggctgtcccggggaggcgagattgaaggcttccggcttagcgcgcactgctcgtgcgactcaagggataacactctgcaggtcgatatcaacgggttcactaccggccgccggggcgatctggcaacgattcacggcatgaatagaccgttcctccttcttatggccactcctctggagagagcccagcatctgcagtcaagccggcatcgcagggctctggacactaattactgctttagttccactgaaaagaattgctgcgtgcgccaactgtacatagatttcaggaaggacctcggttggaaatggatccatgagccaaagggataccacgcaaacttctgcctggggccttgcccgtacatctggtcgctcgacacccagtactcaaaagtcctggcgctctacaaccagcacaatcctggagcctcggcagcgccgtgttgcgtcccacaggccctggagcctctcccgatcgtgtactacgtaggacgcaaaccgaaggtggagcaactgagcaatatgattgtgcgctcctgcaagtgctcg

SEQ ID NO: 20062 - DNA, 1170 bp, Artificial Sequence
  Description of Artificial Sequence: Synthetic coding sequence
atgccgccgtcgggacttcgcctccttcctctcctgctgccactgctgtggcttctggtcctcactccaggaaggccggccgctggcctgtcgacttgcaagactatcgatatggaactggtcaagcgcaagcggatcgaagcaatccgaggacagatcttgagcaagctgcgcctggcctcgcccccgtcgcagggtgaagtgcctcctggtccgctgccggaggcggtcctggcactctacaactccacgcgcgaccgggtcgctggagagtcagccgaaccggaacccgaaccagaggccgattactacgcgaaggaagtaacccgcgtcctcatggtggagactcacaacgagatctacgataagttcaaacagagcactcattcaatctacatgttcttcaacacctccgaattgcgggaggctgtgccagaacccgtgctgctgtcaagggcagaacttaggctgctccgccttaaactcaaggtggaacaacacgtggagctgtaccagaagtacagcaataactcgtggcggtacctgtccaacagactcctcgcaccgtccgattcgcctgaatggctgtcctttgacgtgaccggagtggtgcggcaatggctctctcggggaggggagatcgagggattccggctgtcggctcactgcagctgtgacagccgcgacaataccctccaagtggacatcaacggcttcaccactgggcgcagaggggacctggccaccattcatggaatgaacagaccgttcctgctcctgatggccacccctttggaaagagcgcagcacctgcagagctcacggcaccgccgcgccctggataccaattactgcttttcctcgactgagaaaaactgttgcgtgagacagctgtatatcgacttcagaaaagatttgggctggaagtggattcacgaacccaagggttaccatgcgaacttttgtctcggaccgtgcccgtacatctggtcactcgacacgcagtactcgaaagtcctcgcactgtataatcaacataatccaggcgcgtccgcggccccatgctgcgtccctcaagccctggagccgttgccgatcgtgtactacgtgggccgtaagccaaaggttgagcagctttcaaatatgattgtgaggagctgcaaatgctcc

SEQ ID NO: 20063 - DNA, 1170 bp, Artificial Sequence
  Description of Artificial Sequence: Synthetic coding sequence
atgcctcccagtggactccggctgcttcctctcctgctgcctttgctctggttgctggtgcttacgcccgggagacccgctgccggactttctacctgcaagactatcgatatggagctggtgaaaagaaagcgcatcgaggccatccgaggacagatcctgagcaagctcaggttggcctcacctccaagccagggtgaagtgcccccaggcccactccccgaagcagtgctggctttgtataacagcacacgggatcgcgttgcaggcgagtctgcagagccagaacccgaaccggaggcagattactacgcaaaagaggtgacaagagtcctgatggtcgagactcataacgagatctacgataaattcaaacaaagcacccacagtatctatatgtttttcaacacaagcgagctccgcgaagccgtgcccgaacctgtcctgctcagcagagctgagctgcgacttctgcgactcaagctgaaggtcgagcagcacgttgaactctaccagaaatacagtaataacagctggcgctacctcagcaacaggctgttggctcctagcgactcccccgagtggcttagctttgatgtcaccggagtggtccggcagtggctttctcgaggtggagagattgagggcttccgcctgagcgcacactgcagctgcgatagccgcgacaacacacttcaggtggatatcaacggttttaccaccggaaggcggggggatctggcaacaattcatggcatgaatcgccccttcctcttgctcatggcaacccccctggagcgggcccagcatctgcaaagctcccggcaccggcgggccctggatactaattattgcttctcttcaactgagaaaaattgctgtgtgcgccaactctacattgatttccggaaggaccttgggtggaagtggattcacgagcctaaagggtaccacgccaatttttgcctgggcccctgcccttacatttggagtctggatacacagtattccaaagtgttggctctgtataatcagcacaatcccggtgcctcagctgcgccctgttgtgttccacaggccctcgaaccactgcctatcgtatactacgtggggcggaaacccaaggtggaacagctgtctaacatgatagtcaggagctgtaagtgctcc

SEQ ID NO: 20064 - DNA, 1170 bp, Artificial Sequence
  Description of Artificial Sequence: Synthetic coding sequence
atgccgccgtcgggcctgcggctcttgccactgctcctcccgctgctctggctcctcgtgctcaccccggggcgtccagctgcaggactctcaacctgtaagactatcgatatggagctggttaagcgcaaacgcatcgaagccattcgcggccaaatcctctccaagctgcggctggcgagcccgccatcgcaaggagaagtgcctccgggaccgctgccagaagcagtcctggccctgtacaactcaactcgcgaccgcgtggcgggcgagtccgccgagccagagcccgaaccggaagctgactactacgcgaaggaggtgaccagagtcctgatggtggaaacccacaacgagatctatgacaagttcaagcaatcgacgcactcgatctacatgtttttcaacacctccgaattgcgagaagccgtcccagagcccgttctcctgagccgggcagagctgcggcttctgagactgaaactgaaggtcgagcagcatgtggaactctatcagaaatactccaataactcctggagatacctgtcgaaccggctcctcgcacctagcgattcccctgaatggctgtctttcgacgtcacgggcgtggtccgccagtggttgtcccgcggaggagaaatcgaaggattccgcctgtcagcccattgtagctgtgactcgcgcgacaacaccctccaggtagacattaatggattcactactggacgccgcggcgacctggccactatccatggcatgaacagaccgttcctgctgttgatggcaactccactggaaagagcccagcacctgcagtcgagccggcaccggcgcgccctggatactaattactgcttctcgtcgaccgagaaaaactgttgcgtccgccaactgtacatcgatttccggaaggatctgggttggaaatggatccacgagccaaaaggctatcatgccaacttttgtctgggaccatgtccttacatctggtccttggacacccaatactcgaaggtgctggcgctctacaaccagcataatccaggcgccagcgccgccccctgctgcgtcccccaggccctcgaaccacttcctatcgtctattacgtcgggcggaagcctaaggtggagcaactgagtaatatgatcgtcagaagctgcaagtgttcg

SEQ ID NO: 20065 - DNA, 1170 bp, Artificial Sequence
  Description of Artificial Sequence: Synthetic coding sequence
atgccaccatccggtctcaggctcctcccccttctgcttccactgctgtggctactggtccttacaccaggtcgacccgcggcaggcctgtcgacatgcaagactatcgatatggagttggttaagaggaagagaattgaggctattagaggacagattctttctaagttgaggctcgcctcacctccctcccagggggaagtgccgcccgggcctcttcccgaggccgtgctcgccttgtacaacagtaccagagatcgggtggctggcgaatccgccgagcccgagcctgagccggaggccgactattacgctaaagaagtcacccgagttctcatggtcgaaactcataatgaaatatatgacaagttcaagcaatcaactcattcaatctacatgttcttcaatacgtctgagctgcgggaggccgtgcctgaaccagtgctgttgtcccgtgccgaactgcgcctgctcaggcttaaacttaaggtcgagcagcatgtggaactgtaccagaagtattcgaacaattcctggcggtatctgtcaaatcgtttgctggccccgtcagactctcccgagtggctgtcatttgatgtgactggtgtggtgcgacaatggttgtctaggggcggggagattgaaggcttcagactcagcgcccactgttcctgtgacagtagggacaacaccctccaagttgacataaatggattcactacaggacgccgtggggacttagcaactatccacggcatgaaccgaccttttctgttgctgatggctactcccctggaacgagctcagcatttacaatcctctagacaccgccgcgccctggacactaattactgtttcagcagtactgaaaagaattgttgcgtgcggcaactctacatcgactttcgcaaggacctagggtggaagtggatccacgagccgaaagggtaccacgctaatttctgcctcggcccatgtccttacatttggtccctggatacgcagtattcaaaggtactcgccctgtataatcagcataaccctggggcctcagccgccccttgctgtgtgccccaggccctggagccacttccgatcgtttattacgttggccggaagccaaaggtggaacagctctcaaacatgatcgtgcgatcttgtaaatgttcc

SEQ ID NO: 20066 - DNA, 1170 bp, Artificial Sequence
  Description of Artificial Sequence: Synthetic coding sequence
atgccacccagtggcctgcgtttgctgccgctccttctccctctgctctggctcctggttctgaccccaggcagacccgccgctggcctgtctacttgcaagacaattgacatggaactcgttaagaggaaacgtattgaggccattcgtggacagattctatcaaaactccgtctggcctcccccccgagtcagggggaggtaccaccgggaccactgccagaagctgttctcgccctctataatagtaccagggatcgtgtagccggagagtccgcagagcctgagcccgaacccgaggccgattactacgcgaaagaagtgacacgggtgctaatggtcgaaactcacaacgagatatacgataagtttaagcaatctacacacagcatttatatgttcttcaatacctcagagctgagagaggccgtacctgaaccagtgcttctgagcagggcggagctgaggttgctgcgcctgaaactcaaagtcgagcagcatgttgagctctaccagaagtactccaataactcttggcggtatttgtctaatagacttttggcacctagcgactctccggagtggctatcatttgacgtgacaggcgtggtgagacagtggctaagccgcggcggggaaatcgagggatttaggctatcagcccactgcagttgcgactcacgcgacaatactctgcaggtggacataaacgggtttaccaccggaaggcgcggcgatttagcaactattcacggcatgaaccggcctttcctcctgctgatggctacccctctcgaacgcgctcagcatcttcaatcgagcaggcaccgccgagcactcgatacaaattattgtttctcctctacagaaaaaaattgttgtgtccggcagctatacatagatttccggaaggatctggggtggaagtggattcacgagccaaaaggctaccatgccaatttttgtctagggccttgcccttatatatggtccctcgacacccagtattccaaagtgttggccctctataatcagcataacccaggtgccagcgccgcgccctgttgtgtcccgcaggctctcgaacctcttcccattgtgtactacgtgggcaggaagccgaaagtagagcagctttcaaacatgatagtgcgatcctgtaaatgctcc

SEQ ID NO: 20067 - DNA, 1170 bp, Artificial Sequence
  Description of Artificial Sequence: Synthetic coding sequence
atgccgccatctggcctgagactccttcctctgctcttgccgttgctgtggctgttggtgctgacccctgggcgacccgccgctggcctctccacatgcaagaccattgacatggagctcgttaagagaaagaggatcgaggccattcgtggccaaatactctcaaaattgagactggcgtcaccccctagtcagggtgaagtgccccctggccccctacctgaggccgtgctggctctgtacaatagcaccagagaccgcgtggccggcgagagtgctgagcccgaacccgaaccggaagctgactactacgccaaagaggtaacgcgtgttctgatggtggaaacccataacgaaatctatgacaaatttaaacagtccacccacagcatttacatgtttttcaacacgtcagaacttcgggaggccgtgccagagcctgttctgctgagtcgcgcggagcttcgattgctcagactcaagctcaaagtcgagcagcatgtggagctgtaccagaagtacagcaacaatagttggcggtacctctccaatcgattgctggccccaagcgactctcctgaatggctcagttttgacgtgactggtgtggtgcgccagtggctgagtcgcggcggcgagattgagggattccgattaagcgctcattgttcgtgcgatagccgagacaatactctgcaagtggacatcaacggttttactactgggcgcagaggagatttggctaccattcacggtatgaatcgcccgttcctactgctcatggccaccccgttggagcgtgcgcagcatctgcagagttcacgccatcgaagagccctggacacaaactactgcttctccagtaccgagaaaaactgctgcgttcgtcaactgtatatagattttagaaaggatctgggctggaagtggatccatgaacctaagggatatcacgccaacttctgtctgggcccatgcccttacatctggagtctggacacccagtacagcaaagtgctcgcgctttacaatcagcacaatcccggcgcctctgctgccccatgctgtgtgccccaggcgctggagcctctccccattgtctattatgtcgggaggaagccaaaggtggagcagttgagtaatatgatcgtcagaagttgcaagtgctcc

SEQ ID NO: 20068 - DNA, 1170 bp, Artificial Sequence
  Description of Artificial Sequence: Synthetic coding sequence
atgcccccttccgggctcagactgctgcctctgcttttgcctcttctgtggcttctggtccttaccccaggcagacctgcagcgggactttcgacttgtaagaccatagatatggagctggtgaaacgcaagagaatcgaagcaatcaggggtcaaattctgagcaaacttcgtcttgcatcgccccctagccagggcgaagttcctcctggacctctccccgaagccgtgctggccctgtacaattcgaccagagatcgcgtcgccggcgagtcggcagaaccagagcctgaacctgaagcggactattacgcaaaagaggtgactagagtcctcatggtggaaacccacaatgagatctacgacaagtttaagcaaagcactcactcaatttacatgttctttaacaccagcgaacttcgggaagcagtgccagaaccagtgctgctgtcccgcgcagaacttcggttgcttcggctcaagctcaaggtggaacagcatgtggaattgtaccagaagtactccaacaatagctggcgatatctgtccaatcggctgctggcaccgtcggactcgccagaatggctgtccttcgatgtgactggtgtcgtccggcaatggttgtccagaggtggcgaaatcgagggttttcgactctcagcacattgctcctgtgattcccgcgacaacactcttcaagtggatatcaacggctttaccaccggacgacgaggtgatctggccactattcatgggatgaacaggccttttctgcttctgatggcaactccgctggagcgtgcacagcatcttcagagctccagacatagacgcgctctggatactaactactgtttttcaagcaccgaaaagaactgttgtgtgagacaattgtacattgattttcgcaaagatctcggctggaagtggattcacgaacccaagggataccatgcaaacttttgccttggtccttgtccctacatctggagcctcgatacccagtactccaaggtcctcgccctgtacaaccagcacaatcctggcgcttccgcagcaccttgctgcgtcccacaagcacttgaaccgcttccaattgtgtactatgtggggagaaagcctaaagtggaacagctgagcaatatgatagtgcgcagctgtaagtgttcg

SEQ ID NO: 20069 - DNA, 1170 bp, Artificial Sequence
  Description of Artificial Sequence: Synthetic coding sequence
atgcctccatccggactgcgcttgctgccactcctgctgcctctcctttggctgcttgtgcttacccctggtcggccagcggccggcctttcgacttgcaagaccatagatatggaactcgtgaagcgtaagcgtattgaagcgatcagaggtcaaattctttccaaactgcgcctcgcaagccccccatcccagggcgaggtgccccctgggccacttccagaagcggtcctggccctgtataactcgacccgggatagggtcgcaggagaaagcgccgagcctgaaccggaacctgaagccgattactacgcaaaagaagtcacccgtgttctcatggtggaaacccataacgagatatatgacaaattcaagcagtcaactcattccatttacatgttctttaacacctcggaactcagagaggcagtgcccgagcctgtgcttctgtcgcgcgctgagctgcgcctcctgcggctgaaactcaaggtggaacagcatgttgaactctaccaaaagtactcgaacaatagctggagatacctttcgaaccgacttctggcaccctcggatagccccgagtggctttcctttgatgtgactggcgtggtgagacaatggctgtcccgaggcggtgaaatagaaggatttcggctgagcgcccactgcagctgcgactcaagagataatacccttcaagttgacattaacggctttactactggtcgaagaggagatctggcaactattcatgggatgaatagaccttttctgcttcttatggcaactcccctggagcgcgcacagcatctgcaaagctcacggcatagacgggctcttgacaccaattactgttttagctcaactgagaagaactgctgtgtgcgtcagctttacattgatttccgtaaggatcttggttggaagtggattcatgagcctaaaggataccacgcaaatttctgtctcgggccatgtccgtacatctggtcgctggatacgcaatattcaaaagtgctcgctctttacaatcaacataaccccggagcatccgccgcaccatgttgtgtgccccaggctttggaaccactgccaatagtttactacgtgggtcgaaagcccaaggttgaacagctgtctaacatgatcgtcagatcgtgtaagtgttca

SEQ ID NO: 20070 - DNA, 1170 bp, Artificial Sequence
  Description of Artificial Sequence: Synthetic coding sequence
atgccaccttcgggcctgcggctccttcctctgctgctccctctgctgtggctgctcgtgctgacgcccggacgtcctgcagcaggtctgtctacctgtaaaaccattgacatggaacttgtgaaaagaaagcgcatcgaggctatccgtgggcagattctgtccaagctgagattggcatcgccacccagccagggtgaggtgcctccaggcccactgccagaagcagtccttgcactttacaactcgacgcgcgatagagtggccggagaatcagcagaacctgagccagagccagaggctgactattatgcgaaggaggttaccagagtgctgatggtggaaactcacaacgaaatctacgacaagtttaagcaatcgactcactcgatctacatgttcttcaataccagcgaactgagggaggcagtgccggaacccgtgctcctgtctcgcgcagaactgcgcctgctgcgacttaagctgaaggtggagcaacacgtggaactgtaccaaaagtactcgaacaacagctggcgctacctgtctaacagacttttggccccatccgacagcccggaatggctttccttcgatgtcactggagtcgtgaggcagtggttgtcacggggaggcgagatcgaaggttttaggttgagcgcccattgctcctgcgattcgcgggacaacactcttcaagtcgacataaacggtttcactactggtcgcaggggcgaccttgcgactatacacgggatgaaccgtccgttccttctgcttatggcgacccctctggaaagagcgcaacatcttcagtcatcccggcacagacgcgcactcgacaccaactactgtttttccagcactgaaaagaactgttgcgtcaggcaactttacattgatttcaggaaggatcttggatggaaatggatccatgagcctaagggctaccacgcaaacttttgtttggggccatgcccgtatatctggtcgctggacacccagtactcgaaggtccttgccctgtataatcagcataatcctggggcgtccgccgccccgtgttgtgtgccacaagcccttgagcccctgcccatcgtgtactacgtgggtcgcaagcctaaagtggaacaactgtcaaacatgattgtcagatcctgtaagtgtagc

SEQ ID NO: 20071 - DNA, 1170 bp, Artificial Sequence
  Description of Artificial Sequence: Synthetic coding sequence
atgccgccgtcgggcctgcggctgcttcctctgctgctgccgctgttgtggctgctggtcctgacccccgggaggcccgcggccggactgtcgacgtgtaagacgatcgatatggagctggtgaaacgcaagcggatcgaggctatcaggggccagatcctttcgaaattgagacttgcctcgccgccgtcacagggcgaagtgccccctgggccgctgccggaggcagtgctggccctctacaactcgaccagggaccgggtcgccggcgagtcagcagagccggagccggaaccggaagccgactactacgccaaggaggtgaccagagtgctgatggtggagactcacaatgagatctacgataagtttaagcagtccactcattcaatctacatgtttttcaacacttccgagttgcgggaggctgtcccagaaccggtgctgctgagcagagctgaattgagactgttgcgcttgaaactgaaggtagaacaacacgtggaactgtaccagaagtattcaaacaattcatggcgatatctgtccaatcggctgctcgctccatcggattcgccagagtggctcagcttcgacgtgactggagtcgttcgccagtggctgtcgcggggcggtgaaatcgaaggtttcaggttgtccgctcactgttcgtgcgactcgcgggataataccctccaggtcgacatcaacgggttcactaccggacgccgcggggacctggctactattcacggcatgaaccgtcccttcctccttcttatggctactcccctggaaagggcccagcacctgcagagcagcagacatagacgcgccctcgataccaactactgtttttccagcaccgagaaaaactgctgtgtgagacagctgtacattgattttagaaaggatctcggctggaagtggatccacgagccaaaggggtatcatgcaaacttctgcctgggaccgtgtccatacatttggagcctcgacacccagtactcgaaggtcctggccttgtacaaccagcataatccgggagcttccgcggccccatgctgcgtgccgcaggcgctggaacctctgcctatcgtctactacgtgggacggaaaccgaaggtggaacagctgtcgaacatgatcgttcgctcctgtaagtgctcc

SEQ ID NO: 20072 - DNA, 1170 bp, Artificial Sequence
  Description of Artificial Sequence: Synthetic coding sequence
atgcctccttcaggactgcggttgttgccactgcttcttccactgctttggcttcttgtgctcacgcctggcaggcctgcagccggcctcagcacttgtaagactattgatatggaactcgtgaaacgcaagcgcattgaagcaatccggggtcaaatcctcagcaaactccgccttgcctccccaccatcccaaggagaggtgcctcctggacctcttcctgaagctgtgttggccctttacaactccacccgggatagagtggcaggtgaaagcgctgagccagaacctgaaccagaggcagattactatgctaaggaggttacgcgggtgcttatggtcgaaacccataatgaaatctatgataagttcaagcaaagtacccatagcatatacatgttctttaacacgtccgagcttagagaagccgtccccgaaccggtgctgctttcccgagcagaactcaggctcctccggctgaaacttaaggtggagcagcacgtcgaattgtaccaaaagtactcgaacaattcctggcggtacctttcgaatcggctcctggcaccatctgattccccagagtggctttccttcgacgtgactggcgtcgtcagacagtggctcagcagaggtggggaaattgaagggtttcgactctcagcacactgttcctgcgattcgagggacaatactctgcaagtcgacattaacgggtttacgactggtcgaagaggtgatttggcaactattcatggcatgaaccggccattcctgttgcttatggcaaccccactcgaaagagcccaacacctgcaatcctcgcgtcatagaagggcccttgataccaactactgcttctcgagtactgagaagaactgctgtgtgagacagctgtacattgattttagaaaggatctcggatggaagtggattcacgagcccaagggctaccatgccaacttttgtctcgggccttgtccttacatttggtcccttgacacccaatattccaaggtcctggccctctataaccagcataacccgggtgcgtcagcagcgccatgctgtgtgcctcaagcactcgaacctctgcctatcgtctactacgtcgggcgaaaacccaaggtggaacagttgtcgaacatgattgtgagatcctgcaaatgttcg

SEQ ID NO: 20073 - DNA, 1170 bp, Artificial Sequence
  Description of Artificial Sequence: Synthetic coding sequence
atgcccccttcgggcctccgcttgctgccactgctgttgccgcttctgtggcttctggtgttgactccggggaggccagccgctggcctcagcacttgcaagaccatcgacatggagctggtcaagcgaaagcggatcgaagccatccgcggacagattctttctaaactgcggttggcttccccacccagccaaggcgaggtgccgccgggcccgctgccggaagccgtcctcgccctttacaactccacccgagatcgagtcgcgggagaatcggccgaacccgaacctgaacctgaggccgactactacgcaaaggaggtgacgcgggtgctcatggtggagactcacaacgaaatctacgataagtttaagcagtcgacccattcaatctacatgtttttcaacacctccgagttgcgtgaagcggtccctgaaccagtgctgctctcccgtgcagagctgagactgctcaggctcaaactcaaagtcgaacagcatgttgaattgtaccagaaatactcgaacaactcctggcgctacctctcaaaccgccttctggcaccgtccgactccccagaatggctgtctttcgatgtcactggtgtggtgagacaatggctttcaaggggaggagaaatcgagggatttcgcctcagcgctcactgttcttgcgattcaagggacaacaccttgcaagtcgacatcaacgggttcaccacgggccggcggggagatctggcgactattcacggtatgaatcggccgttcctgctgctcatggcaactcccctcgaacgggcccaacacctgcagtcgtctcgtcaccgcagagcgctggacactaattactgcttctcatcaaccgagaagaactgctgcgtgcgccaactgtatatagacttccgcaaggacctgggatggaagtggatccatgagccaaagggttaccacgctaatttctgtcttggaccctgtccgtatatctggtcgctggacacccagtacagcaaagtgctcgccctgtacaatcagcataatcctggagcgtccgcggcaccttgctgtgtgccacaggcattggagcctctgccaatcgtttactacgtggggagaaagccgaaagtggaacagttgagcaacatgatcgtccgctcgtgcaagtgcagc

SEQ ID NO: 20074 - DNA, 1170 bp, Artificial Sequence
  Description of Artificial Sequence: Synthetic coding sequence
atgcccccgagcggacttcgcctgctgcctctgctgcttcctctgctctggttgctcgtccttaccccaggtagacctgcagccggtctttccacttgcaagactatcgatatggaactcgtgaagagaaagcgcattgaggccattagaggccaaattctctccaagttgcggcttgctagcccgccatcccaaggtgaggttccgccgggcccactgcccgaggcagtgcttgccctctataactcgacgcgcgatagggtcgctggagagtccgcggagcctgaaccggaacctgaggcggactattacgccaaggaggtgacccgagtgcttatggtggagactcacaatgaaatctatgataagtttaagcaaagcactcattcgatttacatgttctttaacacctcggaactccgggaagccgtgcctgaaccagtcctgctttcgagagccgagttgagactgctgcgcctgaaacttaaagtggaacaacatgtggaactgtaccagaagtacagcaacaactcctggcggtacctttccaatagactgcttgccccatccgacagccccgaatggctctcattcgatgtgaccggagttgtcagacagtggctgtcccggggaggagaaattgagggatttcggctgtccgcgcattgttcttgtgattcaagggataacaccctgcaggtggacattaacggttttacgaccgggagacgtggagatctcgcaactatccacgggatgaaccgcccttttctcctgctcatggccacccctctggaaagggcacagcacctccagagctcccggcacagacgggcactcgataccaattactgtttttcatccacggagaaaaactgctgcgtgaggcagttgtacatcgacttccggaaagatctcggatggaagtggattcatgagcctaagggctaccatgcaaacttttgcctgggaccatgcccatacatctggtcgcttgacactcaatatagcaaggtcctggcactgtataaccagcacaatccaggagcgtccgccgcaccctgttgtgtccctcaggccctggaacctctgcctattgtgtactacgtcggacgaaagccgaaagtggagcaactgtcaaatatgattgtgcgttcttgtaagtgtagc

SEQ ID NO: 20075 - DNA, 1170 bp, Artificial Sequence
  Description of Artificial Sequence: Synthetic coding sequence
atgcctcccagtgggttaaggcttttgcccctcctgctgccactcctgtggctgctggtgctcacacctggacggccggccgccggcctgtccacctgcaagacaatcgacatggaactggtcaagaggaaaaggatcgaagcgattcgaggccaaatcctcagcaaactgagactggcatcaccaccttctcagggagaagttcctcccgggcccctgcctgaagcagtgttagccctatacaactcaacgagggatcgtgtggccggcgaatcagccgagcctgagcccgagccagaagcggattactatgcaaaggaagtgacacgagtactgatggtggaaacacacaacgaaatctacgataagtttaaacaatcaacgcattcaatctacatgtttttcaacacgtccgagctgagagaggccgtgcctgaacccgtactgctctcccgtgcagagttgcggctgctgcggctaaagctgaaagttgaacagcacgttgagctgtatcagaagtacagcaataacagctggcggtatctaagcaataggctcctagcaccttccgacagccctgagtggctatcatttgacgttacgggagtagttcgccagtggctgagtagggggggcgagatcgaggggttccggctctcggctcactgctcatgtgattcgagagacaacaccctgcaggtggacattaatggatttacaaccgggcgtcgcggagatttggccacaatccatggcatgaatcggccttttctgctcctgatggccacccccctggagcgagcacagcatctgcagtctagtagacacagaagggccctcgatactaattactgtttctctagtacagagaagaactgctgcgttcgtcagctgtacattgactttcgcaaggatctggggtggaaatggatccacgaacccaaaggctaccacgccaatttttgcttaggaccatgcccttacatctggagcctggatacgcagtactctaaggtgctcgccctttacaaccaacacaatccaggagccagcgctgcaccttgttgtgtgccacaagcgctggagccactcccgattgtgtattatgttgggagaaaaccgaaggtcgagcaactgagcaatatgatcgtccgatcttgcaaatgctcc

SEQ ID NO: 20076 - DNA, 1170 bp, Artificial Sequence
  Description of Artificial Sequence: Synthetic coding sequence
atgcctccaagcggactccggctgttgcccctgctgttgccgctgctgtggctgctggtccttacccctggtcgcccagccgcaggcctgtcaacttgtaagaccatagacatggaactggtgaaaagaaagcgtattgaggcaataagaggccagattctctccaagctgaggcttgcatcgcctccgagccaaggagaagtgccccctggacccctgcctgaagccgtgctggcactgtacaactctacccgtgatagagtggcaggggagtcagcagaaccagagccagagcccgaagcggattactatgcaaaggaggtgaccagagttcttatggtcgaaactcataacgaaatctacgataagtttaagcagtcaacccatagcatttacatgttctttaacacttcagaactcagagaagcagtgccagagccggtgcttctctcgagggcagagcttaggctcctccgtctcaaactcaaggtggaacagcacgtcgaactctaccagaagtactcgaacaacagctggagatacctctccaatagacttcttgcaccttccgattcgccggaatggctgagctttgatgtaactggggtggtaaggcaatggctgtcacggggaggagaaatagagggatttcgcctctccgcccattgttcgtgcgacagcagagacaatacccttcaggtcgacattaacggattcactactgggagaaggggagatcttgcaaccatccacggtatgaaccggccatttcttcttctcatggccactccactcgaaagagctcagcacctccaatcctccagacatcgccgggcgctcgatacgaactactgctttagttcgaccgaaaagaactgttgcgtgcgccagctgtacatcgacttccggaaagatctgggctggaagtggattcacgagcctaaagggtaccatgcgaatttctgtcttggtccatgcccttacatttggagcctggacacccagtactcgaaggtgctcgccctgtacaaccagcataacccgggtgccagcgcagcgccatgttgtgtccctcaagcacttgaacctctgcctattgtctactacgtcggccggaaacctaaggtggaacaactttccaacatgattgtcagatcctgcaagtgttcc

SEQ ID NO: 20077 - DNA, 1170 bp, Artificial Sequence
  Description of Artificial Sequence: Synthetic coding sequence
atgccacccagtggcctccgactccttccgttgttgctcccactgttatggctcttagtgttaacaccaggtcggccggcggctggactgtccacctgcaagaccatcgatatggagctcgtgaaacgcaaacggatcgaagctattcgcggtcaaatcctgtcaaagttgcggcttgccagtccccctagccagggggaggtcccacctggtccactgccagaggcagttctcgctttgtataattctacacgggatcgggttgcaggggaatctgccgagccagagccggagccggaagccgactattacgcaaaggaggtgacccgagtgttgatggtggaaactcacaacgaaatatacgataagttcaaacaatctacccatagtatctatatgttttttaacacctctgaacttcgggaagccgtccccgagcctgtgctgctgtcgagagccgaactgcgtctgctcagactgaaactgaaggtggaacagcatgttgagttataccaaaaatatagtaacaactcttggcgctatttatcaaatagactcctggccccatcagactcaccagaatggctgagcttcgacgttactggcgtggtgaggcaatggctctcacgcggtggagagattgaagggtttcggctaagcgcccattgcagttgcgatagccgcgacaatacgctccaggtggacatcaacgggttcaccaccggacgcagaggggatctggccacaatccatggtatgaaccgcccatttctactcctgatggccacgccgttggaaagagcccaacacttgcagtccagtcgacatcgtcgagccctggacactaattattgtttttcttcgaccgaaaagaactgctgcgtccggcaactttacatagatttcaggaaagacctcggatggaaatggatccacgagcccaaaggatatcacgcgaatttctgcttagggccctgcccctatatatggtctttagatacccaatattccaaggtgctcgcactctacaatcaacataacccaggggcttcagctgcgccttgttgcgttccccaggccctggaacccctgccgattgtgtactacgtgggcagaaagccaaaggttgaacagctctctaacatgatcgtgcgctcttgcaaatgttcg

SEQ ID NO: 20078 - DNA, 1170 bp, Artificial Sequence
  Description of Artificial Sequence: Synthetic coding sequence
atgcccccgtcgggactgcgactgttgcccttgcttctgccgctgctgtggttgcttgtcctgacccccggtcggcctgcggccggcctgagtacctgcaagacaatcgatatggagctagtgaagcgtaaacggatcgaggccatccgtggccagatccttagtaagctgcgactggcgagtccaccgtctcagggcgaggtcccccccggacctttgccagaggcggtgctggcattgtacaacagcactagagacagagtcgctggagagtcggccgagccggaaccagagccggaggcagattactacgcgaaggaagtgactcgggtgctcatggttgaaacgcacaatgaaatctacgacaaattcaaacagtcgacgcacagcatctacatgttcttcaacacatccgaattgagggaagccgtacccgaaccggtgctgttgagccgagcggagttgcgtctgctgcgtctgaagctgaaggtggagcaacatgtagagctgtaccagaagtattcgaataactcgtggaggtatctaagtaatcggctgctggcaccctcggattcccctgagtggctgtccttcgacgtgacaggagtcgtgcggcaatggctctcgcgaggcggtgagatcgaaggttttagactctccgcccactgcagctgtgattcgcgcgataatactttgcaagtggatattaacggctttacgacaggcagacgaggtgatctggccacgattcatggaatgaatagacccttcctgttgctgatggcaacgccgctggaaagagcgcaacacctccagtccagcagacaccgacgcgcgctcgacaccaactactgtttctcttctaccgagaagaactgctgcgttcgtcagctttacatcgacttcagaaaggacctaggctggaaatggattcatgaacctaagggctaccatgctaatttttgcctaggaccatgcccttacatctggtcactagatactcagtactcgaaggtgttggcattgtacaatcaacacaatcccggagcgagcgccgcaccgtgctgcgtcccccaagcgctggagccattacccatcgtgtactatgtgggccgcaaaccgaaagtggagcaactgagcaatatgatagtacgctcctgcaagtgctcg

SEQ ID NO: 20079 - DNA, 1170 bp, Artificial Sequence
  Description of Artificial Sequence: Synthetic coding sequence
atgcctcctagcggactgcgcttacttccattacttctgcctctactgtggctgttagtgttaaccccaggtcgccctgccgccggccttagcacttgcaaaacgatcgacatggaattggttaagagaaagaggattgaggctatcagaggacaaatcctttcaaaattacgactggcatctcctccgagccaaggagaagtcccgcctggtcctctaccggaagctgttttggcactttataattctactagagatcgagttgcaggcgaatccgcagaacctgaaccggagccggaggctgattattatgctaaagaggttaccagggttttgatggttgaaacgcataacgaaatttacgacaagtttaaacagagcacccactcgatatatatgttcttcaatactagcgagctgagagaagctgtgccggaaccggtattactttctcgcgcagaactgcggctactgagattaaaacttaaggttgagcaacacgtagaattgtaccagaaatactcaaacaacagctggaggtacttgtccaacagacttttagctccgagcgactctccggaatggctttcattcgatgtcacaggagtagtgcgtcagtggttgtcccgcggcggagagattgaagggttcagactttctgctcattgcagctgtgactcacgtgataacaccctacaagtcgatatcaacggatttaccacaggacgccgcggtgatcttgcaacaattcacggaatgaacagaccctttttgctacttatggccacacctctggaacgcgctcaacacctccaatcatctagacatcgcagagcgttagacacaaattattgcttcagctctaccgaaaaaaactgttgcgttcgtcagctctacatcgattttcgtaaagatcttggctggaaatggattcatgaaccgaaaggatatcatgctaacttctgcttaggcccttgcccgtacatatggtcattggatactcagtactctaaagtccttgccctgtacaatcagcataaccctggtgcttctgccgcgccctgctgcgttcctcaggctctcgaaccactgcccatcgtctattatgtaggtcgcaaaccgaaggtcgagcaactcagcaatatgattgtccgctcatgtaagtgttct

SEQ ID NO: 20080 - DNA, 1170 bp, Artificial Sequence
  Description of Artificial Sequence: Synthetic coding sequence
atgcctccatccgggctgcggctgctgcctcttctcctaccattgttatggctcttggtgctgacaccgggacgccctgcagcaggtctgtccacatgtaagaccatagatatggagctggtaaagcggaaaaggattgaggctattaggggtcagatcttgtccaaactgcggttagcctctcccccttcgcagggagaggtcccacctggaccactgcctgaagcagttctggccctctacaattcgaccagagaccgggtcgcaggagagtccgccgaaccagagcctgaaccagaagcagactactatgccaaggaagtcaccagagtgctgatggtggagactcataatgagatctatgacaagttcaaacagtctacccacagcatctacatgttttttaatacaagcgagttgcgggaggccgttcctgagcccgtgctcctctctcgagctgaactacggctgttgaggctcaagctcaaggtcgagcaacacgtcgagctctatcagaagtacagtaataattcctggcgctacctcagtaatcgattactcgcaccaagtgactcccctgagtggcttagcttcgacgtgaccggggtggtgcgtcaatggttgagtagggggggagaaattgaaggattcaggctcagcgcccactgcagctgtgattccagagacaatactctgcaagtggacatcaacggctttaccaccggcaggagaggggatcttgccacaattcacgggatgaacaggcccttcctacttcttatggctactccattggagagggcccagcatttgcagagctcgaggcacaggcgagctcttgacacaaattactgttttagctccacagagaagaactgctgcgtgcgccagctttatattgatttcagaaaggatctcgggtggaagtggattcacgagcctaaagggtatcacgctaatttctgtttaggaccctgtccatacatctggtctctggatacccagtacagcaaagtgttggcgttgtacaatcaacataacccaggagcttcggcagcgccatgctgcgtgccacaggctctggagcctctccctattgtctactatgttgggaggaaaccgaaggtggagcagctgtctaatatgatagtgcggtcctgcaagtgttca

SEQ ID NO: 20081 - DNA, 1170 bp, Artificial Sequence
  Description of Artificial Sequence: Synthetic coding sequence
atgccaccaagcgggctgcggttactgccccttttactacccctactgtggttgcttgtcctgacccccggcaggcccgcagctggcctctccacatgcaaaacaatagatatggagctcgtaaaaagaaagcgtatcgaagcaatccgaggtcaaattttgtcaaaactgcggttggcctcccctccgagccagggcgaagtgccgcctggaccactgccagaagcggtcctggctttgtataattcaacccgcgaccgggtggctggagaaagtgctgagccagagccggaacctgaggcggactattacgccaaagaagttactagagttctgatggtggagacccacaacgaaatctacgacaaatttaagcaaagcactcacagtatatatatgttctttaatacaagtgagctgcgggaagccgtacctgaaccagtgctcctctccagagccgaactcaggcttctccggctcaaacttaaggtagaacagcacgtcgagctatatcaaaaatactccaataatagttggcgatacctgagtaaccgcctgcttgctccctcagattcccccgagtggttgtccttcgacgtcaccggagtggtgcgccagtggcttagccgggggggagaaattgaaggcttcagactgagcgcccactgcagctgcgatagccgcgataatacactgcaggtagatatcaacggctttactactgggcgaagaggggacttggccaccatccacggaatgaaccggccttttttactcttaatggctacaccactagagcgagctcagcaccttcaatcatcaaggcaccggcgggcgctcgatactaactactgtttctcgagcacggagaagaactgctgcgttagacagctgtacatcgactttcgaaaggatttgggttggaagtggatacatgaaccaaaaggctatcatgctaacttttgtctgggcccttgtccttacatttggtctctggacactcagtatagcaaagtgttagcactatacaaccaacacaacccgggggcttctgccgcaccttgttgcgtgccccaagcgctggagcctctccccatcgtgtactatgtcgggcgtaagccaaaagtggagcaattgtccaatatgatcgttcgaagttgcaaatgtagt

SEQ ID NO: 20082 - DNA, 1170 bp, Artificial Sequence
  Description of Artificial Sequence: Synthetic coding sequence
atgccaccaagtgggctacgcctactgccactcctcctcccactgctttggctgctggtactgacgccaggaaggcctgccgcaggtctgtccacttgtaaaaccatcgacatggagctggttaagcgcaaacgaatcgaggctattcgagggcagatactgtcaaaactgcggctggcttccccaccatcccagggtgaggttccccctgggccgctaccagaggccgtactggccctttataattcgactagagatcgcgtggctggagagagcgccgaaccagaaccggagcccgaggctgactactacgctaaggaagtgacccgcgtgttgatggtcgaaacccacaacgagatttacgataagtttaagcagtctacccacagcatatacatgttcttcaatacgagcgagctccgggaagcagtccctgaaccggtgctactctctcgggcggagttgaggctcctgcggctcaagctcaaggtggaacagcacgtcgaactttatcagaagtactcaaacaattcctggaggtacttgagtaaccgactcctcgcccctagtgattcccccgaatggctgtccttcgatgtgaccggcgtggtgcggcagtggctttctcgcggcggcgagatcgaagggttccggttgtctgcacattgctcatgcgactcccgagataacactctccaggtagacatcaacggctttactactggaagaagaggcgacctcgccaccatccatggcatgaacaggccatttctgctcctcatggccacccctcttgagagggctcagcacttgcagtcttcacgtcacagacgcgctttagacactaattactgtttctcatctacagagaaaaactgctgtgtacggcagctttatatcgatttcaggaaagatttggggtggaagtggattcatgagcctaaaggatatcatgccaacttttgtctgggaccgtgtccctacatctggtctctggatacacaatacagcaaggtcctggcactttacaaccaacataatcctggcgcaagcgctgctccatgctgcgtgccccaggcactggagcccctccccatagtctattatgttgggcgaaagccaaaagtcgaacagctgagtaacatgatcgttagatcatgtaagtgcagt

SEQ ID NO: 20083 - DNA, 1170 bp, Artificial Sequence
  Description of Artificial Sequence: Synthetic coding sequence
atgccgccaagtggactcaggttactgcctctcttactgcccctgctctggctgctggtactgacgccagggcgtccagccgctgggttgtctacctgcaaaaccatcgacatggaactcgttaaaaggaaacgcatcgaagccatcagggggcagatcctgtcaaagctgcgcctcgcaagtccacccagccagggcgaagtgcctccgggacctctgcccgaggcggtgctggctctctacaactctactagagatcgtgttgcaggcgagtcagcagagccagagcccgagcccgaagctgactattatgccaaggaggttactagggtgctgatggtggagacccacaacgaaatttacgacaagttcaagcaaagtacgcattccatttacatgttttttaacacctctgaactcagagaggctgtccctgagccagtgctgttgtctcgtgcagagctcaggctattgcggctcaagctgaaagtggagcagcatgtcgaactgtatcagaagtactccaacaattcttggagatacttatccaatcggctgttggctcctagcgactcacccgaatggctcagcttcgacgttaccggtgtggtgcgtcagtggctctccaggggtggagaaattgagggattccgcttgtccgcacactgctcctgcgactccagagacaatactctgcaggtggatatcaacggctttacgactggacgccgtggcgaccttgcgaccatccatggcatgaaccgaccatttctgctgctcatggcaacgccgctggagcgagcccagcaccttcagtctagtagacatcggcgcgcccttgatacaaattattgctttagcagtactgaaaagaattgttgtgtgaggcagctatacatcgacttccgaaaggacctgggctggaagtggatacatgagcctaaaggctaccatgccaatttctgtctgggcccttgtccatatatttggtccttggatacccagtattctaaagtgctggccctgtataatcaacataatcccggcgcttcagccgcgccatgttgcgtgcctcaggccttggaaccactcccaatcgtttattatgtgggccgaaaaccaaaagtagaacagctgtccaacatgatcgttcgctcctgcaagtgctct

SEQ ID NO: 20084 - DNA, 1170 bp, Artificial Sequence
  Description of Artificial Sequence: Synthetic coding sequence
atgcccccttccgggctaaggctcctgcctttgctccttcctcttctctggctcctagtgttgacaccaggaagacccgccgctggactttccacatgtaaaacaatcgacatggaactggttaaacggaaaagaatagaggcgatccgggggcagatactgtccaaactccgcctggcatctccaccatctcagggagaagtgccccccgggcctctacccgaagctgtcctcgcgctttataactccactagagatagagtcgctggagaatccgctgaacctgaacccgaaccagaagctgactattatgcgaaagaagttacaagagtgctcatggtggaaacacataacgagatatatgataaattcaagcagtcaacgcactcgatatacatgttttttaatacatctgaacttcgcgaagcggtacctgaacctgtgctactctctcgggctgaacttagattactgagactgaaactcaaagtggaacagcatgtggaactgtaccagaagtactcaaacaattcttggagatacctgtctaacagactactggctccgtccgattcaccagaatggttgagttttgatgtgactggagtcgtgcggcagtggctaagtcgagggggggaaatcgaagggtttaggcttagtgcccattgctcctgcgatagtcgagataacactctccaggtggatatcaacggattcacaacggggcgccggggggatctcgcaactatccacggaatgaatcggcccttcctgctcctgatggcaactcccctggaaagagcacagcatctacagtccagtaggcatcgacgcgctctcgatacaaactactgcttctcttctacagagaaaaattgctgtgttcgacagctttatattgattttcggaaagatctcgggtggaagtggattcatgaacctaaaggatatcacgctaacttctgccttgggccctgcccctacatatggtccttggatacacagtattctaaagtgctggctctatataaccagcataatcctggggcttcagccgctccatgttgtgttccccaggctctcgaaccccttccaatcgtctactatgttgggagaaaacctaaagtagaacaattaagtaacatgatagtaagatcctgcaaatgtagt

SEQ ID NO: 20085 - DNA, 1170 bp, Artificial Sequence
  Description of Artificial Sequence: Synthetic coding sequence
atgccgccgtcgggtttacgactattaccgttattattaccgttactatggttattagttctaacgccgggtcgaccggcggcgggtttatcgacgtgtaaaacgatagatatggaactagtaaaacgaaaacgaatagaagcgatacgaggtcaaatattatcgaaattacgtctagcgtcgccgccgtcgcaaggtgaagtaccgccgggtccgttaccggaagcggtactagcgctatataattcgacgcgagatcgagtagcgggtgaatcggcggaaccggaaccggaaccggaagcggattattatgcgaaagaagttacgcgtgtattaatggtagaaacgcataatgaaatatatgataaatttaaacaatcgacgcattcgatatatatgttttttaatacgtcggaattacgtgaagcggtaccggaaccggtattactatcgcgagcggaactacgtttactacgtctaaaattaaaagtagaacaacatgttgaactatatcaaaaatattcgaataattcgtggcgttatttatcgaatcgactattagcgccgtcggattcgccggaatggttatcgtttgatgtaacgggtgtagtacgtcaatggctatcgcgaggtggtgaaatagaaggttttcgactatcggcgcattgttcgtgtgattcgcgtgataatacgctacaagttgatataaatggttttacgacgggtcgtcgtggtgatctagcgacgatacatggtatgaatcgtccgtttttactactaatggcgacgccgctagaacgagcgcaacatttacaatcgtcgcgtcatcgacgtgcgctagatacgaattattgtttttcgtcgacggaaaaaaattgttgtgtacgacaattatatatagattttcgtaaagatttaggttggaaatggatacatgaaccgaaaggttatcatgcgaatttttgtctaggtccgtgtccgtatatatggtcgttagatacgcaatattcgaaagtattagcgttatataatcaacataatccgggtgcgtcggcggcgccgtgttgtgttccgcaagcgttagaaccgttaccgatagtttattatgttggtcgtaaaccgaaagtagaacaactatcgaatatgatagttcgttcgtgtaaatgttcg

SEQ ID NO: 20086 - DNA, 1170 bp, Artificial Sequence
  Description of Artificial Sequence: Synthetic coding sequence
atgccccccagcggtttgcgactgttaccattacttctgcccctgttgtggctgttggtcctaactcctggtagaccggcagcaggtctatcgacctgtaagactattgacatggaattggtaaaaaggaaaaggattgaggcgatccggggccaaatactgagtaaacttcgactggcatctccaccatctcagggcgaagtgccacctggtccactgcctgaggcggtgctggcattgtataatagcaccagagatcgagtggccggcgaatccgccgagccggagcccgagccagaagctgattattacgcaaaagaggtgacgcgtgtcctgatggtagaaacccacaacgaaatctacgacaagttcaaacaatccacccactccatctacatgtttttcaacacctcagaacttcgggaggccgtgcctgagcctgtgctgctatcaagagccgaattaaggttgctcaggctgaagcttaaggtcgaacaacacgttgaactgtaccagaagtacagcaataactcctggcgatacctgtcaaaccgactgttagccccctcagactccccagagtggctctcctttgacgtaactggggtggtgaggcagtggctgtccaggggcggtgagatcgaaggattccgattatccgctcattgttcatgcgactcaagggacaatacactgcaagtggatatcaatgggttcactacaggacgtagaggcgatctggccacgatacacggaatgaacagaccgtttctactattaatggccactccattggaaagggcccagcatctccaaagttctcgacaccggcgagcactggacaccaattactgttttagtagtacggagaaaaattgttgtgtacgacagctgtacatcgacttcagaaaggacttgggatggaaatggatccatgaaccaaagggctaccacgcaaatttctgcttagggccatgtccttacatctggtctctggacacccaatattctaaggttctggctctttacaatcaacacaaccccggcgccagcgcagctccgtgctgtgtgcctcaagcactggagccattgcctatagtgtactacgttgggcgtaagcccaaagtagaacagttatctaatatgattgtccgttcctgtaagtgtagc

SEQ ID NO: 20087 - DNA, 1170 bp, Artificial Sequence
  Description of Artificial Sequence: Synthetic coding sequence
atgccaccgtcgggtttgcgtttgctgccacttttgctgcctctcttgtggcttctcgtgctcacgcccggtcgccctgcggccggactttcgacgtgcaaaactatcgatatggaactggtaaaacgaaagagaatcgaggctattagaggccaaatcctttcgaaactgcgcttggcgtcaccaccttcgcagggagaagtgcctccggggccactccccgaggcagttctcgcactctacaactcgacgcgagatcgcgtggcaggcgaatccgctgaaccggaacccgagcctgaagcggattactacgccaaggaggtcactcgagtcctgatggtggaaactcataacgagatttacgacaagtttaagcagagcacccattccatatacatgtttttcaatacctcggaacttcgagaggccgtaccagaaccagtgctgctttcccgcgctgaacttagacttctgcgcctgaagctgaaagtggaacaacacgtcgagctgtatcaaaagtactcaaacaattcgtggcggtatctgagcaaccgtcttttggccccctcagactcccctgaatggctgtccttcgacgtgaccggagtcgtccggcagtggctgtcgcgaggaggagaaatcgaaggatttaggctgtccgcgcattgttcctgcgatagtagagataatactctgcaagtggacattaacggtttcaccaccggacggagaggcgatctggcaaccatacatggtatgaacaggccttttctgcttctgatggcaacgccgctcgaacgggcccaacatttgcaaagctccaggcatcgccgagcactcgatactaattactgtttttccagcactgagaagaattgctgtgttcggcagctctacattgactttagaaaggatctgggttggaaatggattcacgagcccaaagggtaccacgcaaacttctgcctgggaccatgtccttatatctggagtctggatacccagtactcaaaggtcctcgcactgtacaatcagcacaaccctggagcatcggccgcaccatgttgtgtgccccaggcactggaaccccttcctatcgtgtactacgtgggcagaaagccaaaagtggagcaactttcaaacatgattgtccggtcgtgtaagtgctcg

SEQ ID NO: 20088 - DNA, 1170 bp, Artificial Sequence
  Description of Artificial Sequence: Synthetic coding sequence
atgccaccctcaggcctgagattgctgcccttgcttttgccactcttgtggctgctggttcttacccccgggaggcctgcagcaggattgagcacctgcaaaactattgacatggaactggtgaaaagaaaaagaattgaggcaattcgcggccagatcctgagtaaacttcggttggcatcccccccttcacagggggaagttcccccaggacctcttcctgaagccgtgctggctctgtacaatagcactagagacagagtggccggcgagagcgctgaaccagaaccagagccggaggccgattactacgccaaagaggtaacacgcgtactgatggtggagacgcataacgagatttacgacaagttcaaacagagcacccactccatctacatgttcttcaacacaagtgaactccgagaagctgtcccagagcctgtgcttctgtctagagctgagctcaggcttctgcggcttaaactcaaggttgagcagcacgtggagttgtatcaaaagtattcaaataattcctggcgctatctcagcaatcgcctgctcgctcccagtgactcacccgagtggctgtccttcgacgtcactggagtggtccggcagtggctgagccggggtggggaaatcgagggcttcaggctgagcgcacactgctcatgtgactctcgcgataataccttgcaggtggacataaatgggttcacaacagggcgcaggggggatctggcaaccatccacggtatgaacagaccctttcttctccttatggcaactccgcttgaaagggctcagcacctgcagtcaagccgccacagacgcgccctcgataccaattattgcttctccagtactgagaaaaattgttgtgttcggcagttgtatattgattttcggaaagacctggggtggaagtggatccacgagccaaaaggctaccacgccaacttttgcctgggtccctgcccgtacatatggtccctggacactcaatattctaaagtcctggcactctacaaccagcacaaccccggagcttccgcagctccatgttgtgtgccccaggctctggaacccctgcccatcgtgtactacgtgggtcgaaaacctaaagtcgagcaactcagcaatatgatcgtgcggtcctgtaaatgctct

SEQ ID NO: 20089 - DNA, 1170 bp, Artificial Sequence
  Description of Artificial Sequence: Synthetic coding sequence
atgccgccgagcggactcaggctcttgccgctgctgctgcccctcctttggctgctggtgctcaccccaggacgccctgccgccggactgagcacctgcaagactattgacatggaactggtcaaaaggaagaggatcgaggcgatccggggacagatcctgagcaagctgcgcctggcttcgccgccatcacaaggagaagtgccgccaggaccactgccggaagctgtgctggcactgtacaacagcactagagatcgggtggcaggcgaaagcgcagaaccggaacctgagccggaagctgattactacgccaaagaagtgaccagagtgctgatggtggaaactcacaacgaaatctacgacaaattcaagcaatcgactcattcgatctacatgttcttcaatacctccgagctcagagaggcagtgcctgagccggtgctgctgtcaagagcggaactgcgcttgctgcggctgaagctgaaggttgaacaacatgtggagttgtaccaaaagtactccaacaacagctggaggtacctgtccaatcgcctcctcgcgccgtcagactcaccggaatggctctcgttcgacgtgactggagtggtgcgccagtggctgtcgcggggcggcgagatcgaaggcttcaggttgtcggcacactgttcatgtgattcgcgggacaacactctccaggttgacatcaatggattcaccacggggcgccgcggtgatttggcaaccatccacggtatgaacagaccattcttgttgctgatggctaccccgcttgagagggcgcaacacctccagtcgtcccgacatagacgggcacttgacaccaactactgcttctcaagcaccgagaagaattgttgcgtccggcagctctacatcgatttccggaaagatctgggatggaaatggatccatgaaccgaaggggtatcacgcaaatttctgcctgggaccgtgtccatacatctggtccctggacacccagtatagcaaagtgctggctctttacaatcagcataaccctggagcttccgctgccccttgctgcgtgccacaagcccttgaacctcttccgatcgtgtactacgtcggcaggaagccaaaagttgaacaactttcgaacatgatcgtgcggtcgtgcaagtgctcc

SEQ ID NO: 20090 - DNA, 1170 bp, Artificial Sequence
  Description of Artificial Sequence: Synthetic coding sequence
atgccgccgtccggcctgaggctgctgccgttgttgctgccgctgttgtggcttctcgtgcttaccccgggacggcccgcggcggggctgtcgacctgcaagacgatcgatatggagctggtgaagcgcaaaagaattgaagctattcggggacagatcctgtccaaacttcgactggccagcccgccgagccaaggagaggtccccccggggccgctgccggaagcggtactggccctgtacaattcaacccgcgatcgagtggccggagagagcgcagaaccggaacccgaaccggaggccgattactacgctaaagaagtcacccgcgtccttatggtcgaaactcacaatgagatatacgacaagttcaagcagtcaacccactcaatctacatgtttttcaacacttccgagttgcgcgaagccgtgccggaaccagtgctgctgtcgcgggccgaactcagactgctgcgcctgaagctgaaggtcgaacagcatgtggaactttaccagaagtacagcaataactcgtggcggtacctcagcaaccggctgctggccccttcggactccccagagtggcttagctttgatgtgactggagtggtgaggcagtggctgtccagaggaggggagattgaaggattccggctgtcggcccactgctcctgcgacagtagagacaatactctgcaagtggatatcaacggattcaccactggtcggcgcggggatcttgcaaccattcacggcatgaaccggccgtttctgctccttatggcaaccccgttggaaagggctcagcacctgcaatcgtcgcgacatcgcagagccttggatactaactactgcttctcatcgactgagaaaaactgctgtgtgcgccagctgtatatcgatttccggaaggacctcggatggaagtggatccatgaaccgaaaggataccatgcaaatttctgccttgggccgtgtccatacatctggtcactcgacactcagtactcaaaagttctcgcgctgtataatcagcacaacccgggagcgtcagcggccccgtgctgcgtcccacaagccctcgagcctctgccaatcgtttactacgtggggcgaaagcctaaagtggagcaactcagcaacatgatcgtgagatcctgcaagtgctcg

SEQ ID NO: 20091 - DNA, 1170 bp, Artificial Sequence
  Description of Artificial Sequence: Synthetic coding sequence
atgccacccagcggactgcgtctgttgcctcttctcctgccgctgctctggcttctggtccttactccaggccgtcctgcagcaggactgtccacctgtaagaccattgatatggagctggtgaagcgaaaacgtattgaagctattcgcggacagatcctgtcaaagctcaggctggcatccccgccatcccagggtgaagttcctccggggcccctgcccgaagcagtgcttgcactctacaactcaaccagggatcgagtggccggtgaatccgctgagcctgaacccgaacccgaggcggattactacgcaaaggaagtgacccgggtccttatggtcgagactcacaacgagatttacgataagttcaaacagtcaacgcactccatctacatgttctttaacacgagcgagctgagagaagccgtgccagaacctgtgcttctgtcccgcgccgagctgcggcttctgcggctgaagctcaaagtggaacaacacgtggaattgtaccagaagtacagcaacaattcatggcgatacctcagcaaccgccttctggctcctagcgattcgcctgaatggctgtcctttgatgtgaccggagttgtgcgtcaatggctgagccggggaggagaaattgaaggttttcggctgtccgcgcattgttcgtgtgattcacgcgataataccctccaggtggatatcaacggtttcactaccggacggcggggcgatcttgcaactattcacggaatgaacaggccttttcttctcttgatggcaactccacttgaaagggcgcaacacctgcagtcctcgcgccatagacgggcactggataccaattactgtttttcgtccaccgaaaagaactgttgtgtgcgtcagctgtacattgatttcaggaaagaccttggctggaagtggatccacgagcctaagggctaccatgcaaacttctgtcttggtccatgtccctacatctggtcccttgacactcagtactcaaaggtgctggcactgtacaatcagcataatcctggcgcaagcgcagcgccatgctgcgtgcctcaagccctggagccgctccctatcgtgtactacgtcgggcgcaagcctaaagtcgagcagttgtcgaatatgatcgtgcgctcgtgcaagtgtagc

SEQ ID NO: 20092 - DNA, 1170 bp, Artificial Sequence
  Description of Artificial Sequence: Synthetic coding sequence
atgcccccaagtggactgaggctgctcccgttgctcctgcctctgctgtggctgctggtactcacacccggccgcccagcagccgggctttcaacatgtaagacaatagatatggaactggtgaaaagaaagcgcatagaagccattcgcgggcagatactttcaaagcttcggctggccagtcctccatcccagggagaggtcccccctggacctctgccagaggctgtgctggcgctgtacaactctactagggatcgggtcgccggagagtccgcggaacccgagccagagccagaggccgattactacgcaaaagaggtgacccgggtgttaatggttgagacacacaacgagatttacgacaaatttaagcagagcacccattcaatttacatgttttttaatacctctgaactaagggaggcggtgccagagcccgtgctgctgtctagggccgagctacggttgctgcggctcaagctcaaggtggaacagcacgtcgagctgtatcaaaaatatagcaacaattcatggcggtacttgagtaataggctgttagcaccgtccgactcccccgagtggctgagcttcgatgtcaccggagtggtgcgccaatggttgtccagagggggtgaaatcgaaggattcagactgtcagcccactgttcatgcgatagccgtgataataccctccaggtcgacataaatggcttcaccacaggcaggcgcggggatcttgcgactatccatgggatgaaccgaccctttttgctgttaatggcaactccactggagcgagcccagcatcttcagtcctcacggcacaggcgggctcttgacacaaattactgcttcagctctacggaaaagaattgctgcgtgagacaattgtacatcgattttcgtaaggacctcggctggaaatggatccatgagcctaaggggtatcatgccaacttttgcttgggtccatgtccgtacatttggtcactggacactcagtactctaaagtactggcactctacaaccaacacaatcctggcgccagcgccgccccctgctgcgtcccccaagccctggaacccctgccaatagtttactatgtgggacgcaaaccaaaagttgagcagctgtccaacatgattgtcaggtcctgcaagtgcagc

SEQ ID NO: 20093 - DNA, 1170 bp, Artificial Sequence
  Description of Artificial Sequence: Synthetic coding sequence
atgccaccatccggcttgcgcctgctgcctctgcttcttcctctgctctggctattagtgctgacaccaggacgtcccgccgccggtctgagcacctgtaaaacgattgatatggagctcgtgaaaaggaaacgtattgaagccattcgtggacagatcttgtcaaagctgaggctagcgagcccacctagtcagggggaggtgcctccgggtcctttgcccgaggccgtgctcgccctgtacaactcaacccgcgaccgtgttgctggggaaagcgcagagcccgagcccgagcccgaggccgactactatgctaaggaggtgactcgagtactgatggtcgagacacacaacgagatctatgacaaatttaagcagagcacacatagtatttatatgttcttcaacacttccgagctgagggaagccgtgccagagccggtgctgctgagtagagcggagctgcgactactgagattgaagctcaaagtcgaacagcacgtagagttgtatcagaagtacagtaataattcgtggcggtatctgagcaatcgcttgctagctccttcagattcacccgagtggttatcatttgatgtgaccggtgttgtacggcagtggctgagccgaggcggggaaatagagggattccgcttatctgctcattgctcctgtgatagtagggacaatacccttcaggtcgatataaatggatttactacagggcgccgcggcgacctggccactatccacggaatgaaccgtcctttcctgctgctgatggctaccccactagagagggcacagcatttgcagagtagccgccaccgacgagccctcgacactaactactgtttcagttctactgagaagaattgctgtgtgagacagttgtatatcgatttcaggaaggacctggggtggaaatggattcacgaaccaaagggataccacgctaacttctgtctggggccatgcccctacatttggagcctcgatacccagtacagcaaggttctagctctgtataaccagcataatccaggagccagtgccgctccatgctgtgtgccacaagctttagagcccctgcccatagtgtactatgtggggcggaaaccaaaagtggagcagctgagcaacatgatcgtgcgctcttgcaaatgcagt

SEQ ID NO: 20094 - DNA, 1170 bp, Artificial Sequence
  Description of Artificial Sequence: Synthetic coding sequence
atgccaccaagcgggctgcggcttcttccacttctgcttccgctcctgtggctgcttgtgcttactccaggacgtcccgcggccggcctttccacctgcaaaactattgatatggagcttgtgaagcgcaaaagaattgaagcaattagaggtcagatcctgtccaaacttaggctggcatccccaccaagccaaggggaagtgcctcccgggcctctgcctgaagcagtgctggcgctgtacaactccaccagagatcgagtcgcaggagagagcgccgaacctgagcctgaaccggaggctgactactacgctaaggaagtcaccagagtgctgatggtggagactcacaatgagatttacgacaaattcaaacaaagcacgcactccatttacatgttcttcaacacctcggaactgcgggaggccgtgccagagcccgtcctgctgtcaagggcggaactgaggctgctgcgactgaagctgaaggtagaacagcacgtcgagctttaccagaaatactcaaacaactcatggcgatacctctccaatcgcctcctggcaccatcagattcgcctgaatggctttcatttgatgtcactggagttgtgagacagtggctctcaaggggcggagaaattgagggttttagactttcggcgcattgttcgtgtgattccagagataatactcttcaagtggatatcaatggtttcaccactggacggcgcggtgaccttgccaccatccatggaatgaacagaccttttctccttcttatggcaactcctcttgagagagcacaacatctgcaaagcagccgacaccggcgcgcgctggataccaactattgtttctcatcaactgaaaagaactgctgcgtccgacagctttacattgattttcggaaggatctgggatggaagtggatccatgagccaaagggctaccatgcgaacttctgcctcggaccttgtccatacatttggagcctcgatacgcagtactctaaggtcctggccttgtataaccaacataatcctggggcgtccgccgcgccttgctgtgtgcctcaagccctggagccgctgcctatcgtgtactacgtcggaagaaagccaaaggtggaacaattgtcaaacatgatagtgcggtcctgtaagtgttcg

SEQ ID NO: 20095 - DNA, 1170 bp, Artificial Sequence
  Description of Artificial Sequence: Synthetic coding sequence
atgccaccaagtggacttcgcctgctaccacttttactgccgctcctttggttattggttcttacaccaggacgcccagcggctggattgtcaacttgcaaaacgatagacatggaacttgttaaaagaaagcgaattgaagctatacgtggacaaattctatcgaaacttcgcctcgcatctccaccatcccaaggcgaagtgccaccaggaccgctcccagaagcagttcttgcgctctacaactcgacacgggaccgagtggctggggaatctgctgagccggaaccggagcctgaggctgactattatgcaaaggaggtgactcgtgtattgatggttgagacacacaatgagatttacgataaattcaagcaatcaacgcacagcatctacatgttttttaatacatcagagttgcgtgaagctgtgccggagccggttttgctgtcgagagctgaactcagactgttgcgtttaaaacttaaggttgagcaacatgttgagttgtaccaaaaatattcgaataattcttggagatacttgtctaatcgattgctggctccatcagatagcccagagtggctgtctttcgacgtgaccggagttgttcgtcagtggctttcaagaggaggagaaatcgaaggattccgtttgtcggctcactgctcatgtgattctcgagataacactttgcaggttgatatcaatggtttcactaccggcagacgcggagatcttgctacaattcatggaatgaatcgtccattcctccttcttatggcaacgcctttggagcgggctcaacacttgcaatcctcacgtcacagaagagctttggatacaaattactgtttttcgagtacggagaaaaattgctgtgttcgacagttgtacatcgattttcgtaaagatcttggatggaaatggattcatgaaccaaagggttaccatgcgaatttctgccttgggccctgcccttacatttggagtcttgatactcaatacagtaaagtccttgcgctttataaccagcataacccaggagctagtgcggccccatgttgtgtaccacaggccttggaaccactcccgattgtatactatgtgggacgaaagccaaaagttgaacaactgtcaaatatgattgttcgaagttgtaaatgttcc

SEQ ID NO: 20096 - DNA, 1170 bp, Artificial Sequence
  Description of Artificial Sequence: Synthetic coding sequence
atgccaccttcgggtctgagactgctgcccctcctcctcccgctgctttggttgctggtgctcacccccgggcgtcctgctgctggattgtcgacttgtaagaccatcgatatggaactggtcaagagaaaacgcattgaggcaatccgcggtcagatcctttctaagctgagactggcgtccccaccatcgcagggtgaggtgcccccgggacccttgccggaggccgtgctcgcgctctacaactccacgagagatcgggtggccggagagtcggctgaaccagaaccagagccagaagccgactactacgccaaagaggtcacccgtgtgctcatggtcgagacgcataacgaaatctacgacaagtttaaacagtcgacccattcgatttacatgttcttcaacacctcggaactgcgggaggccgttccggagccagttctgctgtcgcgggccgagctgcggttgctccggctgaagttgaaggtggagcaacacgtggagctgtaccaaaagtactccaacaattcctggcggtacctgtcgaacaggctgctcgcaccatcggattcccctgagtggctgtccttcgatgtgactggcgtcgtgagacagtggctcagcagaggaggagaaatcgaggggtttcgactgtcggctcattgttcttgcgattcccgggacaacacgttgcaagtcgacatcaatggatttactactggccggaggggggacctcgccacgattcacggcatgaacagacccttcctcctgctcatggcaactccgctggagcgcgcgcagcatcttcaatcatcccgccaccggcgggcacttgacactaactactgcttctcatccactgaaaagaactgctgcgtgcggcaactttacatcgacttcaggaaagaccttggatggaagtggatccacgaaccaaagggctaccatgcaaacttttgtctgggcccctgtccgtacatctggtccctggacacccagtactcaaaagttctggcgctctacaatcagcacaatccgggagcgagcgctgcgccatgctgcgtgccacaggctctcgaaccgctcccgatcgtgtactacgtcggacggaagcctaaagtcgaacagttgtcaaatatgattgtgcgctcctgtaaatgttct

SEQ ID NO: 20097 - DNA, 1170 bp, Artificial Sequence
  Description of Artificial Sequence: Synthetic coding sequence
atgcccccgtccggactgcgcctgctgccgctgcttcttccactgttgtggctcctggtgctcactccaggccggcccgccgctggcctctcgacttgcaagaccatcgatatggagttggtgaagagaaagaggatcgaggctatcaggggtcagatcctttccaaactgcgacttgcttcgccgccttctcaaggggaggtcccgcccggcccgctccccgaggccgtcctcgctctttacaatagcactcgggatcgggtggccggagaatcagcggaacctgaacctgaaccagaagccgactactacgcgaaggaggttactcgcgttctcatggtggaaacgcacaatgagatatacgacaaattcaagcagtcaacccattcaatctacatgttcttcaacacttccgaactgagggaggccgtgccggagccggtccttctttcacgcgccgaacttcgcttgctgagactcaaactgaaagtggaacaacatgtggaactgtaccagaaatactccaacaactcgtggcgctatctgtcaaaccgcctcctggccccgtcggatagcccggaatggctgtcatttgatgtgaccggggtcgtcagacaatggctctcgagagggggcgaaatcgagggattcagactgagcgctcattgctcgtgtgacagccgcgacaacacgctgcaggtggacatcaacgggttcaccactggcagacgcggcgatctggcaaccatccacgggatgaatcgccctttcctcctcctgatggcgacgccacttgagagagcgcaacacctgcaatcgtcaagacaccgccgagcactcgatacgaactactgctttagcagcaccgaaaagaattgctgcgtgcgccagttgtacatcgactttcggaaggatttgggatggaagtggatccacgaaccgaagggttaccacgcgaacttctgtctgggaccatgcccatatatctggtcgctcgacactcaatactccaaggtgctggccttgtacaaccagcataacccgggagcctccgcggcaccgtgctgcgttccccaagccctggaaccattgcctattgtgtattacgtcggccggaagccgaaggtcgagcagctgtccaatatgatcgttagatcttgtaaatgttcc

SEQ ID NO: 20098 - DNA, 1170 bp, Artificial Sequence
  Description of Artificial Sequence: Synthetic coding sequence
atgccaccttcagggttgaggctgttgccgctgttacttcctcttctctggctgcttgtactaactcctgggcggcctgccgccgggctaagtacctgcaaaaccatcgacatggaactggtcaagcgcaagaggatcgaagcgattcgaggtcaaatactcagtaagctacgactcgcctctccacctagccagggagaggtgcctccggggccacttcccgaggccgtgctggccttgtataactcaacccgcgatagggtggcgggcgagtccgcagagccagagcctgagcccgaggccgattactacgcgaaagaggtgacaagggtcctgatggtcgaaacccacaatgaaatctacgataaattcaagcagagcactcattctatttatatgtttttcaacacctcagagttgagggaggcagtgcctgagccggttcttctgagccgggctgagctgaggctcctgcgtttgaagctgaaagtagagcagcacgtggagctgtatcagaagtacagtaataactcatggaggtatttgagtaatcgtctgttggcccccagtgattcccctgagtggctgtctttcgatgttacaggagtggtgaggcagtggctgtcccgtggcggcgagatcgaaggctttcgactgtccgctcattgttcctgcgatagcagagacaacacactgcaggtggacatcaatggctttacaactgggcgcaggggcgacctcgccacaattcacggaatgaaccgacccttcctactgctgatggccacacctctggaacgagctcaacacctccagagctctaggcacaggagagcgctcgataccaactattgtttcagctccaccgaaaaaaactgctgcgtccgccagctttacatcgacttccgcaaggacctgggctggaagtggattcatgaacccaagggttaccacgcgaacttctgtcttggcccatgcccctatatctggagcctcgatacacagtatagcaaagttctggctttgtataatcagcataaccctggtgcttcagccgccccctgctgtgtaccacaggctttggagcccctgccaatagtgtactatgttgggcgaaagcccaaagtggaacaactttcaaacatgattgtgaggagttgtaaatgttcg

SEQ ID NO: 20099 - DNA, 1170 bp, Artificial Sequence
  Description of Artificial Sequence: Synthetic coding sequence
atgcccccatctgggctacgcctgttacccctgctgctgcctctgctctggctgttggttctcacccccggtaggcctgctgccggtctctctacctgtaaaacgattgatatggagctggtgaagcggaaaaggatagaagccatccgcggacagatcctgagcaaactgaggttggcctctcctcctagtcagggggaggtgccccctggtccccttcctgaagcagtgctggctctgtataactcgacaagagatagagtcgcaggggagtccgcggagccagagccagagcctgaagctgactattacgccaaggaggtgaccagggtgctgatggtggagacacacaatgaaatatacgacaagtttaagcaatctacccacagtatctacatgttcttcaacacgtcagagctgcgagaagcagtgccagagcccgtcctcctgtcccgggccgaactgaggctcttgcggctgaagcttaaggtagagcagcacgtggagttgtaccagaaatacagtaacaactcttggcggtacctgtcaaatagactgctcgccccctctgactcgcccgaatggctcagttttgacgtgaccggagtagtgcgtcagtggctatcccgaggaggagaaattgagggcttcagactgagtgcccactgcagctgtgacagccgtgataatacgttacaggtggatatcaatggctttactaccggacgccggggggacctcgcaaccatccatggcatgaatagacccttcctgcttctcatggcgacacccctcgagcgtgcccagcacttgcaaagctcacggcacagacgcgcccttgacacaaattactgcttttcatctacggagaagaactgctgtgtgcggcagctgtacatagatttcaggaaggacttgggctggaaatggatccacgaaccaaagggatatcatgctaatttctgcctgggtccctgcccgtacatctggagcctggacacccagtatagcaaagttttggcactctacaatcagcacaaccctggagcgtccgctgcgccatgttgcgttccgcaggcactggagcctctccccattgtgtactacgtgggcaggaagccgaaggtggaacagcttagtaatatgatcgtacgctcatgcaagtgctca

SEQ ID NO: 20100 - DNA, 1170 bp, Artificial Sequence
  Description of Artificial Sequence: Synthetic coding sequence
atgccaccttcggggctgcgcctcttgccacttctcctgccgctcctttggcttttggtgttgactccaggtagaccggccgcgggactctcaacctgcaagacgatcgatatggagctggttaaacgcaagcgaatcgaggcaatccggggacagatcctctccaaacttaggctggcctcgccaccgagccagggagaggtgcctccgggaccgctgccggaggcggtgctggcgctgtacaactcaacccgggatcgcgtggccggcgagagcgcggagcctgaaccggaaccggaagcggactactacgcgaaggaagtgacccgcgtcctgatggtggaaacccataacgaaatctacgacaaattcaagcaatccacccacagcatctacatgttcttcaatacctcggagctgcgcgaagcagtgccggagcctgtgctgctctcccgcgcggaactcagactgctgagactgaagctcaaagtcgagcaacacgtggaactgtaccagaagtactctaacaactcctggcggtacctttccaaccggctcctcgcaccgtccgattcaccggaatggttgtcgtttgacgtcaccggtgtggtcagacagtggctgtcacggggaggcgaaatcgaaggcttccggctttcggctcattgctcatgcgattcacgcgacaataccctgcaggtggacatcaacggattcacgaccggtcggcggggcgacctggcgacgatccacggaatgaatagaccgttcctgctgttgatggctacccctctggagcgggcccagcacctgcaaagcagcagacacagacgggccctcgacactaactactgtttctcaagcaccgaaaagaactgttgcgtgagacaactgtacatcgacttcaggaaggacctgggatggaagtggatccacgaacccaaggggtaccacgccaatttctgcctgggaccatgcccatacatctggtcactggacactcagtacagcaaagtgctggccctgtacaatcaacacaacccaggagcttcggctgccccgtgctgtgtgccacaagccctggaacctctgccaatcgtgtactacgtgggaagaaagccaaaggtggagcaattgtccaacatgatcgttaggtcgtgcaagtgcagt

SEQ ID NO: 20101 - DNA, 1170 bp, Artificial Sequence
  Description of Artificial Sequence: Synthetic coding sequence
atgcccccaagcgggcttcgcctgctgccccttctcctgcctctcctgtggctgctggtgctgactccgggcaggcctgcagccgggctctccacttgcaagaccattgatatggagctcgttaagaggaaacgcatcgaggctatccgagggcaaatcctgagcaagttgcgattagcttctcccccttcacaaggggaagtgcctccaggccccctgcctgaggcagtacttgccctgtataattcaacgcgggatagggtcgcgggcgagagtgctgagccggaacccgagccagaagctgattattacgcaaaggaagtaaccagggtattgatggtggaaactcataatgagatttacgacaagtttaagcaaagtacacatagcatctacatgtttttcaatactagcgagctacgggaggctgtcccagagcctgtgctgcttagtagggccgagcttaggcttttacgcctgaagctgaaggtcgaacaacacgtggagctgtatcagaaatatagcaacaactcttggcgctatcttagcaaccggctcctggccccctcagattctcccgagtggctgtcgtttgacgtaactggagtcgtcaggcagtggctgtccaggggaggagaaatagagggcttcaggctttctgcacactgctcttgtgactcccgcgacaacacactccaggtcgacattaatggcttcaccacagggaggaggggcgatctggcgacaatacatggcatgaaccgcccctttctcttgctgatggctacacctttagagcgagcacagcatttacagagctctagacataggagagctctagataccaattactgtttttcgtctaccgaaaagaattgctgcgttcggcagctctatatagatttcagaaaagacttgggttggaaatggattcacgaacccaagggctaccacgccaacttctgcctcgggccctgtccgtacatttggtctctcgatacacagtactctaaggtgctcgccctatacaatcagcacaatcccggagccagcgcggctccatgctgcgtgccacaggctctggagcccctgcccattgtctactacgtgggacgaaagccaaaggtggaacagctgagcaatatgattgtgaggtcttgtaagtgctct

SEQ ID NO: 20102 - DNA, 1170 bp, Artificial Sequence
  Description of Artificial Sequence: Synthetic coding sequence
atgccaccctccggtctgaggctgcttccgttgctgctgccactgctctggctcctggtgcttacccccggacggcccgccgctggactgtcaacctgtaagactattgacatggagttggtgaagagaaaaagaattgaagctatacgaggacaaatcttgtcgaaattaagactggcctccccgccttctcagggagaagtccctcctggacctctcccagaggccgtgctggccctgtacaactctactagagatcgcgtggctggggagtctgctgagcctgaacctgagcctgaagctgattattacgctaaggaggtcactagggtgctcatggtcgaaacccacaatgaaatctacgacaagttcaagcagtccacccacagtatctatatgttcttcaacacatccgagttgcgcgaggccgtgccagagcctgtcttgctgtcgcgggcagaattgcggctgctcagactaaagttaaaagttgagcagcatgtggaactgtaccaaaagtactccaacaactcatggcgctacctctccaatcgcctgcttgccccctcagattcgcctgaatggctatcttttgacgtaaccggcgtggtgagacagtggctgagtagaggcggagagattgaagggttccgcctttccgcccactgttcctgcgactcacgcgataatactttacaggtggatatcaacgggttcaccaccgggagacggggggatctggcgaccatccatggcatgaatcgtccctttttgcttctgatggccacccctctggagcgggcccaacatctgcagtcctctagacacaggagagcacttgataccaactattgcttctcctccaccgagaagaattgttgcgtcagacagctgtatatcgacttccgtaaagatctagggtggaagtggattcatgagcctaagggctaccacgccaatttctgtttaggcccttgtccctatatctggtcactcgacacacagtatagtaaagttttggcactgtacaatcaacacaatccaggtgcctccgcagcaccctgctgcgtacctcaggccctggagcccctgcccatcgtatactatgtgggtaggaagcctaaagtggagcagctgagcaacatgattgtgagatcttgcaagtgcagc

SEQ ID NO: 20103 - DNA, 1170 bp, Artificial Sequence
  Description of Artificial Sequence: Synthetic coding sequence
atgccgccttctggcctaaggttgctgccgctcctgctgccactgctgtggttgttggtcctgacacctggccgtcctgcagcgggcctgtcaacatgcaaaaccattgacatggagctcgtgaaacgcaaacgcattgaggcgatcaggggccagatcttgagtaagctcaggctggccagccctccaagccagggagaagtgcccccagggccgctgcccgaagctgtgttggccctctacaactctactagagatcgagtggccggcgaatcggcagaaccagagccggaacccgaggccgattattacgcaaaggaagtcactagggtcctgatggttgagactcacaacgaaatatatgacaaattcaagcagagcactcacagtatctatatgttttttaatacttctgagctgcgcgaggcagtccctgagcccgtcttgttgtcccgagctgagctgagactcctaaggcttaaactgaaagtcgagcagcacgtcgagctctaccagaagtactcaaataacagctggcgctacctctccaaccgacttcttgcgccctccgattcgcctgaatggctgtcattcgacgttacgggtgtggtgcgccaatggctgagccgcggcggtgaaatcgagggctttaggctatctgcccactgctcttgtgattctcgtgacaatacactgcaggtggacataaacggattcactacaggacggagaggggacctcgcaaccatccacggtatgaataggcctttcctactgctgatggcgacccccctggagcgagctcagcacctccagtcgagccggcacaggagagcactcgacaccaattactgtttttcctctactgagaaaaactgctgtgtgcggcagctttacatcgatttcaggaaggacttaggttggaaatggatacacgaacctaagggctatcacgcaaacttctgtcttggcccatgtccatacatttggtccctggacacccagtattcaaaggttctggcactctataaccaacacaaccccggcgccagcgcagcaccttgctgtgttccacaggctctcgagccactgccaatcgtgtactacgtgggtaggaaacccaaagttgagcagctttccaacatgatcgttcgcagctgcaaatgttcc

SEQ ID NO: 20104 - DNA, 1170 bp, Artificial Sequence
  Description of Artificial Sequence: Synthetic coding sequence
atgccgccgtcgggactgcgcctgctcccacttctcttgccgctcctgtggctcctggtccttaccccaggccgcccggccgcaggtttgagcacgtgcaagactattgacatggaactggtgaagcgcaagagaatcgaggctatacgcggccaaatcttgagcaaactcagattggccagcccgccgtcccaaggcgaggtgccgccaggacctctgccggaagccgtcctggctttgtacaactcgacccgggatcgcgtcgcgggagagagcgctgagcctgaacctgaaccggaggcagactactacgcaaaggaagttactcgcgtcctgatggtcgagactcacaacgaaatctacgacaaattcaaacagtctacccattcgatctatatgtttttcaacaccagcgaactgcgcgaagcagttccggaacctgtgctcctgtcccgcgctgagctgcgccttctgagacttaagctgaaagtggaacaacatgtggagctctaccaaaagtactccaataactcttggcgctacctctccaatcggttgctggctccgtcggacagcccagaatggctgtcattcgacgtgactggcgttgtgcgccaatggttgtcacggggcggggagatcgaaggcttcaggctgtccgcacactgttcgtgcgactccagggacaacactctgcaggtggacatcaacggcttcacgactggacgccgcggtgatctggctactattcacggaatgaatcgcccgttcctcctgcttatggcaaccccactcgagcgcgcccagcacctgcagtcatcccgccaccggcgcgcgctggataccaactattgcttttcatccaccgagaagaattgctgcgtgcggcagctttacatcgacttccggaaggatctcggctggaagtggatccatgaaccgaagggatatcatgccaacttctgcctgggcccttgtccgtacatctggtcccttgatacccaatactcaaaagtgctggccttgtacaaccaacacaatccaggagccagcgccgccccgtgctgcgtaccgcaggcactggaacccctgcctatcgtgtactacgtgggacggaagccgaaggtggagcagctgtcgaacatgatcgtcagaagctgtaagtgctcc

SEQ ID NO: 20105 - DNA, 1170 bp, Artificial Sequence
  Description of Artificial Sequence: Synthetic coding sequence
atgcctccgtccggtttgcgtctgttgcccctgctacttcctctcctctggctgttagtcctgacccctgggaggcctgctgccgggctcagtacctgcaagacgatagatatggaattggtaaaacgcaagcgaatcgaggctattaggggtcagatcctctccaagttacgtctcgcatcacctcctagccaaggtgaggtgcctcctggcccattacccgaagctgtgctggcactctacaactctacgcgcgacagagttgccggtgaaagcgccgaaccagagccggagcccgaagccgactactatgcaaaagaggtgacacgcgttctcatggtcgagactcataacgaaatttacgataagtttaaacagtccacgcactcgatctatatgtttttcaatacctctgaacttagagaagctgttcctgaacccgtacttctctcgagggccgagctccgactcttgagacttaagcttaaggttgaacaacatgtcgagctctatcagaaatatagtaataattcctggcgctatctttctaataggctcttggcaccctcggatagccctgagtggctcagcttcgatgtgactggtgtcgttcgacagtggttgtctcggggaggagaaatcgaggggttccgtttgtcggcgcattgtagttgtgactcgcgagacaacactcttcaggtcgatatcaacggtttcacgacaggtcgtcggggtgatttagcgaccatacacggtatgaaccgtccctttttgctgctaatggcaacaccgttggaaagggcccagcacctgcagtcatctcgtcataggcgagccctagacactaattattgttttagctccacagagaagaattgctgcgtgaggcagttgtatatcgactttcggaaagatttaggttggaaatggatccatgagccaaaaggataccacgcaaacttctgcctcggtccatgcccgtatatatggagtcttgatacccagtacagcaaagtcttggcgttgtacaaccagcataaccctggcgcctccgcagctccatgttgtgttcctcaggccttggagccactgcccatcgtctattacgtcggtcgtaagccaaaggttgaacagctaagcaatatgatcgttcgctcttgcaagtgtagc

SEQ ID NO: 20106 - DNA, 1170 bp, Artificial Sequence
  Description of Artificial Sequence: Synthetic coding sequence
atgcctcctagtggattgcggctcttgcctcttttactccctctcttatggctgctggttctgacacccggacgccccgcagctggcttgtctacctgtaagactatcgatatggagctcgtgaaacgtaaacggattgaggccattaggggccaaattctgagtaaactgcgcctggcaagtccccctagccaaggtgaggtaccgcctggacctctgccagaggccgtcctggccttgtataattccacaagagaccgcgtggctggggagtccgctgaacctgagccagaacccgaggcggattattacgctaaggaggtgactagagtcctgatggttgaaacacacaacgagatctatgacaaatttaagcagtctacacacagcatatacatgttcttcaacacatcggagctccgggaagcagtgcccgaaccggtgctcttatcgagagcagagcttagactgcttaggttaaaactgaaagtggaacagcatgtagaactataccagaagtattcaaacaatagctggaggtaccttagtaaccggctccttgcacccagcgactccccagaatggctgagttttgacgtgacgggagtggttagacagtggctgtcacggggaggcgaaatcgaaggttttcggcttagcgcccactgctcctgcgacagccgcgacaacactctccaggttgacataaacggctttacaaccgggaggcggggagatctcgccaccatccatggcatgaaccggccatttctgttgttgatggcgacacctttagagcgggcccaacacctgcaatcctctcgacatagacgagcgcttgacacaaactactgtttttctagcacagaaaagaactgttgtgtgcgacagctgtacatcgacttcaggaaggaccttggctggaaatggattcatgaaccaaaaggatatcacgcaaacttctgtctaggtccctgcccctatatatggagccttgatacccagtacagcaaggtgctcgcactctacaatcaacataaccccggtgcttccgcagccccgtgctgcgtgccccaggctctggaacccctccctatcgtgtactatgtggggcggaagcccaaggttgagcagctgtcaaatatgatcgtcaggagttgtaagtgtagt

SEQ ID NO: 20107 - DNA, 1170 bp, Artificial Sequence
  Description of Artificial Sequence: Synthetic coding sequence
atgcctccatcgggtctgaggctgctaccacttctgttgcccctgttgtggttactggttcttaccccagggaggcccgctgcgggtttgtccacttgcaagaccatagacatggagcttgtgaaaagaaagcgcatcgaagccattagaggacagatcctgagtaaactccggctggcgtcacctccatctcaaggcgaggttccaccaggccccctaccagaagcggttttggctctttataatagcacgcgtgaccgagttgccggtgagtccgctgagcctgagccagaacccgaggctgactattacgcgaaggaagtgaccagggtcctgatggtggaaacccataacgaaatatacgacaaattcaagcagtcaacacattccatttacatgttttttaatacatccgaactccgggaagcagtccctgaacctgtgttattgagccgggcggagctgcgcttgttgcggctgaagctcaaggtagagcagcatgtcgagctgtatcagaagtattccaacaatagttggagatacttatcaaacagattgttggcaccgtcagacagccctgagtggctttccttcgacgttacgggcgtggttcggcagtggctgtcccgggggggagaaatcgaaggttttcgtctgagcgcccattgtagctgtgattccagggacaacaccttacaggtggacatcaacgggttcacaaccggtagaagaggcgacctcgccacgatccacgggatgaataggccatttctgttgttaatggcaactcccctcgagcgggctcagcacctgcagtcatctagacaccgaagagcactggacaccaactactgcttttcttcaacggaaaagaattgttgcgtccgccagttgtatattgatttccggaaggacctagggtggaagtggattcatgagccaaagggataccatgcgaacttttgcctcggcccctgtccctacatatggagcctcgacactcagtattcaaaggtgctcgccctctacaaccaacataatccgggcgccagtgccgccccttgttgtgtgcctcaggccctggagccactgccaatcgtgtactatgttggacgcaagcccaaagtggaacagctaagcaacatgattgtgcggtcttgcaaatgtagt

SEQ ID NO: 20108 - DNA, 1170 bp, Artificial Sequence
  Description of Artificial Sequence: Synthetic coding sequence
atgccaccttcaggccttcggcttctgccactgcttctaccactgctgtggctgttagtgctgacacctggacggcccgctgctggccttagcacatgtaaaaccatcgatatggaactggtgaaaagaaagcggattgaggcaattcgggggcaaattctcagcaaattacgattggcttctccgccttcacagggtgaagtgccaccaggcccgctccccgaggctgttttggcgctttacaactcaacaagagatagagttgcaggggaatctgcagaaccagagcctgaacctgaggccgactattatgccaaggaagtgactcgggtcttaatggttgagactcacaacgagatatacgataagttcaagcagtccacccatagtatttatatgttttttaatacatccgagctccgagaggcggtccctgagcccgtgctgctctcaagggcagaattgagactgcttcgcctgaagctgaaggtggagcaacacgttgagctttaccaaaaatatagcaacaatagctggcgctacctctctaatcgccttctcgcaccgtcggactcaccagaatggctctcatttgacgtcaccggagtcgtgagacagtggctgagccgggggggtgagattgagggattccgcctcagcgctcattgcagctgtgatagccgggacaacactctccaggtggacatcaacgggttcaccacagggcggcggggcgatctcgctacgatccacggcatgaatcgtcccttcctgttactgatggctactcccctcgaacgtgcacagcacttgcagagttcacgacacagaagggctctggacacaaactactgtttttcctccactgaaaaaaactgttgtgtaagacagctgtacatagacttccgaaaggacctgggttggaagtggattcacgaacctaagggttatcacgctaacttctgtctaggtccctgtccctatatttggtccctcgacacccaatattcaaaggtgctggctctctataatcaacacaaccctggggcatctgcagctccatgctgtgtcccccaggccctagaaccgctgccaatcgtatactacgttggcaggaagccaaaggtggaacagctctccaacatgattgtgaggtcgtgcaaatgttca

SEQ ID NO: 20109 - DNA, 1170 bp, Artificial Sequence
  Description of Artificial Sequence: Synthetic coding sequence
atgccaccatcaggcctgagattgctgcctcttctgctgccactgctgtggttgttggtgcttactcctgggaggcctgccgctggacttagcacctgcaagaccatcgatatggaattggttaagcgcaagaggatcgaggctatcaggggacagattctgtcaaagttgaggctggccagtcccccatcccagggcgaggttccgcccggccccctgccagaggccgtcctcgccctgtataactccacccgggatagggttgccggcgagtcagccgagcccgaacccgagccagaagcagactattacgccaaggaggtcacaagggtgctcatggtggaaacccataacgagatctacgataaattcaagcagtctacccacagtatttacatgttcttcaacaccagtgaactgagggaggctgttcctgagcccgtccttttgagccgcgccgagcttaggctgctgagactgaaactgaaagtggaacagcatgtggagctgtaccagaaatactctaataacagttggagatacctgtccaatcgactgctggcccccagcgactcacccgagtggctttcatttgatgtaactggcgtggtgcgccaatggctttccaggggcggggaaattgaggggttcagacttagtgcacactgcagctgtgattcccgcgataacaccctgcaagtggatatcaatggctttaccactggccggaggggggatctggcgacaattcatgggatgaacagaccattcctcttgctcatggccacacctttggagcgggctcaacacctgcagtcatcaaggcaccggagagccctcgatactaactattgtttctccagcaccgaaaagaactgctgtgtccgacagctgtatatcgactttaggaaggatctgggttggaaatggattcacgagcctaaaggctatcatgctaacttttgtctcgggccttgcccctacatctggagcctcgatacccagtattccaaagttcttgcgctctacaaccagcacaatccgggtgcctccgctgctccctgctgcgtgcctcaggccctggaacccctgccaatcgtgtactatgtcgggaggaagcccaaagtcgaacagctctccaatatgatcgtgagatcatgtaaatgttct

SEQ ID NO: 20110 - DNA, 1170 bp, Artificial Sequence
  Description of Artificial Sequence: Synthetic coding sequence
atgccaccttcggggctgaggctgctgcccctgctgctcccactcctctggctgcttgtgttgacgccgggcagacctgcagcaggactgtcgacttgcaagaccatcgatatggagctggttaagaggaagcgcatcgaggccattcggggtcagatcctgagcaaactcaggctggcctctccaccatcacagggagaggtgccgccggggccgttgccggaggcagtgctggcactttacaactcgacccgcgatcgggtggcgggagagtcggcggaaccagaacccgaacctgaggcagactactacgcaaaggaggtcacgcgggtgctgatggtcgaaacccacaatgagatctacgacaagttcaagcaaagtacccactcgatctacatgttcttcaatacttcagaacttagagaagctgttcccgagcctgtgctgctgagccgggccgaactgcggctcctgcgcctgaaattgaaggtcgagcaacacgtggaactgtaccagaagtattccaataactcctggcggtacctgagcaacagactccttgcaccctccgatagcccggagtggctgagctttgacgtcaccggggtggtccggcaatggttgagccgagggggagagatcgaaggattcagattgtcagctcactgttcgtgcgactccagggacaatactctgcaggtggatatcaacggctttacgaccgggcggcgaggagatctggcgaccattcacggtatgaatcgccctttcctcctgttgatggcaaccccactggagcgcgcccagcatctccaatcatcacgccatcgcagagcgttggataccaattactgtttctcctcgactgaaaagaactgttgcgtccgccaactctacatagactttcgcaaagacctcggttggaagtggatccacgagcctaaaggctaccatgccaacttctgcctgggaccttgcccatacatttggtccttggatactcaatactcaaaagtgctggccctctacaatcagcataatccgggggcctcggcagcaccatgttgcgtccctcaggcactcgaacccctgccgatcgtttactacgtgggccggaagccgaaggtcgaacagctgagcaacatgatagtgcgctcctgcaagtgttcc

SEQ ID NO: 20111 - DNA, 1170 bp, Artificial Sequence
  Description of Artificial Sequence: Synthetic coding sequence
atgccccctagcggcttgcgcctgttacctttgctgttacccttattgtggttgctggttcttacccctggtcgaccagccgctgggctttcaacttgtaaaacaattgatatggaattggtcaagagaaagcgtatcgaggctattaggggacaaattttgtcaaagctcaggcttgcttcacctccgtcccagggtgaggtccctcctggaccgttgcctgaagccgttctcgctctctataactccactcgagacagggttgccggagaatcagctgaacctgaaccagaaccggaagccgattattatgctaaggaagtgacccgcgtactcatggtggagacgcataatgagatctacgataagttcaaacagtcgactcacagcatatatatgttctttaacacctctgaactaagagaggccgttccagaaccggtcttgttaagtagagccgagttgcgtttgcttcgtttgaaacttaaagttgagcagcatgttgagctctatcaaaaatattctaataattcttggcgatatttgtctaaccgtctacttgctcctagcgattcacctgagtggctttcatttgacgttacgggcgtcgtgcgacagtggctttcaagaggaggcgaaatcgaaggttttagactttctgctcattgttcctgcgatagccgtgataacactcttcaggttgatattaatggctttacgactggccggcgaggagacttagctactattcatggaatgaaccgaccattcctgctccttatggcgactcccctggagagagctcaacatcttcagtcttccagacatcgacgtgcattggacactaattattgtttctcgagtaccgaaaaaaattgttgtgtcagacagttgtacatcgatttcagaaaggacttaggatggaagtggattcatgagcctaagggttatcatgcgaatttttgccttgggccttgtccttatatatggtcgctggatacccaatatagcaaagttttagctctatataatcagcataatccgggtgcctccgctgcgccatgttgtgtccctcaagctcttgaacctctcccaattgtatattacgttggtcgtaagcccaaggttgaacaattatctaacatgattgtaaggtcatgcaagtgctcg

SEQ ID NO: 20112 - DNA, 1170 bp, Artificial Sequence
  Description of Artificial Sequence: Synthetic coding sequence
atgccgccctcaggcctgcggctgctgccgctcctcctcccgctgctgtggctcctggtgctcactcctggccgtcccgccgcaggactgagcacttgcaagaccatcgacatggaactcgtgaagcgcaagcggatcgaagccatcaggggccaaatcctgagcaagctccgcctggcgtcgccaccgtcacagggtgaagtgccgccgggacctctgccagaggcggtgctggccctttacaactccactagagacagagtggccggggagtcggccgagcctgagcccgagccagaagcggattactatgcgaaggaggtgactagagtgctgatggtggagactcacaatgaaatctacgacaaattcaagcaatccacccattcaatctatatgttcttcaacacctctgaactgagggaagcagtgccggaaccagtgctgctctcccgagcagagctgcgccttctcaggctcaagctgaaagtggaacagcacgtggagctgtatcagaaatactcgaacaattcctggagatacctgtcgaatcggctcctcgcaccgtcggactccccggagtggctctcattcgacgtgactggagtagtccgccagtggctgtccagaggtggagaaatcgaaggcttcaggctgtcagcacattgctcgtgcgattcgcgcgacaacactttgcaagtggacatcaacggcttcaccaccggacggcgcggcgaccttgccaccatccacggaatgaaccggccgttcctcctgctgatggccactccgctcgaacgggcgcagcacttgcagagctcccgccatcgccgcgccctggataccaattactgttttagcagcaccgaaaagaactgctgcgtccggcaactgtacatcgacttccgcaaagacctgggttggaagtggatccacgaaccgaaaggataccacgccaatttctgtctcggaccctgcccatacatctggtccctcgacacgcagtactcgaaagtgttggcgctttacaatcagcataaccctggagcaagcgcagccccgtgctgcgtccctcaggccttggaaccgctcccaattgtgtactacgtcggcagaaagccaaaggtggagcagctgagcaacatgattgtgagatcatgtaaatgctcc

SEQ ID NO: 20113 - DNA, 1170 bp, Artificial Sequence
  Description of Artificial Sequence: Synthetic coding sequence
atgccgcctagcgggcttagactgctgcctcttctgcttcctcttctgtggctgctggttctgacgcctgggaggccagccgctggactctccacctgtaagaccattgatatggagctggtcaagcggaagcggatcgaggcgattagggggcaaattctttcgaagctgcgtctcgcctcgccaccctcccagggagaggtgccaccgggtcctctccctgaggcagttctggcactttacaacagcacccgagacagggtggcgggcgaatcggcggagcccgagccggagccagaagccgactactacgccaaagaagtgactcgcgtgcttatggtggaaacgcacaacgaaatctacgacaaattcaaacaatcgacccactcgatttacatgttctttaacaccagtgaattgagagaagccgtgcctgagcccgtgcttttgagtagagctgaacttcggctgctgagacttaagctgaaggtggagcaacatgtggaactttaccagaagtacagcaacaattcgtggaggtacctttccaataggttgcttgcaccatccgattcgcctgaatggctcagctttgatgtgaccggtgtggtacggcaatggcttagccgaggaggcgaaatcgagggattccggctgagcgctcattgctcatgcgacagcagggataacactttgcaagtggacataaacggcttcacgaccggacgaagaggtgatctggcaactatccacggtatgaatcggccgtttctgcttctgatggcaaccccactggagagagctcagcacctgcagagctctcgccatagaagggcccttgatactaactactgctttagcagcaccgaaaagaattgctgtgtgcgccaactctacatagactttcgcaaagatctcgggtggaaatggatacacgagccgaaaggctaccatgcgaatttctgccttggaccatgtccctacatttggtcacttgacactcagtactccaaggtcctcgcactctacaaccaacataatcctggagcgtccgcagccccctgctgtgttccacaggcacttgaaccacttccaatagtgtattatgtcgggcggaagcctaaggtggaacaactctccaatatgatcgtcagatcgtgtaagtgtagc

SEQ ID NO: 20114 - DNA, 1170 bp, Artificial Sequence
  Description of Artificial Sequence: Synthetic coding sequence
atgccgccatcgggacttagactgttgcctctgctgctgcctttgctgtggctcttggttcttactcctggacgcccagccgcaggtctgtccacctgtaagacgattgatatggaactggttaagcgcaagcgcattgaagcaatcagagggcagatattgtcgaaactgcggcttgcttcccctccgtcacagggtgaagtgcctcctggtcctctgccggaggcagtgcttgcactctacaactccaccagagatagagtggcaggagagtccgcagaaccagagcccgagcctgaagcagactactacgctaaggaggtgacgagagtgcttatggtggaaacgcataacgagatttacgataagtttaagcaaagcactcacagcatctacatgttctttaacacctcagaactgcgtgaagcagtgccagaacctgtgcttctgtcaagggcagaactcaggctgctgcgactgaagctcaaggttgagcaacacgtggagctgtaccaaaagtacagcaataactcatggaggtacctgtcgaaccggcttctggccccctcggatagccctgagtggctgtcgttcgacgtaactggagtggtgagacagtggctgagtagaggtggggaaatcgaagggtttcgcttgtccgcccattgcagctgtgatagcagggataacaccctgcaagtggacattaacgggtttactactggtcgacggggagatctggccaccattcatggaatgaatcgtcctttccttctgttgatggcaactccgttggagcgcgcccaacatctccagtcgtcaagacataggagagcactggacaccaactactgtttttcatcaaccgaaaagaattgttgtgtgcgccaactctatattgacttccgcaaagatcttgggtggaaatggattcacgaaccaaaaggataccatgctaacttttgccttggaccatgcccttacatctggtcccttgatacccagtatagtaaggtcctcgctttgtacaaccagcacaatcctggcgcttcggcggcaccatgctgtgtgcctcaagcactggagccccttcccattgtctactacgtcggtcgaaagccgaaagtggagcagctcagcaatatgattgtgcggtcctgtaagtgttcc

SEQ ID NO: 20115 - DNA, 1170 bp, Artificial Sequence
  Description of Artificial Sequence: Synthetic coding sequence
atgcccccctccggcctgcgactcctgcccctattgttgcctctgctgtggcttctcgtcctgacccccggtcggccggccgcgggcctctcgacctgcaagaccatcgacatggaacttgtcaagaggaaacgcatcgaggcgatcagaggacagatcttatccaaactcaggctcgcctcgcctccctctcagggtgaggtcccgccgggacctttgcccgaggccgtcctcgcgctttacaactctacaagggaccgtgtcgccggcgagtccgctgagccggaacctgagcccgaggctgactattatgctaaggaagtgacccgtgtgttgatggtggaaacccacaacgagatttacgacaagttcaagcagtcgacccacagtatctatatgttcttcaacacctcggagctgcgggaggcggtcccggagccggtcctattgtctcgtgctgagctgcgactgcttaggctcaagctgaaggtcgagcaacacgtcgagctgtaccaaaagtactccaacaattcgtggaggtatctgagtaaccgcctcctagcgccgagcgactcgcctgaatggctgtcgttcgacgtcaccggtgtcgtccgtcagtggctctcccgcgggggtgagatcgaaggtttccgtttgtctgctcactgcagttgcgactctcgggacaacacgctgcaggtcgatattaacggattcacgaccgggaggcgcggcgacctggcaactatccacggtatgaaccgccctttcctcctgctgatggccacaccgctcgaacgtgctcagcacttgcagtcctcccgtcataggcgggcgcttgatacgaactattgcttctcgtctaccgagaagaactgctgtgtgcgccagctctacatcgatttccgtaaagatctgggctggaagtggatccatgagcccaagggctatcacgcgaacttctgcctgggaccctgcccgtacatatggtccctcgacacccaatactcgaaggttctggccctttacaaccaacacaaccccggtgccagcgcggctccgtgttgcgtgccccaagcgttggagccactgccgatcgtctactatgtgggtcgtaagccgaaggtcgagcagttgtctaacatgatcgttcgctcgtgcaagtgctcc

SEQ ID NO: 20116 - DNA, 1170 bp, Artificial Sequence
  Description of Artificial Sequence: Synthetic coding sequence
atgccccctagcggactccgcctcctgcctttgctgctcccacttctgtggcttctcgtactgactccgggacgaccagccgccggactgtcgacttgcaagaccatcgacatggaactggtgaagagaaagcgcattgaggcaatccgcggtcaaatcctgagcaagttgaggctcgcttcacctccttcccagggggaggtgcccccaggaccacttccagaggcggttctggctttgtacaactcgactcgtgaccgcgtggcaggagaatccgcagaacctgaaccggaaccggaggcggattactatgccaaggaggtcactagggtgctgatggtggagacgcataacgaaatctacgacaagttcaagcaatcgactcactccatctacatgttctttaacacttccgagcttcgggaggcggtcccggaaccagtcttgctgtcccgcgctgaactgaggctgctccgtctgaagctgaaggtcgaacagcacgtggaactgtaccaaaagtactcaaataacagttggcgctacttgtcgaatcggctgctggcgcctagcgattcgcctgagtggctctcgttcgacgttaccggagtcgtacggcagtggctttcgaggggcggcgaaatcgagggattccggctgtcggcacactgttcctgcgattcccgggataacaccttgcaggtggacattaatggcttcaccacgggacgccggggagatttggcgacgatccatggaatgaatagaccgtttctgctgttgatggcaacccctctcgagcgggcccagcatctgcaatcgagcaggcaccgccgggccctggacacgaactactgcttttcctccaccgaaaagaactgctgcgtccggcagctctacatcgatttccgcaaggacctcggatggaaatggatacatgagccaaagggctaccacgccaacttctgcctgggaccttgcccgtacatttggtcactcgacacccagtattcaaaagtgctggcactgtacaaccagcacaatcccggtgccagcgcggcgccatgctgtgtgccacaggccctggaaccgttgccgatcgtctactacgtggggcgaaaaccgaaagtggaacaactctccaacatgatcgtgcggagctgcaaatgttca

SEQ ID NO: 20117 - DNA, 1170 bp, Artificial Sequence
  Description of Artificial Sequence: Synthetic coding sequence
atgccaccgtccggcttgagactgcttcccctgctgttgccgttgctgtggctgttggttctgaccccgggtagaccggctgcaggtctcagtacctgcaagactattgatatggagctcgtgaagcgcaagagaatcgaggctattagaggacagattctcagtaagctgcgccttgcctctccacccagtcagggcgaggtgccgcccggaccgctccctgaagcagtgcttgctctgtataattcaacgagagatcgcgtcgccggcgagtctgcggaacctgaaccggagcctgaggcggactactatgcgaaagaggtaacaagggttctgatggtagagacgcacaacgagatctacgacaaattcaagcagagtacacattccatttacatgtttttcaacacaagcgaactccgcgaggctgtgcctgaacctgtgctgctttcccgcgctgagctgaggttgctcaggttgaaactgaaggtagagcagcacgtggaactgtaccagaagtacagtaacaacagttggcgctatctgtccaataggctgctggctccttccgatagccccgaatggctgagtttcgatgtgaccggagttgtaaggcaatggctgtcaagaggaggagagattgaaggttttcgcctcagcgcccactgctcttgtgatagtagggataatacgcttcaagtagatattaatggctttaccactggtagaagaggtgacttggcaaccattcatggcatgaatagaccgttcctgctgttgatggccactcccctggaacgcgcacagcacctccaatcttccagacatagaagggctttggatactaactattgtttcagttccacggagaaaaactgttgtgttagacagttgtatatcgactttaggaaggaccttggctggaagtggattcatgaacccaagggctaccacgccaatttctgtctgggtccatgcccttatatctggtcccttgacacccagtattcaaaggtgttggctctgtataaccagcacaaccctggagcgtctgctgctccgtgttgcgttccccaagctctggagcctctccccattgtgtactatgtcggaaggaagccaaaagtggagcagctgtctaacatgatcgtccgctcctgcaagtgtagc

SEQ ID NO: 20118 - DNA, 1170 bp, Artificial Sequence
  Description of Artificial Sequence: Synthetic coding sequence
atgcccccttcgggtctgcgcctgctgccacttctcctgcctcttttgtggctgttggtgctcaccccaggcagaccagcggcgggcctttcgacctgtaagacgatagatatggaactggtcaagcggaaacgaatagaggccatcagggggcagattctctcaaagctgcgtctggcaagcccgccttcgcaaggtgaggtccctcctggacctctccctgaggccgtgctggcactttacaacagcacgcgcgacagagtggcaggggaatccgcagaacctgagcccgagcctgaggccgattactatgcaaaggaagtgacccgcgtgctcatggtggagactcataacgaaatctacgataagtttaagcaatccacccattccatttacatgtttttcaacacctccgagttgagagaggcagtgcctgaaccggtgctgctcagcagagcagagcttcgactccttcgtctgaaacttaaggttgagcagcatgttgaactctaccagaagtattccaacaattcatggcggtacctgtcgaatcggctcttggcgccttctgacagtcctgaatggttgtcgttcgatgtgacgggagtcgtgaggcagtggctctcacgaggcggtgagattgagggattccgcctgagcgcacattgctcgtgcgattcacgagataacaccctccaggtggatatcaatggttttaccaccggtagacggggggacctcgcaaccattcacggaatgaaccggccattcctgcttctgatggcaaccccgctggagcgagcacaacatctccaatcttcgagacacagaagagcccttgacacgaactactgcttttcctcgactgagaaaaactgttgcgtgcgtcaactctacattgattttaggaaggacctgggatggaagtggattcacgaacccaagggttaccatgctaatttctgtctcggaccatgtccttacatatggtccctggacacccagtactcgaaggtcctcgcactgtacaatcaacataatccaggagcatcagcagcgccatgttgcgtgccccaagccctcgagccgctgcctattgtgtactacgtcggcagaaaacctaaggtggaacaactgtcaaacatgattgtgagatcctgtaagtgctcg

SEQ ID NO: 20119 - DNA, 1170 bp, Artificial Sequence
  Description of Artificial Sequence: Synthetic coding sequence
atgccaccctctggattgaggctcctgcctcttctcctccccctactgtggctcctggtactgacccccggccgacctgccgcaggcctctccacatgcaagaccattgacatggagttggtgaaaagaaaacgaatcgaggcgattcgcggccagatcctgtcaaaactgcgactggcctcacctccctctcagggagaagtgccaccaggacctctgcccgaggccgtgctggctttgtataactctactcgagacagggttgcgggagagtccgctgaacccgagccagagccggaggccgattactatgctaaagaggttaccagagtcctgatggttgagactcacaacgagatctacgataagttcaaacagagtacccactctatatatatgttttttaataccagcgagctgcgagaggccgtaccggaacccgtcctattgagtcgcgcagagttgcggctcctgagattaaaacttaaagttgaacagcatgtcgagttgtaccagaaatactctaataatagctggcgatacctctctaataggttgctggcccccagtgattctcccgagtggttgagtttcgatgtaacgggagtggtccgtcaatggctctcacgtggaggtgagattgagggattccggctgtctgctcactgcagctgtgattcaagagataacaccttacaagtggacatcaatgggtttacaacgggccgtcgcggggacctagcaacaattcacggcatgaacagaccattccttctcctcatggctactccactggagcgagcacagcacctgcagtcttctcgccacaggcgggcccttgatacgaactattgtttttcgtccacagagaaaaattgctgtgtgcgccagctgtacatcgattttaggaaagatttgggatggaaatggatccacgaacccaaggggtaccacgccaacttttgcctcggaccctgcccctacatttggagccttgacactcaatactcgaaggtactcgctttatacaatcagcacaaccctggggcttctgctgccccctgctgcgtgccgcaggctctggagccactgcccattgtgtattacgtgggcagaaaaccgaaagtggaacagttgtctaatatgatcgtgcgaagctgcaaatgcagc

SEQ ID NO: 20120 - DNA, 1170 bp, Artificial Sequence; identical to SEQ ID NO: 20075
  Description of Artificial Sequence: Synthetic coding sequence

SEQ ID NO: 20121 - DNA, 1170 bp, Artificial Sequence
  Description of Artificial Sequence: Synthetic coding sequence
atgccgccatcggggttgcgccttctcccactccttctgccgcttctgtggctccttgtgctgactccgggaaggcctgctgcgggactctcgacctgcaagaccatcgacatggagttggttaaaaggaagcgaatcgaagctatccgcggacagatcctctcgaagctcaggcttgcgtcgccgcctagtcaaggagaagtgccccccggaccgctgcctgaagctgtgctcgctttgtacaactcaacccgggaccgtgtggccggggaatcggcagaaccggaacccgaaccggaagccgactattacgcgaaggaagtgacgcgggtcctgatggtcgagactcataatgagatctatgataagttcaaacagtcgacccattcaatctacatgttcttcaacacttcagagctgcgcgaagccgtgccggaacctgttttgctctccagggccgagcttcggctgcttagactgaagctcaaagtcgaacaacacgtggagctttaccagaagtatagcaacaactcatggcggtacctgagcaataggctcctggcaccatcagattcccccgagtggctctcgtttgatgtcactggagtcgtgagacaatggttgtcaagaggaggagagatcgagggcttccgtctgagcgcgcattgctcctgtgacagccgcgacaatacccttcaggtggacatcaacgggtttaccacgggccggcgcggcgacctggccactattcacggaatgaacaggccgttcctgctgctgatggccacgccactggagagggctcagcacctccaatcctcccgccatagacgggccctggataccaattactgcttcagcagcaccgagaaaaactgttgcgtgcggcagctctacatagatttcagaaaggatctcggctggaagtggatccacgagcctaagggctaccacgcaaacttttgcctgggaccgtgcccgtacatttggtcgttggacactcagtactccaaagtgctggcgctttacaaccagcacaacccgggtgcatccgccgcgccatgttgcgtgcctcaagccttggagccacttccgattgtatactacgtgggtcgtaaacccaaggtcgaacagttgtcgaatatgatcgttcgaagctgcaagtgtagc

SEQ ID NO: 20122 - DNA, 1170 bp, Artificial Sequence
  Description of Artificial Sequence: Synthetic coding sequence
atgcccccctccggcctccgattgttacctctgttgctcccactgctttggctactagtgttgacgcctgggcgacccgctgcaggactgtccacttgcaagaccattgacatggagcttgtgaaaagaaaaagaatagaagctattagaggccagatcttgtccaaactcaggctggctagcccacctagtcagggcgaggttccacctgggcctctgcctgaggcagtgcttgccttgtacaacagcacccgtgaccgggtggcaggggaatctgccgagcccgagcccgagcctgaagctgactactatgctaaggaagtgacccgagtgctgatggtggagacacacaacgagatttacgacaaatttaagcagtcgactcactccatctatatgttcttcaatacctccgagcttagggaagccgtccccgaaccagtcttgctgtcacgcgctgagctgcggctgctaaggttaaagctgaaagtcgagcagcacgttgaactataccagaaatattccaacaactcgtggcggtacctttccaaccgcttactcgccccttctgattcacccgagtggctgagttttgacgtcactggagtagttcggcagtggttaagtcgggggggcgaaatcgagggcttcaggctgagtgcacactgtagttgtgacagcagagacaacactttacaggtcgatattaacggatttacaaccgggcgacgcggcgacctggccactatccacgggatgaataggccgttcctactgttgatggccaccccgctggaacgagcccagcacctccaatcctctagacatagacgcgccctggataccaattactgtttctcctcaacagagaagaattgctgcgtgcgtcagctctacatagattttcggaaggacctgggttggaagtggatccatgaaccgaagggataccatgctaacttctgtcttggcccatgcccttacatttggtcactggatacccagtacagcaaggtgctagcgttgtataatcagcataatcccggcgcgtctgccgcaccttgttgcgtacctcaagcactggaaccattgcctattgtctattacgtaggcagaaagccaaaggtagaacagctgtccaacatgatcgttcgttcttgtaagtgctcc

SEQ ID NO: 20123 - DNA, 1170 bp, Artificial Sequence
  Description of Artificial Sequence: Synthetic coding sequence
atgccccctagtggacttagactcctcccactcctcctgccacttctgtggcttctggttctgactcccggaaggcctgctgccggcctcagcacatgtaaaactatagacatggagctagtgaaaagaaaaaggatagaggcaatccggggacaaatcttgagtaaactgaggttagcttcgcctccgagccagggcgaagtccctccaggccctctgcccgaagcagtgttagccctgtataacagcaccagggatcgggtggcaggcgaaagtgccgagccagaaccagagcctgaagcagattactacgctaaggaagtgacacgggttcttatggtcgaaactcacaatgaaatctatgataagttcaaacaatcgacacactctatttatatgttttttaatacaagcgagctaagggaggccgtccccgagccggttctgctctccagagccgagctgcgcctcctcaggttgaagctgaaagtggagcagcacgtcgagctgtatcagaaatacagcaacaactcttggaggtaccttagcaacagattgttggctccaagcgactctcctgaatggcttagttttgatgttacaggggtggtgagacagtggctgagccgcggaggtgagatcgagggctttcgactgtccgcccattgcagttgtgattcccgcgacaatacacttcaggtggacataaacggctttacgactggaaggagaggagaccttgcgactatccatggaatgaatcgccccttcctgctgcttatggccacccctttggagagggcgcagcacttgcagtcgtcaaggcaccgacgagcgctggatacaaattattgcttttcttcaaccgagaagaactgctgcgtgaggcaactatacatcgattttaggaaggatttgggctggaagtggatacatgagcccaaaggctatcatgcaaacttctgcctggggccatgcccctatatctggtctcttgatactcagtatagcaaagtgctggctctgtataaccagcacaatcccggtgccagcgctgccccttgctgcgtgccacaggctctggagccattgcccatcgtgtactatgtcgggagaaagccaaaggtggaacaactgagcaacatgatagtgagatcgtgcaaatgtagt

SEQ ID NO: 20124 - DNA, 1170 bp, Artificial Sequence
  Description of Artificial Sequence: Synthetic coding sequence
atgcctccatcaggattacgacttttaccattattacttcctttattatggcttttagtattaacaccaggacgtccagcagctggattatcaacttgtaaaacaatagatatggaattagttaaaagaaaaagaattgaagctattagaggacaaattttatcaaaattaagacttgcttctccaccatcacaaggagaagttcctccaggaccacttccagaagctgtacttgctctttataattcaacacgtgatagagtcgcaggagaatcagcagaaccagaaccagaacctgaagctgattattatgcaaaagaagtaactagagttttgatggttgaaacacacaatgaaatctatgataaatttaaacaaagtacacattcaatttatatgttctttaatacatcagaattacgagaagcagttcctgagccagttttactttcaagagctgaattaagattattaagattaaaactaaaagtagaacaacatgttgaattatatcagaaatatagtaataattcatggagatatttatcaaatagattattggctccttctgactctccagaatggttgagttttgatgtaacaggtgttgtaagacaatggttaagtagaggtggtgaaattgaagggttcaggttatctgcacattgttcttgcgattctagagataatacattgcaagtcgatattaatggatttactacaggtcgacgtggtgatttagctacaatacatggaatgaatagaccttttcttcttcttatggctactccacttgaaagagctcaacacttacaatctagtagacatagacgtgcactagatactaattactgtttttcatctacagaaaaaaattgttgtgttcgacaactttacattgattttagaaaagatttgggttggaaatggattcatgaaccaaaaggatatcatgcaaatttttgtttgggaccatgtccttatatatggtcattagatacacaatattcaaaagttttagccttatataatcaacataatccaggagcttccgcagcaccttgttgtgttccacaagcattagaacctttgccaattgtatattatgttggaagaaagccaaaggttgagcaattatctaatatgattgtaagatcatgtaaatgttca

SEQ ID NO: 20125 - DNA, 1170 bp, Artificial Sequence
  Description of Artificial Sequence: Synthetic coding sequence
atgcccccatccgggctgcgactcctgcccttgctcctgcctttgttatggttgttagtgctgacgcccgggaggcccgcggcagggctctcgacctgtaagaccatagacatggagttagtcaagagaaagcgtattgaggctatccgggggcagattctgagcaagttgcgcctggcgtcccctcctagtcagggtgaggtgcctccaggccctttgcctgaggcagtgctggccctatacaacagcaccagagaccgcgttgccggggaatctgccgagccggagccggaacccgaagctgactactatgccaaggaggttacgagggtccttatggtggagacacataatgaaatttacgataaattcaagcagtctactcacagcatctatatgttttttaatacatcagaactgcgggaagcagtgcctgagcctgtgcttttgagtcgcgctgagctaaggctgttgcgcctgaaactcaaagtcgagcagcacgtcgagctgtaccagaagtacagcaataatagctggaggtacctgtctaacaggctgctcgccccctcggactccccggaatggctctcctttgatgtcacaggggtcgtacgacaatggctatctcgcggtggggaaatcgagggatttaggctctctgctcactgtagttgcgactctcgcgataatacgctacaagtcgacatcaacggtttcacgacaggccgcagaggggatctggctaccattcatggcatgaaccgaccttttcttctcctgatggccacccctctggagagggctcagcaccttcagtcgtccaggcacaggcgcgcccttgacaccaattactgcttttcctccactgagaaaaattgctgcgtgcggcaactgtacatcgattttcggaaagacctgggatggaagtggattcacgaacccaaaggctatcatgccaacttctgtctcggaccatgcccctacatttggagtctagacacgcagtactctaaagtacttgctctatacaaccagcacaaccccggtgcaagcgctgcgccctgctgtgtcccacaggctctggaaccattgcctatcgtgtactacgtgggtcggaaacctaaagtggaacaactgtccaatatgattgtcagaagctgtaaatgctca

SEQ ID NO: 20126 - DNA, 1170 bp, Artificial Sequence
  Description of Artificial Sequence: Synthetic coding sequence
atgccaccatctggattgcgtcttctccctctgctgcttccattgctctggcttctggtgttgacacccggaaggcccgccgctggtctctccacttgcaaaaccatcgatatggagctggttaagagaaagaggatagaggccatcagaggtcagatcttgagcaaattgcgtctcgcatcacctccttcccaaggtgaagtccctccaggccctctccctgaggcagtcctggctctttacaatagcacccgcgatagggtggccggagaaagtgcagagcccgaacccgaaccagaggctgattattatgctaaggaagtgacacgcgtccttatggtggaaacacataatgaaatatacgacaagtttaaacagagtacccacagcatctacatgttcttcaacacatccgaactgagagaggcagtacctgaaccagtgctcttgagtagggctgaactgaggctgctcagactgaagctgaaggtggagcagcacgtagaactctatcagaagtactcaaataattcttggagatacctcagtaatagactccttgcaccatccgattcaccagagtggttgtctttcgatgtcaccggtgtcgtcaggcagtggctctctcgtggtggagagatcgagggatttagactctccgcacactgctcatgcgattccagagacaatacccttcaggttgacattaacggcttcacaactggccgtcgcggcgacttggccactattcacggcatgaaccgtccttttctgttgctgatggcaaccccactggagcgtgcacagcacttgcagtcctctagacacagaagggcccttgatactaactactgtttcagttccaccgagaagaactgctgcgtgaggcagctctacattgacttccgcaaggacctgggttggaaatggattcatgaacccaaaggatatcatgctaatttctgtctgggtccatgcccctacatctggtccttggacacacaatatagcaaggtgctggcactttataaccagcacaatccaggcgcctcagccgccccatgctgtgtgcctcaggccctggagccactgcctattgtgtactatgtaggacgtaaacctaaggtcgagcagttgtctaacatgattgtgagatcatgcaagtgtagc

SEQ ID NO: 20127 - DNA, 1170 bp, Artificial Sequence
  Description of Artificial Sequence: Synthetic coding sequence
atgccaccatcaggcctccggctgcttccgctgctgctgccactcctgtggctgcttgtcctgacgccaggccggccagctgcggggttgtctacatgtaagaccattgacatggaactcgtgaaaagaaagcggattgaagccattaggggtcagatccttagcaagctgagactcgcttcccccccctcacaaggagaggttccccctgggcccctgcctgaagccgtgctggccttgtacaattccactagagacagggtggccggcgaaagtgccgagccggaaccagaacctgaagccgattactacgccaaggaggtgactagagtattgatggtggagacccacaatgaaatatatgacaagttcaagcagtctacacactcaatctacatgttcttcaacactagcgaactgagggaggccgtcccggaacccgtgttgctgtctcgagccgaactgcgcctcctgcggcttaaattgaaggtggagcaacatgtagagttgtaccagaagtattcaaataatagttggagatatctgtccaaccgtctgctagctcctagcgactctccggagtggctgtcattcgatgttaccggggtggtcaggcagtggctgtcccgaggaggcgaaatcgaagggtttaggctcagcgcacactgctcgtgtgactcaagggacaacactctgcaggtggacatcaatgggtttacaaccgggcgacggggggacctcgccacaatacacggcatgaataggcctttcctgttgctcatggcgacccccctggagcgcgcccaacatctgcaaagttcacggcatcgcagagcattagacaccaactactgtttttcttctacagagaaaaactgctgtgtacgccaactgtatatcgacttccgcaaggacctggggtggaagtggatccacgagcccaagggatatcacgccaatttctgtcttggcccttgtccatacatttggagcctggacactcagtattcgaaggtgctcgccctatacaaccagcacaaccccggggcctcggctgccccctgttgcgtcccacaggcgctcgagccactccctatcgtatactatgtaggacggaaacctaaggtggaacagttaagcaacatgattgttcgttcatgtaagtgtagc

SEQ ID NO: 20128 - DNA, 1170 bp, Artificial Sequence
  Description of Artificial Sequence: Synthetic coding sequence
atgcctcctagcggacttcggcttcttccgcttctgcttcccctcctttggctgcttgtgttgaccccaggacgcccagctgccgggctgtccacttgcaagaccattgatatggagttggtcaaaagaaagaggatagaagcaattagaggacagattcttagcaagttgaggttggcgtcccctccgtcccagggcgaggtgccacccggacctcttcccgaggcagtcctggcgttgtacaactcgacgagagatagagtggccggggaatccgccgaacccgaacctgaaccggaagcagattactacgccaaggaggtgaccagggtgctgatggtcgaaactcataacgagatttacgataagtttaaacagtcgactcattcaatttacatgttctttaacacctcggaactccgagaagctgttcctgaacctgtccttctttccagggcggaactccgcctgctgcgccttaagctgaaggtggaacaacatgtcgagctctaccagaaatactccaataactcgtggagatacctgagcaacaggctgctggcaccatcggactcgcctgagtggcttagcttcgatgtgactggagtggtgagacaatggctttcgagagggggagagattgaaggatttcgcctgagcgcacattgcagctgcgattcgagagacaatacgcttcaagtggacattaatggattcaccacgggtaggcgaggcgacttggcgactattcatggaatgaaccgcccctttctcctgctgatggcaactccactcgagcgagcacagcatcttcaatcgtcccggcacagaagggcactcgataccaactactgtttttcatccactgagaaaaactgttgtgtgcgccagctgtacattgatttcaggaaggacctcggttggaaatggattcacgagccaaagggttaccacgcaaacttttgtctcggaccctgcccttacatttggtcgctggatacccagtacagcaaggtgcttgcactttacaaccaacacaatccaggagcaagcgccgccccgtgttgtgtcccgcaagcgctggaaccactgccaatcgtgtactacgtgggacggaaacctaaagtggagcagctcagcaatatgatcgtgcggtcatgtaaatgctcc

SEQ ID NO: 20129 - DNA, 1170 bp, Artificial Sequence
  Description of Artificial Sequence: Synthetic coding sequence
atgccaccttcaggcctgcggctgcttcctttgctgcttcctcttctctggctccttgtgcttactccaggacggccagcagcaggcctgtccacctgcaaaaccattgatatggagcttgtgaagagaaaacgaattgaagcaataagaggacagatccttagcaagctgcggcttgcatcgccaccttcccagggtgaggtgcctccaggtccacttccagaagccgtcttggccttgtataacagcacccgtgatagagtggcaggggaatcggctgagccggaacccgaacctgaagcagactactacgcaaaggaggtgaccagagtgctcatggtcgaaacccacaacgaaatctacgataagttcaagcaatcaactcattcaatttacatgtttttcaacacttcggaacttagggaagcggtgcctgaaccagtcctgctctctcgggcggaactccgtctcctccgacttaagttgaaagttgagcagcacgtcgagctgtaccagaagtactccaacaactcgtggaggtacctctcgaaccgactgcttgctcctagcgactctccagagtggctttcgtttgatgtgactggagtcgtgcgacaatggctctcccggggaggggaaatagaaggctttagactgagcgctcactgttcgtgcgactcgcgcgataacactctgcaagtcgacataaacggttttaccaccggacgtcgcggtgatcttgcaaccattcatggaatgaaccgcccttttcttcttctcatggcgacccccctggagagagcacaacaccttcaatcgtccaggcataggagagcgctcgatacgaactactgcttcagtagcaccgagaagaactgttgcgttcggcagctttacatcgattttcgcaaggatctgggatggaagtggatccatgaaccgaaaggataccacgccaatttctgtctgggaccctgtccatacatttggagcctggatactcagtactccaaggtgcttgcactgtacaatcaacataatcctggagcctccgcagcaccatgttgcgtgccccaagcactcgagcccctccctattgtgtactacgtcggaagaaaacccaaggtggaacagctttccaacatgatagtgagatcctgcaagtgttcg

SEQ ID NO: 20130 - DNA, 1170 bp, Artificial Sequence
  Description of Artificial Sequence: Synthetic coding sequence
atgcccccctctggtcttaggctactgcctctgctacttcctctcctgtggttgctcgttctgactcccgggagacccgcagcggggctttccacatgcaagaccattgacatggagcttgtcaagcggaagcgcatcgaggcaatcaggggtcagatattgtcaaaactcagactggctagccctcctagccagggtgaggtccctcccggccccctgccagaagcggtgctggctctttataattctacccgagatagggttgccggggaatcagccgagcctgaaccagagcctgaagcagattactatgccaaagaggttacacgtgtactcatggtggaaactcacaacgaaatatatgacaagttcaaacagtctacacactccatttatatgtttttcaatacttctgaacttcgtgaggcagtgcctgaacccgtgctgctctccagagcggagctgcgtctgctgagactgaaattgaaggtggaacaacatgtcgagctgtatcagaagtacagcaacaacagttggagatacttgtccaatagactgctcgctccatccgacagccctgaatggctgtcttttgatgtcacaggagtggtgagacagtggctcagcagaggaggcgaaatcgaagggttccgtctttccgcccactgttcatgcgactctcgcgacaatacccttcaggtggacataaacgggttcactaccggaaggcggggcgatctcgcaaccattcacggcatgaacaggccgtttctcctcctgatggccacgcccctcgaaagagcacaacacctccaaagtagtagacacaggcgggcactcgatacgaactattgctttagctcaaccgagaagaactgttgtgtccggcagctttacatcgactttcggaaagacttagggtggaagtggattcacgaacccaagggctatcacgctaacttttgtcttggaccgtgtccctatatctggtctcttgacacgcagtacagcaaggttctcgcactgtacaaccagcacaaccccggcgcctctgctgctccatgctgcgttcctcaggcactcgagcctctgcctattgtctattacgttggtcgtaaacccaaggtcgagcagctctcaaatatgattgtgagatcctgtaagtgttcg

SEQ ID NO: 20131 - DNA, 1170 bp, Artificial Sequence
  Description of Artificial Sequence: Synthetic coding sequence
atgcccccatctggattaaggctgcttccactgttactcccacttttatggcttctcgtgctgacgccgggacgcccagctgctgggctctccacctgcaagactatcgacatggagctggtcaagaggaagcgcatcgaggccatccgagggcagatcctgagcaaactgagattagcttctccgccttcacaaggtgaggtgccccctgggccactcccagaagccgtgctcgcattatacaacagtacaagggatcgagtcgccggcgaatccgccgaacctgaacccgagccggaggccgattactatgcgaaagaggttactcgcgtactgatggtagagacacataatgagatatatgataagttcaagcaatccacccacagcatatacatgtttttcaatacaagcgaacttagggaagccgtgcccgagcccgttttgttgtctcgcgctgagcttcgactgctgcgcctgaagctaaaggttgagcagcatgtggaactgtaccagaagtactcaaacaatagctggcgctacctatcaaacaggctcctcgccccaagcgactctcctgaatggttaagctttgatgtgaccggtgtggtccgtcagtggctctctcgcggcggggaaatcgaagggtttagattaagtgcgcattgtagttgcgattccagggacaacacattgcaagtggacattaacgggtttactactgggagaaggggggacctggctactatccatggaatgaacaggccgtttctccttctgatggctacacccctggagcgtgcacagcatctacagagctcgcgccacagacgtgcccttgacacaaactattgtttcagtagcactgaaaaaaactgttgcgtgcgccagctatacattgattttaggaaggaccttggttggaaatggatccatgagccaaaaggctatcacgccaatttctgcctgggaccctgcccctacatctggagcctggatacccagtatagtaaggtgctggccttgtacaaccagcacaacccaggagcctctgcagcaccgtgctgcgtcccccaggcactagaacctctgcctattgtctattacgttggccgtaagccaaaagtggagcaactgtccaatatgatcgttaggtcatgtaagtgcagt

SEQ ID NO: 20132 - DNA, 1170 bp, Artificial Sequence
  Description of Artificial Sequence: Synthetic coding sequence
atgcccccctctgggcttaggctgctgccactgcttttgccacttctatggttgctggttctgactcccggccgacccgctgctggtctttcaacttgcaagactatcgatatggagcttgtaaagcgaaagcgaattgaagcgatccggggccaaatcctgagcaaactgcgcttagcgagccctccatcccagggcgaggtgccccccggacctctgcccgaagccgtgctggctctctataatagtacccgggaccgggtggctggtgaatccgctgagccggaaccagagccagaagccgactactatgctaaagaagtgacccgggtcctcatggtagagactcataacgaaatttacgacaagttcaagcagagtacccactccatttatatgttcttcaatacaagcgaactcagggaagctgtacccgagccagttctcctcagccgggctgagttgcgactgctccgccttaagttaaaggttgagcagcacgtggagctgtatcagaaatatagcaacaatagctggaggtatcttagcaacagattgctcgctccaagtgattcccctgagtggctgagcttcgacgtcacaggagtcgtgcgccagtggctgtcccgtgggggagaaatcgagggcttccgtctctcagcccattgtagttgcgatagccgagacaacaccttacaagtggatatcaatggctttaccactggtcgcaggggggatctggcgaccattcacggcatgaaccggccgttcctcctcttgatggctactcccctggaacgggcccagcatctccagagttccagacataggcgagcgcttgataccaactattgtttttcttccactgaaaaaaactgctgcgtgcgccaactctacattgattttaggaaggatctcggttggaagtggatccatgagccgaagggctatcacgccaacttttgtttggggccatgtccgtatatttggagtcttgacacccaatactcaaaggttctggcactttataatcagcataatcctggtgctagtgctgctccctgctgcgtgccccaggcccttgagcccctgcccattgtttattacgtcggcagaaagcccaaggtcgagcagctgagcaatatgatcgttcggagctgcaaatgcagc

SEQ ID NO: 20133 - DNA, 1236 bp, Artificial Sequence
  Description of Artificial Sequence: Synthetic coding sequence
atgaagatgcatttgcagagagctctggtagtattggctcttctgaatttcgccaccgtgtccctgagcctctcaacttgtactacactggatttcggacacatcaagaagaaaagggtggaggccatcagaggacaaatattgtcaaaactccgtttgacttcacctcccgaacccactgtcatgacacatgtgccctatcaggtcctcgctctgtacaattccactagagagttgctcgaggaaatgcatggcgagcgcgaggagggctgtacacaagaaaacaccgaatccgaatattacgccaaggagattcataagtttgatatgattcaaggactggctgagcacaatgaactcgctgtgtgtccaaagggaatcacatctaaagtgtttaggttcaatgtctctagcgttgaaaagaaccgtactaacttgttcagagctgagttccgcgtgctccgcgtgcctaaccctagttcaaagagaaacgagcaacgcatcgagctctttcaaatcctgcgccctgacgagcacatcgccaagcagcgttacatcggcggtaaaaatctccccacacgtggaacagctgaatggttgagtttcgacgtcactgacaccgtccgtgaatggctgctgcgccgtgaatctaatcttggcctcgagatctcaattcactgcccctgtcataccttccaacccaatggagatattttggagaatatccatgaagtgatggagatcaagtttaagggcgtggacaacgaggacgatcacggcaggggagatctcggtagattgaagaagcagaaagatcaccacaacccacatctcatcctcatgatgatccctccacatcgcctggataaccctggccagggcggccagagaaagaagcgtgccctggacaccaactactgtttcaggaatctcgaggagaattgctgcgtaagacctctctatattgattttaggcaggatctgggctggaagtgggtgcacgaacctaaaggttactacgccaatttctgctctggcccatgcccctacctgcgctcagctgatactactcactccacagtccttggcctgtacaatactctcaatcctgaggcctcagcctcaccctgctgcgtgccacaggacttggagccactgaccatcctctattacgttggacgcacccccaaggtcgaacagctctccaatatggttgtaaagtcttgtaagtgctct

SEQ ID NO: 20134 - DNA, 1236 bp, Artificial Sequence
  Description of Artificial Sequence: Synthetic coding sequence
atgaaaatgcacttacaaagggctctcgtcgtacttgccttgctcaatttcgccacagtcagcctgtccctgtcaacgtgcaccacgctggacttcggtcatattaagaaaaagcgggtggaggcgattagaggtcagatcctgtccaagctgaggttgacttctcctccggaaccaacagtaatgacacatgtaccctatcaggtcctcgccttatacaactctacccgcgagctcctagaggagatgcatggtgaaagggaggagggttgtacgcaggagaacacagagtccgagtattacgctaaggaaattcacaagtttgacatgatacagggcctggcagagcacaatgagctggctgtgtgccctaagggtatcacatctaaggtgtttcgctttaatgtgagttctgtagagaagaaccgcacaaacttattccgcgccgaatttagggtacttcgagtccctaatccatccagcaaacgcaacgagcagcgcatcgagctgttccagatccttcggcccgatgagcacattgccaagcaaagatatatcgggggcaagaatctgcctacccgcggaacagctgagtggctgagcttcgatgtcacagacacggtgcgggagtggctccttcggcgggaatccaatttgggactagaaatctcaatccactgcccctgtcacacgtttcagcccaacggagatatactggaaaacattcatgaagtgatggaaattaagtttaagggagtggataatgaagatgatcacggacggggggacctagggagactgaagaaacagaaggaccaccacaacccccacctgatcttgatgatgatcccgccccacaggctcgacaatccaggccaaggtggtcagaggaaaaaacgcgccctcgacacaaactattgctttagaaacctggaggagaactgttgcgtgcgcccgctctacatagatttcagacaggacctgggatggaagtgggtgcatgagcccaaaggctattatgctaacttttgctccggaccttgtccatatcttcggtctgccgatactacccatagcaccgtgctcggcctgtataacaccctgaacccagaggctagcgcctccccatgctgcgtgccccaggaccttgaacccttgacgattctctactatgtcgggcgaaccccgaaggtggaacaactgtctaatatggtggtcaagtcttgtaagtgttcg

SEQ ID NO: 20135 - DNA, 1236 bp, Artificial Sequence
  Description of Artificial Sequence: Synthetic coding sequence
atgaaaatgcaccttcagcgggcccttgtggtcctggcgttacttaacttcgcgactgtgtccctgagcctatctacatgtactacactcgattttggtcacattaaaaagaaacgagtcgaagcaataaggggccaaatcttgtccaaacttcgcttgacgtcacccccggagccaactgtgatgacccacgtgccatatcaggttctagccttgtacaactccacgagagagctcctggaggagatgcatggggaacgggaggagggatgcactcaggagaataccgagagtgagtattatgcgaaggaaattcacaagttcgacatgattcaggggctggcagagcacaacgagctggctgtttgccctaaggggatcactagcaaagttttcagattcaacgttagttcagtggagaaaaatcgtaccaacctcttccgggctgagtttcgtgtgctgagagttcctaatccaagtagcaagagaaatgagcagagaatcgagctgtttcagattctgagacctgatgagcatatcgcgaagcagcgctacattggaggcaaaaacctgccaacccggggcactgcagaatggctttccttcgatgtaacggataccgttcgtgaatggctactaaggcgggaatctaacctgggcctggaaatcagcatccattgcccgtgccatacctttcagccaaatggggacatcttagagaacatccacgaggtcatggaaatcaaattcaagggcgtggataacgaagacgatcacggcagaggcgatttgggcagattaaagaaacagaaggaccaccataacccgcacctgatactgatgatgatccccccccaccgcctggacaaccctggacagggtgggcagcggaaaaagagggccttggacactaactattgcttccgcaacttggaagagaattgctgtgttagaccactgtatatcgacttccgccaagatcttggctggaaatgggtacacgagcccaagggttattatgcaaacttttgctccggaccatgtccttacctccgttccgctgatactacccacagcactgtcctcggcctgtacaacaccctcaacccagaagccagtgcctcaccctgctgcgtcccccaagacctggaaccactcacaattctttactacgtgggacggacaccaaaagtcgagcagctgagcaacatggtggtaaagtcttgcaagtgtagt

SEQ ID NO: 20136 - DNA, 1236 bp, Artificial Sequence
  Description of Artificial Sequence: Synthetic coding sequence
atgaagatgcatctgcagcgggcgctggttgttctcgccctccttaacttcgccaccgtgagcctatctctgagcacctgtaccaccctcgactttggtcacattaagaagaagcgcgttgaggccattcgcggccaaatcctatccaagctgcgcctaacctcacctcccgagcccactgtcatgacacacgtcccatatcaagttctcgccctttataactcgacccgtgaactgctggaggagatgcatggcgagcgtgaggaaggctgtactcaggaaaacactgagagcgagtactacgcaaaagaaatccataagttcgatatgatccagggccttgcggagcacaacgagctggccgtctgtccaaagggaatcactagtaaagtgttccgttttaatgtttccagtgtggagaagaaccgcacgaacctcttccgtgcggagttccgtgtgcttcgcgtacctaacccatccagcaagcggaacgagcaacgcattgagcttttccaaatccttcgtcctgacgagcatatcgcgaagcagcgttacatcggcggtaagaacctgcctactcgcggtacagctgagtggctgtctttcgacgttacggatacggttcgagagtggctgttgcgtcgcgagtcgaatctggggctcgagattagtatccactgcccttgccacacttttcagcccaacggcgacatcttggagaatatccatgaggtaatggaaattaagtttaagggggtcgataacgaagacgaccatgggcgcggggatctgggtcgactcaagaagcagaaggaccaccacaacccgcacctcatcctcatgatgattccgccccaccgtcttgacaaccctggtcaaggaggtcaacgcaaaaagcgcgcgctggatactaactactgcttccggaacctggaggagaattgctgcgtgcggcccctctacatcgattttagacaggatctcggctggaagtgggtccatgagcctaagggttactacgccaacttctgcagcggcccctgcccctatttgcgttctgccgacacgacccacagcaccgtccttggcctttacaacactctcaacccggaagcttcggctagcccctgttgcgtgccacaggatctcgagccgctgaccatcctttattatgtgggccggactcctaaggtggagcagttgagcaacatggtggtgaagtcctgcaagtgcagt

SEQ ID NO: 20137 - DNA, 1236 bp, Artificial Sequence
  Description of Artificial Sequence: Synthetic coding sequence
atgaaaatgcatcttcaacgtgccttggtggtgttggccctgctaaactttgctacagtaagcctgagcctgagcacctgcactacccttgacttcggacatattaagaaaaagagggtcgaagctattaggggccagattcttagcaaattaaggctgaccagcccacctgaaccgacagttatgacacatgttccctaccaggtgttggcactgtacaatagcacaagagaactgcttgaggagatgcatggggaaagggaggagggctgtacccaggaaaacacggagtctgagtattatgccaaagaaattcacaaatttgatatgattcagggcctcgcagaacataacgagctcgctgtctgcccaaaaggcattacatcaaaggtctttcgctttaacgtgtcatccgttgagaagaacaggaccaacctgttccgagcggagtttagggtactccgcgtgccaaatccatcctctaagaggaacgagcagaggattgaactgttccagatactgaggcccgacgagcacatagccaaacagagatatattggtggcaagaatttgcccacaaggggaaccgccgaatggctgtcatttgacgtcactgacacagtgcgagagtggctgctcaggagggaaagcaatctcggccttgaaattagtatccactgcccatgtcacactttccagcccaatggcgacattctggagaatatacacgaggtgatggagattaaattcaaaggggtggacaacgaagatgaccacgggcgtggtgatctagggcggctgaaaaagcagaaggatcaccataatccccacctaattctgatgatgattcctccacacaggttagacaatccaggccagggtgggcaaaggaaaaagcgggccctcgacaccaactactgctttagaaacctggaggagaattgctgcgtgcgacctttatatattgattttagacaagacctgggctggaagtgggtacatgagcctaagggctactatgccaacttttgtagcgggccttgcccttacctcagatctgctgataccactcacagtacagtcttaggattatacaatactctcaaccccgaggcttctgcatctccctgttgcgtaccgcaggaccttgagccattgaccatcctatattatgtgggcaggacccccaaggtagaacagctgagcaatatggtggtcaaatcctgcaagtgcagt

SEQ ID NO: 20138 - DNA, 1236 bp, Artificial Sequence
  Description of Artificial Sequence: Synthetic coding sequence
atgaaaatgcacttgcaacgagcactcgtggtgcttgcattgcttaacttcgccaccgtgtcactttccctgagcacttgcactaccctcgattttggacacataaagaaaaagcgtgtcgaggcgattagaggacagatcctttcgaagctgagacttaccagcccacccgaaccaaccgtgatgactcacgtcccttatcaagtccttgccctctacaatagtacccgagagctgcttgaggaaatgcacggagaacgtgaagaaggatgtactcaggagaacactgaatcagaatactacgcaaaggaaattcacaaattcgatatgattcaaggacttgcagaacacaatgagcttgccgtctgtccgaagggaattacttcaaaggtgtttcgattcaacgtctcatccgtggagaaaaacagaactaacctgttccgggcagagttcagagtgcttagggttccgaatccctcttccaaacggaacgaacaaaggattgaactttttcagattctcagaccagatgaacatatagcgaagcagagatacattggagggaagaatctgccaaccagaggcactgcagaatggctctcctttgatgtgaccgacaccgtccgtgaatggctgctcagaagggagtccaatcttgggcttgagatttcgatacactgtccatgtcatacctttcaacccaacggtgacattcttgaaaacattcatgaagtcatggaaatcaagtttaaaggagtggacaatgaggacgatcatggaagaggtgacctgggtagactgaaaaaacagaaggatcatcataatcctcacctcattctcatgatgattccaccccaccgacttgataaccccggccagggaggacaacggaaaaaacgggcactggataccaattactgttttcggaacctggaggaaaattgttgcgtgcggcctctttacattgacttcagacaagatctcggatggaagtgggtgcatgaaccaaaaggttactacgccaatttctgtagcggtccatgtccgtacctgagaagcgcagatactacccatagcaccgtcctgggactgtacaacacccttaaccctgaagcatcggcatccccttgctgtgttcctcaagatctcgaacccctgaccatattgtattacgttgggcgcacgcctaaggtggaacagctgtcaaacatggtggtgaaatcatgcaagtgtagc

SEQ ID NO: 20139 - DNA, 1236 bp, Artificial Sequence
  Description of Artificial Sequence: Synthetic coding sequence
atgaaaatgcatctccagagagcactcgtcgtgctggcactgctgaacttcgccacagttagcctgagcctgagcacttgcacaactctggacttcgggcacataaaaaaaaagcgggttgaggccattcgtggccagatactgtcaaagctgcgccttacaagtccacccgagcccacagtgatgactcacgtaccataccaagtgctcgctctgtacaatagtactagagagctactagaagaaatgcacggtgaacgggaggaaggatgtacacaggaaaatacagagtctgagtactacgctaaggaaatccacaaattcgatatgattcaggggttagccgagcacaatgagctagctgtctgtcccaagggcatcaccagtaaagtcttccggttcaatgtttccagtgtcgagaagaaccggaccaacttatttagggctgaattccgagtgctgcgcgtgcccaatcctagttctaagcgaaacgagcagcgtattgagctatttcagattctcagacctgacgagcatatcgccaagcaaagatatattggcgggaaaaacctgcccacaagagggaccgcagaatggctgagcttcgacgtgaccgacactgtacgggagtggctgctgcgacgcgaaagcaatctgggcttagaaatctccatacattgtccatgtcacacattccaacccaacggcgacatcctggaaaatatccatgaggttatggagatcaagtttaagggagtggacaacgaggacgaccacggccggggcgatctgggacgcctaaaaaagcagaaagaccatcacaatcctcacctgatactgatgatgatccctcctcacaggctggacaatcccgggcagggaggacaaaggaagaagcgtgcattagataccaactattgcttccgcaatctggaagaaaactgctgcgtcaggcctctgtacatagactttcggcaagacctcggctggaagtgggtgcacgagccaaaggggtactacgcaaacttctgttcaggcccctgtccttacttacgcagcgccgacaccacccacagtaccgtcctcggcctatacaacaccctgaacccagaggccagtgcaagcccatgttgtgtccctcaagatctggagccactcaccatactctattatgttgggagaactccaaaggtggagcaattatctaatatggtggtgaagagctgcaagtgcagt

SEQ ID NO: 20140 - DNA, 1236 bp, Artificial Sequence
  Description of Artificial Sequence: Synthetic coding sequence
atgaagatgcacctccaacgggcccttgttgtgctcgccctcctgaatttcgcgaccgtctcgctgtcgttatccacctgcactaccctcgactttggtcacataaagaaaaaacgcgtggaggcaatccgaggacagatcctgtccaagcttcggctcacatcccctccagaacccactgtgatgacacacgtaccctatcaggtgctggctctctacaattctactagggaactgttggaggaaatgcacggcgaacgcgaggaggggtgcacgcaagagaacaccgaatctgagtactacgccaaggaaatacataagtttgacatgatccagggcctggctgagcacaatgagcttgcagtgtgcccgaaaggcattacgagcaaggtcttccgctttaatgtaagttcagtggagaagaatcgtaccaacctgttcagagccgaatttagggttctgcgcgtgcctaacccttcttcaaagcgcaacgaacaaagaatcgaattgttccagatcttgaggccagatgaacatattgccaagcagagatatatcgggggaaagaatttgcccacaagaggcactgctgaatggctaagtttcgatgtgaccgataccgttcgcgagtggctgctaaggagggagtcgaatcttggattagaaataagcattcattgtccgtgccatacatttcaaccaaatggtgatatcttagaaaatatccacgaggtcatggaaatcaaatttaagggggttgataacgaggacgatcatggcaggggggacttgggacgattaaaaaagcagaaggaccatcataacccacaccttattctgatgatgataccaccccaccgactggacaaccccggccaaggaggtcagcgaaaaaagagagctcttgataccaattactgctttcggaatctggaggagaactgttgtgtccggcccttgtacattgatttcaggcaggatctgggctggaagtgggttcatgagcctaaaggctactacgcaaacttttgtagcggcccatgtccatatttacgatctgcggacacaacacactccacagttctggggctttacaacaccctcaatccggaggcaagcgcaagcccttgctgcgtcccacaggatttagaaccactgactattctgtactacgttgggagaacaccgaaggtcgagcagctgtccaatatggttgttaagtcttgcaagtgttcc

SEQ ID NO: 20141 - DNA, 1236 bp, Artificial Sequence
  Description of Artificial Sequence: Synthetic coding sequence
atgaaaatgcacctgcagcgcgccctcgtcgtgctcgccttgctgaactttgccactgtcagtctgtctcttagcacgtgtactaccctggacttcggccatataaagaagaagagggtcgaggctattagaggccaaatactgagtaagctgcgacttactagtcctcctgaacctaccgtcatgactcatgtaccataccaggttcttgctctatataatagcacaagagagctccttgaggagatgcatggcgaacgtgaagaggggtgtacccaagaaaatactgagtccgagtactacgccaaagagatacacaagtttgatatgatccaggggctcgcagagcacaacgagttggccgtttgtccaaaggggatcacctcaaaggtgttccgatttaacgtgtcttcagtggaaaaaaaccggacgaacctgttcagagccgaatttagggttctacgagtgcccaatccaagcagtaagcgaaacgagcagagaattgaactgttccagatcctacgacctgacgagcacattgccaaacaacggtacataggcggcaaaaacctgccaactaggggcaccgccgaatggttatctttcgacgtgaccgatacagtcagggagtggttgctgaggcgggaatccaacttgggactggaaatctccattcactgtccctgccacacttttcagccgaatggtgatatcctggaaaacattcatgaggtgatggaaattaagttcaagggagtcgacaacgaggatgatcacggaaggggagaccttggaagactgaagaagcagaaggaccaccataatccccacctaattctcatgatgatacctcctcatcggctcgacaatccaggccaaggaggacaacgcaagaagcgtgctctggatacgaactactgctttcgaaacctcgaagagaattgttgtgtgaggcctctgtacatagactttcgacaagacctagggtggaaatgggtgcacgaacctaagggatattatgccaacttctgtagcggcccatgtccgtatctcaggagcgctgacaccactcacagcacagtactgggactgtataatacgctcaacccagaagctagtgcaagcccatgctgcgtgccacaggacctggaaccactaacgatactctattacgtggggcggacaccgaaagtcgagcagctgagcaacatggttgtgaaaagctgcaagtgctcc

SEQ ID NO: 20142 - DNA, 1236 bp, Artificial Sequence
  Description of Artificial Sequence: Synthetic coding sequence
atgaagatgcacctgcagagagccctcgtggtactggccctgttgaattttgctacagtgtccctgtcactgagcacctgcaccacactcgactttggtcatatcaaaaagaaaagggtggaagccattaggggccaaatcctgtccaaattgcgccttacttcaccccctgaacctaccgtgatgactcacgttccatatcaagtcttggctctgtataacagcacgcgcgagcttctggaagagatgcatggtgaaagggaagaaggatgtacacaagaaaatacagaatcagagtattatgcgaaagagatccacaaattcgatatgattcaaggcctggcagagcacaacgagctggccgtatgtcctaaaggcattacttccaaggtgttcaggtttaacgtatcaagcgtggaaaagaaccgcaccaacctcttcagggcagagttcagagtacttagggtgccaaacccttccagtaagaggaacgagcagaggattgaactctttcagatcctgagacctgacgaacatatcgctaagcagcgctacatcggtggcaaaaacctccctacacgcggtacagcagagtggctctccttcgacgtcacagataccgtgcgcgagtggctgctgaggagagagagcaacctgggcctggaaatatctatacattgtccttgtcacactttccaacctaacggcgatattttggagaacatccacgaagtaatggagatcaaattcaagggcgtggacaacgaggatgaccacggcagaggcgatctgggacgccttaaaaagcagaaggaccaccataacccccatcttatattgatgatgatacccccccacagactggataatccgggtcagggcggccagagaaaaaaaagggccctggatacaaactactgtttcagaaaccttgaggagaactgctgcgttagacctctttatatcgatttccgccaagacctgggctggaagtgggttcacgaacctaaaggttactacgccaatttttgctctggaccatgtccatacctgaggtcagctgacacaacacattcaaccgttttgggtctgtacaacactttgaacccagaggctagcgcttcaccgtgttgtgtccctcaagacctcgagccattgaccatactttactatgttggaaggacacctaaagtcgagcaactctccaacatggtagtgaaatcatgcaagtgttct

SEQ ID NO: 20143 - DNA, 1236 bp, Artificial Sequence
  Description of Artificial Sequence: Synthetic coding sequence
atgaagatgcatttgcagagggcactggtggtgctggctttgctcaacttcgctaccgtgtccctttccctgtcaacttgcaccacgctggatttcggtcatatcaagaagaagcgtgtggaggcgattcgagggcagatcctgtccaagctccgcctcacttccccacctgagcctaccgtgatgactcacgtgccgtaccaggtgttggcattgtacaactcgaccagagaacttctggaagaaatgcacggtgaaagggaggagggctgtactcaggaaaataccgaatcagaatactacgcaaaagagattcataagtttgacatgattcaaggactggcggagcataatgaactggcagtgtgccctaaaggtattacctccaaggtgtttaggtttaatgtgtcgtcagtggagaaaaatcggactaacctgtttcgagctgaattccgtgtgctgagggtccccaatccatcttcaaagagaaatgagcaacggattgagctgtttcagattcttagaccagatgagcacattgcgaaacagcgttacattggaggcaagaatcttcctaccaggggaactgcggaatggctcagcttcgatgtgacggatactgtgagagagtggctgctgagaagagaaagcaacctgggactggaaatctcaatacattgtccctgtcatacttttcaaccaaacggagacatcctcgaaaacatccatgaagtgatggagattaagtttaagggagtcgacaacgaagatgaccatggtaggggtgaccttggcagacttaagaagcagaaggaccatcacaacccacatctgattttgatgatgatcccccctcatagacttgataacccaggacaaggcggtcagagaaaaaagcgggcacttgatactaactattgtttccgcaacttggaagaaaactgttgcgtacggcctctctacattgactttcgacaagatttggggtggaagtgggtccacgagcccaagggttactatgcaaatttctgttcgggtccttgcccatacctccgttctgccgacactacccattcaaccgtgctgggactttacaacacgttgaacccagaagcatcggcatcgccctgctgtgtgccgcaggaccttgagccactcaccatactgtactacgtcggtcgaactcccaaggtggagcagctcagcaacatggtcgtgaagtcctgtaaatgttcg

SEQ ID NO: 20144 - DNA, 1236 bp, Artificial Sequence
  Description of Artificial Sequence: Synthetic coding sequence
atgaagatgcacctgcagagggccctggtggtgctggccctgttgaatttcgccactgtctcactgtcgttgtccacctgcaccacgttggacttcggtcacatcaaaaagaagcgagtggaggctatcagagggcagatcctgtccaagctcagactcacttccccaccggaaccaacggtcatgacccacgtgccgtaccaggttctcgcgttgtacaattcaactcgcgaactgctggaggaaatgcacggcgagcgcgaggagggctgtactcaagagaacaccgaatcggagtactacgccaaagaaatccacaagtttgacatgatccaggggctcgcggagcataacgaactcgctgtgtgcccaaagggcataacttccaaggtgttccggtttaacgtctcgagcgttgaaaagaacagaactaacctcttccgggctgaattccgcgtcctgagggtcccgaacccatcctcgaaacgcaatgaacagcggatcgaattgtttcaaatcctcagacccgacgaacacatcgcaaagcagagatacatcggaggaaaaaacttgcctacgcggggaaccgcggaatggctctcattcgatgttaccgatacggtccgggagtggctgctgaggagggaatcaaatttgggactcgaaatctctattcattgcccgtgtcacactttccagccgaatggcgacatcctcgaaaacatccacgaggtgatggaaatcaagttcaagggagttgataacgaggacgaccacggacgcggggatctgggcagactgaagaagcagaaagatcaccataacccccacctgatacttatgatgattccgccacacagattggacaacccgggacagggcggacagagaaagaagagagcgctggacactaactactgtttccgcaatttggaggagaactgttgtgtgaggcccctttacatcgacttccgccaggacctgggatggaagtgggtgcatgagcctaaggggtactacgcgaacttctgctccggaccgtgcccatacctccgcagcgccgacaccactcattccaccgtgcttggcctgtacaacactctgaaccccgaagcatcagctagcccatgttgcgtcccacaggatctcgagcctttgaccattctgtactatgtcggtaggacccctaaggtcgagcaactgtccaatatggtggtgaagtcatgcaagtgctcg

SEQ ID NO: 20145 - DNA, 1236 bp, Artificial Sequence
  Description of Artificial Sequence: Synthetic coding sequence
atgaagatgcacctccagcgggccttggtcgtgcttgcacttctgaactttgcaacggtgtcgctgagcctttcgacttgtaccactctcgactttggacacattaagaagaaaagggtggaagcaatccgaggccagatcctctcgaagctcagacttacctcgcctcctgagccaaccgtgatgacccatgtcccgtaccaagtcctcgccctttacaacagcacccgagagttgcttgaagaaatgcatggcgagagagaggaaggatgtactcaggaaaatacggaatctgaatactacgcaaaggaaatccataagttcgatatgatacagggactggctgaacataacgagctcgcagtctgcccaaagggtataactagcaaagtgtttcgattcaacgtgagctcggtggaaaagaatagaacgaacctgtttagagcagaattcagagtgctgcgtgtgcctaatccatcgagcaaaagaaacgaacagcgaattgaactgtttcagatacttcggccagatgaacacattgcgaaacaacgctacataggtggaaagaatctgccgacccggggtactgcagagtggctgtcgtttgatgtgaccgacactgtgcgagagtggctcctgcggcgggaatcaaatcttggattggaaatttcgatccattgtccatgccacacttttcaacctaatggtgatattctcgaaaacatccacgaagtcatggagattaagttcaagggagtcgacaacgaagatgatcacggtcggggagatttgggcaggcttaagaagcaaaaagatcatcacaacccacaccttattctgatgatgattccccctcatcgccttgacaacccaggccaagggggccaacgcaagaagagagcgcttgacactaactactgttttagaaacctcgaagagaactgttgtgtaagaccgctttacatcgactttcgtcaagatctcggatggaagtgggttcacgaaccgaaagggtactacgcgaacttttgctcggggccctgtccttaccttcgttcagctgacacgacccattcgaccgtgcttggactttacaataccctcaaccctgaagcaagcgcctccccttgttgtgtccctcaggatctcgaaccactgactattctgtactacgtgggcaggactcctaaggtggaacagctttcgaacatggtggtgaagtcatgtaagtgctcc

SEQ ID NO: 20146 - DNA, 1236 bp, Artificial Sequence
  Description of Artificial Sequence: Synthetic coding sequence
atgaagatgcatctacaaagagctcttgtggtgctcgcgttgttaaatttcgctacagtttcactatcactatccacgtgcacgaccctggatttcggtcacattaaaaaaaaaagagtcgaggcaatacgaggacagatactatctaaactccgccttacgtccccccccgagcctaccgtaatgacacatgtgccttaccaggtcctggctctatacaacagtacacgcgagctgctggaggagatgcacggcgaacgtgaggagggttgtacccaggagaacaccgagtctgaatattacgccaaggagatccacaaattcgatatgattcagggtctggcggagcacaatgaactggctgtgtgtcctaagggcatcaccagcaaagtgttccggttcaacgtctcctcggtggagaagaatcggactaacttgttccgggctgagttccgcgttttacgagtgccgaaccccagttcgaagcggaacgagcaaaggattgagctattccaaattctccgacctgatgaacacatcgcaaagcagcgatacattggtggcaagaatcttcccacgcgcgggaccgctgagtggctttcattcgacgttactgacacggtacgcgagtggcttcttcgccgtgagtctaacctcggattagaaatttcgatccactgcccatgccacactttccagccaaacggggatatcttagaaaatattcacgaagtcatggagattaaattcaagggcgtcgacaacgaagatgatcatggaagaggtgaccttggccgactaaaaaagcaaaaggaccaccacaacccgcatttgattttgatgatgattccacctcacaggctggataatcccggccagggtgggcagcggaagaagcgagctctcgacaccaactactgctttcgcaaccttgaggagaactgctgtgtgcgccccctgtacatcgattttaggcaggatctgggctggaaatgggtacacgagcccaaaggatactatgccaatttttgcagcggcccctgtccttatcttcgctcagccgataccactcattccacggtgcttggtctgtacaatactctcaacccggaagcgtccgcatctccgtgctgcgtgcctcaggacctcgagcctctcaccatcctatattacgtgggtcgtacaccaaaagtggagcagttgtcaaacatggttgtcaaaagctgtaagtgctcc

SEQ ID NO: 20147 - DNA, 1236 bp, Artificial Sequence
  Description of Artificial Sequence: Synthetic coding sequence
atgaaaatgcatcttcaaagagcattggttgtattggcattgctgaatttcgctacagtctcgttgtcgctgtctacatgtacaactctcgactttggccatatcaagaaaaaacgggtcgaggccattcgcggtcagatcctttccaagttgagactgacatcaccaccggagcccactgtcatgacacacgtaccgtaccaggttttagccttgtataacagcacacgggaactattagaagaaatgcacggcgaaagagaagaaggatgcacacaagagaatacagaaagcgaatactacgcaaaagaaattcataaatttgatatgatccaagggttagctgagcacaatgaactcgcagtgtgtccgaaaggcatcacatctaaggttttccgtttcaatgtgtcctctgtggagaaaaatcgtacaaatttatttcgggccgaattcagagttttacgtgtgccgaatccttcttcgaaacggaatgagcagcgaattgaactgtttcaaattttgagaccagatgagcatatcgccaaacaaagatacatcggagggaaaaatctgccaactagaggcacagcagagtggctttcttttgatgtgacggatacagtgagagaatggttgcttcggcgagaaagtaacctgggtttggaaatcagcattcattgcccttgtcatacgtttcaaccaaacggcgatattttagagaacatccacgaagttatggagatcaaatttaaaggggtggataatgaagatgatcatggcagaggagatctaggtagacttaagaagcagaaagatcatcacaatccgcacctaatcttgatgatgatcccgccgcacagacttgataatccgggtcaaggaggccagagaaagaagcgcgcgcttgatactaactattgtttccgcaatctcgaggagaactgttgcgtaagacctctttatatcgattttagacaggatcttggctggaagtgggtgcatgaacctaaaggctactatgccaatttttgtagcggtccgtgtccatatctgaggagcgcagacacgacgcacagcacagtactgggtttatacaacacacttaatcctgaagcatcagcgagcccctgttgtgttccccaggatttagagcctttaactattctttactatgttggtaggacgcctaaagttgaacagctgtctaatatggtcgttaaatcatgcaaatgctca

SEQ ID NO: 20148 - DNA, 1236 bp, Artificial Sequence
  Description of Artificial Sequence: Synthetic coding sequence
atgaagatgcacttgcagagagctttggtggtcctcgctctacttaactttgccaccgtttccctttccctgagcacatgtacaacactagattttgggcacatcaagaaaaagagagttgaagccatcaggggccagatactcagcaaactacgccttacttccccacccgagcctacagtgatgacacatgtgccgtatcaagtcctggcactgtacaatagtaccagagaactgttagaagaaatgcacggcgagcgggaagagggctgcacacaagagaatactgagagtgagtattacgctaaagaaatccataagtttgacatgattcagggccttgctgagcacaatgagctcgctgtatgtcccaaagggattacatccaaggtgttcaggttcaacgtctctagtgtggagaagaataggaccaatctattccgcgcagagttccgagtactcagagtgccaaacccaagctccaagagaaatgagcagaggatcgagttgttccagatacttcgtcccgacgagcatatcgccaagcaacgttatattggcggcaagaaccttcccacccggggaactgcagagtggctgtcatttgatgttaccgacacggtgcgcgagtggctactgcggcgcgaatcaaacctgggtttagagatctcgattcactgcccttgccatactttccaacccaatggtgacattctggagaatattcatgaagttatggagatcaagttcaaaggtgttgacaatgaggacgaccacggaagaggagatctaggaagattaaagaaacaaaaggaccaccataaccctcacctcatactcatgatgattccaccgcaccggctagataaccctgggcaaggtgggcagcggaagaaacgtgcattagacaccaactactgcttcaggaatttagaagagaattgttgcgtaagacctctgtatatagatttcaggcaggacctggggtggaagtgggtgcatgagcctaagggctattacgcaaatttctgcagtggcccatgtccctatttgcggagtgcggacactactcattcaacagttttgggcttgtacaacacactgaacccggaggcgtccgcgagtccctgctgtgtcccacaggacttagagccgctcactatcctctattacgtcggaaggacacccaaggttgagcagttgtcgaatatggtcgttaaatcgtgcaaatgctcc

SEQ ID NO: 20149 - DNA, 1236 bp, Artificial Sequence
  Description of Artificial Sequence: Synthetic coding sequence
atgaaaatgcatctacagcgagctctggtggtcctagccctcctgaactttgccacggtgagtctgtcactgtctacctgtacaacgcttgacttcgggcatatcaaaaaaaaaagagtggaggcaatcaggggacagattttaagcaagctgaggcttacctcgcccccagaacctaccgtgatgacacacgtgccgtaccaagttctggccctgtataactcgactagggagttactcgaggagatgcatggggaacgtgaggaaggctgcacgcaggagaatacagagagtgagtactatgctaaggaaattcacaagttcgacatgatccagggcttggctgaacacaacgaattagctgtgtgccctaagggaattactagtaaggtattccggtttaatgtaagcagtgtcgagaagaaccggacaaacctgtttagggccgagtttcgcgtgctgagggtgcctaacccttcatctaaaaggaacgagcagagaatagagctcttccagattctgaggccagacgagcacatagccaaacagaggtatatagggggcaagaacctccctactcggggcacagccgagtggctgagtttcgacgtgactgacaccgtccgagaatggctcttgagacgggagtccaatctcggcctggaaatcagcatccattgtccttgtcacacattccagcctaacggggacatactggagaacatccatgaagtgatggagattaagttcaaaggagtggataatgaggacgatcacgggaggggagatcttggcaggctgaagaaacagaaggaccatcacaatccccacctgatcctcatgatgatcccccctcaccggctcgataacccaggccaggggggccaaaggaagaagagggccctggacaccaattattgctttcgtaatcttgaagaaaattgctgtgtgcgacccctttacatagatttccgccaggacctaggttggaaatgggtgcacgaaccaaagggatactacgctaacttctgttccggaccttgcccatatctgaggagcgcagacactacacactcaacggtgctaggcctctacaatacactgaatccagaagcctccgcgtccccttgttgtgtcccccaagatctggaaccactaacgatcttgtattacgttggacgtacccccaaagtggagcaactgagtaacatggtggttaaatcttgcaagtgtagt

SEQ ID NO: 20150 - DNA, 1236 bp, Artificial Sequence
  Description of Artificial Sequence: Synthetic coding sequence
atgaagatgcaccttcagcgcgctctggttgtcctggcactgctgaactttgccactgtgtcgctgtcattgtccacctgcacgaccctggacttcggacacatcaagaagaagagagtggaagccatcagagggcagatcctctcaaagttgcgattgacttcccctcccgagccgactgttatgacccacgttccataccaggtgcttgcgctgtacaactcgactcgagaactcctggaagagatgcatggagagcgggaagaaggatgcacccaggaaaataccgaaagtgagtattacgccaaggagatccacaaattcgatatgatccagggacttgccgaacataatgaactggctgtctgcccaaaggggatcacctcaaaagtctttaggttcaacgtgtcatcagtggagaaaaacaggaccaacctgtttcgagcagagttccgcgtattgagggtcccgaatccatcctcgaaacgcaatgagcagagaattgaactcttccaaatactgcggccggacgaacatatcgccaagcagcgctacatcggcgggaaaaacctgcctactcgcggcactgcggagtggctgtcgttcgatgtgactgatactgtcagggaatggctcctgagacgcgagtccaatttgggacttgaaatcagcattcactgtccctgtcatacttttcaacctaacggcgacattttggagaacatccatgaagtgatggaaatcaagttcaagggagtggataatgaagatgatcacggacggggagatctcggacgcctgaagaagcagaaagatcaccacaacccgcatctgatcctgatgatgatcccaccgcaccgccttgacaacccaggacaaggaggacaacggaaaaagcgggctctggacaccaattactgcttccggaacctcgaagaaaactgctgcgttcggccgctgtacatcgacttcaggcaggacctgggatggaaatgggtgcatgagccaaagggttactacgctaacttttgctcaggaccttgtccgtacctgcggagcgcggacacgacccacagcactgtgcttggcctctacaatactcttaacccggaggccagcgcctctccttgctgtgtcccccaggacttggaaccgctgacgatcctgtactacgtgggccggacgcctaaggtggagcaactgagtaacatggtggtgaagagctgcaaatgctca

SEQ ID NO: 20151 - DNA, 1236 bp, Artificial Sequence
  Description of Artificial Sequence: Synthetic coding sequence
atgaagatgcacctgcagcgggccctggttgtcctcgccttgctgaatttcgccactgtctccctctcgctctctacttgcactactttggactttggacacattaagaaaaagcgggtcgaggccattcgcggacagatcctttccaaactgaggctgacctcgccccctgagccaactgtcatgacccacgtcccttaccaagtgctcgccctgtacaactctaccagagagcttctcgaggaaatgcacggcgaacgcgaagaaggatgcacccaggaaaatactgaatcagaatactacgccaaagaaatccacaaattcgatatgatccaggggctcgccgaacacaatgaactcgcagtgtgtcccaagggtatcacctccaaagtgttcagattcaatgtctcgtcagtcgagaagaacaggaccaacctgtttagagctgaattccgcgtgctgcgggtgccgaatccttccagcaagagaaatgagcagcgcatcgagctcttccaaatcctcagaccagacgagcacatcgctaagcagcgttacatcggaggaaagaaccttccgacgagaggcacggcggagtggctgtcgtttgatgtcactgatactgttcgcgaatggctgctgaggcgggagtcaaacctgggccttgagatttcgattcactgtccatgccataccttccagccaaacggagatatcctggagaacatccacgaagtcatggagatcaagttcaagggcgtcgacaatgaggacgatcacgggcggggtgacctcggacgcctcaagaagcaaaaggaccaccacaacccgcacctcattctcatgatgatcccgccacaccgcctggacaacccgggacaaggagggcagcggaagaagagagcactcgatactaattactgcttccgcaacctggaagaaaactgctgtgtccgcccgttgtacatcgatttccgccaggacctcggatggaagtgggtgcatgaaccgaagggatactacgctaacttttgttcgggtccgtgcccttatctgcggagcgcggacactacgcactcgactgtcctgggcctgtacaatactctgaacccggaggcttcggcctcaccatgctgcgtgcctcaagacctcgaaccactcaccattctgtactacgtgggacggactcccaaggtggaacagctgagcaatatggttgtgaagtcatgcaaatgctca

SEQ ID NO: 20152 - DNA, 1236 bp, Artificial Sequence
  Description of Artificial Sequence: Synthetic coding sequence
atgaagatgcatctgcaaagggccctggtcgtgctggctttgctgaatttcgctaccgttagcctctcccttagtacttgcaccactctggattttggccatatcaagaagaagcgggtagaggctattcgcggtcagattctttcaaagctccgactgacatccccgccagagccgacagtcatgacccatgtcccataccaggtactggcactctacaattccacaagagagctcctcgaagaaatgcacggcgagcgagaagaagggtgcacgcaagagaataccgagtcagaatactatgcgaaggagatccataaatttgacatgattcagggattggccgagcacaacgaacttgccgtttgtccgaaagggatcacgtccaaggttttccgatttaacgtctcctccgtagagaaaaaccgaactaacctgtttcgggctgagttcagagtgctgcgagtgcctaacccctcatccaagcggaacgaacagcgaatcgaactgttccagatactgcggcccgatgagcatattgctaagcagagatacattggtggaaagaatctgcccactagagggactgccgaatggctgagcttcgatgtgactgacacagtgcgagagtggttgctgagaagagaaagcaatttggggctggagatctccattcactgcccatgccacacctttcagcccaatggtgatatcctggagaacatacacgaggtcatggagataaagttcaaaggtgttgacaacgaggacgaccacggccgcggagacttgggccggcttaaaaaacagaaggatcatcataatccccacctcattttgatgatgatccccccgcacagactcgacaacccgggccagggcggccagcggaagaagagggctctcgataccaattattgttttcgcaacttggaagagaattgttgtgttagaccgctgtatatagacttccggcaagacctcggatggaaatgggtccatgagccaaaagggtactacgctaatttttgttccgggccctgcccttatctgaggtcagccgacaccactcatagcaccgtactgggcctttataacactttgaaccccgaggcttctgcaagcccgtgctgtgtgccccaggatttggaacctctgaccatcctgtattatgtcgggcgcacaccaaaggtggaacaacttagtaatatggtggtgaagtcctgcaagtgcagt

SEQ ID NO: 20153 - DNA, 1236 bp, Artificial Sequence
  Description of Artificial Sequence: Synthetic coding sequence
atgaagatgcatttacagcgggcgcttgtggtgttggctcttctgaacttcgctacggtgtcgcttagtctgagcacctgtacaaccttggactttggccatatcaaaaagaaacgggtcgaggccattcgtggccagattttgtcgaaactcaggcttacaagtcccccagaacctactgtcatgactcatgtgccctaccaggtgctggctttgtacaactctacccgcgagctgctggaggagatgcacggtgagagagaggagggttgtacgcaggagaatacggagtctgaatattatgccaaggagatccacaagtttgatatgatacagggactggccgagcataatgaactggcggtctgccctaaaggcattacttcaaaagtcttcagattcaacgtgagttcagtcgaaaagaaccgaacgaacctctttagggccgaattccgagtgctccgcgtccccaacccctcctcaaaaagaaacgagcagagaattgagctctttcagattctcagacctgacgagcacattgcgaaacagaggtacattggagggaaaaacctacccaccaggggaaccgcggaatggctgtctttcgacgtgactgacaccgtccgagagtggctattgagaagagaatcaaacctagggcttgaaatcagcatacattgtccttgtcacacctttcagccaaacggggacatcctcgaaaatatacatgaggtcatggagatcaagttcaagggtgttgacaacgaagacgaccacggccgcggcgacctcggtagactcaaaaagcagaaagatcatcacaatccgcatctgattttgatgatgatacctccccatagactagacaatccgggccagggcgggcaaaggaagaagagagccctggacaccaactactgcttcaggaacctcgaggagaactgttgtgtccgtccactttatattgattttcggcaggacctcggatggaaatgggtgcacgaaccgaagggctactacgcaaatttctgtagcggaccttgtccctacctgcgcagcgccgacacgacacattccacagtattgggtctctacaacacgctcaaccctgaagccagcgcatcgccatgttgtgtgccacaagacctggagccgttgactatcctgtattacgtggggcgcactcctaaggtagaacagctgagtaatatggtagttaagtcttgtaaatgcagt

SEQ ID NO: 20154 - DNA, 1236 bp, Artificial Sequence
  Description of Artificial Sequence: Synthetic coding sequence
atgaaaatgcatctacaacgtgcgctagtagtattagcgttattaaattttgcgacggtatcgttatcgctatcgacgtgtacgacgttagattttggtcatataaaaaaaaaacgagttgaagcgatacgtggtcaaatactatcgaaattacgattaacgtcgccgccggaaccgacggtaatgacgcatgtaccgtatcaagtattagcgttatataattcgacgcgtgaactattagaagaaatgcatggtgaacgagaagaaggttgtacgcaagaaaatacggaatcggaatattatgcgaaagaaatacataaatttgatatgatacaaggtctagcggaacataatgaattagcggtatgtccgaaaggtataacgtcgaaagtttttcgatttaatgtttcgtcggtagaaaaaaatcgtacgaatttatttcgtgcggaatttcgtgttttacgtgtaccgaatccgtcgtcgaaacgtaatgaacaacgtatagaattatttcaaatattacgtccggatgaacatatagcgaaacaacgatatataggtggtaaaaatttaccgacgcgaggtacggcggaatggttatcgtttgatgttacggatacggttcgtgaatggctattacgtcgtgaatcgaatttaggtttagaaatatcgatacattgtccgtgtcatacgtttcaaccgaatggtgatatattagaaaatatacatgaagtaatggaaataaaatttaaaggtgttgataatgaagatgatcatggtcgtggtgatttaggtcgtctaaaaaaacaaaaagatcatcataatccgcatctaatattaatgatgataccgccgcatcgtttagataatccgggtcaaggtggtcaacgtaaaaaacgagcgctagatacgaattattgttttcgaaatttagaagaaaattgttgtgttcgtccgttatatatagattttcgacaagatttaggttggaaatgggttcatgaaccgaaaggttattatgcgaatttttgttcgggtccgtgtccgtatctacgatcggcggatacgacgcattcgacggtattaggtttatataatacgttaaatccggaagcgtcggcgtcgccgtgttgtgttccgcaagatctagaaccgttaacgatactatattatgtaggtcgtacgccgaaagtagaacaattatcgaatatggtagtaaaatcgtgtaaatgttcg

SEQ ID NO: 20155 - DNA, 1236 bp, Artificial Sequence
  Description of Artificial Sequence: Synthetic coding sequence
atgaaaatgcatctgcagagggcattggtggtcttagccctcctcaatttcgcaaccgtgtcactgtccttgagcacctgtactaccctcgacttcggacatattaaaaagaagcgtgtcgaggcaatcaggggccagattctctcaaagctgagattaacttctccccctgaaccgaccgtgatgactcacgtcccttatcaggtcctggccctgtacaacagcaccagagaattactcgaagaaatgcacggtgagcgtgaggagggttgtacccaggaaaacacagagtccgaatactacgcaaaggaaatacataagttcgatatgatccaagggttagcggagcacaatgaattggcagtgtgccccaaaggcatcacttcgaaagtgttccgctttaatgttagttccgtggagaagaataggaccaacctgtttcgtgccgaattcagggtcttaagggtgcccaatcccagttcaaagaggaatgagcagaggatagaactgtttcaaatcctgaggccagacgaacatatcgctaagcagcgatacatcggcggcaagaacttgcctactaggggtaccgcagaatggctgtccttcgacgtgactgatacggttcgcgaatggttgctgagaagagagtcaaatctgggcctggaaattagtatccactgtccctgccacaccttccagcctaatggagatatccttgagaacattcacgaggtgatggaaattaaatttaagggtgtcgacaacgaagacgaccacggtaggggcgacctgggccgattaaagaaacaaaaagatcaccataaccctcatctgattctgatgatgattcccccccatcgtttggacaaccctggccagggcgggcaacgaaaaaagcgagcgcttgacaccaattactgctttcgaaacttagaggagaattgctgcgtgcggccattatacattgacttccgacaggacttaggctggaagtgggtccatgaacccaagggctactatgccaatttttgcagtggcccatgcccctacttgaggagcgcggatactacacattccacggtgttagggctctataacacattaaacccggaggcgagtgccagtccttgttgcgtgccgcaagatctggagcctcttacaatactttattacgttgggcgaacacctaaagtcgaacagctgtccaacatggtggtgaagtcttgtaaatgttca

SEQ ID NO: 20156 - DNA, 1236 bp, Artificial Sequence
  Description of Artificial Sequence: Synthetic coding sequence
atgaaaatgcatcttcagagagcgctcgtcgttttggcactgcttaacttcgccaccgtgtccctgtccctgagcacttgtacgaccctggacttcggacatatcaagaagaagcgggtggaagccatcagggggcaaatcttgagcaagctccggctgacttcgcccccggaaccaaccgttatgactcacgtgccttaccaggtgctcgcgctgtacaattccactagagagctgttggaagagatgcatggagagcgggaggaagggtgcactcaggaaaacaccgaaagtgaatactacgctaaagaaatccataagttcgatatgattcaaggcctggctgaacacaacgagctcgctgtgtgccccaaaggcattactagcaaggtgtttcgctttaacgtgagctcagtcgaaaagaacagaactaatctgttccgtgcggaattcagggtgctgagagtgcccaacccgagctccaagaggaacgaacaacggatcgaactgttccagatcctgcggcccgacgaacacatcgcaaagcaacgctacatcggcggcaaaaacctgccgactagagggaccgctgaatggctctcgttcgacgtcaccgataccgtacgggaatggttgttgcggcgcgagtcaaatctggggttggaaatttcgattcactgcccctgccatactttccaaccaaatggagacatcctcgagaatatccacgaggtgatggagataaagttcaagggcgtcgataatgaagatgatcacgggcgcggtgatctcgggcggctgaaaaagcagaaggaccaccataacccacacctcatcctcatgatgatccctcctcaccgactggacaacccgggacagggtgggcagcgaaagaagagggctctggatactaactactgcttcagaaacctcgaggaaaattgctgcgtgcgaccgttgtatatcgactttaggcaggacctgggctggaagtgggtgcatgagccgaaaggatactacgcaaacttttgctcaggaccttgtccgtacctgcgctccgccgacacgacccatagcactgtcctcggtctgtacaatacgttgaaccccgaggcatctgcttcaccttgttgcgtgccacaggacctggagcccctgaccatcctctactacgttggtcgcaccccaaaggtcgaacagctttcaaacatggtcgtcaagtcgtgcaaatgctcg

SEQ ID NO: 20157 - DNA, 1236 bp, Artificial Sequence
  Description of Artificial Sequence: Synthetic coding sequence
atgaagatgcacctgcagcgcgctcttgtggtgctggccctcctgaatttcgccaccgtctctctgtcccttagcacttgtactactctggacttcggacatatcaaaaagaagcgagttgaggccattagggggcagattctttccaaactgcgtctgacctcgccgccagaaccaaccgtcatgacccacgtcccataccaggtgctggcactttacaatagtactagagaactcctggaggagatgcacggagagagagaagagggctgcacgcaagagaacaccgaaagcgaatactacgctaaagaaattcacaaattcgacatgatacagggactggcagaacataacgaattggccgtgtgccccaagggaatcacctccaaggtattccggtttaacgtctcgtcagtggaaaagaatagaaccaatttgtttcgggcggagttccgcgtgctgcgtgtgccgaatccttcatcgaaacggaacgaacagcggatcgaactcttccagatcctcagaccggacgagcatatcgcgaagcagcggtacattggaggaaaaaacctccctactcgaggcaccgcggagtggcttagctttgacgtgactgacaccgtgcgggaatggctgctgaggcgggaatccaatctggggctggagatatccatccattgcccctgccacacgtttcagccgaacggagacatcctggaaaacatccatgaggtcatggaaatcaagtttaagggcgtagataatgaagatgatcacggtcgcggagatctcggtagactgaagaagcaaaaggatcaccacaacccgcacctcatcctgatgatgatcccgccacatcgcctcgacaatccgggtcaaggaggacagaggaagaagcgggccctggacaccaactactgtttcaggaacctcgaggagaactgctgcgtgcggcctctgtacatcgatttcaggcaagacctgggatggaagtgggtgcacgaaccgaagggctactatgccaacttttgctcgggtccgtgcccgtacctccggtcggcagacacgacgcattctacggtgctcggactgtacaacacgctgaacccggaagctagcgcctcaccttgttgtgtgccacaggaccttgagcctctgactatcctctattacgttggccgcacccccaaggtggaacagctttccaatatggtggtgaaatcatgtaaatgcagc

SEQ ID NO: 20158 - DNA, 1236 bp, Artificial Sequence
  Description of Artificial Sequence: Synthetic coding sequence
atgaagatgcatctccaacgggctcttgtggtcctcgccctcctgaacttcgctacggtgtctttgtcgctttccacgtgcaccaccctggattttggacacattaagaagaagcgtgtggaggcgatccgcggtcaaatcctctcgaagctcagactgacgtcccctccggaaccgaccgtgatgacccatgtgccctaccaggtgctcgccctctacaatagcactagagaactgctggaagaaatgcatggagaacgggaagaaggctgcactcaggaaaacacggaatcggaatactacgcgaaagaaatccataagtttgatatgatccagggactcgcagagcacaacgagctggcagtgtgtccgaagggaatcacctccaaggtgttcagatttaacgtttcctcggtcgagaagaacaggactaatctgttccgagccgagttcagggtgctgcgagtgccaaacccttcgagtaaacgcaatgaacaaaggatagagcttttccagatcctgcggccggacgaacacatagccaaacaaagatacattggaggcaagaatcttccgacccgagggaccgcggagtggctgtccttcgacgtcaccgacactgttcgggagtggctgctccggcgggagtcgaatctggggctggagatttcgatccactgcccgtgccatactttccagccgaacggcgacatcctggaaaacatccacgaggttatggagatcaagttcaagggtgtcgataacgaggacgatcacgggagaggcgatctggggagattgaaaaaacaaaaggaccaccataaccctcaccttatcctgatgatgatcccgccccacaggttggataaccctggacagggaggacagagaaaaaagcgggctctggacaccaattactgcttcagaaatttggaggaaaattgctgtgtccgcccactctacattgacttccgccaggacctgggatggaaatgggtgcatgaacctaaaggttactacgccaatttctgtagcgggccctgcccgtatctccgctcggcggacaccacccactccaccgtcctgggactctacaacactttgaatccggaagcctcagcatccccgtgctgtgtgccccaagatcttgaaccactgaccatcctgtattacgtaggacgcaccccaaaggtggagcaacttagcaacatggtagtgaaaagctgcaagtgctcc

SEQ ID NO: 20159 - DNA, 1236 bp, Artificial Sequence
  Description of Artificial Sequence: Synthetic coding sequence
atgaagatgcaccttcagagagcactggtggtcctcgccctgctcaactttgcaactgtgtcattgtcgctgtcaacttgcactacccttgatttcggtcacatcaagaaaaaacgtgttgaagctatcaggggccagatcctctcgaagctcaggctcacttcgcctccagaaccaaccgtgatgacccacgttccttaccaagtccttgccctttacaactctactcgcgagctgctcgaagaaatgcatggggaaagagaagaaggttgcacgcaggaaaacaccgaatcagagtactacgccaaggagatccacaagtttgacatgatccaagggcttgcggaacataacgaactggcagtgtgcccaaaaggtattactagtaaagtttttcggtttaatgtctcgtcggtggaaaagaatcggaccaacctctttcgggccgagtttagagtcctcagagtgcccaacccatcatccaagcgaaacgaacagaggattgagctgtttcagattcttcgacctgatgaacatattgctaagcagcgatacatcggtggaaagaatctgcctactcggggcactgcagagtggcttagctttgacgtgactgatactgtgcgcgaatggctgcttagaagagagagcaacctgggcttggaaatttcaattcactgtccttgtcacactttccaaccgaacggcgatattctggaaaacattcatgaggtgatggagattaagtttaagggagtggataatgaagatgaccatggtcggggtgatctgggccgccttaagaagcaaaaagatcatcataaccctcaccttattcttatgatgataccaccccatcgactggataacccaggacaaggaggccagaggaaaaagagagcccttgataccaattactgctttcgtaacctggaggaaaactgttgtgtgcgccccctgtatattgactttagacaagatcttggttggaaatgggtgcacgagccaaagggatactacgcaaatttctgttcgggtccatgtccctacctgcgctccgctgacactactcattccaccgtgctcgggctttacaacaccctcaatcccgaggcatctgcatccccatgttgtgtgccgcaagatcttgagccactgaccatcctgtactacgtcggaagaaccccaaaggtcgagcaactctcgaatatggtggtgaagtcatgcaagtgttcg

SEQ ID NO: 20160 - DNA, 1236 bp, Artificial Sequence
  Description of Artificial Sequence: Synthetic coding sequence
atgaagatgcacctgcaacgggctctcgtggtgctggcactgctcaacttcgctactgtctcgctgtccctttccacttgtaccactttggattttgggcatatcaagaagaaaagagtggaagccatccgaggacagatcctgtccaagctcaggctcaccagccccccggagcctactgtcatgactcacgtgccgtaccaagtgctcgcgctgtacaacagcacgcgggaacttttggaggaaatgcacggagaaagagaggaaggatgcactcaggaaaataccgagtcagaatactatgctaaggagatccataaattcgacatgatccaagggctggccgaacacaacgaactcgcggtctgtcctaagggtatcacctcgaaggtgttccgcttcaatgtgtctagcgtggagaaaaaccgcaccaatcttttccgcgccgagtttcgtgtgctgagagtgccgaacccgagctccaaacgcaatgagcaacggattgaactgttccagatcctccgcccggatgagcacatagcaaagcagcgctacatcggaggaaagaacctgccaacccggggaaccgccgagtggctctcgttcgacgttactgacaccgtgagggagtggctgctgcggcgcgaaagtaatttgggcttggaaatctcaattcactgcccatgccatacgtttcagcccaacggagacatcctggaaaatattcatgaagtgatggaaatcaaatttaagggcgtcgacaacgaggatgatcatggccgcggggatcttggacggctgaaaaagcagaaggaccatcacaacccacacctgatcctgatgatgatccctcctcacaggcttgataacccgggacagggcggccagagaaagaagcgggccctcgacaccaattactgcttccgcaatctcgaggagaactgctgcgtgcgcccactctacatcgacttcagacaagacctgggatggaagtgggtgcacgagccgaagggttactacgcaaacttctgctccggaccgtgcccatacctgagatcagccgataccactcatagcactgtgctgggcctgtataatactctgaaccctgaagcgtcggcgtcaccctgctgtgtcccgcaggacctggaaccgctcacgattttgtactacgtcggtcggaccccaaaggtcgaacaactgtccaacatggttgtgaaatcgtgtaaatgctcg

SEQ ID NO: 20161 - DNA, 1236 bp, Artificial Sequence
  Description of Artificial Sequence: Synthetic coding sequence
atgaaaatgcacttgcagcgggcgttggtggttttagccctgcttaactttgcaacagtgtccctgagcctgtcaacgtgcacgacactggatttcggtcacattaaaaagaagcgagtcgaggccatccgtggccaaatcttgtcaaagctacgcctgacctccccaccagagcccaccgttatgacgcacgttccctaccaggtgctggctttgtacaatagcacccgcgagctgctggaggaaatgcacggcgagcgtgaggaagggtgcacccaggagaacacggagtcggagtactatgccaaggaaatacacaagttcgacatgatccaaggcctcgcggaacataacgaactggctgtttgtccaaagggaattaccagcaaggtgttccgattcaatgtctccagcgtggagaagaaccgtacaaaccttttccgcgcggaatttagggttttgcgagtgccgaacccatcttctaagcgcaacgagcaacgtatcgaattgttccagattttacgacccgacgagcacattgccaagcagaggtatatcggcggcaagaatctccccacccgcggcacggcagaatggctttcatttgatgttacggacaccgtccgggagtggttgctgaggagggagtccaacctgggcctcgagatctccatccactgcccgtgccatacgtttcagcccaatggagatatcttggagaatatccacgaggtcatggagatcaaattcaaaggcgtggataatgaggacgaccacggcaggggagatcttggccgtttgaagaaacagaaggaccatcacaatccgcacctaattctgatgatgatacctccccacagactggataacccaggtcaaggcggccagaggaagaagcgagccttggacacgaactactgcttccggaacttggaagaaaactgttgcgtccggcccctgtacattgacttccgccaggatctgggctggaagtgggttcacgagcccaaaggatattatgctaacttttgcagtggcccatgcccatacctgcgttcggcggacaccacgcactcgacagtgctgggtctctataatactctgaaccccgaggcgagcgcaagtccgtgctgcgtgccgcaggacctggagccgctgacaatcctgtattacgtgggccggacccccaaagtggagcaactatccaacatggtggttaaaagctgcaagtgcagc

SEQ ID NO: 20162 - DNA, 1236 bp, Artificial Sequence
  Description of Artificial Sequence: Synthetic coding sequence
atgaaaatgcaccttcagcgggctctcgtagtccttgctttgctgaactttgctacagtgtctctatccctctctacttgtacaacgttggatttcgggcacatcaagaaaaaacgggtggaagccatccgggggcagatattatccaagctccgccttactagtcctcctgaaccaactgtcatgactcacgtgccctatcaggttttggctttatataattccacacgggaattattggaagagatgcacggagaacgagaagagggatgtactcaggagaacacagaaagtgaatattacgcaaaagaaatccacaaatttgatatgatccaggggctggcagaacataacgagctcgccgtgtgtccaaaagggataacttccaaagtttttcgctttaatgtatccagtgtggaaaaaaaccgaacaaacctatttagggccgaatttcgagtcctacgcgtgcctaatccttcatctaaaagaaatgaacagcgaatcgaactctttcagattctacgacccgatgaacacatcgctaaacagaggtatatcggggggaaaaatctccccacacgcggaacagctgaatggctctccttcgatgttacagatactgtgcgcgagtggctactccgccgggaatccaatctcgggctagaaatctcaatacattgtccatgtcatactttccagcccaatggggacatcctagaaaatatacatgaggttatggaaatcaaatttaagggagttgataatgaagatgaccatgggcggggagatttagggcgcctaaaaaaacagaaggatcaccataatccccatctgatcttaatgatgatacctccccatcggctggataatccaggacagggagggcagcggaagaaacgggcactggacactaactactgcttccgaaatctggaagaaaattgttgtgtccggcccctttatatcgatttcagacaggatttgggatggaaatgggtccacgaaccaaaaggatattatgccaacttctgttcaggaccgtgcccctatctgcgatccgctgatactactcattcaactgtgctggggctctacaatactctgaatcctgaagcatcagcctctccatgctgtgtgcctcaggatctcgaaccactgactatcctgtattatgttgggcggacacccaaagttgagcagctctcaaacatggtcgttaaatcttgcaaatgtagt

SEQ ID NO: 20163 - DNA, 1236 bp, Artificial Sequence
  Description of Artificial Sequence: Synthetic coding sequence
atgaaaatgcacctgcagagagcgctcgtcgtgttggcactcctgaacttcgccactgtgagcttgtcgctctccacgtgtacgactctggacttcgggcacatcaagaaaaagcgcgtggaagcgatccgcggacagatcttgtctaaactgcggctgacttcgccacctgagccgaccgtcatgacccacgtcccataccaagtcctggccctgtacaacagcactcgggagctgctggaagagatgcatggggagcgcgaagaagggtgcacccaagagaacaccgagtcagagtattacgcaaaggaaatccacaagttcgacatgatccagggactggcagaacacaatgagctggccgtctgtccgaaaggaatcacttctaaggtgttccgattcaatgtgagctcggtggagaagaacaggaccaacctgtttcgcgccgagtttagagtcctgagagtgccaaatccgtcgtcgaagcgaaacgaacaacgcatcgaactctttcaaatcctgcgcccggatgaacacattgccaagcaacggtacattgggggaaagaacttgccgaccagaggaaccgcggaatggctgtcgttcgacgttaccgacaccgtgagagaatggctgctccgcagggagtccaatttgggacttgaaatcagcatacactgtccgtgccatacttttcagccgaatggcgacatcctcgagaacatccacgaagtgatggaaatcaagttcaagggagtggacaatgaggacgatcatggaaggggtgacctgggacgactgaagaaacagaaggatcatcacaatccgcatttgatccttatgatgatccctccacatcgcctcgataaccccggacagggcgggcagcgaaagaagcgcgcccttgacacgaactattgtttccggaatctggaagagaattgctgtgtgaggccgctctacatcgacttccgccaagatctggggtggaagtgggtccacgaaccaaagggatactacgctaacttctgtagcggcccttgcccgtatctgcgttctgcggatacgactcattcaaccgtgctgggcctgtacaacactctgaacccagaagcctcagcatccccttgttgcgttcctcaagacctcgagccgctcaccattctgtactacgtgggacgcacgcccaaggtcgagcagctgtcgaacatggtcgtgaaatcatgtaaatgctcc

SEQ ID NO: 20164 - DNA, 1236 bp, Artificial Sequence
  Description of Artificial Sequence: Synthetic coding sequence
atgaaaatgcacctccaacgagcgcttgtggtgctggcacttctgaactttgcaacggttagcctctcactctcgacgtgtacgaccctcgattttggtcatatcaagaaaaagcgggtggaagcaatccggggacaaatactttccaagctcagacttacgagccctcccgagccaaccgtgatgacccatgtgccttaccaagtgctggcgttgtacaatagcactcgggagctccttgaagagatgcatggtgagagagaggaaggctgcactcaggagaacaccgaatcagaatactacgctaaggagatccataagttcgacatgatccagggactcgcagaacacaatgagcttgcagtctgccctaaggggattacgtcaaaggttttccgtttcaatgtgtcctcggtggaaaagaacagaaccaaccttttccgagccgaatttagagttttgcgtgtgccaaatccatcgtccaagcggaacgaacaaagaattgaactgtttcaaatactgcggccggacgaacatattgcaaagcagaggtatatcgggggtaagaatctccccacgcgcggaacggcagaatggctgagcttcgatgtgactgataccgtcagggagtggctgctgcggcgggaatccaatctgggacttgagatctccattcactgtccctgtcataccttccagcctaacggagacatactcgagaacatccacgaggtgatggagataaagtttaagggcgtggataacgaagatgatcacggaaggggtgatcttggaagattgaagaagcaaaaggaccatcacaatccacatctgattctcatgatgattccgcctcatcgactggataaccctggtcagggtggtcagcggaagaagcgggccctggatactaactactgttttaggaacctcgaagaaaattgttgtgtcagaccactgtacatcgattttaggcaggatcttggatggaagtgggtgcatgaaccaaagggttactacgcgaacttttgttcgggtccatgcccataccttagatcagctgatactacccattccacggtgcttggactgtacaacactctgaaccctgaagcgagcgcctcaccgtgctgtgtgccccaagacctggagcccctcaccatcctttactacgtcggtagaacccctaaagtcgaacaactctccaatatggttgtcaaatcgtgtaaatgctca

SEQ ID NO: 20165 - DNA, 1236 bp, Artificial Sequence
  Description of Artificial Sequence: Synthetic coding sequence
atgaaaatgcacctgcagagagccttggtggtcttggctctgttgaacttcgcaacagtttccctgtccctgtccacatgcaccaccctcgatttcggtcacattaaaaaaaaaagagtggaagctataagaggacagatactgtctaagctgaggcttacaagcccccctgaaccaaccgtcatgactcacgtaccttaccaggtgcttgcattgtataactccacacgggagcttttggaggaaatgcacggagagagggaggaggggtgcacacaagaaaatacggaatcagagtactacgctaaggagattcataagttcgacatgattcaaggacttgccgaacacaatgaactggccgtttgcccgaagggtatcacatccaaggtgttccgcttcaacgtcagcagcgtggagaaaaatagaaccaatctgttccgagctgaattccgcgtcttgcgagtgccaaacccttcctctaagcgcaacgagcaacgaattgagttgtttcagatattgaggcctgatgaacacatcgctaagcagcgctacataggaggcaaaaatctcccaactagagggactgcggaatggctgagcttcgatgtgactgataccgtccgcgaatggcttcttcggagggagtcaaacttggggctggagatcagtatccactgtccttgccacacatttcagccaaacggcgacatactggagaatatccatgaggttatggaaataaagttcaagggcgtcgacaacgaggacgatcatggtcgaggagacctgggacgactgaagaaacagaaggaccaccataaccctcacctcatccttatgatgatcccgccccaccgcctggataaccctggacagggcggtcaacggaagaagcgggctttggacactaattactgctttaggaacttggaggagaactgttgcgtcaggcctctgtatattgactttcgccaggacctgggctggaaatgggtgcatgagccaaaagggtactacgcaaacttctgcagcggaccctgtccgtatctgcgcagcgccgacaccacccatagcactgtgctggggctctacaataccctgaatcccgaagccagcgcctcaccctgttgtgtgcctcaggatctggagcctctcacaatcttgtactacgtgggtcgcacacctaaagtggaacagctgagcaatatggttgtcaagtcttgcaagtgctct

SEQ ID NO: 20166 - DNA, 1236 bp, Artificial Sequence
  Description of Artificial Sequence: Synthetic coding sequence
atgaagatgcacttgcagagggctttggtggtgctggctttattgaattttgcaaccgtcagcctaagcctgagcacatgcacaacactggattttgggcatatcaagaagaagcgggtggaagccattagagggcagattctgagtaaattgagactcaccagcccccccgagcccactgttatgacacacgtgccttaccaggtactggccctctataactctaccagagaactgttggaggagatgcacggggagcgagaagagggatgcactcaagagaacacagagtcagagtactatgccaaagaaattcacaagttcgatatgatccagggtttagccgagcacaatgagttggcggtgtgtcccaagggcattacaagcaaggtttttagattcaatgtgtcttccgtcgagaaaaacagaacgaatttatttagagctgaattccgcgtgcttcgggttccaaatccgagcagtaagcggaacgagcagcgtatcgagctgttccagatccttaggccggatgagcacattgcaaagcagagatacattggaggcaagaacctccccactcgagggaccgccgagtggttatcgttcgatgttactgacaccgtgcgtgagtggcttctgcgccgggaatcaaatttgggactggaaatcagtattcattgtccatgccacactttccagcctaatggagacatcctggaaaatatccatgaagtgatggagatcaaattcaagggagtagacaatgaagatgaccacggacgaggagatctggggaggttgaaaaaacagaaggaccatcacaatccgcatttgattctcatgatgatcccaccccaccgtctcgacaacccgggccagggcgggcagagaaaaaaaagggcccttgacacgaactactgttttagaaacctagaagaaaattgttgcgtacgtccactctacattgactttcgccaggatctcggatggaaatgggtgcatgaaccgaaaggctattacgccaatttctgttctggcccatgcccgtatctgcgctcagcagacaccacccactcaaccgtgctggggctgtataatacgctcaaccctgaagcgagtgcgtctccctgctgtgtccctcaagatcttgaacccctgaccatactgtactacgttggacgaacaccaaaggtagaacagctatctaatatggtggtgaagagctgtaaatgtagc

SEQ ID NO: 20167 - DNA, 1236 bp, Artificial Sequence
  Description of Artificial Sequence: Synthetic coding sequence
atgaagatgcatttgcagagagcactggtcgtgctggcattgttgaattttgcaaccgtgtccctctcattgtccacttgtactaccttggactttggacacataaagaaaaagcgagtggaagcaattagaggacaaattctttcaaagctgaggcttacgtcgcctccggagccaaccgttatgactcatgtgccttaccaggtgctggcactgtacaactccactagggaactcctcgaggaaatgcatggggaaagagaagagggttgtacccaggaaaataccgaatccgaatactacgccaaggaaattcataagtttgacatgattcaggggctggcggaacacaacgaactcgcagtgtgtcctaagggaataacctcgaaggtgtttagatttaacgtttcgagcgtcgagaagaacaggacgaatctgttccgggcagaattcagagtgcttcgagtccctaacccatcgtccaagcgcaatgagcagcgcatagaattgttccaaatacttcgcccggatgaacatattgccaaacaaaggtacatcggaggtaaaaacctccccacccggggcacggccgagtggcttagctttgatgtgacggacacggtcagagagtggcttctgcgacgcgagtcaaacctggggcttgaaattagcatccactgcccatgccatacctttcagcctaatggtgacattctcgaaaacattcatgaagtgatggagattaagttcaaaggggtggacaatgaagatgaccatggacgcggtgacctcggccggctcaagaaacaaaaggatcatcataacccccaccttatcctcatgatgatacctcctcatcggctcgacaatccaggacagggaggtcaacggaagaagagagcgctggataccaactactgctttcgcaaccttgaagaaaactgttgtgtcagacccctgtacatcgacttcagacaggatctggggtggaagtgggtccacgaacctaagggctactacgcaaacttctgttcagggccttgcccctacctcagatctgcggacactacccattccaccgtgctggggctttacaatactcttaaccctgaagcatccgcatcgccatgttgtgtccctcaagaccttgaaccacttacgattctctactacgtgggccgaacccctaaggtggaacagctgtcgaacatggtggtgaaatcgtgcaagtgcagc

SEQ ID NO: 20168 - DNA, 1236 bp, Artificial Sequence
  Description of Artificial Sequence: Synthetic coding sequence
atgaaaatgcatctacagagagctctcgttgttctagctttgctcaatttcgccacagtgtccctgtccctttctacttgcactactctagatttcggacatataaaaaaaaaacgagttgaagcaatcagagggcagatactgtctaaattgcgactgacgtctccccccgagcctactgttatgacacatgttccctaccaggtactcgcattatataactcgacacgcgagctcctcgaggaaatgcacggggaaagagaagaaggatgcacacaggaaaacacagaatcagaatactacgctaaagaaatccataaatttgatatgatacagggacttgccgaacataatgaactggccgtctgtcctaaagggattacatcgaaagtattccggttcaatgtatcttcggtagaaaaaaaccgaacaaatctttttcgggcagaattcagggtgctcagagtgcctaaccctagttctaaacgcaacgaacagcgcatcgaactgttccagatactgagacccgatgaacatatagcaaaacagcgttacataggggggaaaaacctcccaactcgagggacagccgaatggttatcctttgatgtgacagatacagtgagggaatggcttctcaggcgggaatcaaatctcgggcttgaaataagtatacactgtccctgtcatactttccagcctaacggagatatactagaaaacattcacgaagtgatggaaatcaaatttaaaggagtggataatgaagacgatcacgggcggggggatctagggcggctcaaaaaacaaaaggatcaccacaatccccatttgatacttatgatgatccctccccataggttggataaccctgggcagggggggcagagaaaaaaaagagccctcgatacaaattattgctttagaaacctggaagaaaattgctgtgtcagacctctatatatcgatttccggcaggatctcggatggaagtgggtccacgaacccaaagggtattatgcaaatttttgttctggaccatgtccataccttaggtctgccgatacaactcactcaactgtgttagggctctacaacactctcaacccagaagcatctgcgtctccttgttgtgtcccccaggatctggagcccctcactatcctgtattatgtggggaggactcccaaagtggaacagctatctaacatggtggtgaagagttgtaaatgcagt

SEQ ID NO: 20169 - DNA, 1236 bp, Artificial Sequence
  Description of Artificial Sequence: Synthetic coding sequence
atgaaaatgcatctgcaacgggcacttgtcgttcttgccttactgaattttgcaaccgtctccctctctctcagcacctgtactaccctggattttggccatattaagaaaaagcgggtcgaagctataaggggacaaattctgagtaagttaagactcacttctccgcctgaacctacagtgatgacccatgtaccctaccaggttctggcgctgtacaactcaactcgcgagctgttggaggaaatgcacggagagagagaagaggggtgcacccaggaaaacactgaatctgagtactatgcgaaggaaatacacaagtttgacatgattcagggcttggccgaacataatgagctggcggtgtgtcccaaggggatcacttccaaagtgtttaggtttaatgtatcttcagttgaaaaaaatagaacaaacctgttccgcgctgagttcagagtgctgagggtgccaaacccaagctcaaaacggaacgagcagcgaatcgagctttttcagatcttgcgccccgacgaacacattgcgaaacaacggtacattggcggaaaaaatctgcccacacggggcacagccgaatggctatccttcgacgttactgacaccgtacgcgagtggttgcttaggcgtgagagcaacctgggtcttgaaatcagcattcactgcccatgtcataccttccagccaaacggcgacatattggaaaacattcatgaggtgatggaaatcaaatttaagggcgtggataacgaggacgaccacggcagaggagatctcgggcgacttaagaagcagaaggaccaccacaatccacatctgatcctaatgatgattccacctcatcgactggacaaccccggccagggtggacaacgcaagaaacgggcactcgatactaactattgcttcagaaatctggaggaaaactgttgtgtacgacctctgtatattgattttcgacaggacctcgggtggaagtgggttcacgagcccaaggggtattatgcgaatttctgcagtgggccctgcccctacctccgcagcgctgacaccacccatagtacggttctggggttatacaacactttgaatcctgaggcttccgcgagcccttgctgtgtgccccaggacttggagcccctaactattctttattatgttggcaggacccccaaggttgaacagttatccaacatggtggtaaaatcctgcaaatgttcg

SEQ ID NO: 20170 - DNA, 1236 bp, Artificial Sequence
  Description of Artificial Sequence: Synthetic coding sequence
atgaagatgcacctccagcgtgccctggttgtgctggccttgttgaatttcgccaccgtctcgctgtccctctccacctgcaccaccctagacttcggacacatcaagaagaagagggtggaagccatcaggggccaaatcctctcaaagttacgcctgaccagtcccccagaacctacagttatgacccacgttccataccaggttttggccctgtataattccacccgagagctgcttgaagagatgcacggcgagcgggaggaaggctgcactcaggaaaataccgagtcggaatactacgcaaaggaaatccataagttcgacatgatccaggggctggccgaacataacgaactagccgtgtgccctaagggcatcacgtcaaaggtttttcgcttcaatgtgagctctgtggaaaagaaccggactaacttgttccgagctgaattccgggtcctgcgagtccctaatccaagcagtaagagaaacgaacaaagaatcgagttgttccagatcttgaggccggacgagcatatcgccaagcagaggtacattggaggaaagaaccttcctacaagaggtacggctgagtggctcagtttcgatgttaccgacacagtgagggaatggttactgcggagagaaagcaatctgggcctggagatttccatccactgcccttgccatacgttccagccgaatggggatattctcgagaatatccacgaagtgatggagattaagttcaaaggggtcgataacgaggacgaccatggtcgaggcgatctgggaagactgaaaaagcagaaggatcatcacaatcctcatctgatcctgatgatgattccaccacaccgcctggacaacccgggccagggcggacagcgaaagaagagagccctagatacaaattactgttttagaaacctggaggaaaactgctgtgtcagaccgctgtatatcgattttcgccaggacctgggatggaaatgggtgcatgagccaaaaggctactacgcaaatttctgctccgggccctgcccctacctgagatctgctgatactacccactcaactgtcctggggttatataacaccctgaatcccgaagcctccgcttctccttgctgcgtccctcaggacttggagcccctcacaatactgtattatgtgggacggactcctaaggtagaacagctgtccaacatggtggtcaaaagctgcaagtgctcc

SEQ ID NO: 20171 - DNA, 1236 bp, Artificial Sequence
  Description of Artificial Sequence: Synthetic coding sequence
atgaaaatgcatctgcagagggcccttgtagttttagccctgctgaacttcgccacagttagcttgtctctcagcacctgcaccaccctggactttggccacattaaaaagaaacgggttgaagcaatcaggggccagattctgtctaagttgcgcctgaccagccctccggagccaactgtgatgacccacgtcccctatcaggtgctcgcactgtacaattctacaagggagctcctggaggagatgcatggcgagcgcgaggagggctgcacacaagaaaataccgaatcagagtactatgctaaggagatacacaagtttgacatgatccagggtctggctgaacacaacgaactcgcagtgtgtccaaaaggtatcacatcaaaagtgttccggttcaacgtgtctagcgtggagaagaatcgaacaaatctgtttcgcgcagagtttcgggtgctgcgcgtgccaaatccctcttctaaacgcaacgagcagcgaattgaactgtttcagattctcagaccagatgagcacattgccaaacaacgctacataggaggaaaaaacctgcccactaggggaacggccgaatggctgtcctttgacgtcacagataccgttcgggaatggttgctgcgccgcgaatcgaatctgggtttggagataagtattcattgcccatgccatacattccagcccaacggtgatattctcgagaatattcacgaagtgatggagatcaaatttaagggtgtggacaatgaggacgaccatggaaggggggacctcggcagactcaagaaacaaaaggaccaccacaatccgcacctaattcttatgatgataccaccacatagactagataaccctggacagggaggtcagcgaaagaaacgcgctttggatactaactattgcttcaggaacctagaagagaactgctgcgtgcgccccctctacatcgacttcagacaggatttggggtggaaatgggtccacgagcctaaaggatactacgccaacttctgttccgggccatgcccatatcttcgctccgcggataccactcactccaccgttctggggctgtataacacacttaaccccgaggctagcgccagtccttgttgcgtcccacaggatttagagcccctcactatcctgtactatgtgggccggaccccaaaagtagaacaactgagtaatatggtagtgaagagctgtaagtgcagc

SEQ ID NO: 20172 - DNA, 1236 bp, Artificial Sequence
  Description of Artificial Sequence: Synthetic coding sequence
atgaaaatgcacctccagcgcgctcttgtagtcttggcactgctgaacttcgctacggtatcattgtccttgagcacctgcaccacactggactttggtcacattaaaaagaaacgagtcgaggctattaggggtcagatcctctccaagctgaggttgacttcaccccctgagcctactgttatgacccatgtgccttaccaggttctcgctctgtacaatagcacccgcgagctgctggaggagatgcacggggagcgcgaagagggttgcacccaggagaacaccgagtctgaatactacgcgaaggagattcacaaattcgacatgatccagggcctggctgaacataatgagctcgccgtgtgccctaaaggaatcacctctaaggtgttccggttcaacgtatccagcgtagagaaaaatcggacaaatctttttcgcgctgaattccgcgtgctgcgagtacccaatccctcctctaaaaggaacgaacagagaatagaactcttccagatactgaggcccgatgaacatatcgctaagcagcggtatattggaggtaaaaaccttccaacccgggggactgcagagtggctgagctttgacgtcacagacactgtccgggagtggctcttgcggagagaatccaatctcggactggagatcagcattcactgtccatgtcacacctttcagcctaatggcgacattcttgaaaatattcacgaagtgatggaaataaaattcaagggggtggataacgaggacgaccatggccggggggacctcggaaggctgaagaagcagaaggaccaccacaacccccaccttatcctgatgatgataccaccgcaccgactcgacaaccctggacagggggggcagcggaagaaaagagctcttgacacaaattattgctttcggaatctggaagaaaattgctgtgtgcggccgttgtacatcgattttagacaggacctgggttggaagtgggtgcacgagcctaagggctattatgccaacttttgttctggcccctgcccttatctgagatccgctgacaccacccactctaccgtgctggggctttacaacaccctgaaccccgaagcatctgcgtcaccctgttgcgtgcctcaggacctggaaccgcttacaatcctgtattatgtcggtcgaacccctaaggtggaacagctgtctaacatggttgtgaagtcttgtaaatgcagc

SEQ ID NO: 20173 - DNA, 1236 bp, Artificial Sequence
  Description of Artificial Sequence: Synthetic coding sequence
atgaagatgcacctccagcgcgcactggttgtgttggctctgctcaatttcgccactgtctccctgagtttgtcaacgtgcaccactctcgattttggacacatcaaaaagaagagggtggaggccatcaggggacagatcctcagtaaactgcggctgaccagcccgccggaacctaccgtcatgacccacgtgccttaccaggtgcttgctttgtataactccactcgggagctgcttgaagaaatgcatggcgagcgcgaggagggatgtacccaagaaaataccgagtcagagtattacgcgaaggaaatccacaaatttgatatgatccaagggttggcagagcacaatgaacttgccgtgtgcccaaagggaatcacttcaaaagtgttcaggttcaacgtgtcatccgtggagaaaaaccggactaatcttttcagagcggagtttcgggtgcttcgggtgccaaacccgtccagcaagaggaacgaacaacgcattgagctgttccagattctgcggccggacgaacatatagcgaaacaaagatacatcggtggaaagaacctgccgactcgcggcaccgcagagtggcttagcttcgacgtcaccgacactgtcagagaatggctgctgcgcagagaatcaaatcttggtctggagattagcattcattgcccgtgccatacgttccagcccaatggagatatccttgaaaacatccacgaagttatggagatcaagttcaagggtgtggacaatgaggacgaccatggacgcggggacctggggcgcctgaagaagcagaaggatcaccataacccgcacctcatcctcatgatgatcccaccgcatcgccttgacaatcccgggcaaggaggacagcggaagaaacgcgctctggacactaattactgttttagaaatcttgaggaaaactgctgtgtgcggcccctgtacatcgacttccgccaagatctgggatggaagtgggtacacgaacccaagggctactacgccaacttctgctcgggaccatgcccttacctccgctcggctgacacgactcactctacggtgctgggactgtacaacactctcaaccctgaagcgtccgcctccccctgctgcgtgccacaggatctggaaccgcttactatcttgtactacgtcggccggacccctaaagtggagcagctgtccaacatggtcgtgaaatcgtgtaaatgttcc

SEQ ID NO: 20174 - DNA, 1236 bp, Artificial Sequence
  Description of Artificial Sequence: Synthetic coding sequence
atgaagatgcatctacaaagagcattagtggtgttagctttgttaaactttgcaactgttagtctttctttgtctacatgcacaaccctcgatttcggtcatataaagaagaagagagttgaagcaataagggggcaaattctatctaagctccggttgacctccccgccagaaccaacggttatgactcacgtcccgtatcaggtacttgccctttataattcgacccgagaattgttggaagaaatgcatggtgagagagaggaggggtgcactcaagagaataccgaatctgagtattatgcgaaggaaattcataagtttgatatgatacaaggattggcagagcataatgaactggccgtttgtccaaaaggtattacatccaaagtattcaggttcaatgtaagtagtgtggagaagaacagaactaacctttttcgggctgagttcagagtgttgagggtgcccaacccgtcgtcaaagagaaacgagcagagaatcgagcttttccaaatcctgaggccggatgaacacattgctaagcaacgatatattggtggaaagaacttacctacgcgcggaaccgctgaatggttgtctttcgacgtgactgatactgtcagggaatggcttctccgacgggagagcaatctaggtctggaaattagtattcattgcccttgccatacctttcaacctaatggtgacatactcgagaacatccacgaggtcatggagataaaattcaaaggggtggacaatgaggatgatcacggtcgtggtgatcttggaagattgaagaaacagaaggatcatcataatcctcacctcatattaatgatgatccctccacaccgactagataaccctggtcaggggggacaacggaaaaagagggcgcttgataccaactactgcttcagaaatttggaagagaactgttgcgttcgtccactatacattgacttcagacaagacttgggttggaagtgggtgcacgagcccaagggttattacgcaaatttctgcagtggtccgtgcccatatcttcgatcggcggatactactcacagtactgtgttgggactgtataatacgttgaatcctgaggcttctgcttccccttgttgtgtgcctcaagatttggaacctttaacaatcctgtactatgttggtcgtacgccaaaggtggagcaattgtcaaatatggttgttaagtcttgcaagtgcagc

SEQ ID NO: 20175 - DNA, 1236 bp, Artificial Sequence
  Description of Artificial Sequence: Synthetic coding sequence
atgaagatgcacctgcaaagagcgctggtggtccttgcgctactgaatttcgccaccgtttctctctctctcagcacgtgcactactctcgacttcggtcacataaaaaaaaaaagagtggaagcaatccgggggcagattctgtccaagcttaggctgaccagcccacctgagcctaccgtaatgacgcacgtgccttaccaggttcttgccctgtacaacagcacgcgagagttactggaggaaatgcatggtgaaagagaggaaggatgcacccaagaaaacactgagtcagaatattacgccaaggagatacacaaattcgacatgatacagggtcttgcggaacataacgaactcgctgtatgtccgaagggcattacgagcaaagtgttccgatttaatgtgagctctgtggaaaagaacagaaccaatctgttccgcgccgagtttcgcgtgttgcgcgtgcccaatccctctagcaaacgtaacgaacaacgaattgagctgttccagatacttaggcccgatgagcatatcgccaaacaacggtatatcggaggcaaaaatctgccgaccagagggaccgccgaatggctaagttttgacgtaacggataccgtgagggaatggttgttacggcgcgagtccaatctagggttagagatctccatccactgtccatgccacacatttcagcctaatggggacatccttgaaaacatccatgaggtgatggagattaagttcaaaggtgtggataatgaagatgaccacgggcggggggacttaggccgtctgaagaagcagaaggatcaccataatccgcacctcattctgatgatgatccctccccacagacttgataatccgggacagggcggtcagagaaaaaaacgagcgctggacacaaattattgtttccgcaacctggaggagaattgctgcgtgagaccgttgtatattgacttcaggcaggacctgggttggaagtgggtgcatgaaccaaagggttattacgcaaacttctgtagcgggccttgcccctacctgagatcggctgatacgactcattctactgtattgggactgtacaatactctgaatccagaagcctccgcttctccttgctgtgtgccccaggacctggaacctctaaccatcctctactacgtcggacgcacccccaaggtggagcagctgtctaacatggtcgtgaaaagctgtaaatgctcc

SEQ ID NO: 20176 - DNA, 1236 bp, Artificial Sequence
  Description of Artificial Sequence: Synthetic coding sequence
atgaagatgcacttgcagcgcgcccttgtcgtgcttgctttgctcaactttgctaccgtcagtctgagcctctcaacctgtaccacacttgattttggacacataaagaaaaagagagttgaagccattagaggtcagattttatctaagctgcggttgacatctccccccgagccaaccgtcatgactcacgtgccatatcaggttctggcactgtacaatagcacaagagaactgttagaggagatgcacggagagcgcgaagagggttgtactcaggaaaatactgagtccgaatattatgccaaagagatccataaattcgatatgatccagggcttggccgaacacaatgaacttgcagtatgtcctaagggaataactagcaaagtctttagattcaacgtttccagcgttgaaaagaaccgaaccaatctgttcagagccgagtttagagtcttgcgtgtgcccaatccgtcctcaaaacggaatgaacaacggattgaactgtttcagatcctgagacccgacgagcacattgctaaacagaggtacatcggcgggaagaatctaccaaccagggggacagcagagtggttgagttttgacgttaccgatacagtcagggagtggctgctcaggcgggaaagcaacttgggtctggagatttctatccattgcccctgccatacttttcaacccaatggtgacatcctggagaatatacatgaagtcatggaaatcaaatttaagggggtcgataacgaagatgatcacggccgcggcgacctgggccggcttaagaaacagaaggaccatcataacccccatcttatactcatgatgattccaccacaccggctggataatccaggccaggggggacagcggaaaaagagagcgctcgacactaattactgctttaggaatctcgaagagaattgttgtgtacggccactgtatattgactttcgacaggacctcggttggaagtgggtccatgaaccaaaggggtattacgccaatttctgttcaggtccttgtccgtatctgagaagtgcggacactacccattcgactgtgcttggactgtacaataccttgaatcctgaagcaagtgcttctccatgttgtgtgccgcaggacctcgagcctttgaccattctctactatgttggacgcacgcccaaagtggagcagcttagtaacatggtcgtgaagtcctgcaagtgtagc

SEQ ID NO: 20177 - DNA, 1236 bp, Artificial Sequence; identical to SEQ ID NO: 20141
  Description of Artificial Sequence: Synthetic coding sequence

SEQ ID NO: 20178 - DNA, 1236 bp, Artificial Sequence
  Description of Artificial Sequence: Synthetic coding sequence
atgaagatgcacctgcagcgcgcacttgtcgtgctggccctgctcaatttcgcaaccgtctcgcttagcctgtctacttgtactactctggatttcggacacatcaagaagaagagagtggaggccatcaggggccagatcctctcgaagctgcggctgacctcaccccctgagccaaccgtcatgacccatgtcccgtaccaggtgctggcactttacaatagcactcgggagctcctggaagagatgcacggagaacgggaggagggctgcacccaggaaaacacggaatccgaatactacgccaaggaaatccacaagtttgatatgatccaaggattggccgagcacaatgaattggctgtgtgcccaaagggtatcacttcaaaggttttccgcttcaacgtgagcagcgtggaaaagaaccgcactaacctgttccgcgccgaatttagagtgctccgggtgccaaacccatcctcgaagcgtaacgaacagcggatcgaactgttccaaatcctgcgacctgacgaacacattgccaagcagcgctacatcgggggaaagaacctgccaacccgtggaactgcagaatggctgtccttcgacgtgactgacaccgtgagagagtggctgctgcggagagaatccaacctgggactggaaatctcaatccactgcccatgccatacctttcagccgaatggagacatcctcgagaacatccacgaagtgatggaaatcaagtttaagggagtggataatgaggacgatcatggtcggggagatctgggacggctcaagaagcagaaggaccaccacaacccacaccttattctgatgatgattccgcctcaccggcttgacaatccgggtcaaggaggccagcgcaaaaagagggccctggacacgaattactgctttaggaacctggaggaaaactgttgtgttagaccactctacattgacttccggcaggacctcggttggaagtgggtgcatgagccgaagggctactacgcgaacttttgctccggcccatgcccgtacctgcgctcggccgacactacccattccactgtgctgggactgtacaataccctgaacccagaagcaagcgcctcgccgtgctgcgtgcctcaagatctggaaccgttgaccatcttgtactatgtgggaaggactccaaaagtcgaacagctttcgaacatggtggtgaagtcctgcaagtgttcc

SEQ ID NO: 20179 - DNA, 1236 bp, Artificial Sequence
  Description of Artificial Sequence: Synthetic coding sequence
atgaaaatgcacctccagagggccctcgtggtgttggccttgctcaactttgccactgtctccctctccctgtctacttgtacaactctcgactttggccacattaaaaagaagagggtggaggccattagaggtcagattttatccaagctgcgactcacctctcctccagaacccacagtaatgacccacgtgccgtatcaagtgctcgcactgtacaattccacaagagaactcctcgaagaaatgcacggcgaaagggaggaggggtgcacacaggaaaacacagaatcggagtattatgcaaaggaaatccacaagttcgatatgatacagggactggccgagcacaacgagctcgccgtgtgccccaagggcattacatcgaaggttttcaggttcaatgtgtcaagcgtcgaaaagaatcggacaaatctgtttagggctgagttcagggtgcttcgtgtccctaatccttcatccaaacgcaacgagcagaggatcgagctatttcagatattgcgtcccgacgagcatatcgctaagcagagatacatcggagggaagaatctgcccactcggggcaccgcagaatggctgagcttcgacgtgacagatacagtgcgcgagtggctgctgcgtagggagtccaacctcggtttggagatatcgatccattgcccatgtcatacatttcaacctaacggcgatatcttggaaaacatccacgaagtcatggagattaagttcaagggcgtagataacgaggatgaccatggaagaggggacctgggccgcctgaaaaagcaaaaggaccaccataaccctcacctgatcctcatgatgatcccaccccaccgcctagacaaccctgggcaggggggacagagaaagaaacgtgcactggatacaaattactgctttcggaacctcgaggagaactgttgcgtacgaccattgtatatagacttccggcaagacctaggttggaaatgggtccacgagcccaagggatactacgctaacttctgctccggtccatgcccgtacctcaggtcagcggacacgactcattcaactgtgttgggtctctacaacacattgaaccccgaggctagcgcaagtccatgttgcgtgcctcaagatctggaaccacttacgatactttactatgtgggacggacccccaaggtagagcagctgtcaaacatggtggtaaagtcttgcaagtgctcc

SEQ ID NO: 20180 - DNA, 1236 bp, Artificial Sequence
  Description of Artificial Sequence: Synthetic coding sequence
atgaagatgcacttgcagagggctctggtcgttctggcgctgctgaatttcgcgactgtttcactgtccctcagcacttgtaccactctcgactttggacacattaagaaaaaacgcgttgaggccattcgcggacagatcctgagcaagctgcggctcactagccctccagaaccgactgtgatgactcacgtgccctaccaggtcctggcactgtacaactcgactcgcgaactgcttgaggagatgcacggggagcgggaggaaggatgcacccaagaaaatacggagtccgaatactacgcaaaggaaatccacaaatttgacatgatccagggactggccgaacataatgagctggcggtgtgccccaagggcatcacgtccaaagtgttccggttcaacgtgtccagcgtggaaaagaatcgcaccaatctgttccgcgctgagtttcgcgttctccgcgtcccgaacccgagttccaagagaaacgaacagcggatcgaactttttcagatcctgcgcccggacgaacacatcgcgaagcaacggtacattggcggcaagaatctcccgacgaggggcaccgcggaatggttgtcgtttgacgtcaccgacaccgtgcgcgagtggctgctccgacgggaatccaacctgggtcttgagatctctatccactgcccatgccataccttccagccgaatggagacatcttggagaatatccacgaagtcatggaaatcaagtttaagggcgtggacaacgaggatgaccacggtcggggtgacctgggccgtctgaaaaagcagaaggaccatcataacccccacctcatcctgatgatgatcccgcctcaccgcctcgataatcctgggcaaggtggccagagaaagaagagggcactggataccaactactgcttccggaaccttgaggagaattgttgcgtgcggccactgtacatcgattttagacaggacctggggtggaaatgggtgcacgagcccaagggatactacgccaacttctgttccgggccctgcccgtacttgagatctgcagataccacccactccacggtcctcggactctacaataccctcaacccagaggctagcgcatccccgtgctgcgtaccgcaggacctggaaccacttactatcctttactacgtggggcgcactcctaaggtcgagcaactctcgaacatggtcgtgaagtcgtgcaagtgctcg

SEQ ID NO: 20181 - DNA, 1236 bp, Artificial Sequence
  Description of Artificial Sequence: Synthetic coding sequence
atgaagatgcaccttcaacgggccctggttgtgctggccttgctcaatttcgccactgtctcactgagcctgtcgacttgcaccactctcgattttggtcacattaagaagaaaagagtcgaagcaatcagaggacagatcctgtcaaagctccggctcacctccccgccggaaccaactgtcatgacccacgtgccataccaggtcctcgccctttacaacagcacccgcgaactgctggaggagatgcatggagaacgggaggagggctgcacccaggaaaacaccgaatcggagtactacgccaaggaaattcataagttcgacatgatccaaggactggccgaacataatgaactggcggtgtgcccgaaaggcatcacctccaaggtgtttcgcttcaatgtctcctccgtcgagaagaaccgcactaacctgtttcgggctgaattccgcgtgctgcgagttcccaacccgtcgtccaagcgaaatgaacaaagaatcgaactgttccagatcctgcgaccggatgagcacatcgcgaagcaacgatacatcggaggcaagaaccttcctaccaggggaaccgctgagtggctgtcctttgacgtcactgacaccgtgagagaatggttgctgcgcagagaatctaacctgggactcgaaatttccatacattgcccctgccacacttttcagccgaatggcgatatcttggaaaacatccacgaagtcatggaaatcaaattcaagggtgtcgacaacgaagatgatcatggcagaggtgacttggggcggctcaagaagcagaaagaccatcacaatccgcatctcatcctcatgatgatcccaccgcacagactggataacccaggacaggggggccagagaaaaaagcgcgcactggacaccaactactgcttccggaacctcgaagaaaattgttgcgtccggccactgtacattgacttcaggcaggacctgggatggaaatgggtgcatgagccgaagggctattacgccaacttctgctcaggaccgtgtccgtacctgcgcagcgccgataccacccactctactgtgctcgggctctacaacaccctgaacccagaagcgtccgcgtcgccgtgttgcgtgccacaagatctcgagccgctcactatcctgtattacgtgggacgcaccccgaaagtggagcagctctcaaacatggttgtgaaatcatgcaaatgttca

SEQ ID NO: 20182 - DNA, 1236 bp, Artificial Sequence
  Description of Artificial Sequence: Synthetic coding sequence
atgaaaatgcacctccaaagagcccttgtggtgcttgccttgctgaatttcgcaaccgtgtcactctcactgagcacctgtactacgctcgattttggccacataaagaaaaaacgggtggaagcaatcagagggcagatcctcagcaaactgcggctgactagccctccagaaccaaccgtgatgacccatgtgccctatcaagtcctggctctgtacaactcaaccagagaacttctggaagaaatgcatggtgagagagaggaaggatgtacccaggagaatactgagagcgaatactacgcgaaagaaatacataagtttgatatgattcagggtttggctgagcacaacgaactcgcagtgtgtcctaagggaattacttccaaagtgtttagattcaatgtctcttccgtggaaaagaataggacgaacctctttagagccgagttcagggtgctgcgtgtgcccaatccgtccagcaagcgcaatgaacagcgcattgaactgttccagatcctgcgtccagacgagcatatcgcaaaacagcgttacatcggtgggaaaaacctgcctactagagggacggccgagtggctgtcattcgatgtcactgatactgtccgggaatggctgttgcggcgggagtcgaaccttggactcgagatatctattcattgtccatgccatacctttcaacccaacggtgacatcttggagaatatccacgaagtgatggagattaagttcaagggggtggataatgaagatgaccatggcaggggagatctcggtagactgaaaaagcagaaggatcaccacaacccgcatcttatccttatgatgatacctccacacagactcgacaacccggggcagggaggccaacgaaagaagcgggcactcgataccaactactgttttagaaatcttgaagaaaactgctgtgtgcgtcctttgtacattgattttcgtcaagatctgggatggaagtgggtgcatgagcctaagggatactatgcgaacttctgttcagggccctgtccctacctgcgaagcgctgatactactcatagcaccgtgctgggtctgtacaacacccttaatcctgaggcctccgcctccccctgctgtgtgccgcaagacctggaaccactcactattctgtactacgtcggacgcactcctaaggtggagcagctttccaacatggtggtcaagtcatgtaaatgcagc

SEQ ID NO: 20183 - DNA, 1236 bp, Artificial Sequence
  Description of Artificial Sequence: Synthetic coding sequence
atgaagatgcacctgcagcgggcactggtggtccttgcattgctgaatttcgctaccgtgtcactgtcactttcgacgtgtaccactctggactttggacacattaagaagaaacgggtggaagcaatcaggggtcagatcctttccaaattgcggttgacctctccacctgaacctactgtgatgacccatgtgccttaccaagtgctggccctgtacaattcaaccagagagctccttgaggaaatgcatggagaacgtgaggaaggatgtacccaagaaaacaccgaatccgagtactacgcaaaggaaattcacaagtttgacatgatccagggacttgccgaacacaacgaactcgcggtctgtccaaaagggatcacttccaaggtgtttcgcttcaatgtgtcctcggttgaaaagaataggactaacctgttccgcgcagaatttcgagtgctgagagtgccgaacccatcctccaagcgcaatgagcaacgaatcgagctttttcagattcttagacctgacgagcacatagcaaagcagaggtatattggaggcaaaaaccttcccacccggggtaccgctgagtggctgtccttcgacgtgaccgatactgtgcgagagtggctcctgagacgagaatcaaaccttggtcttgaaatatcaattcactgcccgtgtcatacctttcaacccaacggagacatcctcgaaaacatccatgaggtgatggagatcaaattcaaaggagtggataatgaggatgatcacggacgaggtgacctgggtagactcaagaagcaaaaagatcatcacaatccgcaccttatcctgatgatgatcccaccacatcggctggataatcctggacaaggtggacaacggaagaagcgtgcgcttgacacgaactactgtttcagaaaccttgaagaaaactgttgcgtgaggcccctttacatagattttcgccaggatcttggttggaagtgggtgcatgaacctaaagggtattacgcgaacttttgctcgggcccttgtccttacctgaggtcggcagacactacccactcgactgtgctgggactgtacaataccctgaacccagaggcctcagcctccccatgttgcgtgccccaggatcttgaacccttgactatcctctactacgtcggcagaacccctaaggtcgaacaactttcgaacatggtggtgaagtcgtgtaagtgtagc

SEQ ID NO: 20184 - DNA, 1236 bp, Artificial Sequence
  Description of Artificial Sequence: Synthetic coding sequence
atgaaaatgcaccttcaacgagcccttgtcgtgctggcccttctgaactttgcaaccgtttcgctgagcctctcaacctgtaccactcttgatttcggacatatcaagaagaagagggtcgaagcaatccgcggtcagattctgagtaagctgagactcacctccccaccggaacctaccgtgatgacccatgtgccttaccaagtgctcgcactttacaacagcactcgcgaacttctggaagaaatgcacggggaaagggaggagggatgcacccaggagaacaccgagtcggaatactacgcaaaagaaatccacaaattcgacatgattcaaggtctggcagaacacaatgagctggccgtctgtcctaagggcatcacttcaaaagttttccgctttaacgtgtcgtccgtggagaagaacagaaccaaccttttccgcgcggagtttagagtcctgcgtgttcctaatccttcctcgaaaagaaacgagcagaggatcgagttgtttcagatcctcagacccgatgagcatatagctaagcagcgatacattggggggaaaaatctgccaactaggggaaccgccgagtggctgtcgtttgatgtcactgatactgtccgggagtggctgcttagaagagagtcgaatctggggctcgagatcagcattcattgcccctgtcacaccttccaacctaatggagacattctcgaaaacattcatgaagtgatggagattaagttcaagggagtggataatgaggacgaccatggaagaggtgaccttggacgcctgaaaaaacaaaaggaccatcataatccacatttgatccttatgatgatccctccccaccgtctcgacaatcctggacagggaggacaacggaaaaagcgggcactggataccaattactgttttcgcaaccttgaagaaaactgctgcgtgcgccctctctatatcgactttagacaggatctcggatggaaatgggtgcatgaacccaagggttactatgcaaatttctgttcaggtccatgtccatacctcaggagcgcagacaccacccactccactgtgctgggcctttacaataccttgaaccccgaagcatcagcgtcaccttgctgtgtgcctcaggacctggaacctttgaccatcttgtactacgtcggacggacccctaaggtggagcagttgtccaacatggtcgtcaagtcatgtaagtgtagc

SEQ ID NO: 20185 - DNA, 1236 bp, Artificial Sequence
  Description of Artificial Sequence: Synthetic coding sequence
atgaagatgcatctgcagagagccctggtggtgttggccctcctgaatttcgcgactgtttctctgagtctgagtacttgtaccactcttgattttggtcatattaagaaaaagcgcgtcgaagcgattcgcggccaaatccttagcaagcttaggctcacttctcctccagagccaactgtgatgacgcacgttccttatcaagtcctggccctatataattctacacgagaactgctggaagagatgcatggagaacgtgaagaaggttgcacgcaggagaacacggagagcgaatattatgcgaaagagatccacaaatttgacatgattcaaggtctcgccgagcataacgaacttgccgtctgcccaaagggtattacaagcaaggtatttcgctttaacgtaagcagcgtcgaaaagaaccgtaccaatctgtttcgagctgagtttcgcgtcctgagggtcccgaatccttcgagcaagcgcaatgaacaacgaattgaactgtttcagatcctgcgtccggatgagcatatcgcaaagcagcgctacatcggcggtaaaaacctgccgactcgggggaccgcagagtggctgagtttcgacgtgaccgacaccgtgcgggagtggctgttgcgcagagaaagcaatctgggcttggagattagcattcattgtccgtgccataccttccaaccgaacggtgatatcctggagaacatccacgaggtcatggagattaaattcaagggtgttgacaatgaggacgaccacggacgtggagatctaggtcgtctcaagaaacaaaaagatcatcacaatcctcatctgattctgatgatgatcccgcctcaccgcctggacaaccctggccaaggtggtcaacgcaagaagcgagctctggatacaaattactgctttcgcaacctggaggaaaactgctgtgttcgcccgttgtatatcgacttccgccaggatcttggttggaaatgggttcacgagccaaaaggatattatgccaacttctgtagcgggccgtgtccgtaccttcggagcgcggatactacccacagcactgtgttaggtctatataacactctgaatcctgaggcgagcgcgtctccatgctgcgttccgcaggatctggagccactgaccattctgtattacgtgggtcgcacccctaaagtggagcagctcagcaatatggtggttaaatcctgcaaatgcagc

SEQ ID NO: 20186 - DNA, 1236 bp, Artificial Sequence
  Description of Artificial Sequence: Synthetic coding sequence
atgaagatgcacctgcagcgggcgctggtcgttctggcgctgcttaactttgcaaccgtgagcctcagcctctcgacttgcaccacccttgactttggccatatcaaaaagaagagggtcgaggccatccgggggcaaatcctgtcaaagctgcgactgacctcgccgccagagcctacggtcatgactcatgtcccataccaggtcttggctctttacaactccactcgtgaactcctcgaagaaatgcatggagagagagaagaagggtgcacccaagagaacactgagtcggaatactatgctaaggaaatacataagttcgatatgattcagggactggccgaacataatgagcttgcggtgtgcccaaaaggtatcacctcgaaagtgttcagattcaatgtgagctcggtggagaaaaaccgcacgaatctctttcgagcagaattcagagtgctgagggtgcctaacccctcgtcaaagcggaacgagcaaaggattgaactgttccagatccttagaccagatgaacacatcgcgaaacagcggtacatcggaggcaaaaacctccccactcggggaactgccgagtggctgtcattcgacgttaccgataccgtgcgcgaatggctgcttcgccgtgaatctaatcttggactcgaaatctctatccactgcccgtgccacactttccagccaaacggtgacattcttgagaacatccacgaagtgatggaaatcaaattcaagggagtggataatgaggacgatcacgggcgcggcgaccttggaagattgaagaagcagaaggatcaccataatccacatctcatcctgatgatgatcccgcctcaccggctggacaacccgggccagggtggacagcggaagaagagagcgctcgacactaactactgctttcggaatctcgaggaaaactgctgcgtcagaccgctgtacattgacttcaggcaagacctgggatggaaatgggtccacgagcccaagggatactacgccaatttctgttcgggcccctgtccttatctgcgcagcgcagacaccacccactccacggtgctgggattgtacaatacgctcaacccagaggcatcggcctccccgtgctgcgtcccacaagatttggagccccttaccatcctctactacgtggggcgaactccgaaggtggaacaactgtctaacatggttgtgaaaagctgtaagtgttcc

SEQ ID NO: 20187 - DNA, 1236 bp, Artificial Sequence
  Description of Artificial Sequence: Synthetic coding sequence
atgaagatgcacctgcagcgggccttggtggtcttggctctgcttaacttcgccaccgtcagcctttccctgtcgacctgtaccactctcgatttcgggcacatcaaaaagaagagggtcgaagccatccgcggtcagattctgtcgaaactgcgcttgacttcgccaccagaaccaaccgtgatgactcacgtgccataccaggtgctggctctctacaactcgactagagagctgctcgaagagatgcatggagaacgcgaagaggggtgcacgcaggaaaatactgaatccgagtactatgcgaaggaaatacacaagttcgacatgatccagggattggctgagcataacgagctggcggtgtgcccaaagggaattacttcgaaggtgtttcggttcaacgtgagctcggtggaaaagaaccggaccaacctgttccgcgcggagttccgggtgctccgagtgccaaatccatcgtcaaagcggaacgaacagcgcatcgaactgtttcaaatcctgcgcccggacgaacatatcgccaaacaacgctacatcggaggcaagaatcttccgaccaggggaactgctgagtggctctcgtttgatgtgactgacaccgtccgtgaatggctgctccgtagagagagtaatctgggactcgagatctccatccattgcccatgccatacttttcagccgaacggcgatatcttggagaatattcatgaggtcatggagatcaagttcaagggagtggacaacgaggatgaccacggaagaggagatctgggtcgtctgaaaaaacagaaggaccaccacaacccgcacctcatcctcatgatgatcccgcctcacaggctcgacaatccgggacagggtggccagcgaaagaagcgggccctggatactaattactgcttccggaacctggaagagaactgctgcgtgcggccactctacatcgactttcggcaggacctcgggtggaaatgggtgcacgagcccaagggatactacgccaatttctgctccggcccctgcccgtacctgagatcagccgataccactcattccaccgtgctgggactttacaacactctgaatccggaagcatcggcgagcccgtgctgtgtccctcaggatctggaaccactgactatcctctactacgtgggaaggactcctaaggttgagcagctgtctaacatggtggtgaagagctgcaagtgctcg

SEQ ID NO: 20188 - DNA, 1236 bp, Artificial Sequence
  Description of Artificial Sequence: Synthetic coding sequence
atgaagatgcacctgcaacgagccctggtggtactggctctgctgaattttgctacagttagcctgtctctgtccacatgtaccactctggattttggacacataaaaaagaaaagggtcgaagcaatcaggggacagattctttctaagctgagacttacctctcctccagagcctaccgtgatgacccacgtgccatatcaggtgctggccctgtataatagcacgagagagctcttggaagagatgcatggagaacgcgaggagggctgcactcaggagaatactgagagcgagtactatgccaaggaaatccacaaattcgacatgatccaggggctggctgagcacaacgagctcgcagtgtgcccaaaaggaatcaccagcaaggtgtttcggttcaatgtttcttccgttgagaaaaacaggaccaacctcttccgggctgaattcagagtcctcagagtcccgaatccatcctccaagcgtaatgaacagcgtattgaactgttccaaattttgaggcctgacgagcacatcgctaaacagcggtacatcgggggcaagaatcttccaactagggggacagccgagtggctctctttcgacgtgacggataccgtaagggagtggttgctgagaagggaatcgaacctgggcctggagatatcgattcactgtccctgtcacacctttcagcccaacggcgacatcctggagaacattcacgaggtgatggaaatcaagtttaaaggcgtggacaacgaggatgaccatggcaggggcgatctcggacgactgaagaagcagaaggatcaccataatccacatctcatcctgatgatgataccgccgcatagactggacaatcctgggcaaggcggccagcggaagaagagagctctagatacgaattattgcttcaggaacctcgaggaaaactgttgcgtccgacctctgtatattgactttcggcaggacctgggctggaagtgggtgcatgaacccaaagggtattatgccaacttctgcagcggaccatgtccataccttcgttcagctgatacgacccacagcacggtgctgggattatacaacacactgaatcccgaggcttctgcaagcccttgctgtgttccccaggatcttgaacctctgacgatcctatactacgtaggacggactcccaaagttgagcaactgagtaacatggtcgttaaaagctgtaagtgttcc

SEQ ID NO: 20189 - DNA, 1236 bp, Artificial Sequence
  Description of Artificial Sequence: Synthetic coding sequence
atgaagatgcacttgcagagggcgttggtcgtgcttgcacttctgaacttcgccactgtgtcactgtcgttgagcacctgcaccactctggactttgggcacatcaagaaaaagcgggtcgaagctatacgtggacagattttgtccaaacttagactgaccagcccacctgagcctactgtgatgactcatgtgccttaccaagtgcttgcattgtacaatagcacccgtgaactgctcgaagaaatgcatggagaaagagaagagggctgcacccaagaaaacaccgagtccgagtactacgctaaggaaattcacaaatttgatatgattcagggactcgcagaacataacgagttggccgtttgtcctaagggaatcacctccaaagtgttccgctttaatgtgtcaagcgtggaaaagaaccggaccaatctgttcagagcagaattcagagtgctcagagtccctaatccatcctcgaagagaaatgagcaacgcatcgaactctttcaaatacttcgccctgatgagcacattgccaagcagaggtacattggcggcaagaaccttcccaccagaggcacggcagaatggcttagctttgacgtgactgacaccgtgcgtgaatggctgctgcgtcgcgaatcgaacctggggctggagatatccatccattgtccttgtcatactttccaaccaaatggtgatattctggaaaacattcacgaagtcatggaaatcaagttcaagggtgtcgataacgaggatgatcacggacggggtgatttgggaagattgaaaaagcagaaagatcaccataacccacacctgatcctgatgatgatccctccccatagactcgacaaccctggtcaaggtggacaaaggaagaagagagcactggacactaactactgttttagaaacctggaggagaattgttgcgtgcgcccactttacattgactttcgacaagacctcgggtggaagtgggtgcatgaacctaaaggctattacgcaaacttctgttctggcccttgtccttacctgagatctgcagataccacccattcgacggttctgggactttacaacaccctcaaccctgaagcatcggcatccccgtgctgtgtgccacaagatttggagcctctcactatcctctactacgtcggtcgtaccccaaaggtggaacagctctcaaatatggtggtcaagtcgtgcaaatgctcg

SEQ ID NO: 20190 - DNA, 1236 bp, Artificial Sequence
  Description of Artificial Sequence: Synthetic coding sequence
atgaaaatgcatctccagagagccttggtagtcctggccctccttaatttcgccaccgtgagcctatccctcagtacgtgcacgaccctcgacttcggccacattaaaaagaagcgggtggaagccatacgaggccagattctgtctaagttacgtcttacctctcctccagaacccaccgtgatgacgcacgtgccataccaggttctggccctgtataatagtacgagggaactgctggaggagatgcacggcgagagagaagagggttgtacccaggaaaacaccgagagcgagtattatgcaaaagaaatacataaatttgacatgatccagggactagcagaacacaacgagttggcagtgtgcccgaaaggcatcacgtccaaggtattccgcttcaatgtgtccagcgttgaaaaaaatcgtaccaacctgtttcgggccgaattcagagtcctgcgcgtgcccaatccaagctctaagcgcaacgagcagcgaatcgagctgtttcagatcttgagacccgacgagcacatcgctaagcagcgttacataggcggaaagaacttgcctacccgcgggacggcggagtggctaagctttgacgtgaccgacaccgttcgagagtggctgttgaggcgtgagagcaacctgggcctcgagatttctatccattgcccttgccataccttccagcctaacggtgacatcctcgaaaatattcatgaggtgatggaaattaagttcaagggggtggacaacgaggatgatcacggacgcggtgacctgggtcgtctgaagaaacaaaaggaccaccataacccccatctgatcctgatgatgatcccaccacacagactggacaaccccggtcaaggaggccagcggaaaaagagggctctcgacaccaattattgctttcggaatctggaggagaactgctgcgtgagaccactttacatagactttagacaggatctcggctggaagtgggtccacgagccaaaggggtattacgcaaatttttgttccgggccatgtccctatcttaggtcagcggacaccacccatagtactgtgctgggactttacaacacactcaaccccgaagcttccgcctctccatgctgcgtgccacaggatctcgaacccctcacgatcctgtattatgtgggtaggaccccaaaggtagaacagctatccaacatggtagttaaatcttgcaagtgctcc

SEQ ID NO: 20191 - DNA, 1236 bp, Artificial Sequence
  Description of Artificial Sequence: Synthetic coding sequence
atgaagatgcacctgcagcgggccctggtggtccttgctctgctgaatttcgccacggtgtcgctgtccctgtccacctgcactactctggacttcggccacatcaagaagaagcgggtagaggcgatccggggtcagatcctttcaaagctcaggcttacctcgcctcccgagccgaccgtgatgacccacgtgccatatcaagtccttgctctctacaactcaactagagaactgcttgaggaaatgcatggtgagcgggaagaagggtgcactcaggaaaatacggagtcggaatactacgccaaggaaatccacaagttcgacatgatccaagggctggcagaacataatgaactggccgtgtgcccgaaaggtatcacctcgaaggtgtttcgtttcaacgtgtcaagcgtcgaaaagaatcgcacgaacctgttcagagcggagttccgagtcctccgggtgccgaatccttcctcaaagaggaacgagcagcgcatcgaactgttccagatcctgcgacctgacgaacatattgcgaaacagagatacatcggcggaaagaacttgccgacccgaggcactgcggaatggctctcattcgatgtcactgatactgtcagggaatggctcctcaggcgggaatcgaatttgggcctggagatctctatccattgcccgtgccacacctttcagccaaatggggacatcttggagaacatccacgaggttatggaaatcaaattcaagggcgtggacaatgaggatgatcacggtcgcggcgatttgggccggctgaagaagcaaaaggaccaccataacccacacctgatcctgatgatgatcccgccgcaccgcctcgataacccgggacaaggaggacagcgcaaaaagcgggcacttgacaccaattactgcttcaggaacctggaagaaaactgctgtgtgaggccattgtacatcgactttcggcaagacctgggctggaagtgggtccacgagcctaagggatactacgcgaacttttgctctggaccatgcccgtacctgcggagcgctgacaccacccattcaactgtccttggactgtacaacaccctgaacccggaagcgtccgccagcccttgctgcgttcctcaggacctggagccgctcaccattctgtactacgtgggccggactccaaaggtggaacaactctcgaacatggtggtcaagtcatgcaagtgttca

SEQ ID NO: 20192 - DNA, 1236 bp, Artificial Sequence
  Description of Artificial Sequence: Synthetic coding sequence
atgaagatgcacctgcaacgggccctggtcgtcctggcacttctcaatttcgcaaccgtctccctgtcactctcaacttgtacgacgctcgactttggacacataaagaagaaacgcgtcgaggctatccggggtcagatcctctcgaagctgcggctgacttcaccgcccgaaccaacggtgatgactcacgtgccgtaccaggtcctggccttgtacaattcgacccgcgagttgctcgaggagatgcacggagagcgggaggagggatgtacccaagagaacactgaaagcgaatactatgccaaagagatccataagttcgatatgattcaggggctggccgaacataatgaactggctgtgtgcccgaagggaatcacttccaaagtttttcgcttcaacgtcagctcggtggaaaagaatcggactaatttgttccgggcagaattccgtgtgctgagggttccgaatccctcgtccaagcgcaatgaacagaggatcgagcttttccagatccttagaccagacgaacacatcgccaagcaaagatacatcggcggcaagaacctgccgaccagagggactgccgaatggcttagcttcgacgtgaccgacactgtgcgggagtggctcctgcggcgcgaatctaacctggggctggaaatctccatccactgcccgtgccacaccttccagcccaatggcgacatcctcgaaaacatacacgaagtgatggagatcaaattcaagggggtcgataacgaagatgatcacgggcgcggcgacttgggcagactgaagaagcaaaaagaccaccacaacccccatctcatccttatgatgatcccaccgcaccgactcgacaatccaggacaaggcggacagcgaaagaagagggccctggacaccaactactgctttaggaacctggaggagaactgctgcgtgcggccgctgtacatcgattttcggcaggacctgggatggaagtgggtgcacgagccgaagggctactacgcgaacttctgcagcggtccctgcccgtacttgcgctcggcggacaccacccactcgactgtcctgggactgtataacactttgaacccagaagcctctgccagcccatgctgtgttccgcaggaccttgaacctttgaccatcctctattacgtcggaaggacccccaaggtggaacaactgtccaatatggtggtcaagagctgtaagtgctcg

SEQ ID NO: 20193 - DNA, 1236 bp, Artificial Sequence
  Description of Artificial Sequence: Synthetic coding sequence
atgaaaatgcatcttcagcgtgcgctagtcgtgctcgccttgctcaatttcgcgaccgtgagtctaagcctgagtacgtgtacaacactcgactttggacatataaaaaagaaaagagtggaagctatccggggccaaattctgtctaaactgcgcctgacgtccccgccagaacccaccgttatgacccacgttccataccaggtgctggcgctatataactccacacgggagctgctcgaggagatgcacggggagcgggaggaaggatgcactcaagaaaataccgagagcgagtactatgccaaagagattcataaattcgatatgattcagggattggcggagcacaacgaactggctgtctgtccgaaggggatcacatctaaggtttttcgattcaatgttagctctgtggaaaagaaccggacgaacctgtttagagccgagttccgagtgctgagagttcccaacccttcttcaaagcggaacgagcaacgcattgagctgttccaaatattgcgtcctgatgaacacattgctaagcagcgctatattggcgggaaaaatcttcctacaaggggaactgccgaatggctcagttttgacgtgacagacacggtacgagagtggcttttacggcgcgagtcgaatctcggactggaaatttctattcactgcccttgccatacattccagccaaatggggatatcttggaaaacatccatgaggtgatggagatcaaattcaaaggcgttgacaatgaggacgatcacggacgcggagacctgggccggctgaagaaacagaaggaccaccataatccacacctgattttgatgatgatacccccccatagactggataatcctggacaggggggccagcgcaagaaacgtgctctcgacaccaactattgcttcagaaatctagaagaaaattgctgcgtaagacccctttacatagattttcggcaggatctgggttggaagtgggtgcacgagcccaaaggatattatgctaacttctgcagtggtccctgcccatatctccgatccgccgacaccacacacagtactgtgttgggcctgtataacacgctaaaccccgaggcctcagcttccccttgctgtgtgccccaggatttagagcccctcacgattctatattacgttggaaggacgccaaaagtggagcagttgtctaatatggtggtgaaaagctgcaagtgctct

SEQ ID NO: 20194 - DNA, 1236 bp, Artificial Sequence
  Description of Artificial Sequence: Synthetic coding sequence
atgaaaatgcatttgcaacgcgcattggtggtactcgcgctgctaaatttcgcaactgtttctttgagtttgagcacctgtaccacacttgacttcgggcacattaagaaaaagagggtggaagctatccgcggacagatactgagtaagctgaggcttacatcgccccctgaacctaccgtaatgacgcacgtaccctatcaggtgctggccttgtacaacagtactcgagaactattggaggaaatgcacggcgaacgcgaggaggggtgcacccaggagaacacagagagtgagtactacgctaaggagattcacaagtttgatatgattcaaggtttggcggagcacaatgaactggccgtgtgtcccaagggaataacgagtaaagtgtttcgctttaatgtgtctagcgtggaaaagaaccgtaccaatctgttcagggcagaattccgagttctccgggtgccaaacccgtccagcaagcgaaatgagcagagaattgagctcttccaaattcttagacccgatgagcacatcgcgaagcagcggtacatcggcggcaaaaatctgcccaccaggggaactgccgaatggctttcctttgacgtgacagatacagtgcgagaatggctgcttaggagggagagtaatctgggcctggagatctctattcactgcccctgccacactttccaacccaatggggacattctggagaatattcatgaggtgatggagatcaagttcaaaggtgtggacaacgaggacgaccatggtcggggtgatctagggagacttaaaaagcagaaggatcatcacaatccacacttgatacttatgatgattccgcctcatcgcctggacaatccggggcagggggggcagagaaagaaacgggcactggacacgaactactgcttccgtaatctggaagagaactgttgcgtgcgacctctgtatatagactttagacaggatctgggctggaagtgggtccatgagcccaagggctattacgcaaatttctgtagcggtccgtgtccgtacctccgcagtgccgacaccacgcacagtacagtgctcggcctgtacaacacgttgaacccagaagcaagcgccagtccatgttgcgttccgcaagatctcgagccgttgacgattctctattatgtcggacgtacaccaaaggtggagcagcttagcaacatggtcgtgaagtcatgtaagtgttcc

SEQ ID NO: 20195 - DNA, 1236 bp, Artificial Sequence
  Description of Artificial Sequence: Synthetic coding sequence
atgaagatgcatctacagcgggccctcgtggtgctcgccctgctcaacttcgctacagtgtcactgagcctctcgacatgtacaaccctggatttcggccacatcaaaaaaaagcgtgtagaggcaatcaggggccagatcctaagtaagctgcgtcttactagccctccggagcccaccgttatgacacatgtcccctatcaggttctggccctgtataattccaccagggaactgttggaggaaatgcacggcgaaagagaagagggatgtacacaggagaacactgagagcgagtactacgcaaaggagatccataagttcgatatgatccaagggttggccgagcataacgagctggctgtctgtccaaagggtattacatccaaggtgttcagatttaatgtctcaagtgtggaaaagaatcgcacaaatctgttcagggctgaatttcgcgtgctgcgtgtccctaatccctccagcaagagaaatgagcagcgcatcgaactttttcagattctaagacctgatgaacacatcgctaaacagcggtacatcggcggcaagaacctgccaacaagaggaaccgcagagtggttgagtttcgacgtcacagatactgtacgggagtggctgttgaggcgcgagagcaacctgggtcttgagatctccatccactgcccgtgccacaccttccaacctaacggcgacatcctcgagaatattcacgaagtgatggaaataaagttcaagggggtggacaacgaagatgatcacgggcgcggtgacctgggccggcttaagaaacagaaagaccaccacaacccacacctgatcctgatgatgattcctccccacagactggacaatcctgggcagggaggacagcgaaagaaacgggctctggatactaattactgtttcaggaatctggaggagaattgttgcgttaggcccctatacatcgacttcaggcaagacctcggatggaaatgggttcatgaaccgaaggggtattacgccaatttttgttctggcccttgtccttatttgagaagtgcggatacaactcacagcacagtactgggcttgtataacactctgaaccctgaggcctctgctagcccttgttgtgttcctcaagacctcgagccgctcaccattttgtactatgtcggtagaactccaaaggtagagcagttgtctaacatggtcgtcaagtcctgcaaatgttct

SEQ ID NO: 20196 - DNA, 1236 bp, Artificial Sequence
  Description of Artificial Sequence: Synthetic coding sequence
atgaaaatgcaccttcagcgcgccttagtggtcctggccctgctaaactttgctactgtgagcctaagcttgtccacctgtaccaccctcgattttggtcacatcaagaaaaagcgtgttgaagctattcgaggccaaatcctgtctaagctgaggctgaccagtccccctgagcccacagttatgactcacgtgccgtaccaagtcttagcactgtataactctacacgggagctcttagaagaaatgcacggcgagcgtgaggaggggtgcacacaggaaaacaccgaatctgagtactacgccaaggagatccacaaattcgacatgatacagggcttggctgaacacaacgagttggccgtttgtccgaagggcattacctccaaggttttcaggttcaacgtgtcctcagtggagaaaaataggaccaatctttttcgcgccgaatttagggtgctcagagtgccaaacccctcctccaagcgcaatgagcagcggatagaactatttcagattttacggccagatgaacatattgccaaacagaggtacattggtgggaagaatctccccacccgaggtaccgcggagtggttgtcatttgatgtcactgacacagtgcgcgaatggctcctgcggcgggaaagcaatctggggctggagatctccattcattgcccgtgtcacacctttcagcctaacggggacattttggagaatattcacgaggtgatggaaatcaagttcaaaggggttgataatgaagacgatcacggtcgtggcgatcttggtcggctgaaaaaacagaaagaccaccacaacccccatctcattctgatgatgatccctccgcataggctggataatcccgggcagggaggtcagcggaagaaacgcgcgctggatactaactattgtttccgcaacttggaagagaactgttgcgtgagacctctctatatcgatttcagacaagatttgggatggaaatgggtgcacgagccaaaaggctattatgcgaatttctgtagtggcccctgtccttatctaagaagtgcagacaccacccattctactgttcttggcctgtacaacaccttaaaccctgaggcaagtgcaagcccttgctgcgtgcctcaagatctggagccgctcacaattttatactacgtagggcgcacgccaaaagtggagcagctttccaacatggttgtgaaatcttgtaaatgttct

SEQ ID NO: 20197 - DNA, 1236 bp, Artificial Sequence
  Description of Artificial Sequence: Synthetic coding sequence
atgaaaatgcatctgcaacgagcattggtggtgcttgctctcctcaactttgctaccgtgagtctctccctgtctacgtgtaccacactcgacttcgggcacatcaaaaagaaacgggtggaagccatccgaggacagattctttccaagttacgactgacttccccgcctgagccaaccgtcatgacccatgtaccctatcaggtcctggccttatataactctacgcgagaactgttagaagaaatgcacggggagcgggaagaaggctgtacacaagagaacactgagtccgagtactatgctaaggagatccacaagttcgatatgatccagggccttgccgaacacaatgagctggctgtgtgtcccaaaggcattaccagcaaagttttccggttcaacgtcagttcagtggaaaagaatcgaaccaatttgttcagggccgaatttcgcgtgctgagagttcccaacccctcatcgaagagaaacgaacagcgcatcgagctgtttcaaatcctgaggccggacgaacatatcgcaaaacagaggtatattggcggtaagaacctgccgacaagaggcacggcggagtggctcagcttcgacgtgactgacaccgttagagagtggttattgagacgagagtccaacttagggctagagatcagcattcattgtccatgtcataccttccagcctaacggagatattctggaaaatatccatgaagtcatggagataaaatttaagggggttgacaacgaggacgaccacggcagaggtgacctaggacggctgaaaaagcagaaagatcatcataatcctcaccttatactaatgatgatccctcctcataggctggataatcctggccaggggggccaaaggaagaaacgggcactcgacaccaactactgcttcagaaacctagaagaaaactgctgcgttcgccctctctatattgacttcagacaggacttagggtggaagtgggttcacgaacctaaggggtactacgcgaatttctgctctggcccatgtccttatctgcggagtgcagacactactcactcaaccgttctcggactgtacaacacactcaacccggaagccagcgcctcaccatgctgtgttccacaggatctcgaacctttgaccattctgtattacgtggggaggacacccaaggttgaacaactgtctaacatggtggtcaaatcttgcaagtgttca

SEQ ID NO: 20198 - DNA, 1236 bp, Artificial Sequence
  Description of Artificial Sequence: Synthetic coding sequence
atgaagatgcatcttcagagggccctggtggtgctcgctctcctcaattttgcaaccgtcagcctttctcttagtacttgcactacactggatttcgggcatatcaagaagaaacgcgtagaagcgatccgcggacaaattttgtcaaaactcaggctgacaagcccccctgaaccgaccgttatgactcacgtaccctatcaggtgctggccctgtataatagtaccagggagttactagaggagatgcatggagaaagagaggaagggtgcacccaagagaacaccgaaagtgagtattatgcgaaagaaattcacaaatttgatatgattcagggcctggcagagcacaacgaactggccgtgtgtcccaaaggaataacatcgaaggtcttccgtttcaacgtttcttcagtcgaaaaaaatagaaccaacctgttccgggcagaatttcgcgtactgcgcgttccaaacccatctagcaaacggaatgaacagcggattgagcttttccagatcctgcgaccagatgagcatatcgcaaaacaacgctacatcggggggaaaaacctgcccacacggggtaccgccgagtggttgagtttcgacgtgaccgacactgttagagagtggctgctcaggagagagagcaatttgggcctggagatttccatccattgtccctgtcacacatttcagccgaatggggatattctcgaaaatattcatgaggtgatggaaatcaagttcaaaggcgttgacaatgaggacgatcacggccggggagaccttggccgactaaagaagcagaaggatcaccacaacccacacctgatattaatgatgatccctccgcatcgcttggataaccctggccagggtggccagcggaagaagcgggccctagatacaaactattgtttccgcaacctcgaagaaaattgctgcgtaagaccactttatatcgacttccgacaggacctcggatggaagtgggtgcatgagcccaaaggctactacgctaacttctgctccggcccatgtccttacctcagaagcgccgataccactcacagcacggtactagggctgtacaacacattgaacccagaggcctctgccagtccctgttgtgtgcctcaggacctcgaaccactcaccatcttatactatgtgggtcgcacacccaaggtggagcagctttccaatatggtcgtaaagtcatgcaagtgttct

SEQ ID NO: 20199 - DNA, 1236 bp, Artificial Sequence
  Description of Artificial Sequence: Synthetic coding sequence
atgaagatgcatctccagcgggctctggtggtgttagcgctgctgaatttcgcaaccgtaagcctctcactttcaacatgtacaactctcgacttcggtcacattaaaaaaaagcgagtcgaagccatcagaggacagatcctgagtaaactacggctgacttcaccccccgagccaacagtcatgactcatgtaccctaccaggttttggcactgtacaactcaacccgcgagctgctcgaggagatgcatggagagagggaagaaggctgtactcaggagaacacagaatcagagtactatgctaaagaaatacacaagtttgatatgattcagggcctcgccgagcacaacgagttggcagtctgccccaagggcatcacaagtaaagtgtttaggttcaacgtgagctccgttgagaagaatagaaccaaccttttcagagccgagttcagggtcctgcgcgttcccaatccctcttctaagagaaatgaacagaggatcgagctgtttcagattttaaggcccgacgagcatatcgccaagcagcgctatatcggtggcaagaacctgcccacccgggggactgctgagtggctgagcttcgatgtgaccgatacagtacgtgagtggctgctacgtcgggagtcgaacttagggctggagatctccattcattgtccctgccacaccttccagccaaatggcgacattctggaaaatatccatgaagtcatggaaattaaatttaagggggttgacaacgaggatgatcatggtcgaggagatctcgggagactgaagaagcaaaaggatcatcataacccccacctgattctcatgatgataccaccacatcggctcgacaacccagggcaaggcggccagcggaaaaagcgagctcttgacactaactattgctttaggaacttggaagaaaattgctgtgtccgccctctctacatcgattttcgtcaggacctcggttggaagtgggtacacgaacccaagggctattacgccaacttttgcagcggcccttgtccctatctgcgttcagccgatactactcatagcacggtccttgggctctacaacactctcaacccagaggcctctgcatcaccatgctgcgttccacaagacctggagcctctgaccattctctactatgtgggccgtactcccaaggtggaacaactgtcaaatatggtggtcaagtcttgtaaatgctcc

SEQ ID NO: 20200 - DNA, 1236 bp, Artificial Sequence
  Description of Artificial Sequence: Synthetic coding sequence
atgaagatgcatctgcaaagagctctcgtggtgcttgccctgttgaattttgcgacggtgtcactctccctgtcgacttgcaccaccttggattttggccatatcaaaaagaagagggtagaggcaatccgcggccaaatcctctcaaagctgcgcctcacttcaccgcccgaacccaccgtgatgacgcacgtcccttaccaggtgctggctttgtacaactctactcgcgaactgctggaggagatgcacggcgaaagagaagaaggatgcacccaggaaaacacggaaagcgaatactacgcaaaagagatccacaaatttgacatgatccagggtctggctgagcataatgagctggccgtctgcccgaaggggatcaccagcaaggtgtttcgcttcaatgtgtcctccgtggaaaagaaccggaccaacctgttcagagccgagttcagagttctccgtgtgccgaacccatcgtccaagcgcaacgaacagcggatcgaactgtttcaaatccttagaccggacgagcatattgccaaacaaagatacattggaggaaaaaacctgcctacccgaggcactgccgagtggctgtcgtttgacgtgaccgatacggtgcgggaatggctcctgagacgcgagagcaatctgggacttgagattagcatccactgtccgtgccatacgtttcaacccaatggcgacatccttgaaaacatccacgaggtcatggagatcaaattcaaaggagtcgacaacgaagatgatcacggtagaggagatctcgggcggcttaagaagcagaaagaccaccacaacccgcacctcattttgatgatgatcccgcctcatcgactggacaatcctgggcaggggggacagcgcaagaaaagagcgctggataccaactactgtttcagaaacctcgaagagaattgctgcgtgcgaccgttgtacattgacttcagacaggatctgggatggaagtgggtgcacgaacccaagggatactacgcgaatttctgcagtggaccatgtccttatctgagatcggccgacaccactcactccaccgtgctgggcctgtacaacaccctgaaccctgaagcctccgcgtcgccgtgctgcgtcccacaggatctggaacccctcacgatcttgtactacgtcggacggactccgaaggtggaacaattgtcgaacatggtggtgaagagctgcaagtgctcg

SEQ ID NO: 20201 - DNA, 1236 bp, Artificial Sequence
  Description of Artificial Sequence: Synthetic coding sequence
atgaagatgcatctccaacgggcgttggtcgtgctcgcactgctgaactttgctactgtgagcctttcgctttcgacctgtaccaccctggacttcggacacattaagaaaaaacgagtcgaagcaattcgcggccagatcctgtccaagctcaggcttacctccccgcccgaacccaccgtgatgactcatgtgccttatcaggtcctggccctttacaactcgactagggaactgcttgaagaaatgcacggggagcgggaagaaggatgtactcaggagaataccgaatcagagtactacgccaaagaaatacacaagtttgatatgatccaaggactggcggagcataatgaattggcagtctgccctaagggtattacctccaaagtctttcgttttaacgtgagctccgtagagaagaatcgaacgaatctgttccgtgctgaattccgggttcttagagtgcctaacccttcgtcgaagagaaatgaacaaagaattgaactttttcagatcttgcggcctgatgagcatatcgcaaagcagagatacattggtggaaaaaaccttcctacccgtggaaccgcagaatggctctcatttgacgttactgacactgtgagagagtggcttctccgtagagagtcgaacctgggcctggagattagtattcactgtccatgccacaccttccagcctaatggagatattctggagaacatccatgaagtgatggaaatcaagtttaagggtgtcgacaacgaagatgaccatggacggggcgatcttggacggctcaaaaaacaaaaagatcaccataatccccatctgatacttatgatgataccacctcaccgactggacaacccaggacagggtggtcaaagaaagaagcgagcactggataccaattactgttttaggaacctggaagaaaactgttgcgtacgcccgttgtacattgattttcgacaagacctgggctggaaatgggtccatgaacccaagggctactacgccaacttctgtagcgggccatgcccatacttgcggagtgcagatacgactcattcgactgtactcggtctgtacaacactctcaacccggaggcatcggcgtcaccatgttgcgtgccacaagatctcgagccgcttacgatcctttactacgtgggcaggacccctaaggttgagcaactcagcaatatggtggtgaagtcctgtaagtgttca

SEQ ID NO: 20202 - DNA, 1236 bp, Artificial Sequence
  Description of Artificial Sequence: Synthetic coding sequence
atgaagatgcatttgcaacgggccctcgttgttctggcgctgttgaatttcgccaccgttagcctctcgctgtcgacttgcaccacccttgatttcggacatatcaagaaaaagcgagtggaggcgatccgaggacagatcctttccaagctcagactgacttccccaccagagccaactgtcatgacccatgtcccctaccaggtgctcgctctctataactctacgagagaactgctggaggagatgcacggtgagcgggaagaaggctgcacccaggaaaacactgaatctgaatactacgcgaaggagatccacaagttcgacatgatccagggactggcggaacacaatgagctcgccgtgtgtccgaaagggatcacgagcaaggtgttccgcttcaacgtgagcagcgtcgagaaaaaccggaccaacctctttagggccgagttcagagtgcttagagtgcctaacccgagctcgaagaggaacgagcagcgcatcgagctgtttcagatcctgcgccctgacgaacacattgcaaagcaaagatacattggcggcaagaatctcccgacccgtggcactgctgaatggctgtccttcgatgtgaccgacactgtcagggaatggctgttgcgccgcgagtctaatctgggactggaaatctcaatccactgtccgtgtcacactttccaaccaaatggagacatactggagaacattcacgaagtgatggagatcaagtttaaaggagtggataacgaggatgatcacggccggggagatctcgggagactgaagaagcagaaagatcatcataacccacacctgatcttgatgatgattccgccgcaccggctggacaacccagggcagggaggacaaaggaagaagagggcactcgacactaattactgcttccgtaaccttgaagaaaactgctgcgtcagacctctgtacatcgactttcgacaggacctggggtggaagtgggtgcatgaaccaaagggctactacgctaatttctgctcaggaccgtgcccttacctcagatcggcggacaccacgcatagcaccgtcctgggtctgtacaacacgcttaatccggaagcctcagcctccccttgctgcgtccctcaagacctcgaaccgcttaccatcctgtattacgtgggccgcactcccaaggtcgagcaattgtcgaatatggtggtgaagtcatgtaagtgctcg

SEQ ID NO: 20203 - DNA, 1236 bp, Artificial Sequence
  Description of Artificial Sequence: Synthetic coding sequence
atgaagatgcacttgcagagggctttggtggtgctggcgttgctcaatttcgcaactgtgagccttagcctgtctacctgcactactctggacttcgggcacatcaaaaagaagcgagttgaggccatcaggggacaaatcctgtcaaagctgcgcctgaccagcccaccagaacccacggtgatgacccacgtgccataccaggtgctggccctgtacaatagcacccgcgagctcctggaagaaatgcacggcgaaagagaagaaggctgcacccaggaaaataccgagtcggagtactacgctaaggaaatccacaaatttgacatgatccagggactggcagaacacaacgagctcgccgtgtgtcctaagggaatcacgagcaaggtgttccggtttaatgtgagctccgtggagaagaaccgcaccaatttgttcagggccgagtttcgggttctccgggtgccgaacccctcaagcaaacgcaacgagcagcggatcgaactcttccagattctccgcccggatgaacatatcgccaagcagaggtacatcggtggcaaaaacctcccgacgcggggaactgccgaatggctcagcttcgacgtgaccgataccgtgcgagagtggctcctcagacgggagtcgaacctgggtttggagatctctatacactgcccatgccacacttttcaaccgaatggcgacatcctggaaaacatccatgaagtgatggaaatcaaattcaaaggagtggataatgaagatgatcatggacgcggggaccttggacgccttaagaagcagaaggatcatcacaacccacaccttatcctgatgatgatccctccacacagacttgacaaccctggtcagggaggacaacgcaagaagagggccctggacactaactactgctttagaaacctcgaagagaattgttgtgtgcgcccgctctacatcgatttccggcaggacctgggatggaagtgggttcacgaacctaagggctactacgctaatttctgtagcggaccctgcccttacctgagaagcgcagacaccacccattccaccgtgctgggactgtacaacacgttgaaccccgaggcgtccgctagcccgtgttgcgtgccgcaagacctggaaccgctgaccatcctgtactacgtgggccgcaccccgaaggtcgaacagctctcgaacatggtggtgaagtcatgcaagtgctcg

SEQ ID NO: 20204 - DNA, 1236 bp, Artificial Sequence
  Description of Artificial Sequence: Synthetic coding sequence
atgaagatgcacctccaacgcgccctcgtggtcctcgccttactgaacttcgcaacagtctccctgagtttgtctacctgtacaacactcgattttgggcatatcaaaaagaaaagggttgaggccatacgaggccagatcctatcaaaactgcgtctgacaagtccccctgagcctaccgtgatgacccacgtcccataccaggtgctcgcactttacaactctacccgggaactcctggaagagatgcatggcgaaagggaggaaggctgcacccaggaaaacacagagagtgaatactacgctaaagagattcacaagttcgatatgatccaaggactggcagagcataacgaactcgctgtgtgccctaaaggcatcacaagcaaggtcttccggttcaatgtaagcagcgtcgaaaagaaccggaccaacttgtttagagccgagttccgcgtcctgagggtgcctaatccatccagcaaaagaaacgaacagcggattgaactgttccagatcctcagaccagacgagcatattgcgaagcagaggtacattggcggtaagaacctccctaccagaggtaccgcagagtggctgagcttcgatgtgaccgacacagtgagagaatggctgctgaggagggaatccaacttgggcctcgaaataagcatacactgcccatgtcatactttccagccgaatggagacatcctcgagaacatccacgaggttatggagatcaagttcaagggagtggacaatgaagacgatcacggcagaggggatctgggccgcctaaagaaacaaaaagatcaccacaatccacacctgatcctaatgatgatcccccctcaccgcctggataatcctgggcagggggggcaacgcaagaagcgggctttggatacgaactactgcttcaggaatctcgaggaaaactgttgcgtgaggccactgtacattgactttcggcaagatctgggatggaagtgggttcacgaaccgaaggggtattacgctaacttctgctcaggaccatgcccttacttgagaagcgctgacaccacacacagcaccgtgctggggttatacaacacactgaacccggaagctagtgcatcaccttgttgcgtgccccaggatctcgagcctctcaccattctgtactatgttggccgcacccctaaagtcgagcaactctcaaatatggtagtaaagtcttgcaaatgtagc

SEQ ID NO: 20205 - DNA, 1236 bp, Artificial Sequence
  Description of Artificial Sequence: Synthetic coding sequence
atgaaaatgcacctgcaaagagcactggtggtgttggcgttgttgaacttcgcaaccgtgtccctgtcgctgtccacgtgtacgactctggattttggacacataaagaagaagagggtggaggcaatcagaggtcaaatactttctaaactgcggttgactagtcctcccgagcccaccgtcatgacccatgtcccctaccaagtcctcgcactttacaactccactagagagctgctggaggaaatgcatggagaacgcgaggaaggttgcacccaggagaacactgaatcagaatactacgctaaggaaatccataagttcgatatgattcaaggactcgcagaacataacgagctcgccgtctgtccaaagggaattacctcaaaagtttttcggtttaacgtgagctccgtcgagaagaacagaaccaatctcttccgggccgagttcagggtccttagggtgcccaatccaagctccaaacgcaatgaacagaggattgagctttttcaaattcttcgacctgacgaacacatcgccaaacaacgttacattggaggtaagaaccttccgactcggggaaccgcggagtggctctcctttgacgtcaccgatactgtgagggaatggctgcttcggcgggaatcgaatcttggacttgagatttcaatccattgcccatgccacactttccaaccaaatggtgacatacttgaaaacatccatgaagtgatggagattaagttcaagggtgtcgacaacgaagatgatcacggacgcggagatctcggtagacttaagaagcagaaagatcatcataatccacacttgatcctgatgatgattccaccgcaccgattggataacccaggacagggaggccagaggaagaagagagcacttgacactaactactgttttcgcaaccttgaagaaaattgttgtgtgcgaccactctatattgactttcgccaagatctgggatggaaatgggtgcatgaaccgaaaggatactacgcaaacttttgttcggggccctgcccttaccttcggtcagcagataccacccatagtactgtgctgggactgtacaatacccttaatcccgaagcatcggcgtcgccttgttgtgtaccccaggatcttgagccactgactatcctctactacgtgggccgtacccccaaggtggagcaactgagcaacatggtcgtcaaatcgtgtaaatgttca

SEQ ID NO: 20206 - DNA, 1236 bp, Artificial Sequence
  Description of Artificial Sequence: Synthetic coding sequence
atgaagatgcacctgcagcgggcgctcgtcgtgcttgcgcttctgaattttgcaaccgtctccctttcgctttcgacttgtacgactctggattttggacacatcaagaaaaagagggtggaggcaattcgaggacaaattctcagcaagttgcggcttacctcgcctcctgagcctactgtgatgacccatgtgccttaccaggtgctcgcactttacaattccaccagagaactgctggaagaaatgcatggtgaacgggaagagggatgcacccaggagaacaccgaaagcgaatactacgccaaggaaattcacaagtttgatatgatccaagggctcgcagaacataacgagctggctgtgtgccctaagggtattaccagcaaggtttttcgttttaacgtgtcaagcgttgaaaagaaccgtaccaacctttttagagcagaattcagagtgttgagagtgcctaatccttcctcgaagcgaaacgaacaaaggatcgagctgtttcagattttgcggcctgatgaacatatcgcaaaacaacggtacataggtggaaagaacctgcctactcgcgggactgcagagtggcttagctttgatgtgaccgatactgttagagaatggttgctgcgcagagaatccaatctgggccttgaaatttccatacactgtccctgtcatacttttcaaccgaacggagatattcttgaaaacattcatgaggtgatggagatcaagttcaagggtgtggataatgaggacgaccacggacggggcgatctcggcagactcaagaaacaaaaggaccatcataaccctcatctgatcctcatgatgatccctccgcatagactggacaatcctggacaaggaggacagcgcaaaaagcgagcacttgacactaactactgttttcgcaaccttgaagaaaattgctgcgtccgtcccctctacatagatttcagacaggatcttgggtggaagtgggtgcacgagccaaaggggtattacgcaaacttctgttcagggccatgtccatacctgagatcggccgatactacccattccactgtcctgggtctgtacaatactctgaaccctgaggcgtccgcttcgccatgttgcgtcccccaagatctggaacctctcacgatcctgtactacgtcggtaggactccaaaggtggaacaactgtcgaatatggtcgtcaagagctgtaagtgttcc

SEQ ID NO: 20207 - DNA, 1236 bp, Artificial Sequence
  Description of Artificial Sequence: Synthetic coding sequence
atgaaaatgcacctccaacgagctcttgttgtcttggcccttctgaatttcgcaactgtttccttgtctctatcaacgtgtactaccctcgatttcggccacatcaagaagaaaagagttgaagcaatccgtgggcagattctttcgaagcttagacttacatctccaccagaaccgacagttatgacacacgtgccatatcaggtcctggctttgtataactctactcgtgaactccttgaagagatgcacggagagagggaagaaggttgcacgcaagaaaacacggaatctgagtattatgctaaagaaatccacaaattcgatatgatccagggattggcagaacacaatgagttagcggtctgtccgaaaggaattacaagcaaagtcttccggtttaatgtttcatcggtagaaaaaaatcgtacaaacctctttagagcagaatttcgtgtcctgagagtaccaaaccctagctcaaaaagaaatgaacaacggatagaactttttcaaatcttgagaccggatgagcatatagctaagcaaaggtatatcggaggcaaaaatcttccaacgcgtggaacagcagagtggctttcatttgatgttacggatactgtgagagaatggcttcttcgaagagaatccaacctgggtctggaaatatctattcattgcccctgccatacttttcaaccaaatggagatattctcgagaacattcatgaagtaatggaaattaaatttaagggagttgataacgaagacgatcacggaaggggagatctaggaagattgaagaagcagaaagatcatcataacccgcatctcatcctgatgatgattccaccacatcgcctcgataatccaggacaaggcggccagcggaagaaacgtgcattggatactaattactgcttccgtaatctggaagagaactgttgtgtccgaccactttatatcgatttcagacaagatttaggatggaagtgggttcatgaaccaaagggatactatgctaatttctgctcaggaccctgtccttacttgagatccgcagatacaactcattcaactgtgctaggactttacaacactctgaatcccgaagcctctgctagtccatgttgcgttccacaagacttggagccacttacaattttatattatgtaggacgtactccaaaggtcgaacagctgtctaatatggtggtcaaaagttgcaagtgttcg

SEQ ID NO: 20208 - DNA, 1236 bp, Artificial Sequence
  Description of Artificial Sequence: Synthetic coding sequence
atgaaaatgcacctccaacgcgccttggtggtgctggctctgcttaatttcgcgaccgtatcactcagtctgagtacttgcacgaccctcgatttcggccacataaaaaaaaagcgggtggaggctatccggggccaaatactgagtaaattaagactgacttcacctcccgaacctacagtcatgactcatgttccctaccaggttctggcgttgtacaattcgaccagggaactccttgaggaaatgcacggcgaaagggaggagggctgcacacaggagaacacagagagtgagtattacgccaaggaaattcacaaatttgacatgatccagggtctcgctgaacataacgaacttgctgtgtgcccaaagggcattacatccaaggtgtttcggttcaacgtgagctccgtggagaagaaccgcaccaacttattcagagctgagttccgagtgctgcgagtacccaacccgagcagcaagagaaacgaacagcgcatcgaacttttccagatcctgaggcctgatgagcacatcgccaagcaaaggtacatcgggggcaaaaacctcccaaccagggggacagccgagtggctcagctttgatgtgacagatactgtgcgggaatggctgcttcgcagagagagtaatctgggcctggagatttccatccattgtccctgtcacactttccagccaaatggggacatactggagaacatccacgaagtaatggagattaagtttaagggggtggacaatgaagacgatcacggacgcggagacctaggccggctaaagaagcagaaagaccatcacaatccgcatctgatactaatgatgatccctcctcacaggctggacaaccccggacaaggaggtcaacggaagaagagggccctggatacaaactactgttttcgtaacttggaggaaaactgttgcgtacgaccattatacattgatttcaggcaggacctcggatggaaatgggttcacgagcctaaggggtattatgccaacttctgttctggtccatgcccctatcttcgaagcgctgataccacacatagcacggtgcttgggctatataacacattgaatccggaggcctccgcctccccttgttgtgtgccgcaggacctggaaccattgacgatcctgtactacgtaggacgaacccccaaagttgaacagttgtctaacatggtagtgaaatcatgcaagtgttct

SEQ ID NO: 20209 - DNA, 1236 bp, Artificial Sequence
  Description of Artificial Sequence: Synthetic coding sequence
atgaagatgcaccttcaacgtgcactggttgtgcttgcattgctcaacttcgccaccgtgtcgcttagcctgtcaacctgtaccactcttgacttcggccacataaagaagaagcgagtcgaagcaatccgtggacaaatcctgtccaagctgaggctgacttcaccaccagaacccactgtgatgactcacgttccttaccaggtcctcgcactttacaactcgactcgtgaacttcttgaggaaatgcacggagagcgcgaggagggctgcactcaagaaaacactgaatctgagtattacgctaaagaaattcataagttcgacatgattcaaggtcttgctgagcataacgaacttgccgtgtgtcccaaaggcattacctcgaaggtttttagattcaacgtgtccagtgtcgaaaagaatcgaaccaacctgtttcgagccgaattcagagtccttcgggtgcccaaccctagctcgaagagaaacgaacagagaatcgaacttttccagatccttcgccccgatgaacacatcgccaagcaacggtatattggcggaaagaacctgccaacgcgcggtaccgccgagtggcttagcttcgatgtgaccgatactgtgcgcgagtggcttctgcggagagaaagcaacctgggtctggagattagcattcattgtccttgccatacctttcagcctaacggagatatcctggagaatattcacgaagtgatggagattaagtttaagggcgtggataatgaagatgatcacgggcgtggcgatcttggacgcctgaaaaagcaaaaggatcatcacaacccccatctcattctgatgatgattcctccacatagactggataaccctgggcagggagggcagaggaaaaaacgcgccctggacactaactattgttttcgcaatctcgaggaaaactgttgcgtcagacccctttacatcgattttcgccaagatttggggtggaagtgggtgcacgagccaaaaggttactacgcgaatttctgttcgggaccgtgtccatacctgcgatccgcggatactacccacagcactgtgctcggactgtacaatactcttaatccagaagcctccgcatccccttgctgcgtccctcaagatctcgaacctctcaccattctttactacgtggggagaactcctaaggtcgagcaactgtcaaatatggtggtgaaatcgtgcaagtgttcg

SEQ ID NO: 20210 - DNA, 1236 bp, Artificial Sequence
  Description of Artificial Sequence: Synthetic coding sequence
atgaaaatgcacctgcagcgtgctctcgtagtgctcgcgcttcttaactttgcaaccgtgagcctttccttgtcgacttgtactactcttgatttcggacacatcaaaaagaagagagtggaggcaatcagaggacagatcctctccaagctgcgactcacttcgcctccagaacctaccgtgatgacccatgtgccttaccaagtgctggccctgtacaactcaacccgtgaacttctggaagaaatgcatggagagcgggaggaaggttgtacccaagagaatactgagtcggaatactacgccaaggaaatccataagtttgatatgatacagggactcgcagaacataacgagctggcagtctgtccaaagggaatcacgtccaaggtctttcgctttaacgtctcgtcggtcgaaaagaatcggactaacctgttccgggcagaattcagggtgcttagggtccccaacccttcctcgaagcgcaacgaacaacggattgagcttttccaaattctgaggcccgacgaacacattgccaagcaacgctacattggcggcaagaaccttccgacccgaggtaccgccgaatggctgtccttcgacgtgaccgacactgttcgggaatggctgctgagaagagaaagcaacctgggactcgaaataagcatccactgcccatgccatacctttcaacctaatggagacatcctggaaaacattcacgaagtgatggaaatcaaattcaaaggagtcgacaacgaagatgatcatggtcgcggagatctgggacggctgaaaaagcagaaagatcaccataacccccatcttattctgatgatgattccccctcatagactggataaccccggtcagggtggtcagcggaagaagcgggcactcgataccaattactgttttagaaacttggaagaaaactgctgcgtgcgcccactttacatagactttcggcaagaccttggatggaagtgggtccacgaaccgaaggggtattacgcgaatttctgctccggtccttgtccgtatctcaggtccgctgacactacgcattccactgtgctggggctctacaacaccctgaaccccgaagcctcagcaagcccgtgctgtgtcccccaggaccttgagccgcttactatcctgtactacgtgggacggactcctaaggtggagcaactgtctaatatggtggtgaagtcctgtaagtgttcg

SEQ ID NO: 20211 - DNA, 1236 bp, Artificial Sequence
  Description of Artificial Sequence: Synthetic coding sequence
atgaagatgcacctgcagcgcgccctggtggtgctggctttactgaacttcgctactgtgtccctgagtctgtccacttgcactacgctcgactttggtcatattaaaaagaaacgggtcgaggcaattcgaggacaaattctgtcaaagctgcggctgacatctcctccagaacctactgttatgactcacgtgccttaccaggtgctggcgctgtacaatagcacacgggagctgctggaggagatgcatggtgaacgggaagagggctgcacacaggagaatactgaatccgaatactacgcaaaagagattcataaatttgatatgattcagggcctggctgagcacaacgaattagccgtttgtcctaaaggaatcaccagtaaagtttttcgcttcaatgtgagctccgtggagaaaaaccgtactaatctcttcagagcagagttcagggttctccgcgttccgaatccgtcttctaaacgcaacgagcagcggattgagctgttccagattcttcggcctgacgagcacatcgctaagcagaggtatatagggggaaaaaatctaccaaccagaggtaccgccgagtggctgtcattcgatgtgacagatactgtgcgcgaatggttgctccggagagaaagcaacctgggactggaaatcagtatccactgcccgtgtcacactttccaacccaatggagacatcttggagaacattcacgaagtcatggagatcaaattcaagggcgttgacaacgaggacgaccatggtagaggggatctgggccgcttaaagaagcagaaagatcatcataaccctcacctcattttaatgatgattccaccacacagactcgacaacccaggacaggggggccagcgcaaaaaaagggcactggatacgaactactgtttccggaacctggaagagaattgttgtgttagacccctgtatatagatttcagacaggatctgggatggaagtgggtacatgagcctaaaggctattatgccaatttctgcagtggaccatgtccgtacctgaggagcgctgatacaacccactccacggtacttgggctgtacaataccttgaacccagaggccagcgcttcaccttgctgcgttcctcaggacctggagcctctgacgatcctgtattatgtgggacggacacccaaggttgagcagctgtcaaatatggtagttaagagctgtaagtgctcg

SEQ ID NO: 20212 - DNA, 1236 bp, Artificial Sequence
  Description of Artificial Sequence: Synthetic coding sequence
atgaagatgcacttacagcgagctctagttgtgctcgcactcctaaatttcgccacagtgtcgttaagtctgtctacttgcacaaccttggacttcgggcatattaaaaaaaagcgagtggaagcaatcagaggacaaatcttgtccaagttgagactgacctcgcctccagagccgacggttatgacccacgtcccatatcaagtactggctctgtataactctacgagggaactcctcgaagaaatgcatggggaacgagaggaaggatgcacacaggagaacacagagtcagaatattacgccaaggagatccacaaatttgacatgatccagggcctggccgagcataacgagcttgccgtatgcccgaaagggattactagtaaggtcttcaggtttaacgtttcctcagtggaaaagaatcggactaatcttttccgcgccgagttccgggttctgcgagtccctaatcccagtagtaaaaggaatgagcagcgaatagagctgtttcaaatcttaaggccagatgagcatattgccaagcagcgatatatcggaggaaaaaatctacctactcgcgggaccgctgagtggttgtcattcgatgttaccgacacggtccgcgagtggctcctgagaagagaaagcaacctcggtctcgagatttcaatccattgtccttgtcatacgttccaacccaatggcgacatactcgaaaacatccacgaggtgatggagattaaattcaagggggtggataatgaggacgaccatggcagaggagatcttggaagactgaagaagcagaaggatcatcataacccccatctcatcctcatgatgattccaccacacagattggacaatccaggccaaggaggacaaaggaagaaaagagcacttgatacaaattattgtttcagaaatctggaggaaaattgttgcgtaaggcctttgtacattgatttccgacaagatctgggctggaagtgggtccacgagcctaagggctactacgcaaacttctgcagtgggccttgtccttatcttagatccgctgatactactcacagtaccgttcttggtctctacaacactcttaaccctgaggcttcagcctcaccatgctgtgtgcctcaggacttggagccattgaccatactctattatgtcgggaggacccctaaggttgagcagctttccaacatggtagttaaatcatgtaagtgctct

SEQ ID NO: 20213 - DNA, 1236 bp, Artificial Sequence
  Description of Artificial Sequence: Synthetic coding sequence
atgaaaatgcatttacaaagagcattagttgttttggcacttttaaattttgcaactgttagcttatcacttagtacatgtacaactcttgattttggtcatattaaaaaaaaaagagttgaagctattagaggacaaattctttctaaattaagattaacatcacctccagaaccaacagttatgactcatgttccttatcaagttttagcactttataattcaactagagaattattagaagaaatgcatggagaaagagaagaaggatgtactcaagaaaatacagaaagtgaatattatgctaaagaaattcacaagtttgatatgatacaaggattagctgaacataatgaacttgccgtatgcccaaaaggaattactagtaaagtatttagatttaatgtttcttccgttgaaaaaaatagaactaatttattcagagctgaatttcgagtattaagagttccaaacccatcatctaagagaaatgaacaaagaattgaactttttcaaattttaagacctgacgagcatattgcaaagcaaagatatattggagggaaaaatctaccaacacgaggaactgcagaatggctttcttttgatgttacagatactgtaagagaatggcttttaagaagagaaagtaatttaggattagaaatttctatacattgtccatgccatacatttcaaccaaatggagatattcttgaaaatattcatgaagttatggaaataaaatttaaaggtgttgataatgaagatgatcatggacgtggtgatttgggtagattaaaaaaacaaaaggaccatcataatcctcatttaatcttaatgatgattcctcctcatagacttgacaatccaggacaaggaggtcaaagaaaaaaaagagcattagatactaattattgtttcagaaatcttgaagaaaattgttgcgttagaccattatatatagactttagacaagatttaggatggaaatgggttcatgaaccaaagggatattatgctaatttctgttctggaccttgtccatatttacgtagtgctgatacgactcattctactgttcttggtttatataatactttaaacccagaagcaagtgcatcaccatgttgtgtcccacaagatttagaaccattaactattctttattatgtaggaagaactccaaaagttgaacaattatcaaatatggtagtaaaatcatgtaaatgtagt

SEQ ID NO: 20214 - DNA, 1236 bp, Artificial Sequence
  Description of Artificial Sequence: Synthetic coding sequence
atgaagatgcatctccagcgggcactggtggtgcttgccctgctcaatttcgccactgtgtctctcagcctctccacctgcactacactggactttggccatattaaaaaaaaacgggtcgaagcgattagggggcaaattctgtctaagctgagacttacaagcccccctgagccgactgtcatgacacatgttccgtaccaggtactcgccctgtacaacagcacccgcgaactcttggaggagatgcacggtgagcgcgaggagggctgcacacaggaaaatacggaatccgagtattacgcgaaagaaattcacaaatttgatatgatccaaggcctggccgagcataacgagttagccgtatgccccaagggaattacctccaaggttttcaggtttaacgtgtccagcgtagaaaagaacagaactaatctgtttcgggcagagtttcgggtcttaagagtgccaaacccgtcttcaaaaagaaatgagcagcgaatagagttgttccagatactgcgacccgatgaacatatcgccaaacaaagatacatcggggggaaaaatttgcccacccgaggtactgccgagtggctgagcttcgacgtgacggacacagtgagggaatggctccttaggagagagtccaatctgggcctcgagatttctatacattgtccttgtcacaccttccagcctaatggcgatattcttgagaatatccatgaagtaatggagatcaaattcaagggcgttgataatgaagacgaccacgggagaggagatctgggacggctgaaaaaacaaaaggatcatcacaaccctcatctgattctaatgatgattccccctcataggctggataacccgggtcagggcggccagaggaagaaacgagccctcgatacaaattactgcttccgcaacctcgaagagaattgttgcgtgcggcccttatatattgacttcaggcaagacctcggctggaaatgggtccatgagccgaaaggctattacgcaaatttctgttccggcccatgcccgtacctgcgctccgccgatactacccactctaccgtgttagggctttataataccctcaatcctgaggcatctgcgtctccctgttgtgtaccccaagatctggagcccctgaccatcctgtactatgtgggtagaacgcctaaggtcgagcaactgagtaatatggttgtgaaaagctgtaagtgttcc

SEQ ID NO: 20215 - DNA, 1236 bp, Artificial Sequence
  Description of Artificial Sequence: Synthetic coding sequence
atgaaaatgcatttgcagcgcgcactggttgtgctggccctgcttaattttgcgaccgtcagcctgtccctgtctacttgcactactcttgatttcggccacatcaagaaaaaacgagtcgaagctattcgggggcagattttgtcgaagttgcggctgaccagtccccctgagccgaccgtgatgacccatgtgccatatcaagtcttggcactgtacaactctactagggaattgctcgaagaaatgcatggagagagggaggagggctgcacccaggaaaacactgaaagtgaatattacgctaaagaaattcacaaattcgatatgattcaggggctggcggagcataatgaactagcagtgtgtcccaagggcatcacctctaaggttttccgctttaacgtatcctccgtggagaagaaccggaccaatctcttcagagcggagttcagggtgctaagagtgcctaatccaagcagcaaacgcaacgaacagcgtatcgaactgttccaaatacttcgaccagatgaacatatcgccaagcagcggtatatcgggggcaaaaatctgccgacccgcgggaccgcggagtggctctccttcgatgtgactgacactgttagggagtggctgctcaggcgtgaatctaacctcgggctcgagatcagtattcactgcccttgtcacacattccagcccaacggtgacatccttgagaatattcacgaagtcatggagatcaagttcaagggtgtggacaacgaggatgatcatggtcgcggcgatctcggtcgcctgaagaagcagaaggaccaccataacccccacctgatcctcatgatgattcctccacatcgcctagacaacccgggccagggaggccagagaaagaaaagggcactggatacaaactactgctttcggaaccttgaggagaattgttgtgtgcgtccattgtatatcgactttaggcaagacctaggctggaagtgggtccatgagcccaagggctactatgccaatttttgctccggtccatgcccttatctcaggtctgctgatactacccattccacagttctggggctctacaatacacttaacccagaggcgtccgcatccccttgctgcgtcccacaggatctggaaccactgacaatactgtactatgtgggccggactcccaaggtggagcagttgagcaacatggtggtgaaaagctgtaagtgctct

SEQ ID NO: 20216 - DNA, 1236 bp, Artificial Sequence
  Description of Artificial Sequence: Synthetic coding sequence
atgaaaatgcatctgcaaagggctttggtggttcttgcgctgctcaatttcgccaccgtctccctttcactgtcgacatgcaccaccctcgatttcgggcatataaagaaaaagagggtggaggccatccgcggacaaattctgagcaaactccgactgacgtcaccacccgagccaacggtgatgacacacgttccctaccaggtgctggcactgtacaactcaacccgggaacttttggaagagatgcacggagaaagagaagaaggttgtacccaggagaatacagaaagcgaatattatgctaaagagatacacaaatttgacatgattcaggggctggccgagcacaatgaactagccgtgtgccccaagggtatcacctctaaggtgtttaggttcaatgtgtctagcgtcgagaaaaaccgaaccaacctcttccgtgcagagtttagagtcctccgggtgccaaaccccagctcaaagaggaacgagcaaaggattgagcttttccagatccttagaccagacgaacatatcgcaaaacagcggtatataggtggaaagaatctgccaacacgaggaactgcggaatggctctcatttgacgtgactgataccgtgagggagtggttgctgcggcgtgaatcaaacctggggctggagatttccatccattgcccttgtcacactttccagccaaatggggatatattagaaaacattcacgaggtgatggagatcaagtttaagggcgtggacaacgaggatgaccacggccgcggcgacttgggaagattgaaaaaacagaaagatcaccacaaccctcacttgatcctgatgatgattccccctcacaggcttgacaatcctggccaggggggacagagaaagaagagagctttagacaccaattattgtttccgcaatttagaggagaattgctgcgtcaggcccctttacattgatttcagacaggatctcggctggaaatgggtccacgaacccaagggctattatgcaaacttctgtagtgggccctgcccctacttaaggagcgcggacactacacattccaccgtgttaggactgtacaatactctgaaccccgaagcgagcgcctccccatgttgcgtcccccaagacttggagccactgaccattctgtactatgtgggtaggacaccaaaggtggagcagctgtccaatatggtagtcaaatcttgcaaatgctct

SEQ ID NO: 20217 - DNA, 1236 bp, Artificial Sequence
  Description of Artificial Sequence: Synthetic coding sequence
atgaaaatgcatcttcagagagccctggtggtgctggcactgctgaacttcgctaccgtgtccctttccctttcaacctgtactaccctggatttcggacacattaagaagaagagagtggaagcaatccgtggacagattttgagcaagttgcggctcacgtcaccacctgagcctaccgtgatgacccacgtgccctaccaggtccttgccctctacaactcgactagggaactcttggaagaaatgcatggagaacgagaagaaggttgtacccaggagaataccgaaagcgaatactacgcaaaagaaatccataagtttgatatgatacagggcctcgcagaacataacgaactggcggtgtgcccgaaggggattacttcgaaggtctttagattcaatgtgtcgtcggtggagaagaacagaactaaccttttcagagcggaatttagagtgcttcgggtcccaaatcctagctccaagcgtaatgaacaacgcattgaactgttccaaattcttagaccggatgaacacattgcaaagcaacgttacattggagggaagaacctcccaacccggggaaccgcagagtggctttccttcgatgtgaccgataccgtgcgcgagtggctcctgagaagggaatccaatcttggacttgaaatttccatccattgtccgtgtcatacttttcaacctaatggtgacatactcgagaatattcacgaggtgatggagattaagtttaagggcgtggacaatgaagatgatcacggaagaggagatcttggccgacttaagaaacaaaaggaccaccacaatccccatctgattctgatgatgattcccccacatagactggacaacccgggacaaggaggtcaacgaaagaagcgggcacttgatactaactactgttttagaaaccttgaggaaaactgctgtgtgcggccactttacattgatttccggcaagacttgggttggaagtgggtgcacgaacctaaggggtactacgccaacttttgttccggaccttgtccctacctgcgttcagccgataccactcattccactgtgctgggactctacaacactctgaatcctgaagcatcggcctctccatgctgcgttcctcaggatctggagccccttactattctttactacgtgggaagaactccgaaggtcgaacagctttccaacatggtagtgaaatcgtgtaaatgttcg

SEQ ID NO: 20218 - DNA, 1236 bp, Artificial Sequence
  Description of Artificial Sequence: Synthetic coding sequence
atgaaaatgcaccttcaacgcgcactggtggtgcttgcactcctgaactttgcaactgtctctctcagcctctcgacttgtactacccttgactttggccatatcaagaaaaagagggtggaagcaattcggggacaaattctcagcaagctgcgcctgacttcgcctccagagccgacggtcatgactcacgtcccgtaccaagtgctcgcactttacaactcgactcgggaactcctggaggagatgcacggagaaagagaagagggctgtacccaggagaacactgagtccgaatactacgcaaaagagattcacaagttcgatatgatccaaggactggcagagcataacgaactggcagtgtgtcctaaaggaataacctccaaggtctttaggtttaatgtgtcctccgtggagaagaatagaactaatctgtttagagcagaatttcgcgtgcttcgtgtgcctaacccctcatccaaacgcaatgaacagcggattgaactgtttcagattcttagaccggatgaacatattgctaagcagcggtacattgggggtaagaacttgcctaccagaggaacggcagaatggctgagcttcgatgtcaccgacaccgtgcgcgaatggctgctgcggagagagtcaaacttgggtctggaaatttcgattcattgcccctgccataccttccaaccgaacggagacattctggaaaacattcacgaggtgatggaaatcaagttcaagggggtggataatgaggacgaccatggaagaggagatcttggacgcctcaagaaacagaaggatcatcataatcctcaccttattctgatgatgatcccaccccatcggctggataatcctggccaaggcggacaacgcaaaaaacgtgcactggacaccaactactgttttcgtaacttggaggaaaattgttgtgtgcgaccactgtacatagactttcgccaagatctgggttggaaatgggtccatgaacctaagggatactacgcgaatttctgctccgggccttgtccctacctccgctcagcggacaccactcattcaactgtgttgggactgtacaacaccctgaaccctgaggcctccgcatcaccttgctgtgtccctcaggacctggaaccactcactatattgtactacgtcgggagaactcccaaagtggaacaactttccaatatggtcgtcaagtcctgtaagtgctcc

SEQ ID NO: 20219 - DNA, 1236 bp, Artificial Sequence
  Description of Artificial Sequence: Synthetic coding sequence
atgaagatgcatctccaacgggctctggtggttttggccttgctgaattttgccacagtgagcttatcactaagcacttgtactacccttgatttcggacatatcaagaaaaagagagtcgaagcgataagaggtcaaatcctctccaagctaagactgacaagcccccccgaacctactgtaatgacccatgtaccctaccaagtcctagctttgtacaactccacaagggagctgcttgaagaaatgcacggtgaaagggaagagggatgtactcaggaaaacacagagagcgagtattatgccaaggagatacataagtttgatatgattcaaggcctggcagaacataacgaactcgccgtctgtcctaaagggatcacaagcaaagtcttccgttttaacgtgtctagcgtggagaagaacagaaccaatctgtttagggctgagtttagggtattgagggtgccaaacccctctagcaagagaaatgagcaaagaattgaattgtttcaaatcctgcgccctgacgagcatatcgccaaacagcggtacatcggaggaaagaacctgcccactcgagggaccgccgagtggctctcgttcgacgtgactgataccgtgcgcgaatggctattaaggagagaatctaatctcggtctggagatatctatacattgcccatgtcatacatttcagcccaatggagacatcctggaaaatatccatgaggtcatggagatcaagttcaaaggagttgacaacgaggatgaccacggcagaggagatctcggaagactcaaaaaacaaaaggaccatcataatcctcatctgattttgatgatgatcccaccccatagacttgataatccagggcaaggtggacagaggaagaagcgagctctcgataccaactattgctttaggaacctggaggaaaactgctgtgtccgaccactgtatattgattttagacaggacctcggctggaaatgggtacacgagccaaaaggctattacgccaacttctgcagcggcccttgtccttatctccgttccgctgataccactcacagcacagttctcggcctctataacacactgaaccccgaggcttcagcttcaccctgctgcgttccccaagacctcgagccattgactatcctgtattacgtgggcagaacccctaaggtggagcagttgagcaacatggtagtgaaaagctgcaaatgtagt

SEQ ID NO: 20220 - DNA, 441 bp, Artificial Sequence
  Description of Artificial Sequence: Synthetic coding sequence
atggcctctcacaggctgttgctgttgtgcctggctggactggtgttcgtctcagaggccggacccactggcaccggcgaatcgaaatgtccgcttatggtcaaggtgctggacgctgtgcggggcagcccggcgatcaacgtcgcagtccatgtgttccgcaaggccgcagacgatacgtgggaaccatttgcctcgggcaaaacttccgagtcaggggagctgcacggactcactaccgaggaggaattcgtggagggaatctacaaagtggaaattgacaccaagtcctactggaaggccctgggaatttccccgttccatgagcacgccgaagtggtctttaccgccaacgactcgggcccacgccgctacactattgccgctttgctgtcgccatactcctacagcactatggccgtggtgactaacccgaaagag

SEQ ID NO: 20221 - DNA, 441 bp, Artificial Sequence
  Description of Artificial Sequence: Synthetic coding sequence
atggcctcgcatcgattattgctgctctgtctggccggactggttttcgttagtgaggctggaccaacaggcacaggcgagtcaaagtgccccttaatggttaaggtactggacgctgttcggggctcaccagcaatcaatgtggctgtccacgttttccggaaggccgcggacgacacttgggagcccttcgcatccggaaagacaagcgaatcaggtgagctgcacgggctcacaaccgaagaggaatttgtggaggggatttacaaggtggagatcgataccaagtcctactggaaagctctcggcatctcgcccttccacgagcacgcggaggttgtatttaccgctaacgactccggcccccgtcggtatactatagctgctctgctgtctccatactcatactctactatggcagtcgtgactaaccccaaggaa

SEQ ID NO: 20222 - DNA, 441 bp, Artificial Sequence
  Description of Artificial Sequence: Synthetic coding sequence
atggctagccacagactcctcctgctttgcctcgcaggactcgtctttgtctccgaggcgggcccaactggaactggagaatccaaatgccccctcatggtcaaggtgcttgatgcggtgagaggaagcccagcgatcaacgtggcggtgcacgtgtttaggaaggccgccgatgacacttgggagccgttcgcctccggaaaaacctcagaatcgggagagttgcacgggctgacgaccgaagaagagttcgtggagggaatctacaaagtggagatcgacactaagtcatattggaaggctctcggaatcagcccgttccatgaacatgccgaggtggtgttcaccgcgaacgattcaggtcctcgaaggtacaccatcgcagccctgctctcaccttactcctactcgactatggctgtggtcacgaatccgaaggaa

SEQ ID NO: 20223 - DNA, 441 bp, Artificial Sequence
  Description of Artificial Sequence: Synthetic coding sequence
atggcatcccaccggcttttgctgctgtgtcttgcaggactggtcttcgttagcgaggctggccccaccggcacaggggagtctaagtgtcccctaatggttaaggttctggatgctgttcgcgggtctcccgccatcaacgtggccgtccatgtcttccgaaaggccgcggacgatacctgggagccctttgccagcggaaagacaagcgaatcaggagagctgcacggcctgacaactgaagaagaattcgtggagggaatttataaagtagaaattgataccaaaagttactggaaagccctcggaatctctccctttcacgaacacgccgaagtagtttttactgccaatgatagcggacctcgtcggtatacaattgctgcgttattaagcccatattcctattcaacaatggccgtggtgaccaatcctaaggag

SEQ ID NO: 20224 - DNA, 441 bp, Artificial Sequence
  Description of Artificial Sequence: Synthetic coding sequence
atggcatcccaccggctcctcctcctgtgcctggctggactcgtgttcgtctcggaggcaggaccaacgggaactggagagagcaaatgtccactgatggttaaggtcctggatgcggtccgcggatcgcctgccatcaacgtcgccgtgcacgtgttcagaaaagcggcggacgacacttgggaaccgttcgcgtcaggcaagacctcggagtccggggagctgcatggcctgactacggaggaagagtttgtggagggtatttacaaggtcgaaattgatactaagtcgtactggaaggctctcggcatttccccgtttcatgaacatgcagaagtcgtgttcacggcgaatgactctgggcctcgccggtacacgatcgcggcactgctctcaccatattcatactctaccatggccgtggtgactaacccgaaggaa

SEQ ID NO: 20225 - DNA, 441 bp, Artificial Sequence
  Description of Artificial Sequence: Synthetic coding sequence
atggctagtcacaggctgcttctgctttgccttgcgggcctggtcttcgtgtcagaggctggacctacaggcaccggcgagagcaagtgccctctgatggttaaggtactggatgcagtcagggggagccctgcgataaatgtcgctgtgcacgtgtttagaaaggcagctgacgatacctgggaaccttttgccagcggaaagacgagcgaatcaggagagctgcatgggctcaccacagaggaggagtttgtcgaaggaatctacaaggttgagatcgacacaaaaagctattggaaagcgctgggcataagcccctttcacgagcatgccgaggtggtgttcacggccaacgatagcggtcctagacgctacacaatcgccgccctgctcagcccctacagttacagtaccatggctgtcgtgacaaaccccaaagag

SEQ ID NO: 20226 - DNA, 441 bp, Artificial Sequence
  Description of Artificial Sequence: Synthetic coding sequence
atggctagccataggctgctcctcttgtgcctcgcaggtctggttttcgtgtctgaggcaggccctactggaacaggtgagtctaagtgtccactcatggttaaggtcttggatgccgtgcgcggtagtcccgcaatcaacgttgccgtgcacgtctttaggaaagccgctgatgatacttgggaaccattcgcctcaggcaagacttctgagagcggagagctgcacggtctgacgactgaggaagaatttgtagaaggtatttataaggtggaaatagacacaaaatcatactggaaggctttgggaatatctccattccacgagcatgctgaagtcgtgttcaccgccaatgacagcggaccgcgccgctacactattgccgccctgctttcaccatattcttacagcactatggccgtggttaccaacccgaaggag

SEQ ID NO: 20227 - DNA, 441 bp, Artificial Sequence
  Description of Artificial Sequence: Synthetic coding sequence
atggcatctcaccgattgctgctgctgtgcctggcaggactggtcttcgtctccgaggcgggccctaccgggactggggagagcaaatgcccgcttatggtcaaagtacttgatgcagtgagggggagccctgccatcaatgtggccgtgcatgtgttcagaaaggccgcagatgatacctgggagccgttcgcttcaggtaagacatcagaatctggtgagctacacggcctcactactgaggaggagtttgtagaaggtatctacaaagttgagatcgacacaaagagttactggaaagcattggggatctctccctttcacgaacacgccgaggtggtgtttaccgcaaatgatagtggaccccggcggtacacaatcgctgcgctgttgagcccatattcctactcaacaatggccgtggtgaccaaccccaaggag

SEQ ID NO: 20228 - DNA, 441 bp, Artificial Sequence
  Description of Artificial Sequence: Synthetic coding sequence
atggcgtcccaccggctgttgctcctttgtttggccggcctggtgttcgtgagtgaggccgggcctactgggaccggcgagagcaagtgcccgctgatggtgaaagttcttgatgctgtgcgaggcagcccggctattaacgtggccgtgcacgtgttcagaaaggccgccgatgacacctgggaacctttcgctagtggaaaaacttctgagtccggagagcttcatgggctgacaaccgaggaggaattcgtggaaggcatctataaagtggagatagatacaaagtcctactggaaggcgctgggaatctcaccctttcatgaacacgctgaggtggtattcaccgccaacgatagcggtccgaggcggtacacaatcgcagcgctcttgagtccttacagttacagcaccatggccgtagtcactaatcctaaggaa

SEQ ID NO: 20229 - DNA, 441 bp, Artificial Sequence
  Description of Artificial Sequence: Synthetic coding sequence
atggcgagccatcggcttcttctgctctgcctcgctggccttgtgtttgttagcgaggctgggccaaccgggacaggggagtcgaaatgtcccctcatggtcaaggtgctggacgccgtaaggggatcgccggccattaacgtagccgtgcacgtatttcgaaaagctgccgatgacacctgggaaccattcgcatccggtaagacaagtgaatctggcgaattgcatggattgaccaccgaagaagagtttgttgaaggaatttataaagttgagatcgacacaaagtcctactggaaagctctaggaatctcaccttttcacgagcacgctgaggtcgtgttcaccgccaacgacagtggaccccggagatatactatcgcagcgctgttgtccccgtacagttattccaccatggcagttgtgactaaccctaaagaa

SEQ ID NO: 20230 - DNA, 441 bp, Artificial Sequence
  Description of Artificial Sequence: Synthetic coding sequence
atggccagtcatagactgttacttttatgtctggctgggctcgtgttcgtgagtgaggctgggcccacaggtactggagagagcaagtgtcccctgatggtaaaggtgctggatgcagtgaggggcagcccggccatcaacgtggcagtgcacgtgttccgcaaagccgcggatgacacctgggagccatttgcttctggcaagacctccgaatccggggaactgcacggcctgaccacagaggaggagtttgtggaaggaatttataaagtggagatcgacaccaaaagttactggaaggccctaggaatcagccccttccatgagcatgccgaggtagtttttaccgcgaatgatagtggcccacggaggtacaccattgccgctctgttgagcccttatagctacagcaccatggccgtggtgacgaaccccaaggaa

SEQ ID NO: 20231 - DNA, 441 bp, Artificial Sequence
  Description of Artificial Sequence: Synthetic coding sequence
atggcttcgcaccggctcctgctgctgtgcctcgctgggctggtctttgtgtcggaagccggaccaactggaactggggagtcgaagtgtcccctgatggtgaaggtcctggacgccgtgcggggtagcccggccatcaacgtcgccgtccacgtgttcaggaaggccgccgatgacacctgggagccattcgcctcaggaaagacgtctgagtccggggagttgcacggtcttaccaccgaagaggagtttgtggaaggaatctacaaagtggagatcgatactaagtcatattggaaggctctcggtatctccccgtttcacgagcacgcagaagtggtgttcaccgcaaacgacagcggacctcggaggtacaccattgcagcgcttttgtccccgtactcgtactcgaccatggccgttgtgactaacccaaaggag

SEQ ID NO: 20232 - DNA, 441 bp, Artificial Sequence
  Description of Artificial Sequence: Synthetic coding sequence
atggcatcgcatagacttctgttgctgtgcctggccggacttgtgttcgtgtcggaggccggtccaactggcaccggagagtcgaagtgcccgcttatggtcaaggtgctggacgcggtgagaggttcgcctgccatcaatgttgccgtgcatgtgttccgcaaggcggcggacgatacctgggaaccgttcgcaagcggaaaaacgtccgaatccggtgagttgcatgggcttaccacggaagaagaattcgtggaaggcatttacaaggtggaaattgatactaagtcctactggaaggctttggggatctcaccattccacgagcacgctgaggtcgtgtttaccgcgaacgatagcggaccgcggcggtataccatcgccgcattgctctccccttactcctactcgactatggcggtggtgactaacccaaaggaa

SEQ ID NO: 20233 - DNA, 441 bp, Artificial Sequence
  Description of Artificial Sequence: Synthetic coding sequence
atggcatcccaccgcctgctccttctctgtctggcgggtttggtgttcgtgtcggaggctggaccgactggtactggtgaatcgaagtgcccgctgatggtgaaggtgctcgatgcggtccggggctcccccgcgatcaacgtggcggttcatgtctttcggaaagctgcagatgacacgtgggaaccattcgcatcgggcaagacgtcagagtccggagagctgcacggcctgactactgaggaggaatttgtcgaaggaatttacaaggtggagattgataccaaaagctactggaaggcattggggatatcgcctttccatgaacatgcagaagtggtgtttaccgcaaacgattcggggccaagacgttacactattgcagccttgctttccccttacagctatagcacgatggcagtggtgaccaatcctaaggag

SEQ ID NO: 20234 - DNA, 441 bp, Artificial Sequence
  Description of Artificial Sequence: Synthetic coding sequence
atggcatcccaccggcttctcttactgtgccttgccggcttggtgtttgttagtgaggcagggcccactgggacaggggaatcgaagtgcccattaatggtcaaagtattggatgcggtgagagggagtccagctatcaacgtggcagtccacgttttccgcaaggcggccgatgatacgtgggagccgtttgccagcgggaagacgtccgagtctggggagctccatggcctgacaacggaggaagaattcgtcgaaggaatctacaaagtcgaaattgataccaaatcctattggaaagccctggggatctcacccttccacgagcacgctgaggtggtgttcacggccaacgatagcggaccccgtcgctacaccattgccgctctgttatccccctacagctattccactatggcagtggttaccaaccctaaggag

SEQ ID NO: 20235 - DNA, 441 bp, Artificial Sequence
  Description of Artificial Sequence: Synthetic coding sequence
atggcctcacaccggctgctccttctctgtttggcaggactggttttcgtctcagaggcggggcctaccggaacgggtgaaagcaaatgcccacttatggtgaaggtgctggatgcagtccgcggatcaccggctatcaatgtggcagtgcatgtgttcaggaaagcggctgacgacacttgggaaccatttgcgagcggcaagacgtcggagtctggagagctgcacggactgaccacggaagaagagtttgtggagggtatctacaaggtcgaaattgataccaaaagctactggaaggcactgggaatcagcccttttcatgaacacgcggaggtggtgttcaccgccaacgacagcggtccgagacgctacactatcgcggccctcctgtcgccgtactcctattcgactatggcagtggtgaccaacccaaaggag

SEQ ID NO: 20236 - DNA, 441 bp, Artificial Sequence
  Description of Artificial Sequence: Synthetic coding sequence
atggcgtcacatcggctccttctgctgtgtctggcaggactggtgttcgtgtccgaggctggcccaactgggaccggtgagtcgaagtgcccgttgatggttaaagtgctcgacgctgtgaggggatctcctgccatcaatgtggcggtccacgtctttagaaaggccgcagacgatacctgggaacctttcgccagcggcaagacttccgaatcgggagagctgcatggactcaccaccgaagaagaattcgtggagggaatctacaaggtcgagatcgacactaaatcctactggaaggcactcgggatctcgccgttccacgaacacgccgaggtggtctttaccgccaacgatagcggcccacgccgctacactattgccgctctgctgagcccctactcgtattcaactatggcggtggtgacgaacccgaaggaa

SEQ ID NO: 20237 - DNA, 441 bp, Artificial Sequence
  Description of Artificial Sequence: Synthetic coding sequence
atggctagccaccgtctgctgctgctgtgcctggctggtcttgtgttcgtgtcagaggctgggcccaccggaaccggcgagagcaagtgccccctaatggtcaaggtgctagatgctgtcagaggttcacccgcgattaatgtcgccgtgcatgttttccgcaaagccgctgatgacacatgggagccgttcgcaagtgggaagaccagcgagtctggggaactccatggcttgacgaccgaggaagaattcgtagagggaatatataaagtggagattgatacaaaaagctactggaaagcgctcgggattagtccatttcacgagcacgcggaggtcgtgttcacagccaacgactcagggcctcgacggtatactatcgccgccctcctgtctccttacagctatagtacgatggcagtcgtaacaaaccccaaagag

SEQ ID NO: 20238 - DNA, 441 bp, Artificial Sequence
  Description of Artificial Sequence: Synthetic coding sequence
atggcaagtcaccggctattgctcttgtgcctggctggtttggtatttgtatctgaagcgggcccaaccgggactggcgagagtaagtgccccttaatggtaaaagtcttggacgccgttagagggtctccagccattaacgtggcggttcacgtgttccgcaaggctgctgatgatacgtgggaacctttcgcgtccgggaagacctctgagagcggcgagctgcacggccttacaaccgaggaggagttcgtagagggaatttataaagtggagatagatactaaatcctactggaaggcattgggcatctctccctttcacgagcacgccgaggtggtatttacggcgaacgatagcggaccccggagatatactatcgccgccctactgtccccctactcttatagtactatggctgtggtgaccaaccccaaagag

SEQ ID NO: 20239 - DNA, 441 bp, Artificial Sequence
  Description of Artificial Sequence: Synthetic coding sequence
atggcatcacaccgtctgcttctgctctgcctggcgggcctggtgttcgtgagcgaagcgggaccaaccggtaccggagagtccaagtgtccactcatggtaaaagttcttgatgcagtgcggggctctccagccattaatgtggcggtgcacgtttttagaaaggcagcagacgacacttgggaaccttttgcgtcgggtaagacgtcggagagcggtgaactgcatggtctgacgactgaagaagaatttgtggagggaatatacaaggtggaaatcgataccaaatcatactggaaggccttgggaatctccccttttcatgaacatgcagaggtggtctttactgccaacgactcaggccctcgcagatataccatcgcagctctgttgtctccttactcctactcaaccatggccgtggtgaccaacccgaaagaa

SEQ ID NO: 20240 - DNA, 441 bp, Artificial Sequence
  Description of Artificial Sequence: Synthetic coding sequence
atggccagccaccgtctgttgttactgtgtctagccggacttgtctttgtgtcagaggccgggcccacaggtaccggggaatcgaagtgtcccctaatggtcaaagtgctagatgctgtccgaggatcacccgctattaatgttgctgttcatgtcttccgtaaagcagcagacgacacctgggagcccttcgcctcaggcaaaacaagcgagagtggagagctgcacggtctgacaacggaggaggagttcgtcgaaggcatttataaggtcgagatcgacaccaagtcctattggaaagcactgggaattagcccatttcacgagcacgctgaagtggtgtttaccgctaatgactcagggcccagacgctacaccatcgctgcacttttaagtccttactcgtactcgacaatggccgtggtgacgaatccgaaggag

SEQ ID NO: 20241 - DNA, 441 bp, Artificial Sequence
  Description of Artificial Sequence: Synthetic coding sequence
atggcgagccaccgactgttactcctgtgtctcgccggattggtgttcgtgtccgaagctggccctacgggaacaggtgagtccaagtgccctttgatggtaaaggtactggacgctgtgcggggatctccggctatcaacgtggctgtgcatgtatttcgcaaggcagcagatgacacatgggagcccttcgcctccggcaagacgtcagaaagcggtgagttgcacggcctgaccaccgaagaggaatttgtagaggggatctataaagtcgagatcgatacaaagagttactggaaggcacttgggatcagtccattccatgagcacgctgaggtagttttcaccgccaacgatagcgggccaagacgctataccatagcggcattactgtcaccgtacagctatagcactatggccgtggtgaccaatcctaaagag

SEQ ID NO: 20242 - DNA, 441 bp, Artificial Sequence
  Description of Artificial Sequence: Synthetic coding sequence
atggctagtcatagactgctcctcttgtgccttgcaggcctggtgttcgtgagcgaggcaggtccaactggaactggtgagtctaaatgtcctctgatggttaaagtcttggatgccgtgaggggcagtcccgcaataaatgtcgcagtccacgtatttagaaaagccgccgatgacacctgggagccattcgcttctggtaagacatcagagtctggcgagctgcacggacttactaccgaggaggaatttgtggagggcatttataaggtggaaattgataccaaatcctactggaaggctttgggaatctcacctttccatgaacacgccgaagtcgtgttcactgcaaacgattctggcccccgcaggtacaccatcgctgcccttctgtccccctatagctattctacaatggcagtagttactaatccaaaggag

SEQ ID NO: 20243 - DNA, 441 bp, Artificial Sequence
  Description of Artificial Sequence: Synthetic coding sequence
atggcctcacataggctgttgctgctctgtcttgccggcctggtgtttgtctccgaagccggaccaactggaaccggagagtcgaagtgcccgctgatggttaaagtgctcgatgcagtccgcggaagccccgccataaatgtcgcggtgcatgtgttccgcaaggcggccgatgacacctgggagccttttgcatcgggtaagaccagcgagtccggcgaactgcatggactgacgaccgaagaagagttcgtggagggaatctacaaggtcgagattgacactaagagctactggaaagcattgggcatctcacccttccatgaacatgccgaggtcgttttcactgccaacgacagcggtccgagacgctacactatcgcagccctcctttcgccatactcctattcgactatggccgtcgtgacgaacccaaaggag

SEQ ID NO: 20244 - DNA, 441 bp, Artificial Sequence
  Description of Artificial Sequence: Synthetic coding sequence
atggcttctcaccggctgttgttattgtgtctcgctgggctggtgttcgtgtctgaagctggacccactggcacaggcgagagcaagtgccccctgatggtgaaagtgttggatgctgtccgcggttcacctgccatcaacgtggctgtccacgtgtttcgcaaagccgcagacgacacctgggagccattcgcatcagggaaaaccagcgaaagcggcgagttacacgggctgaccaccgaagaggagttcgtcgaaggtatatacaaggtggagatagacaccaagtcttactggaaggccctggggatttctccatttcacgaacacgcagaagtggtttttaccgccaatgactctggtcccaggcggtatactattgctgctctactatccccttatagttattctacaatggccgtcgtcacaaacccaaaagaa

SEQ ID NO: 20245 - DNA, 441 bp, Artificial Sequence
  Description of Artificial Sequence: Synthetic coding sequence
atggcctcccatcggcttcttctgttgtgccttgcaggattggtctttgtctcagaagcgggtccgacgggcaccggggaatcgaagtgtcctctgatggttaaggtgctggacgcagtgcgcggttcgcccgccataaacgtggcagttcacgtgtttagaaaagcagcagatgatacttgggaaccatttgcatccggtaaaacctcggagtccggcgagctccacggattgaccactgaagaagagtttgtggaaggaatttacaaggtggagatcgacactaagtcatactggaaagcgctcggtatcagccccttccatgaacatgctgaggtagtattcaccgcaaatgattccggccctaggagatacacgattgctgctctccttagcccatacagttattcgaccatggctgtggtcactaaccctaaggag

SEQ ID NO: 20246 - DNA, 441 bp, Artificial Sequence; identical to SEQ ID NO: 20240
  Description of Artificial Sequence: Synthetic coding sequence

SEQ ID NO: 20247 - DNA, 441 bp, Artificial Sequence
  Description of Artificial Sequence: Synthetic coding sequence
atggcttcacacagacttctactgttgtgtctcgcaggcctggtgttcgtgtcagaagcagggccaacaggcaccggcgagtccaagtgccctctgatggtgaaagtgctcgatgccgtgcggggatccccagctatcaacgtggccgtgcacgtatttcgtaaagctgctgatgatacctgggagcccttcgctagtgggaagacctcagagtccggtgaacttcacgggcttacgacggaggaggagttcgtcgagggaatctacaaggtcgaaattgatactaaatcctattggaaggcactcggcatttccccctttcatgagcacgcagaagtggttttcactgccaacgacagcgggcctaggaggtatactatcgcggcactcctgtctccatatagctactccaccatggcagtggtcactaaccctaaggaa

SEQ ID NO: 20248 - DNA, 441 bp, Artificial Sequence
  Description of Artificial Sequence: Synthetic coding sequence
atggcatcccacagattgttgttgctgtgtctggcaggtctggtgtttgtgagcgaagccggccccacgggcactggcgagtccaaatgcccacttatggttaaggtgctggatgcggttagggggagccctgctatcaatgtagcggtacatgttttccggaaggcagccgacgacacctgggaaccattcgcatcagggaaaacttccgaatcaggagagctgcatggactgaccactgaagaagaatttgtcgaaggaatttacaaggtggagattgatacaaagtcatattggaaagcattgggcattagtcctttccatgaacatgcggaagtggtgttcacagcaaatgattccggaccgcggcgatatactattgctgcacttttgagtccttatagttactcaaccatggccgttgttactaatccgaaggag

SEQ ID NO: 20249 - DNA, 441 bp, Artificial Sequence
  Description of Artificial Sequence: Synthetic coding sequence
atggcgtcccaccgccttctgcttctgtgtctggcaggcttggtgttcgtgtcagaagctggaccgaccggaactggagaatctaagtgcccgctcatggtcaaggtgctggatgccgtgcgggggtcgcctgcgattaacgttgccgtgcacgtttttcgcaaggctgcggatgacacttgggagccattcgcctcaggcaagacgtctgagtccggtgagctgcatggcctcaccactgaggaagagttcgtggaaggtatctacaaagtcgaaatcgacaccaagtcatactggaaagccctcgggatctcaccgttccacgagcacgcggaagtggtctttactgcgaatgactccggaccgcggcggtatactattgccgcactgctgtccccctactcctactcgactatggccgtcgtgaccaatccaaaggaa

SEQ ID NO: 20250 - DNA, 441 bp, Artificial Sequence
  Description of Artificial Sequence: Synthetic coding sequence
atggcatcacataggctgttgctcttatgcctcgcaggacttgtttttgttagcgaagcagggcctaccggaacgggagaaagtaaatgtccgcttatggtcaaagtgcttgacgcggtaagaggcagcccggcgattaatgtagccgttcatgtctttcgtaaggccgctgacgacacgtgggaaccgtttgcctcaggaaaaacatccgaaagcggtgagctgcatggattaaccacagaagaggaatttgtcgaaggtatttataaagttgaaatcgataccaagtcgtactggaaagctttgggtatttcaccgttccatgaacatgcggaagttgttttcaccgctaatgattcaggaccgagacgctatacaatcgcagctcttctgtcaccgtatagctattccacgatggctgttgtcaccaatcccaaagaa

SEQ ID NO: 20251 - DNA, 441 bp, Artificial Sequence
  Description of Artificial Sequence: Synthetic coding sequence
atggcgtcccaccgcctgctgctgctgtgtctggcgggtctagtctttgtttcagaggcggggccaaccgggaccggcgaaagtaagtgcccactgatggtcaaagtactggatgcggtgcgaggtagcccagcgatcaatgtggccgtgcatgtatttcgcaaggcagccgacgatacttgggagcctttcgcgtcaggaaaaacgagcgaatctggggaactgcacggcctaacgacggaagaggagttcgtcgaaggtatttataaagtggagatcgacaccaagagctattggaaggccctgggtattagcccatttcacgagcacgcggaggtggttttcaccgccaacgacagcggccccagacgctacacgatcgccgcgttactgagcccgtattcctacagcaccatggcagtcgttaccaacccaaaggag

SEQ ID NO: 20252 - DNA, 441 bp, Artificial Sequence
  Description of Artificial Sequence: Synthetic coding sequence
atggcatcccaccggcttttgctgctgtgcctggccgggctggtgttcgtgtcggaggctggtccaactggaaccggagaaagcaagtgcccgctgatggtgaaggtccttgatgcagtgcgcggtagccctgccatcaacgtggctgtgcatgtctttcgcaaggccgcagacgatacctgggaaccctttgcttcgggaaagaccagcgaatcaggggagctgcatggtctgacgactgaagaagagttcgtggagggcatttacaaggtggaaatcgatactaaatcatactggaaggcgctcggaatctccccgttccatgaacacgctgaagtggtctttactgccaacgactccggtccgcggcggtacactatcgccgccctcctctccccctattcctactccacgatggcggtggtcactaaccccaaggag

SEQ ID NO: 20253 - DNA, 441 bp, Artificial Sequence
  Description of Artificial Sequence: Synthetic coding sequence
atggcaagtcaccgcctcctcctgctttgtctggccggcctggtattcgtgagcgaagccggaccgactgggactggagaaagcaaatgcccgctcatggttaaagtgctggacgcggtgcgcggttccccagccatcaatgtcgccgtacacgtgttcagaaaggcagctgatgacacttgggagccttttgcttcaggaaaaacttccgagtcaggcgagctgcatggactgacgactgaagaagaatttgtggaaggaatctacaaggtcgaaatcgataccaagtcgtattggaaggcccttgggatttccccgttccatgagcacgccgaggtcgttttcaccgcgaacgactcgggtcctagacgttacaccatcgcggcgcttcttagcccatactcgtactcgaccatggctgtggtgaccaaccccaaagaa

SEQ ID NO: 20254 - DNA, 441 bp, Artificial Sequence
  Description of Artificial Sequence: Synthetic coding sequence
atggccagccatagacttctgttgctgtgtcttgctggactggtgtttgtctcagaagcaggtcctactggtacgggagaaagcaaatgccctcttatggtgaaggtgctcgacgcagttaggggtagccctgccattaatgtggccgtgcacgtgtttagaaaagccgcggacgatacctgggaaccttttgcgtcgggaaagacctcggagtccggtgaattgcatgggctgactaccgaagaagagttcgtggaaggaatttacaaggtcgagatagatacgaagtcctactggaaggcactgggtatctcgcctttccatgaacacgctgaggtggtctttaccgctaacgattcagggcccagacgctacaccatcgcagcactgctgagtccctattcgtactcgactatggctgtggttactaaccctaaagag

SEQ ID NO: 20255 - DNA, 441 bp, Artificial Sequence
  Description of Artificial Sequence: Synthetic coding sequence
atggcctcccaccggttgctgctgctgtgtctcgccggtttggtgtttgtgtccgaagccgggccgacgggaactggagaatctaagtgcccgctgatggtgaaggtcctcgacgcagtccggggaagccccgcaatcaacgtggcggtccatgtgttccgcaaggcagccgacgacacctgggaaccgttcgcgtcaggtaagacgtcagagtcgggagagctgcatggactgactaccgaagaggaattcgtggaggggatttacaaggtggaaatcgatactaaatcctactggaaagccctcggaatctcaccattccatgaacacgctgaggtcgtctttaccgccaacgactccggtccgaggcgctacactatcgctgccctgctgtccccctactcctactcaacgatggccgtggtgactaacccgaaagaa

SEQ ID NO: 20256 - DNA, 441 bp, Artificial Sequence
  Description of Artificial Sequence: Synthetic coding sequence
atggcaagccaccgtttgctgctgctgtgtctggccggcctggttttcgtgagcgaggctgggcccaccggaacaggcgagtcgaaatgtcccctcatggtgaaagttctggacgccgtgcggggtagcccagcaatcaacgttgccgttcacgtttttcgaaaagcagccgacgatacatgggagccgttcgcaagtgggaagaccagtgaatcaggagagctccatgggctaaccaccgaagaagagtttgtggaaggaatctacaaggtagaaatcgatactaaaagttattggaaggccctgggtatatctccgtttcatgaacatgccgaggtagtgtttaccgccaatgactctggcccaagacgatacacaattgccgcactgcttagcccttactcttactccactatggctgtggttactaaccctaaggaa

SEQ ID NO: 20257 - DNA, 441 bp, Artificial Sequence
  Description of Artificial Sequence: Synthetic coding sequence
atggcttcccacaggctgcttctcctctgtttggcgggcctagttttcgtttccgaagctgggcctacgggcacaggggagtcgaaatgccccctcatggtgaaggtgctagatgctgtccgaggcagtccggcaatcaacgtcgccgtccacgtgtttcgtaaagccgccgacgacacatgggaaccttttgcctctgggaaaacttccgaaagtggagagctgcatggcctgaccacagaagaggaattcgtggaggggatctataaagttgaaatagacacaaagagctattggaaagctcttgggatatcaccgttccacgagcacgcagaggtggttttcacagccaacgatagcggccctagacgctacactatagccgctcttctctctccatattcttattccaccatggctgtagttaccaacccaaaagag

SEQ ID NO: 20258 - DNA, 441 bp, Artificial Sequence
  Description of Artificial Sequence: Synthetic coding sequence
atggcctcccaccgtctgctcctgctgtgcctggccggtctggttttcgtgtcggaagcgggcccgacgggcacgggcgagtccaagtgcccactcatggtgaaagtgttggatgccgtgaggggatcgcctgcaattaatgtcgccgtgcacgtttttaggaaggcagctgacgatacctgggaaccattcgcttcaggaaagaccagtgagagcggtgagctgcacggcctcactacagaggaagagttcgttgagggaatctataaggtcgagatcgataccaagagttactggaaggcgcttggcatatctccattccatgagcacgccgaggtggtcttcacggctaatgatagcggcccacgtcgctataccatagccgcactactctccccgtacagttactcgaccatggcagtggtgacgaaccctaaagag

SEQ ID NO: 20259 - DNA, 441 bp, Artificial Sequence
  Description of Artificial Sequence: Synthetic coding sequence
atggcgtcacaccggctcctcctgctgtgtctggctggactcgtgttcgtgtccgaggccggcccgaccggaactggagaatccaagtgcccactgatggtgaaagtcctcgacgccgtgcgggggtcgccggccatcaatgtcgccgtgcatgtgttccgcaaggccgcagacgacacgtgggaaccattcgcctcaggtaagacctcggaatcaggagaactgcacggactcactactgaggaagagttcgttgagggaatctacaaggttgaaatcgacaccaaatcgtactggaaggctcttggtatcagcccgttccacgaacatgccgaggtggtgtttaccgcgaacgatagcggtccgcgcaggtacactatcgcagccctgctgtccccgtactcgtatagcaccatggctgtggtgaccaatccaaaggag

SEQ ID NO: 20260 - DNA, 441 bp, Artificial Sequence
  Description of Artificial Sequence: Synthetic coding sequence
atggcctctcacagactactgctgctttgtctggcgggtctggtttttgtgagtgaggcaggtcccactggtaccggggagagtaaatgccccctgatggtgaaagtgcttgacgccgtcagggggagccctgcgataaacgtagccgtacatgtgtttcgaaaggccgccgacgatacgtgggagccattcgcaagcgggaagacaagcgagtctggtgaactgcatggcctgaccactgaggaagaattcgtcgaagggatctacaaagtggagattgacactaagtcctactggaaggcactgggaatttcccccttccatgagcacgcagaggtggtttttacggctaacgactctggacccaggagatacacgatcgccgccctgctcagcccatacagctactccacgatggccgttgtcacaaaccccaaagag

SEQ ID NO: 20261 - DNA, 441 bp, Artificial Sequence
  Description of Artificial Sequence: Synthetic coding sequence
atggcatcgcatagactgcttctgttgtgcctggcagggctggtgtttgtgtcagaggcgggcccaactggcactggagaatccaagtgcccactgatggtcaaggtgcttgacgccgtgcgcgggtcccctgcgattaatgtggcggtgcatgtgtttcgaaaggcagccgatgatacttgggaaccttttgcttccggtaaaacttccgagagcggagaactccatggattgaccactgaggaagagttcgtggaaggtatctacaaagtggaaatagataccaagtcgtactggaaggcgctgggtatctccccgtttcacgagcatgcagaagtggtgttcaccgcgaatgactctggtccccggcgatacactatcgcagcccttctctcgccatattcgtatagcaccatggctgtggtgacgaaccctaaggag

SEQ ID NO: 20262 - DNA, 441 bp, Artificial Sequence
  Description of Artificial Sequence: Synthetic coding sequence
atggcctcacatcggcttctgcttctctgtctggcaggattggtgtttgtgtcagaagccgggcctactgggactggagagtcgaagtgcccactgatggtgaaggtgttggatgccgtcaggggatcccccgcaatcaatgtcgcagtccacgtctttagaaaagcggcagacgatacttgggaacctttcgcatcgggcaagacctcagaatccggagaactgcatggcctgaccaccgaggaagagttcgtcgagggtatatacaaggtggaaatcgacaccaagtcttactggaaggctctgggaatctcccctttccatgaacacgcggaggtggtgttcacggcgaacgattcgggtcccaggcgctacaccattgcagcccttttgtcgccatattcgtacagcacgatggcagtggtgactaacccaaaggag

SEQ ID NO: 20263 - DNA, 441 bp, Artificial Sequence
  Description of Artificial Sequence: Synthetic coding sequence
atggcttctcaccggctattgctcctgtgcctggccggcctcgttttcgtaagcgaggccggccctactggcacaggtgaatccaagtgtcccctaatggtgaaggttctcgatgctgtgcgaggcagccctgccatcaacgtggcagttcacgttttcagaaaagccgccgatgatacgtgggagccatttgcctccggcaaaactagtgagagcggggaactccacggcctaacgaccgaggaggaattcgtagagggaatatataaggttgaaattgatacgaaatcttattggaaagccctgggcataagtcccttccatgagcatgcggaggtcgtgtttactgcaaacgattctggtcccaggcgttacaccatagctgccctgttgtctccctattcctactctacaatggcagtggtcacaaacccaaaggag

SEQ ID NO: 20264 - DNA, 441 bp, Artificial Sequence
  Description of Artificial Sequence: Synthetic coding sequence
atggcaagccaccgccttctcctgctttgcctggcagggttggtgtttgtctccgaggcgggccctacgggtaccggagagtccaaatgtccattgatggtgaaagttcttgacgcagtacgagggagtccggccataaacgtggccgtgcatgtgttcaggaaggcagcggacgatacctgggaaccgtttgcgtccggaaagacttcggagtcaggtgaactccacggactgactacggaagaagagttcgtggaagggatctacaaggttgagattgataccaaatcgtactggaaggcccttggaatttcgccttttcatgaacatgcagaagttgtctttaccgcaaacgattcgggtccccggcgttataccatcgccgctcttctcagcccgtactcgtactctactatggccgtggtaactaatcccaaggaa

SEQ ID NO: 20265 - DNA, 441 bp, Artificial Sequence
  Description of Artificial Sequence: Synthetic coding sequence
atggcctcccatcggctgctcttgctgtgcctggcaggccttgtcttcgtttctgaagccggaccaactggaaccggggaatccaagtgtccattgatggtcaaggtgctcgacgccgtgaggggaagcccagcgatcaatgtggctgtgcatgtgttccgaaaagccgcagacgacacctgggaaccgttcgcgtccggaaagactagcgagtcgggcgagctgcacggactcaccactgaagaagaatttgtggaagggatctataaggtggaaatcgataccaaatcgtactggaaggcactcggaatctcgcccttccatgaacatgcagaggtcgtgttcaccgcaaatgactcgggccctaggagatacactattgcagccctgctgtcaccgtactcatactccaccatggcagtggtcactaaccccaaggaa

SEQ ID NO: 20266 - DNA, 441 bp, Artificial Sequence
  Description of Artificial Sequence: Synthetic coding sequence
atggcatcccataggttattgctgctctgtttggcgggacttgtattcgtaagcgaggctggtccgacaggtactggagagtctaaatgtccactcatggtgaaggtcctggacgcggtgcgcggatcccctgcaataaatgtggcagtgcacgtgttccgaaaggccgcagatgacacttgggaacccttcgcgagcggaaagactagcgagagcggggaactgcacgggctcactacagaggaagagtttgttgaaggaatctataaggtggagatcgacactaaatcttattggaaagcgctcggcatcagcccctttcatgagcatgctgaagtggtgttcactgccaatgactctggcccgcgcaggtacaccatcgctgcgctcctgtccccttattcgtattctaccatggccgttgtcacaaaccccaaggag

SEQ ID NO: 20267 - DNA, 441 bp, Artificial Sequence
  Description of Artificial Sequence: Synthetic coding sequence
atggcctcccatagactgctccttctttgccttgccgggctggtgtttgtgtcggaagcaggacccaccggcaccggggaatctaaatgtcctcttatggtgaaggttctggacgccgtgagaggcagcccagcaatcaatgtcgctgtgcatgtgttccggaaagcagccgatgatacttgggaacctttcgccagcggaaagacttcagaatccggagagctgcatggattgactaccgaagaagagtttgtcgaaggaatctataaagtcgaaattgatactaagtcatactggaaggcactcggcatctccccgttccacgagcacgccgaagtggtgtttactgcaaacgactcggggcctagaagatacaccatcgccgcacttctgtcaccttacagctactccactatggcagtcgtgaccaaccccaaggaa

SEQ ID NO: 20268 - DNA, 441 bp, Artificial Sequence
  Description of Artificial Sequence: Synthetic coding sequence
atggcttcacacaggttactgctgctgtgcctcgctggcctcgtctttgtaagtgaagccggtccaaccggtacaggtgagagcaagtgcccacttatggttaaagtactggacgccgttcgcgggagccctgcaatcaacgtggcggtccatgtcttccgcaaagccgctgatgatacctgggagccattcgctagcggcaagacaagtgaaagtggcgagctccacggactgacgaccgaggaagaattcgtggagggtatatacaaagtggagatcgataccaaaagctattggaaggcactgggaattagcccgtttcacgaacacgccgaagtggtttttactgcaaatgacagcggcccaagacgctatactattgctgcgctgctgagcccctactcttattcaacaatggccgtagtgaccaacccaaaggaa

SEQ ID NO: 20269 - DNA, 441 bp, Artificial Sequence
  Description of Artificial Sequence: Synthetic coding sequence
atggcatcacaccgactcttacttctttgtctggcaggactcgtgttcgtgtcagaagcaggaccaacaggaacaggagaatctaaatgccccctaatggttaaggttttggacgccgttaggggaagtccagcaataaacgtggccgtgcatgtcttccgcaaggcggccgatgacacatgggaaccattcgcttccgggaaaactagtgaatcaggggaactccacgggctcacaactgaagaagaattcgttgaaggaatctacaaagtggaaatagatacaaaatcttattggaaagcactagggatatcacctttccacgaacatgcagaagtcgtctttacagcgaacgattctgggccacggcgctatactatcgccgccctgctaagtccttattcctattctactatggctgtggtcactaaccctaaagaa

SEQ ID NO: 20270 - DNA, 441 bp, Artificial Sequence
  Description of Artificial Sequence: Synthetic coding sequence
atggcatctcacagattattattattatgtttagcagggttagtttttgtttctgaggcaggaccaacaggaactggtgaatcaaaatgtccattaatggttaaggttcttgacgcagttcgtggttctccagctattaatgttgctgtacatgttttcagaaaagcagctgatgatacatgggaaccattcgctagtggaaaaacttcagaatctggagaattacatggattaacaacagaagaagaatttgttgaaggaatttataaagttgaaattgatactaaatcatattggaaggctttaggtatttcaccttttcatgaacatgcagaggtagttttcactgctaatgatagtggtccaagaagatatactattgcagctttactttctccatactcttattctactatggctgttgttactaatccaaaagaa

SEQ ID NO: 20271 - DNA, 441 bp, Artificial Sequence
  Description of Artificial Sequence: Synthetic coding sequence
atggcctcacaccggttgctgttactctgtcttgctgggctggtattcgtgtctgaggccgggccaaccgggacaggggagagcaaatgtcctctgatggtgaaggttctggacgctgtcaggggatcaccggccatcaatgttgccgtgcacgtgtttagaaaggccgctgacgatacgtgggagcccttcgcttccggcaaaacgagcgagtcaggcgagctgcacggtttgaccaccgaagaggaatttgtggagggtatctacaaagtggaaattgacacaaaaagctactggaaggccttgggaatctccccgtttcacgaacacgcagaggtggtgttcaccgccaacgactccggaccccgccgttatactattgccgctctgctgagtccatattcctactccacaatggctgtcgtgactaaccctaaagag

SEQ ID NO: 20272 - DNA, 441 bp, Artificial Sequence
  Description of Artificial Sequence: Synthetic coding sequence
atggcttcccatcgtctgctgctgctgtgcctggccggcttagtctttgtctccgaggcaggccctaccggaaccggagagagcaagtgcccgctgatggtaaaggtcctcgacgctgttaggggaagcccagccattaacgtcgcagtgcacgtgtttcggaaagcagccgatgatacctgggagccgtttgcttcgggaaagacctcagagagtggggaacttcacggcctgaccaccgaggaggaattcgttgagggtatctacaaggtcgaaattgataccaagtcgtactggaaggcactggggatctccccttttcacgaacacgcggaagtggtgttcactgccaacgacagcggtcccagacgttacaccatcgccgccctgctgagtccgtatagctactcgaccatggctgtcgtcacaaacccaaaggag

SEQ ID NO: 20273 - DNA, 441 bp, Artificial Sequence
  Description of Artificial Sequence: Synthetic coding sequence
atggcctctcatcgtctccttcttctctgtctggctggactcgtgtttgtatctgaggctggaccaactggcaccggtgagagcaaatgtcctcttatggtcaaagtcttggatgccgtcagaggatctccagcaattaacgtagccgttcatgtgttcaggaaagctgcagatgacacatgggaaccattcgcgagtggcaaaacgtccgagagcggcgagttacatggtcttaccacagaggaagagtttgtcgaaggtatctacaaagttgaaattgatacaaaatcttactggaaagcgttaggaatctctccatttcacgaacatgcagaagtcgtatttacagccaatgactctggtccacgaagatacacaattgcagccttgttaagcccatatagctactctactatggcagttgtaaccaacccaaaagag

SEQ ID NO: 20274 - DNA, 441 bp, Artificial Sequence
  Description of Artificial Sequence: Synthetic coding sequence
atggcctctcatagactgttactgctgtgccttgcgggcttggtcttcgtcagcgaagccggaccaacaggcacaggggaatccaaatgcccgcttatggtgaaggtgctggacgcagtgagaggaagccccgccattaatgtggctgtgcatgtattccgcaaagccgccgacgacacttgggagccatttgcgtcaggtaagacaagcgagtcaggtgagctccacggcctaactactgaagaagaattcgtggagggtatttacaaagttgaaatcgatactaagtcttattggaaagcccttggtatcagcccttttcatgaacacgcggaggtcgtatttactgcaaacgattcaggacctcgccgctatactatagccgctctactctccccgtatagctacagtaccatggctgtggtaacgaatcctaaagag

SEQ ID NO: 20275 - DNA, 441 bp, Artificial Sequence
  Description of Artificial Sequence: Synthetic coding sequence
atggcttcacaccgtcttctgttattgtgcctcgccgggctggtgttcgtatccgaggccggccctaccgggacaggggagtcaaagtgccctctcatggtgaaagtcctggacgccgtgcgagggtccccggcgattaacgtcgcggttcacgtgttccgcaaagccgccgacgatacctgggagccctttgccagcggcaagaccagcgaatctggagaactgcacggtctgacaaccgaggaggaattcgtggagggaatctacaaggtggagatagataccaaatcttactggaaagcactgggcatctcccctttccacgagcacgcggaggtggtcttcaccgctaacgattccggccctcggagatacaccatcgctgctctcctgagcccttactcgtactccactatggccgtcgttacgaacccaaaggaa

SEQ ID NO: 20276 - DNA, 441 bp, Artificial Sequence
  Description of Artificial Sequence: Synthetic coding sequence
atggccagccatcggctgctgcttctgtgccttgctggactcgtctttgtgagcgaagccggaccgaccggaactggggaatccaagtgtccgctgatggtgaaggtgcttgatgccgtgcggggatcgccggcaatcaacgtcgcagtgcacgtgttcagaaaggccgctgacgatacctgggaaccgtttgcgtcgggaaaaacttccgaatccggagaactccatggtctgactactgaggaagagttcgtcgagggaatctataaggtggagatcgacactaaatcgtactggaaagccctcggcatttcacctttccatgagcacgcggaagtggtctttacggccaatgactctggtccccgccgctacacgatcgcggcgcttctgtcgccatacagctactcgactatggcggtcgtgaccaatccaaaagaa

SEQ ID NO: 20277 - DNA, 441 bp, Artificial Sequence
  Description of Artificial Sequence: Synthetic coding sequence
atggcgtcacatcgcctgcttctgctctgcttggctggcctggtctttgtctccgaagcaggaccaaccggaaccggcgaatcgaaatgtcctttgatggtgaaggtgttggatgcagtgagaggatcccctgcaatcaacgttgcagtgcatgtgtttcggaaggcggccgacgacacctgggagccattcgcgagcggtaagacctccgaatcgggagaacttcacggactcaccactgaagaggaatttgtggaaggtatctacaaggtcgaaatagatactaagtcctactggaaggcccttggtatttcaccatttcatgaacatgctgaggtggtgttcactgcaaatgatagcggaccacgcagatacactattgcagcactgctgtccccgtactcctactcaaccatggcagtggtcaccaaccctaaggaa

SEQ ID NO: 20278 - DNA, 441 bp, Artificial Sequence
  Description of Artificial Sequence: Synthetic coding sequence
atggcctcgcatagactcttgctgctgtgcctcgccgggttggtgttcgttagcgaggcgggtcctactggaactggcgaatcaaagtgcccgctgatggtgaaagtgcttgatgcagtccgcggatcaccggccatcaacgtcgccgtgcacgtgttccgcaaggccgcggacgacacgtgggaaccattcgcgtcaggcaagacctcagaaagcggggagctccatgggctgactactgaggaagagttcgtggagggcatctacaaggtggaaatcgataccaagtcgtactggaaggcgctcggaatctccccgttccacgagcacgccgaagtcgttttcactgctaacgattcgggaccacgccgctacactattgcggcgttgctctctccgtactcatactccactatggccgtggtgactaatcccaaggaa

SEQ ID NO: 20279 - DNA, 441 bp, Artificial Sequence
  Description of Artificial Sequence: Synthetic coding sequence
atggcatcccaccgcttgcttctgctttgtctggcaggactggtttttgtgtccgaagccggacctaccggcaccggggagtcgaagtgtcccctgatggtgaaggtgctggacgcagtcagaggttcgcctgcaatcaatgtggccgtgcatgtgtttaggaaagcagccgacgatacttgggaaccatttgcatcgggtaaaactagcgaatctggtgagctgcatgggctcactactgaggaagaatttgtcgagggaatctacaaggtggaaattgataccaagtcgtactggaaggcactgggtatctcccctttccatgagcacgcagaggtggttttcactgccaacgatagcggacccagaagatacactattgcagcacttctgtccccttacagctactctactatggccgtcgtgaccaacccaaaggaa

SEQ ID NO: 20280 - DNA, 441 bp, Artificial Sequence
  Description of Artificial Sequence: Synthetic coding sequence
atggcctcccaccgactgctgttgctgtgcctcgctgggctcgtctttgtgtccgaagctggccccaccgggacaggggagtcaaagtgccctttgatggtgaaggtgttggacgcggtgagaggttcacccgctattaatgtggctgttcatgtctttcgcaaagcagctgacgatacttgggagccatttgcttccggcaaaacatccgagtctggtgagttgcacgggctcaccaccgaggaggagttcgtggagggaatctataaagtcgaaattgacaccaagtcatattggaaggccctgggcataagtccttttcacgaacacgctgaggtagtgttcacggcgaacgacagtggccctcggcgatacaccattgcagccctgctgtctccttactcttattcaaccatggctgttgtcacaaaccccaaagaa

SEQ ID NO: 20281 - DNA, 441 bp, Artificial Sequence
  Description of Artificial Sequence: Synthetic coding sequence
atggctagtcaccgactgctgctgctgtgcctggcagggctggttttcgtctcagaagcaggcccaacaggcaccggcgaatcaaagtgccccttgatggtaaaggtgttggacgcggtgcgtgggtcccccgctatcaacgtggcagtgcatgttttccgcaaggcagccgatgacacctgggaacctttcgcgtccggtaagactagcgagagcggcgaactccacggcttgacgacagaggaggaattcgtggaggggatttataaagttgaaatcgacacgaagagttactggaaagccctaggaatcagccccttccacgaacacgccgaagtcgtttttactgcaaatgacagcggcccccggaggtataccattgctgccctgttgagtccttacagttacagcaccatggccgtggtgacgaatccaaaagag

SEQ ID NO: 20282 - DNA, 441 bp, Artificial Sequence
  Description of Artificial Sequence: Synthetic coding sequence
atggcatcccaccgacttttgctgctctgcttggcaggccttgtgttcgtgtccgaggccggaccaaccggaaccggcgaaagcaagtgtccccttatggtgaaggtccttgacgccgtccggggatcccctgcaattaacgtggccgtgcatgtgtttagaaaggcagccgatgatacctgggaaccatttgcttccggaaagaccagcgaatccggagaattgcatgggctgactactgaagaagagttcgtggaaggaatttacaaggtcgaaattgatacgaagtcatactggaaggcacttggaatatcaccttttcatgagcacgccgaggtcgtgtttacggctaatgacagcggtcctaggcggtacaccattgccgcacttctgtccccgtattcgtactcgaccatggcagttgtgactaaccccaaggag

SEQ ID NO: 20283 - DNA, 441 bp, Artificial Sequence
  Description of Artificial Sequence: Synthetic coding sequence
atggcttcacacaggcttctcctgctttgcctagctggcctggtgtttgtctccgaggccggaccgaccggcaccggtgagtccaagtgcccactgatggtgaaagtgctggatgcagtccgtggcagcccagcgattaacgtcgccgtgcatgtttttaggaaggctgcagacgacacttgggagcctttcgccagcggcaagacttctgagtcaggagagctgcatgggttaaccaccgaggaggagttcgttgagggtatttataaagtggagatagataccaagtcctactggaaggccctagggatatcacccttccatgagcatgccgaagtggtctttacagcaaacgattcggggccgagaaggtacaccatagccgccttgttgtctccatatagctacagcactatggccgtggtgaccaaccctaaagag

SEQ ID NO: 20284 - DNA, 441 bp, Artificial Sequence
  Description of Artificial Sequence: Synthetic coding sequence
atggcgtcccacaggttgctgctgctgtgccttgccggactggtctttgtctcggaagcggggccgactggtacgggagaatcgaagtgtcccctgatggtgaaagtgctcgatgccgttagaggctccccagccattaacgtcgcggtgcacgtgttccgcaaggctgcggatgacacctgggaaccgttcgccagcggcaagacctctgagagcggcgagttgcatggactgaccactgaggaagaatttgtggaaggtatctacaaagtcgagatcgacaccaagagctactggaaagcactgggaatctcgcctttccacgaacatgcagaggttgtattcacggctaacgactccggtccacgtcggtacactatcgccgccttgctcagtccctactcttattcgactatggcagtggtgaccaatccgaaggag

SEQ ID NO: 20285 - DNA, 441 bp, Artificial Sequence
  Description of Artificial Sequence: Synthetic coding sequence
atggcgtcgcatcgattactactactatgtttagcgggtttagtatttgtatcggaagcgggtccgacgggtacgggtgaatcgaaatgtccgttaatggtaaaagtattagatgcggttcgaggttcgccggcgataaatgtagcggtacatgtttttcgtaaagcggcggatgatacgtgggaaccgtttgcgtcgggtaaaacgtcggaatcgggtgaactacatggtctaacgacggaagaagaatttgttgaaggtatatataaagtagaaatagatacgaaatcgtattggaaagcgctaggtatatcgccgtttcatgaacatgcggaagtagtatttacggcgaatgattcgggtccgcgtcgttatacgatagcggcgctactatcgccgtattcgtattcgacgatggcggttgttacgaatccgaaagaa

SEQ ID NO: 20286 - DNA, 441 bp, Artificial Sequence
  Description of Artificial Sequence: Synthetic coding sequence
atggcaagtcatcgtttattgcttctatgcttggctgggctggtatttgtttcggaggcaggacctactggaaccggtgagtccaagtgtccacttatggttaaggtgttggatgctgttaggggttctcccgctataaacgtggcagtgcacgtgttccgtaaagctgctgatgacacgtgggaaccattcgctagcggaaagacttccgaatcaggggagttgcacggacttaccactgaagaagaatttgtagaaggtatttataaagtagaaattgataccaagtcttattggaaagcactcggaatatccccatttcacgagcatgctgaggtcgtcttcaccgccaatgattcaggcccgagaagatatacgattgccgcgttgctcagcccttattcatacagtacaatggcggtggtgacaaaccccaaggag

SEQ ID NO: 20287 - DNA, 441 bp, Artificial Sequence
  Description of Artificial Sequence: Synthetic coding sequence
atggcaagccacaggttactgctgctctgtctcgccggtttagtatttgtaagcgaagcaggaccaaccggtacgggcgaatctaagtgcccactaatggttaaagtccttgacgcggtccgcggctcgccggccattaatgtcgcggtgcacgtctttcgtaaggcagctgacgacacatgggagcccttcgccagtggcaaaactagtgagagcggcgagctgcatggacttaccaccgaggaggagttcgtcgaaggtatttacaaggtggagattgataccaagtcgtattggaaggctttgggaatttcccctttccacgaacacgctgaggttgtcttcacggcaaatgactcgggccctcgtcgctacactatcgcggcgctcttgtctccctactcctatagtactatggcggttgtcactaacccgaaagag

SEQ ID NO: 20288 - DNA, 441 bp, Artificial Sequence
  Description of Artificial Sequence: Synthetic coding sequence
atggcatcgcacagattgcttctgctgtgccttgccggactcgtgtttgtgtccgaagcaggaccaaccgggactggcgagtccaagtgtcctctcatggttaaagttctggatgcagtacgtggtagtcctgcaataaacgttgcggtgcatgtgttccgaaaggcagccgatgacacgtgggaaccatttgcgagcggtaagacctcggaatcgggagagctccatggacttactactgaggaggaatttgtagaaggaatttacaaggtggaaatcgacactaaatcttattggaaagcactgggtatttcaccgttccatgagcacgcagaagtcgtctttacggctaatgactcgggccccagaaggtacactattgcggccttgctgtcaccctactcctactcgacgatggcagtcgtgaccaacccaaaggaa

SEQ ID NO: 20289 - DNA, 441 bp, Artificial Sequence
  Description of Artificial Sequence: Synthetic coding sequence
atggcctcccaccgcctgctgctgctctgcctggctggccttgtgttcgtgagcgaggcaggacccacgggcaccggggagagcaagtgcccactcatggtgaaggtgcttgacgccgtcagagggtctcccgccatcaatgttgcagtgcacgtgtttagaaaggcggcggacgatacctgggaaccattcgccagcggtaagacgagtgaatcgggcgaactccatggcttgaccaccgaggaggagttcgttgagggtatttataaggttgagatcgatacaaaaagctactggaaggccttagggatatcaccctttcatgagcacgccgaggtggtgttcactgccaacgactctggacccagacgttacaccattgccgcactgctgtcgccttattcctatagcacgatggctgtcgtgacgaatcctaaggaa

SEQ ID NO: 20290 - DNA, 441 bp, Artificial Sequence
  Description of Artificial Sequence: Synthetic coding sequence
atggctagtcatagactccttctcctttgtcttgcagggctcgtgttcgtttccgaagccgggcctacaggaactggagagtctaaatgcccattgatggtgaaagtcctcgatgctgtccgcggatcccccgcgataaacgtagctgtacatgtttttaggaaagcagccgatgatacttgggaaccgttcgcatctggaaaaacttctgaatcaggagaattacatggactgacaactgaagaagaattcgtggaagggatctataaagtagagatcgatacaaaaagttactggaaagccctggggatatcgcctttccatgaacacgctgaagtggtttttacagctaacgattcaggaccacgaagatacacaatcgctgctctactctcaccttattcttactctactatggcggtagtcacaaatcccaaagag

SEQ ID NO: 20291 - DNA, 441 bp, Artificial Sequence
  Description of Artificial Sequence: Synthetic coding sequence
atggcaagccacaggctcctcctgctgtgcctggccggcctggtctttgtctccgaagccgggcccaccggaacgggcgaaagcaaatgtccactgatggtgaaggtgctggatgccgttagaggatctccggcaatcaacgtggcggtccatgtgtttcggaaggccgcagacgatacttgggaaccttttgcttcggggaaaacgtctgagtcaggagaactccacggactcaccactgaagaagagttcgtggaaggaatctacaaggttgaaattgacaccaagtcctactggaaggcactcgggatttctcctttccatgagcatgccgaggtggtgttcactgcaaacgattcaggaccgcgcagatacactatagcagcgttgctgtcgccttactcctactccactatggccgtggtgaccaatccaaaggaa

SEQ ID NO: 20292 - DNA, 441 bp, Artificial Sequence
  Description of Artificial Sequence: Synthetic coding sequence
atggctagccaccgtctgcttctcctctgcctcgccggcctggtgtttgtctccgaggccggacctactggaactggggaaagcaaatgtcctctcatggtcaaagtcctcgacgctgtgcgtggtagccctgcaatcaacgtggcggtgcatgtgtttcgaaaggcagcagatgatacctgggagcccttcgcatccggtaagacttccgagagcggagaactgcatggccttaccacggaggaggaatttgtggaaggaatttacaaggtggaaattgataccaaatcctactggaaagcactgggcatatcaccctttcatgagcacgcagaagtcgttttcaccgccaacgattcgggtccgaggagatacactattgctgccctgcttagcccttactcctattctaccatggcagttgtgaccaacccaaaagag

SEQ ID NO: 20293 - DNA, 441 bp, Artificial Sequence
  Description of Artificial Sequence: Synthetic coding sequence
atggcttcccaccgcctactgctgctgtgcctcgcaggcctcgtatttgtgtccgaggcaggccccaccggtaccggcgagagcaagtgtcctctgatggtgaaggtcttggacgcagtgaggggaagtccagcaattaatgtggcggtccacgtgtttcgcaaagccgccgatgacacttgggagcctttcgcctcaggcaaaacctcagaatccggcgagcttcacggtttgacaacagaggaggaattcgtggaaggtatctataaagttgagatcgatacgaagtcatattggaaggcgctcggcatatccccttttcatgaacacgctgaggtcgtgttcacggcaaacgattccgggcctcggcggtacaccatcgccgcacttctgagcccatatagttacagtacgatggcggtagtcactaatccaaaagag

SEQ ID NO: 20294 - DNA, 441 bp, Artificial Sequence
  Description of Artificial Sequence: Synthetic coding sequence
atggcctcacaccgtctactgctgctatgtctggccggactcgtgtttgtgtcagaggcgggacctacaggcactggagagtccaaatgcccgctcatggtcaaggtcttggacgctgtccggggatcgcccgcaattaacgtggccgtccacgtctttagaaaggccgctgacgacacctgggagcctttcgcaagtgggaagactagcgaatctggggaactgcacggcctcacgactgaagaagagtttgtggaaggaatctataaggtggaaattgataccaagagctattggaaggctttgggcatctctccttttcatgaacatgctgaggtggtctttaccgccaacgattccggcccacgccggtataccattgcagccctgcttagcccttactcctatagtactatggctgtcgtgaccaatccaaaagag

SEQ ID NO: 20295 - DNA, 441 bp, Artificial Sequence
  Description of Artificial Sequence: Synthetic coding sequence
atggcgagccacagattgctgctgctctgtctcgctggtctggtgtttgtctcagaggccgggccgactggcaccggcgagagcaagtgcccgctcatggtgaaagtactggacgcggtccgcggctcgcctgcgatcaatgtcgcagtgcacgtgtttcggaaggcggccgacgacacctgggaacctttcgcttccggaaagactagcgagtcaggagaactgcatggtcttaccactgaagaggaattcgttgagggtatctacaaagtggaaatcgatacgaagtcgtactggaaggctctgggcataagccccttccatgaacacgcagaagttgtattcactgcaaacgattcagggccaaggcgctacacgatcgccgcgctgctctccccatattcttactccaccatggccgtggttaccaaccccaaggaa

SEQ ID NO: 20296 - DNA, 441 bp, Artificial Sequence
  Description of Artificial Sequence: Synthetic coding sequence
atggcgagccatagactgctcctcctgtgtcttgcggggctcgtgtttgtgtctgaagcagggccaactggaactggagaatcaaagtgccctctgatggtcaaggtgctggatgcggtgcgaggttcacccgccatcaacgtggccgtgcatgtgtttcgcaaggccgcagatgacacttgggagccttttgcttccggaaagacctcggagagtggagaactgcatggtctgactactgaagaggaatttgtggaaggtatttacaaggtggagattgatacgaagtcctactggaaagcacttggtatatcgcccttccacgaacatgcagaagtggtgtttaccgcgaatgactccggaccccggaggtacactatagcggcacttctcagcccatactcctattcgaccatggcagttgtcacgaaccctaaggag

SEQ ID NO: 20297 - DNA, 441 bp, Artificial Sequence
  Description of Artificial Sequence: Synthetic coding sequence
atggcatcgcatagactgcttcttctctgcctcgcaggcttggtgttcgtgtccgaggcgggtccaaccggcactggtgaatcgaagtgtcctctgatggtgaaggtgctcgacgccgtccggggaagcccagcgatcaacgttgcggtgcacgtgtttcgcaaggccgctgatgacacctgggaacccttcgcatcgggtaagacctctgagtccggagagctccacggtctgaccaccgaagaagaattcgtcgaaggaatctacaaggtggagattgatactaaatcatactggaaagcattgggaatttctccttttcatgaacatgccgaggtcgtgtttaccgccaacgattcgggccctagacggtacactattgcagcgttgctgagcccatactcttattcaacgatggccgtcgttacgaatccgaaggag

SEQ ID NO: 20298 - DNA, 441 bp, Artificial Sequence
  Description of Artificial Sequence: Synthetic coding sequence
atggccagtcaccgcctcctcctgttgtgcttggcagggctggtgtttgtaagcgaggcgggcccgacaggtaccggtgagagcaagtgccctctcatggtgaaagtgctggatgcagtacgagggtccccagcaatcaacgtggctgtgcatgtgtttaggaaggccgccgatgacacctgggagcccttcgcttcaggtaaaacgtctgaaagcggcgagctccatgggctgaccactgaggaagaatttgtagaaggcatatataaagtagaaatcgacacaaagtcctattggaaagcactgggcatctcccccttccatgaacacgcagaagtcgtgtttactgcaaatgattcgggtcctcgacgatatacaatcgccgcgctgctgtcgccctacagctattcaacaatggccgttgtgacgaaccccaaggaa

SEQ ID NO: 20299 - DNA, 441 bp, Artificial Sequence
  Description of Artificial Sequence: Synthetic coding sequence
atggcaagtcatcggctcctgctcctgtgcctcgccggactggtatttgtcagcgaagccgggcccacaggaaccggggagtccaagtgtcctctcatggtaaaggtcctagatgcggtgaggggatccccagccatcaacgtggccgtgcacgtgtttagaaaggctgctgacgacacctgggagcccttcgcttccggcaaaactagcgagagcggggagctgcacggtttgacgacagaggaggaatttgtggaagggatctacaaggtcgaaattgacacaaagtcctactggaaagccctggggattagcccatttcacgagcatgccgaggtggtgttcacagcaaatgacagtggccccagacgctacacaatcgctgcccttctgtccccatactcctactcgactatggccgttgtgaccaaccccaaagag

SEQ ID NO: 20300 - DNA, 441 bp, Artificial Sequence
  Description of Artificial Sequence: Synthetic coding sequence
atggcgtctcaccgtttgctactcctgtgccttgccgggctcgtatttgtttcagaggccggaccaaccgggacaggtgaatccaagtgccctctcatggtgaaagtcctggacgcagtcagagggtcacctgctattaacgtggctgtccacgtatttcgaaaagccgcagatgatacttgggaaccttttgcctccgggaagaccagcgagagcggagagttgcacgggctgactacagaagaagaattcgtggaagggatctacaaagttgagatcgacaccaagtcatattggaaggccctgggaatcagtccattccacgaacacgccgaggtagtgtttactgcaaacgactccggcccaagaagatacaccattgcagcccttctgtccccctactcttattctacaatggccgtcgtaacgaatcctaaggaa

SEQ ID NO: 20301 - DNA, 441 bp, Artificial Sequence
  Description of Artificial Sequence: Synthetic coding sequence
atggctagccaccgattactccttttgtgcctggccgggctagtgtttgtgtcagaagctgggcccacagggactggtgagtccaaatgccctttaatggtaaaagtcctagacgctgtacgaggtagccctgccatcaatgtcgccgtccacgtgttccgcaaagccgctgatgacacttgggagccgttcgcttccggcaagacatcagagagtggcgagctccacgggttgaccactgaagaggagtttgtggagggcatatacaaggttgagatcgacaccaaaagctattggaaagccttggggatatccccttttcatgagcacgccgaagtcgtgttcacagccaatgactcgggccctcgtcggtacactattgccgccctgttgtctccatatagttattctactatggcggtggtgaccaatccaaaggag

SEQ ID NO: 20302 - DNA, 441 bp, Artificial Sequence
  Description of Artificial Sequence: Synthetic coding sequence
atggcctcccacaggttgcttctcctgtgtctggcaggactcgttttcgtgtcagaagcggggcccaccggaactggagaatcaaagtgcccccttatggttaaagtccttgatgcagtgcgcggatcgccggccattaatgtggcagtgcatgtgtttagaaaggccgccgacgatacttgggagccgttcgcttccgggaaaacctcggaatccggcgaacttcatggtctgaccaccgaagaagaatttgtggagggaatctacaaagtcgaaatcgacactaaaagctactggaaggctcttggtatctcgccattccatgaacacgcagaagtggtgttcactgctaatgattcgggccctcggagatacaccatcgcagcgttgctttccccttactcgtacagcaccatggcagtcgtcacgaatcctaaggaa

SEQ ID NO: 20303 - DNA, 441 bp, Artificial Sequence
  Description of Artificial Sequence: Synthetic coding sequence
atggcatcccaccggctgttgctgctgtgcctggcgggccttgtctttgtcagcgaggccgggccgacaggcaccggcgagtcaaaatgtccgttgatggttaaggttctcgacgctgtgcgcggttcccctgccatcaacgtggccgttcacgttttccgcaaagcagcggacgatacatgggagccttttgctagtggcaagacctccgaatcgggcgaactgcatggactgaccactgaggaagagttcgtggagggaatatataaagttgaaattgatacaaaatcctactggaaggctctaggtatctcgccattccatgaacatgccgaggttgtgtttacggccaatgattctggccctagaagatacactattgccgccctgctgtctccatactcctactctactatggcagtagtgacaaatcccaaggag

SEQ ID NO: 20304 - DNA, 441 bp, Artificial Sequence
  Description of Artificial Sequence: Synthetic coding sequence
atggctagtcaccgtctgcttctgttgtgtttggccggcctcgtgttcgtgagtgaagccggaccgaccgggacgggggagtctaaatgtcccctgatggtgaaagtgttggatgcggtgcggggatctcctgctataaacgtggcagttcacgtcttccgaaaagcagcagatgatacctgggaacctttcgcttcaggcaaaacgtccgagagcggcgaactgcacggactaaccacggaggaggaattcgtcgaagggatctataaggtggagatcgacaccaaaagctactggaaggccctgggaatctccccattccatgaacacgccgaggtcgtcttcacagcaaacgactccggacctagacgatacacgattgccgccctcctgtctccctactcatattccactatggcggttgtgacaaatcccaaggag

SEQ ID NO: 20305 - DNA, 441 bp, Artificial Sequence
  Description of Artificial Sequence: Synthetic coding sequence
atggcttcccacagactcctcctgctgtgtctggccggtcttgtgtttgtgtcagaagctggcccaaccggcaccggcgagagcaaatgcccccttatggtgaaggtcctcgacgctgttcgcgggtcacctgccattaacgtggcggtccacgtgtttaggaaggccgcggacgacacctgggaaccctttgcaagcggcaaaactagcgaatcaggggaacttcatggactcaccaccgaagaggaattcgtcgaagggatctacaaggtggagattgacacaaagtcatattggaaagccctggggatctccccctttcacgagcacgcggaggtagtctttactgctaacgactctggaccgagacgatataccattgcagcactcctgtctccatattcttacagcacaatggccgtagtgacgaaccctaaggag

SEQ ID NO: 20306 - DNA, 441 bp, Artificial Sequence
  Description of Artificial Sequence: Synthetic coding sequence
atggcttcgcatcgccttctgctgctgtgtctggccgggcttgtgttcgtctcagaggccggaccgacggggactggcgaatccaagtgcccgctcatggtgaaagtgctggacgcagtgaggggatctccagccatcaacgtcgccgtgcatgtgttcagaaaggcagccgatgacacctgggaacccttcgcttcagggaaaacctcagagagcggagagctgcacggtctgaccaccgaggaagaatttgtggaaggaatctacaaggtggagattgatactaagtcttactggaaggcacttggtatcagcccgttccacgagcacgccgaagtggtctttactgcaaacgacagtggaccacggcgctacacgatcgcagcactgctctcgccctactcgtactccaccatggccgtggtcacgaatccgaaagaa

SEQ ID NO: 20307 - DNA, 441 bp, Artificial Sequence
  Description of Artificial Sequence: Synthetic coding sequence
atggcatctcatcgcttactccttctgtgtttagccgggctcgtattcgtatcagaagccggccccacgggaacaggcgaaagcaaatgtcctcttatggtcaaggttcttgacgccgtaagaggaagccccgctattaatgttgctgtgcacgtttttaggaaagcagccgatgacacttgggagcccttcgcgtctggcaaaacctctgagtcaggcgaactgcatggcctgacgaccgaagaggaattcgtcgaaggaatttacaaagtggagattgatacaaagagctattggaaggccctcggtattagtcctttccacgagcacgccgaggtggtatttactgccaacgatagcggacctcgccggtacactatcgcagcactcttaagcccgtatagctactcaacaatggctgtggtgactaatcctaaggaa

SEQ ID NO: 20308 - DNA, 441 bp, Artificial Sequence
  Description of Artificial Sequence: Synthetic coding sequence
atggccagccatcggttactactactctgcctggcaggtctcgtgttcgtttccgaggcaggaccgaccggcactggggagtccaagtgccctctcatggttaaggtgctagacgccgtaaggggctctcccgcaattaatgttgccgtacatgtcttccgaaaagcggccgatgacacctgggagcctttcgcctctggaaaaactagcgaatccggcgagctgcatggtctcacaactgaggaggagttcgtcgaggggatatataaagtggaaattgacactaaatcgtactggaaagctctcggcataagtccgtttcacgagcatgcggaagtagtgttcacagctaatgactccggcccgagaagatatacgatcgctgcgctgctgagcccgtatagttatagcacgatggccgtggtaactaatccgaaggaa

SEQ ID NO: 20309 - DNA, 441 bp, Artificial Sequence
  Description of Artificial Sequence: Synthetic coding sequence
atggcctctcaccgcttgctcctactgtgtctcgctggactggtttttgttagcgaagccggaccaaccggcaccggagaatcgaagtgcccactcatggttaaggtgctcgatgctgtcagaggttctcctgctataaacgtggctgtgcatgtgttccgcaaggcagcagacgatacttgggaacccttcgcatccggcaaaaccagcgagagcggggagctccacggtcttaccacagaagaggaattcgtggaggggatctataaagtggagatagatactaagtcttactggaaggcgctgggaatatcacccttccatgagcacgctgaagtcgtcttcactgccaacgactctggtcccaggagatataccattgcagctttattgtccccatatagctacagtaccatggctgtggttaccaacccgaaggag

SEQ ID NO: 20310 - DNA, 441 bp, Artificial Sequence
  Description of Artificial Sequence: Synthetic coding sequence
atggcatctcacaggctactgctcctgtgtttggccggactggtgttcgtgtccgaggccggaccaacaggaacaggagagagtaaatgtcccttaatggtaaaagtcttagacgccgttagaggatctcccgcgataaacgtggccgtgcacgtgtttcgcaaagccgcagatgatacttgggaaccttttgcctctggaaaaacatcggaatctggggaactgcatggactgactacagaagaagaatttgtagaagggatatacaaagtggaaatcgatacaaaaagttattggaaagctctcggaatctccccttttcacgaacatgcggaggtggtatttactgccaatgattcaggaccccgaaggtatacaatagccgcattgttatcaccttattcatattccacaatggcggtagttacaaatccaaaagag

SEQ ID NO: 20311 - DNA, 441 bp, Artificial Sequence
  Description of Artificial Sequence: Synthetic coding sequence
atggcatcgcatcgcctgcttctgctctgccttgcggggcttgtgtttgtgtctgaggccggaccaaccggcaccggagagtctaaatgccctctgatggtgaaggtccttgacgccgtcagaggcagccccgcaatcaatgtggcggtccacgtcttccggaaagcagccgatgatacatgggagcctttcgcctctgggaaaacgagcgagtccggggagctccatggcctcaccactgaagaagagttcgtcgagggcatttataaggttgagatcgacactaagagttattggaaagctctgggcattagcccctttcacgagcacgctgaggtcgtattcaccgcgaatgactcaggacctagaagatataccattgcggcattgttatccccatactcctattcaacgatggctgttgttaccaaccctaaagaa

SEQ ID NO: 20312 - DNA, 441 bp, Artificial Sequence
  Description of Artificial Sequence: Synthetic coding sequence
atggcaagccaccgtctattattgctgtgcttggccggcctggtgttcgtgtcagaagccggtcccacgggcacaggagagagcaagtgcccgctgatggttaaagtgttagacgccgtaaggggatcgcctgctattaacgtcgccgtccacgtcttccgcaaggctgcggatgatacctgggagccattcgcctcgggcaaaacatctgagagtggtgaactgcacggtctgaccactgaagaggaattcgttgaaggaatctacaaggtcgagattgataccaagagctattggaaagccctggggatttccccattccatgagcatgcggaggtagtattcacagcgaacgattccggaccgcgccgctacacgattgcggccctgctgagcccatacagctacagtaccatggccgtggttactaaccctaaggaa

SEQ ID NO: 20313 - DNA, 441 bp, Artificial Sequence
  Description of Artificial Sequence: Synthetic coding sequence
atggcctctcatagactgctgttgctgtgcctggctggcctggtgtttgtgtcagaagccggaccaactggcaccggcgagtccaaatgtcctctgatggtcaaggtgctggatgcagttcgcggatccccggctatcaacgttgccgttcatgtgtttagaaaagcagccgacgatacctgggagccttttgccagtggaaagacgtccgaatcgggagaactccacggcctcaccaccgaagaagagttcgttgaagggatctacaaggtcgaaattgatacaaagagctactggaaagccttgggtataagtcccttccacgagcacgccgaggtggtgttcaccgccaacgattccggtcccaggagatacactatcgctgcattgctgtctccttactcctactctacaatggcagtggtgactaatcccaaagag

SEQ ID NO: 20314 - DNA, 441 bp, Artificial Sequence
  Description of Artificial Sequence: Synthetic coding sequence
atggcgtcgcatcgactactactattatgtctagcgggtctagtatttgtatcggaagcgggtccgacgggtacgggtgaatcgaaatgtccgctaatggttaaagtattagatgcggtacgtggttcgccggcgataaatgttgcggtacatgtatttcgtaaagcggcggatgatacgtgggaaccgtttgcgtcgggtaaaacgtcggaatcgggtgaactacatggtttaacgacggaagaagaatttgtagaaggtatatataaagttgaaatagatacgaaatcgtattggaaagcgctaggtatatcgccgtttcatgaacatgcggaagtagtttttacggcgaatgattcgggtccgcgtcgttatacgatagcggcgctattatcgccgtattcgtattcgacgatggcggtagtaacgaatccgaaagaa

SEQ ID NO: 20315 - DNA, 441 bp, Artificial Sequence
  Description of Artificial Sequence: Synthetic coding sequence
atggcctctcaccgcctgcttttgctgtgcctggccggtctggtcttcgtctctgaggcaggccctaccggtaccggggaatctaagtgtccattgatggtgaaagtactcgacgcggtgcggggctcacccgcaattaatgtagccgtccacgtgttcagaaaggcggctgatgatacttgggaaccattcgcctcagggaagacatcggagtctggtgaattgcacggactgactacagaggaagagttcgttgagggcatatacaaagtcgagattgatacaaaaagctactggaaagcactgggaatcagcccctttcatgaacacgctgaagtagttttcacagctaatgatagcgggcctcggaggtacaccatcgcagcactgctgagcccatactcttattctactatggccgtcgtaaccaatcccaaagag

SEQ ID NO: 20316 - DNA, 441 bp, Artificial Sequence
  Description of Artificial Sequence: Synthetic coding sequence
atggcctcacatcggctcctgttgctgtgcctcgctggtctggtgtttgtgtctgaagccggcccaactggtaccggggagagcaagtgtccactcatggtgaaggtactggacgccgtcagggggtcaccagcaatcaatgtggcggtgcatgtcttcagaaaagccgcagacgatacctgggagcccttcgcatccgggaaaactagcgaatctggagagcttcatgggcttacaacagaggaggagtttgttgaaggcatttataaagtcgagatcgacacaaaatcttattggaaagctcttggcatcagcccctttcatgaacacgcagaggtcgtattcactgccaacgatagcgggccacggaggtacaccatcgccgccctgttgtccccctacagttattccacaatggccgttgttacgaacccaaaggaa

SEQ ID NO: 20317 - DNA, 441 bp, Artificial Sequence
  Description of Artificial Sequence: Synthetic coding sequence
atggcaagtcatcgtcttctgctcctgtgtctggcaggtttggtgtttgtatccgaagcagggccaaccgggaccggtgaatcaaagtgtccactgatggtcaaggtgctggatgctgtgcgcggctctcccgctatcaatgtcgccgtgcacgtgttccggaaggcggctgacgacacctgggaaccctttgcaagtgggaaaaccagtgagtcgggagagctccatggcctcaccactgaagaggagttcgtggagggaatctataaggtggagatagataccaaatcctattggaaagctctggggatctccccttttcacgagcacgccgaggtcgtgttcacagcaaacgatagtggacctaggaggtatactatagctgctctattaagtccctattcatattcaaccatggctgtcgtgaccaaccccaaagaa

SEQ ID NO: 20318 - DNA, 441 bp, Artificial Sequence
  Description of Artificial Sequence: Synthetic coding sequence
atggccagtcacagactgttactcctgtgcttagccggactggtgtttgtgtccgaggcaggccctacaggcaccggcgagagtaagtgccccctaatggttaaagttctcgatgctgtgaggggctcgcctgccatcaacgtggcagtgcacgtgtttaggaaagctgcagatgacacctgggagccctttgctagtggaaaaacttctgagagtggtgaactgcatggactgaccacagaagaggagttcgttgaaggtatctacaaagtggagatcgacaccaagagttactggaaggccctggggataagcccgttccatgagcacgcggaggtagtctttacagctaatgacagtggccctagaaggtacaccattgccgctctgctgtcgccatattcgtactcaacgatggctgtggtgacaaatccaaaggag

SEQ ID NO: 20319 - DNA, 441 bp, Artificial Sequence
  Description of Artificial Sequence: Synthetic coding sequence
atggcctcacatcgcctcctcctgctgtgcctggctggcctggtgttcgtgagcgaggctggaccaaccggtaccggtgagtccaaatgcccactgatggtcaaagtcttggacgccgttagaggcagtccagcgattaacgtcgcagtgcacgtcttcagaaaagccgcggacgatacatgggaacccttcgctagtggtaaaacatctgagtcaggagagttgcacggactcactactgaggaagaattcgttgagggaatctataaagtggagattgacaccaagagttactggaaggcactgggcatctcacccttccacgagcatgccgaagtagtgtttacggcaaacgactctggcccacgcaggtatacaattgcagcactcctctctccttactcttacagtacaatggctgtggtaactaaccctaaggag

SEQ ID NO: 20320 - DNA, 441 bp, Artificial Sequence
  Description of Artificial Sequence: Synthetic coding sequence
atggccagtcacaggctactcttattatgtcttgcagggcttgtttttgttagtgaagctggaccaacagggactggagaatctaaatgtccacttatggtaaaagtgctggatgccgtccgggggtcccccgcaataaacgtcgcggtgcatgtatttcggaaagccgcagatgatacatgggaaccatttgcctcaggaaagacttctgaaagtggagagctccacgggctcactacagaagaagaattcgtagaagggatctacaaagttgagatagacacaaagagttattggaaagccctaggaatctctcccttccacgaacatgccgaagtggtattcacagcaaatgactctggaccccgaagatatactatcgcagcactcctatccccctacagttactcaactatggccgtcgtgacaaaccctaaggag

SEQ ID NO: 20321 - DNA, 441 bp, Artificial Sequence
  Description of Artificial Sequence: Synthetic coding sequence
atggcatcccaccgactacttcttttatgcttggccggactggtgtttgtttccgaagctggtcccaccggtaccggggagtcgaaatgtcccctgatggtaaaagtgctggacgccgttagagggtcccctgccataaacgtcgcagtccacgtcttccggaaggcggcggacgacacgtgggaaccattcgcctcaggaaagaccagtgagtcaggtgagctgcatggcctaacaaccgaagaagagtttgttgagggaatctataaggtcgagatagataccaagtcctactggaaggccttgggtatttccccctttcatgagcatgccgaggtggttttcactgcgaatgattcagggcctagaagatacacaattgcagcgctactaagtccgtactcatatagcacgatggccgtagtgaccaaccccaaagaa

SEQ ID NO: 20322 - DNA, 441 bp, Artificial Sequence
  Description of Artificial Sequence: Synthetic coding sequence
atggcatcccatcgcctcctccttttgtgtcttgcaggtttggtgtttgtgtctgaggctgggcccaccggcaccggtgaaagcaagtgccccttgatggttaaagtcttggatgcagttcgtggctcacctgcaattaatgtcgcagtgcacgtgttcagaaaggccgcggatgatacgtgggaaccctttgcctcaggaaaaacttcggaaagtggcgagctgcacggtctgaccactgaagaggagtttgtggaaggcatttataaagtggagatagatacaaaaagttactggaaggcactgggaatctcccccttccacgaacacgccgaggtggtcttcactgccaatgattctggaccaagaaggtatacaatcgccgctctgttatccccttacagctattccaccatggctgttgtgaccaaccccaaagag

SEQ ID NO: 20323 - DNA, 441 bp, Artificial Sequence
  Description of Artificial Sequence: Synthetic coding sequence
atggcctcccaccgcttgctcctgctctgcctggctgggttggtgtttgtgtctgaggcaggtcctaccggcacaggggaaagcaaatgcccacttatggttaaggtgcttgatgcagtccgggggtctcctgccatcaatgtagccgtgcacgtgtttcggaaggctgctgatgatacctgggagcctttcgcttccggcaaaacctccgagagcggggaactgcacggcttgaccaccgaggaagagtttgttgagggcatttataaggtagagatagatacaaaatcctactggaaagcgttaggcatctcccctttccacgaacacgcggaggtagtatttacagctaacgattccggtcctagacggtataccattgccgctctgttatccccttactcttattcaaccatggctgtcgtcactaacccgaaggag

SEQ ID NO: 20324 - DNA, 441 bp, Artificial Sequence
  Description of Artificial Sequence: Synthetic coding sequence
atggctagccaccggctgttgttgctgtgtttagcagggcttgtgttcgtgagtgaggcaggtcctacaggcacgggtgaatccaagtgcccattgatggtaaaagttttagacgccgtgagggggtcccctgccattaatgtcgcagtgcatgtctttcgaaaagctgcagacgacacttgggagccatttgcatccggaaagacgagcgaatctggcgagcttcacggcttgacaactgaagaagagtttgtagaggggatttacaaggtggagatcgacactaaatcttactggaaagccctcggtatcagcccattccacgagcacgcagaggttgtgtttaccgcaaacgacagtggccctcggagatacaccatcgccgcactcctgagcccttactcctatagcaccatggccgtcgtgaccaaccctaaagaa

SEQ ID NO: 20325 - DNA, 441 bp, Artificial Sequence
  Description of Artificial Sequence: Synthetic coding sequence
atggctagccaccgtctgctacttctgtgcctcgccggtctggtgttcgtatctgaggctggccccaccggcaccggggagagtaagtgcccactcatggtcaaagtacttgacgccgtgcgaggctctccggctattaacgtcgcagtccacgtgttcaggaaggccgctgatgacacctgggaaccttttgcatctggcaagacctctgaatcaggggagttgcatgggttgacaaccgaagaagaatttgtggagggcatttacaaggtagagattgatactaagtcatactggaaggccctcggaatcagcccttttcatgaacacgccgaggtcgtgttcaccgcaaacgattctgggcctagaaggtacaccatcgctgctctcctgtcgccttactcatatagcaccatggccgtcgtcacaaaccccaaagag

SEQ ID NO: 20326 - DNA, 441 bp, Artificial Sequence
  Description of Artificial Sequence: Synthetic coding sequence
atggcctcacatcggctacttttgctctgtctcgccgggcttgtattcgtgagtgaagctggacccaccggaaccggtgagtcaaagtgcccacttatggtgaaggtgctggacgccgtcagaggctcccccgcaattaatgtggcagtccatgtgtttcggaaggctgccgatgatacttgggaaccatttgccagcgggaaaacatccgaatcaggcgaactccacgggctgacaaccgaggaagagtttgtagagggcatttataaggtggagatcgacactaaatcctattggaaagctctgggcatttcacccttccacgagcacgccgaagtggtatttaccgccaatgactctggaccccgtaggtatacgatcgccgcgctcctgtcaccctactcttacagcaccatggccgtggtaacaaatcctaaagag

SEQ ID NO: 20327 - DNA, 441 bp, Artificial Sequence
  Description of Artificial Sequence: Synthetic coding sequence
atggctagccacagactgcttctgctgtgcctggcggggttagtctttgtgtccgaggctggacccaccggcacgggcgagtcgaagtgtcccttaatggtgaaggtgctggacgctgtccggggctctcccgccatcaatgtggcggtgcatgtattcaggaaggccgctgatgacacctgggagcccttcgcaagtggaaaaacctctgaatcaggcgaactgcacggcctgacaaccgaggaggaatttgttgaggggatctataaggtggaaatcgataccaagtcatactggaaagctcttggcatctccccctttcacgaacacgcagaggttgtgttcacggctaacgactcagggcccagaaggtacaccattgccgccctgctcagcccgtatagctactctaccatggcagtcgtgacgaatcccaaggag

SEQ ID NO: 20328 - DNA, 441 bp, Artificial Sequence; identical to SEQ ID NO: 20308
  Description of Artificial Sequence: Synthetic coding sequence

SEQ ID NO: 20329 - DNA, 441 bp, Artificial Sequence
  Description of Artificial Sequence: Synthetic coding sequence
atggcctctcacaggctcctcctgctgtgcttggccggactggtcttcgtgtccgaagctggtcctactggtaccggcgagtctaagtgccccctgatggtcaaggtcctcgacgccgttagaggcagtccagccattaatgtggccgtccatgtgttcaggaaggccgcagacgatacttgggagcccttcgcctccggtaagacatccgagtcaggtgaattgcatggtctcacaaccgaagaggaatttgtggaaggcatttataaggttgaaatcgacacaaagtcctattggaaagccctgggaatttctccttttcacgaacacgccgaggtggtgttcactgccaacgacagtggaccccgccgttacactatcgccgcccttctgtctccctactcctactccacaatggcagtcgtgacaaatccaaaggag

SEQ ID NO: 20330 - DNA, 441 bp, Artificial Sequence
  Description of Artificial Sequence: Synthetic coding sequence
atggcttcccacaggctgctgttgctgtgcctcgccggcctcgtcttcgtttctgaagccggtccaacagggacaggagagagcaagtgccctttgatggtgaaagtgctcgacgctgttaggggttcacctgctattaacgtcgccgtgcacgtttttcgcaaggccgccgacgatacttgggagccattcgctagcggcaagacatctgagagcggggaactacacggcctaactacagaggaggaattcgtggaggggatctataaggtggagattgacaccaaatcctattggaaagccctgggaatttccccattccacgaacacgcagaggttgtgttcacggcgaacgattccgggcccaggcggtacaccattgccgccctgctgagtccgtattcttattccaccatggcagttgtgacaaatcccaaagaa

SEQ ID NO: 20331 - DNA, 441 bp, Artificial Sequence
  Description of Artificial Sequence: Synthetic coding sequence
atggcttcacaccgactattgcttttgtgccttgcaggtcttgtattcgtgagtgaggcaggaccgacgggaacaggagaatccaaatgcccgttaatggtgaaagtattggatgctgttcgaggtagccctgctatcaacgtcgctgtccatgttttcagaaaagccgctgatgatacttgggagccgtttgcgagtggcaagacgtcagagtccggagaattacatggtttgacaacggaagaagaattcgtggaaggaatatacaaagtcgagattgatacgaagtcgtattggaaggccctaggaatcagtccatttcacgaacacgcagaagtagtgttcactgctaatgattctggaccacgaagatacacaatcgctgctttattatcaccatactcttactctacaatggcggtcgttactaacccaaaagag

SEQ ID NO: 20332 - DNA, 441 bp, Artificial Sequence
  Description of Artificial Sequence: Synthetic coding sequence
atggcctcgcatagactactactattatgcctcgccggtctggtttttgtgagtgaggccggacccaccggtacaggcgagtccaagtgccctctaatggtcaaggtgctggacgccgttcgaggctcacctgctataaatgtggcggtacacgtcttccgcaaagctgcagacgatacttgggagccttttgcaagtggaaagaccagcgagagcggcgagctccacgggctgacaacagaggaagagttcgtggagggcatctataaggtggaaatcgataccaaatcttattggaaggccctcggaatcagccccttccacgaacatgcagaagttgtgttcactgccaacgattccggaccgcgcagatacacaatagccgctctgctctctccttatagttactccaccatggctgtggtgacaaatcctaaggaa

SEQ ID NO: 20333 - DNA, 441 bp, Artificial Sequence
  Description of Artificial Sequence: Synthetic coding sequence
atggcctcacaccgcttgcttcttttgtgcctcgctgggctcgtctttgtttcggaagccggcccaaccgggacaggagagtcgaagtgtcctttgatggtcaaggttctcgacgccgtccgtgggtcccctgccattaacgtggcggtacacgtgtttcgtaaagctgctgatgatacatgggagcccttcgcatcgggcaagacctcggagtcaggagaattacatggactcaccacggaggaagaattcgtggaggggatctacaaagtggagattgatacaaaatcgtactggaaggcgctcggaatcagccccttccacgagcatgctgaggtggtatttacagccaatgactccggccctcgtcggtatacgatagctgcgctcctatctccttacagctattcgaccatggccgtcgtcactaaccccaaagag

SEQ ID NO: 20334 - DNA, 441 bp, Artificial Sequence
  Description of Artificial Sequence: Synthetic coding sequence
atggcttctcataggcttctcctcttatgtttggccggactggtttttgtgagtgaagcaggtcccacagggacaggcgagagtaagtgtcctctgatggtgaaggtgctggatgctgtgcgtggatctcccgcaatcaatgtcgccgtccatgtgttcagaaaagctgcagatgatacctgggaacctttcgcgtctgggaagacgagtgaatcaggggagctgcacggattgacaaccgaagaagaatttgtagaaggtatatacaaggtagaaatcgataccaagagttactggaaagcattaggaatttcccctttccacgaacacgcagaagttgtcttcaccgccaacgactccgggccacggagatacacaattgccgcactcctgagcccttatagttactctactatggccgtggtgactaacccgaaggag

SEQ ID NO: 20335 - DNA, 441 bp, Artificial Sequence
  Description of Artificial Sequence: Synthetic coding sequence
atggcctctcataggctactgttgctctgcctggccggcctggtcttcgtatctgaggctggccccactgggaccggggagagcaaatgtcccctgatggtgaaagtgctcgacgcggtaagaggatctccagcaatcaacgtggctgtgcacgtgtttagaaaagccgccgatgacacctgggagccgtttgcatctggaaagaccagcgagagcggggaattacacggactgactacggaggaggagtttgtagagggcatttacaaggtcgagatcgacaccaaaagctattggaaggctctgggaatctctccgtttcacgagcacgcagaagttgtgtttaccgcgaatgattcgggccctaggaggtataccatcgccgcgcttctttcaccatatagctactcaaccatggctgtggtcacaaaccccaaagag

SEQ ID NO: 20336 - DNA, 441 bp, Artificial Sequence
  Description of Artificial Sequence: Synthetic coding sequence
atggcctcacaccggctgttgttgctgtgcctggccggtctggtcttcgtgtcggaggcgggcccgaccggcacaggcgaaagcaaatgcccattgatggtgaaagtgctggatgcagtgcggggctccccagctatcaacgtcgccgtgcatgtctttcgcaaggcagcggatgacacctgggaaccgtttgcttccggcaaaaccagcgagagcggtgagctgcacggcctgaccacggaggaggaatttgtcgaaggtatctacaaggtagaaatagacactaaaagctattggaaggctctcgggatcagcccgttccacgagcacgcggaggtggttttcacggctaatgatagcggccctcgtcgatacaccatcgcggcactccttagcccgtatagctactccaccatggcagtggtcacgaaccctaaagaa

SEQ ID NO: 20337 - DNA, 441 bp, Artificial Sequence
  Description of Artificial Sequence: Synthetic coding sequence
atggcgtcccataggctgcttctcctgtgccttgccggcctggtgttcgtcagcgaagccgggcctacgggcaccggcgagagcaagtgcccactgatggttaaggtactggatgccgtacggggctcacctgctatcaatgttgccgtgcatgtgttcaggaaagctgccgacgacacttgggagcctttcgcctctgggaaaacatccgagtcgggagagctccatggtctcaccacggaggaggagttcgtggagggcatatataaggttgaaatcgatacaaaaagctactggaaagccttgggtatcagccccttccacgaacacgcagaagtcgtcttcaccgccaatgattctggcccacgccgatacaccattgccgccttgctgagtccatactcgtattcgactatggctgtcgttacaaaccctaaggag

SEQ ID NO: 20338 - DNA, 441 bp, Artificial Sequence
  Description of Artificial Sequence: Synthetic coding sequence
atggcctctcatcgactgcttctcctgtgtctcgctggcctggtgtttgtttcagaggccggacccaccgggacaggcgagtccaaatgtcccctgatggtgaaggtgctcgatgctgtgagggggagccccgcaatcaatgtggccgtgcacgttttccggaaggccgccgacgatacctgggagcctttcgcatccgggaagaccagcgagagcggagaactgcacggcctcaccaccgaggaggagtttgtggaaggcatttacaaggtcgagatcgacacaaagagctattggaaagctctggggatttctcccttccatgaacacgcggaggtcgtgttcacagcaaatgactcaggaccccggcgatatacgatcgccgccctgctgagtccatattcctactcaactatggccgttgtcactaatcctaaggag

SEQ ID NO: 20339 - DNA, 441 bp, Artificial Sequence
  Description of Artificial Sequence: Synthetic coding sequence
atggcctcacataggcttctgctcctctgtctggcgggactcgtgttcgtgagtgaagcaggaccaacaggcaccggtgagtccaaatgtccacttatggttaaggtgctcgacgccgtgagagggtcccccgcaattaacgtggccgtgcatgtcttccgaaaggccgccgatgatacttgggagcccttcgcgagcgggaagacgtccgaaagcggggagctgcacggactgaccactgaagaggaattcgtggagggaatctataaggttgagatcgacacgaaaagttattggaaagcactgggtatctcaccattccacgaacatgccgaagttgtgttcacagctaacgactccgggccaaggcgctacaccatcgcagccctgctctctccttacagttatagcactatggctgtggttaccaatccgaaggag

SEQ ID NO: 20340 - DNA, 441 bp, Artificial Sequence
  Description of Artificial Sequence: Synthetic coding sequence
atggcttcacatcgattacttttactctgcttggcaggcctggtcttcgtgagtgaggcgggaccgacgggcactggtgaatcaaaatgtcctctgatggtcaaggttttagatgcagttcgtggttctcctgccattaacgtggcagtgcacgtttttcgtaaggcggcagatgatacatgggagccgtttgcatcgggaaaaacaagcgaatcaggggaattacacggtctgacaacggaggaggaatttgtggaaggtatctataaggtggaaattgatacaaaatcttattggaaagctcttggaatatcaccgtttcatgaacatgcagaagtggtttttacagcgaatgattctggcccgcgccgctacacgatcgcagcactgctctccccctattcgtactctacgatggccgttgtgacgaacccgaaggag

SEQ ID NO: 20341 - DNA, 441 bp, Artificial Sequence
  Description of Artificial Sequence: Synthetic coding sequence
atggcttctcaccgcctgcttctgctatgtctcgcaggtcttgtcttcgtgtccgaagccggtcccacgggtaccggcgagagcaagtgccctctgatggtgaaggtccttgacgccgtccgcggttcccccgccattaatgtggcagtgcatgtcttcagaaaggctgccgacgacacatgggagccctttgctagcggcaagacctctgagtccggcgagcttcatggtctgacgactgaagaagaattcgtcgagggtatttacaaggtggagatcgacactaagtcctactggaaggctttaggtatcagccctttccacgagcacgcggaggttgtcttcaccgctaacgacagcggcccccgtaggtataccatcgcggcgctcttgtcgccctactcctacagtacaatggctgtcgtcaccaatcctaaggaa

SEQ ID NO: 20342 - DNA, 441 bp, Artificial Sequence
  Description of Artificial Sequence: Synthetic coding sequence
atggcttctcatcgtctgttacttctttgtcttgcgggattggtttttgtttccgaggctggtcccaccggaacgggggagtccaagtgtcctttaatggttaaagtgttagatgcggtaaggggttctcctgcaattaatgtggcggttcacgtattcagaaaggctgctgatgatacctgggagccatttgctagtgggaaaacatctgagtctggtgaacttcatggtctcaccaccgaggaggagtttgtggaaggaatatataaggtcgaaatagatactaaaagttattggaaggcattgggaatctccccttttcatgaacatgcagaggtcgtgttcaccgctaacgattcaggcccacgcagatatacgattgctgccttgcttagcccatattcctatagcactatggcggtagttacaaaccctaaggaa

SEQ ID NO: 20343 - DNA, 441 bp, Artificial Sequence
  Description of Artificial Sequence: Synthetic coding sequence
atggcaagccatagactgcttctgctatgcttagccggcctcgtgtttgtttctgaggccgggccaacaggaacaggtgagtccaagtgtccactcatggtaaaggtgcttgacgctgtgcgcggttcccctgcaataaatgttgctgtgcacgtgttcaggaaggctgcagacgacacttgggagccgttcgcttctgggaagactagtgagagtggcgaactacacggtctgactacagaagaggagtttgtagagggaatctataaggtggagatcgatacaaagtcctattggaaggccctggggatatctccgtttcatgagcacgccgaggtagtcttcaccgcaaatgacagcgggccgagacgatataccattgctgccttactgtccccctattcttactccacaatggccgtggtgactaaccccaaagag

SEQ ID NO: 20344 - DNA, 441 bp, Artificial Sequence
  Description of Artificial Sequence: Synthetic coding sequence
atggcaagccacaggctgctcttgctttgcttagccgggctagtgttcgtctctgaggccggcccgactggcaccggggaatccaagtgtcctctcatggtgaaagtactcgatgccgtccggggatcgcccgctattaacgttgcagttcatgtctttaggaaggccgccgacgatacgtgggagccctttgcgagtggcaagactagcgagtcgggagaattgcacggattaacaaccgaggaggaattcgtggagggaatttataaggtagagattgacaccaagtcttattggaaagcccttggtatctcccccttccacgaacatgccgaggtagtgttcaccgccaacgattcaggacctaggcgctacacgattgccgcgctgctgagtccatacagctattccaccatggccgttgttaccaatcctaaagaa

SEQ ID NO: 20345 - DNA, 441 bp, Artificial Sequence
  Description of Artificial Sequence: Synthetic coding sequence
atggcctcccaccggctgttgcttctgtgcctcgcaggtctggtctttgtgtccgaagctggcccgaccggcacaggagaaagcaaatgccccctgatggtgaaagtgctggacgccgtcaggggctcacccgcaatcaacgtggccgtgcatgtgtttcgaaaagctgcagacgacacatgggagccattcgccagtggcaaaacctccgagtcaggagaactccacggcctaaccacagaggaggagtttgtggagggcatttataaggtggagattgacaccaagagctactggaaagccctgggtatcagcccatttcatgaacatgccgaggtagtgttcaccgcgaacgactcaggaccaaggaggtacacgatcgctgctctgctgagcccatacagttactccactatggccgttgtgaccaatcccaaagaa

SEQ ID NO: 20346 - DNA, 441 bp, Artificial Sequence
  Description of Artificial Sequence: Synthetic coding sequence
atggcatctcatagattacttcttctttgtttggctggattagtatttgtatcagaagctggtccaactggaactggagaaagtaagtgtccacttatggttaaagttcttgatgctgttagaggtagtcctgcaattaacgttgcagtacatgtttttcgtaaggctgctgatgatacttgggaaccattcgcatctggtaaaacttctgaatcaggagaacttcatggtttaactacagaagaagagtttgttgaagggatttataaagtagaaattgatacaaaatcatattggaaggcacttggaatatcaccattccatgaacatgcagaagttgtttttacagctaatgattcaggtccaaggcgatatacaattgcagctttattatctccatattcttattcaacaatggcagttgtaacaaatccaaaagaa

SEQ ID NO: 20347 - DNA, 441 bp, Artificial Sequence
  Description of Artificial Sequence: Synthetic coding sequence
atggcatcacatagattactgctgctatgtctggccgggctagtcttcgtaagtgaggctggtcctacaggcaccggtgagagtaagtgccctctgatggtcaaagtgctggatgctgtccgcggctccccagctattaatgtcgctgttcacgtttttaggaaagccgctgacgatacatgggaaccctttgcttctgggaagaccagcgaatctggcgagctgcacggcttgaccaccgaggaggagtttgtggagggcatctataaggtcgagatcgacacaaaaagctattggaaggcactgggcataagcccctttcacgaacatgctgaagtggtgttcacagcaaacgacagcggcccaagacgatacactattgccgctctgctgagcccttatagttacagcaccatggccgttgtgacaaaccccaaggaa

SEQ ID NO: 20348 - DNA, 441 bp, Artificial Sequence
  Description of Artificial Sequence: Synthetic coding sequence
atggcttcccacagactgctcctactgtgtctggcagggctggtcttcgtcagtgaagctggcccgactggtacaggcgaatctaagtgtcctctcatggtgaaggtgcttgacgccgtgagaggaagtccagccatcaacgtggccgtgcatgtgtttaggaaagccgccgatgacacttgggagccgtttgcctccggaaagacatctgaatctggcgagttgcacgggttgaccacggaagaagaatttgtggaaggaatctacaaagtggagatcgatactaagtcctactggaaggcccttgggatcagcccatttcatgagcatgctgaggtggtgttcacagcaaatgactccggtccaaggagatatactatcgccgcccttttgtctccctactcatattctaccatggcagtagtcaccaaccccaaagag

SEQ ID NO: 20349 - DNA, 441 bp, Artificial Sequence
  Description of Artificial Sequence: Synthetic coding sequence
atggcctcacatagactactattactgtgcctggccggactagttttcgtgagcgaggccggccctaccggaaccggagaatcaaaatgccccttgatggtcaaggtcttagacgccgtccgaggttctccagccattaacgtggctgtgcacgttttccgcaaggcggccgacgacacctgggagcccttcgccagtggaaagacctccgaaagtggagagctgcacgggctcacaactgaagaagagtttgtggaaggtatctacaaggtggagatcgatacaaaaagctattggaaagcactggggatctccccatttcatgagcacgctgaggtcgtgttcactgcaaatgattccgggcctcgacggtataccatcgctgccctgctgagtccctacagttattctaccatggccgtggtaaccaatcctaaggaa

SEQ ID NO: 20350 - DNA, 441 bp, Artificial Sequence
  Description of Artificial Sequence: Synthetic coding sequence
atggcaagtcatcgcttgctcctgctatgtctggccgggctggtcttcgtgtctgaagccgggcctacaggaacaggcgagtctaaatgccccctgatggtgaaggtactggatgctgtgaggggcagccccgctatcaatgtcgccgtccacgtattccggaaagcagccgatgacacttgggagccctttgcctccggcaaaacctccgagtccggcgagttgcatggtttaacgacagaggaggagttcgtggaaggcatttataaggtggagatcgatacgaagtcatactggaaggctttgggcatcagcccgttccatgagcatgccgaggtggttttcacagccaacgattccgggccaagacgatacaccatcgcagctctgctgtccccctacagttattccactatggccgtggtgacaaatcccaaggaa

SEQ ID NO: 20351 - DNA, 441 bp, Artificial Sequence
  Description of Artificial Sequence: Synthetic coding sequence
atggcgtcccacagactactccttctctgcctggccggcctggtgtttgtgagtgaggccggccccacaggtacaggggagagtaagtgccctcttatggtaaaagttctggatgcggtgcgtggcagccctgcgatcaatgtggccgtgcacgtatttcgcaaagccgcagatgatacctgggagccatttgctagcggcaagacatccgagagtggcgaattgcacgggcttaccaccgaggaagagttcgtggaggggatctataaggtcgaaatcgacactaagagctattggaaagcccttgggatcagccctttccacgaacacgcagaggtagtcttcacagctaatgatagcggcccgaggcgatacaccatcgccgcgctgctttctccgtattcttatagtacaatggcggtggtgacaaatcccaaggag

SEQ ID NO: 20352 - DNA, 441 bp, Artificial Sequence
  Description of Artificial Sequence: Synthetic coding sequence
atggcctcgcacagactcctgcttctctgcctcgcaggacttgtcttcgtgtctgaggccggccccactggaaccggagagtcaaagtgcccactgatggtgaaggtgttggatgcagtccgtggcagcccagctattaacgtggcagtccacgtgttcaggaaggccgcagacgacacttgggagcctttcgcatctggaaaaacgtctgagagcggagaactgcatggtctgaccaccgaagaggagtttgtcgaaggaatttataaggtagagatcgacacaaagagttattggaaggcactggggatctccccattccatgaacacgctgaggtggtgttcaccgctaacgactctggtcccaggcggtataccattgccgccctgctgagcccttattcctacagcaccatggccgtggtgacgaaccccaaggag

SEQ ID NO: 20353 - DNA, 441 bp, Artificial Sequence
  Description of Artificial Sequence: Synthetic coding sequence
atggcctcacacaggctacttcttttgtgtttggctggacttgtttttgtgagcgaggcgggcccaactggtaccggcgagtccaagtgcccgctcatggttaaggtgttagatgctgttagggggtctccagcaatcaatgttgccgtgcatgtcttcagaaaggcagccgatgacacttgggagccatttgcctctggaaaaactagtgagtctggggagctgcacgggctaaccactgaggaggagtttgtcgagggcatatataaggttgaaatcgacacgaagagctattggaaagcccttggaatcagtccctttcatgagcacgcagaggtcgtgtttacagctaatgatagtggccctcgcagatatactattgctgctcttctgtctccttactcctacagtacaatggcggtggttacgaacccgaaggag

SEQ ID NO: 20354 - DNA, 441 bp, Artificial Sequence
  Description of Artificial Sequence: Synthetic coding sequence
atggcctcacatagattgttgctgctatgtttagcagggctggtcttcgtatcagaggcagggccgaccggaacgggagaaagcaaatgtccactgatggttaaagtgctggatgccgtgcgcggttctccagccataaatgtcgccgtccatgtctttcggaaagcagccgatgacacctgggagccatttgcctccggtaaaactagcgagtccggagagctccacggtctgacaacagaagaggagttcgtagagggaatttacaaagtcgagatcgacacaaaaagctattggaaggctctcggcatctcccccttccacgaacacgcagaggtagtctttactgccaacgattccggtcctaggaggtataccatcgcagctctattgtctccttattcctatagtactatggctgtggtcactaaccccaaagaa

SEQ ID NO: 20355 - DNA, 441 bp, Artificial Sequence
  Description of Artificial Sequence: Synthetic coding sequence
atggcatcacaccgattactgttgctctgcctggccggactcgtgtttgtaagtgaagcaggccctaccggtactggcgaaagcaagtgtcctcttatggtgaaggtactggacgctgttagaggcagcccggctatcaacgtggcggtgcatgtgtttcgcaaggcggccgacgatacgtgggaaccatttgcttcaggcaagaccagcgagtctggagaactacatggcctgaccacggaggaggagtttgtggagggaatctacaaagtggaaattgacacaaagtcatattggaaggctctagggatttctcctttccacgagcatgcagaggtcgtgttcaccgcaaatgattccggtccaaggcgctacacgattgcggcacttctgtctccgtattcctactcgactatggcggtggtaacaaaccctaaagag

SEQ ID NO: 20356 - DNA, 441 bp, Artificial Sequence
  Description of Artificial Sequence: Synthetic coding sequence
atggcatcacacaggctgcttttgttatgtctagctgggctcgtcttcgtaagtgaagcaggcccaactgggacgggcgagtccaagtgccccttgatggtgaaggtcctcgacgcagtgcgaggaagtccagcgatcaacgtagcagtgcatgtgtttcgcaaagcagcggacgacacatgggaacccttcgctagtggaaaaacctccgagtcaggcgagctgcacgggctgacaaccgaggaggaatttgttgaggggatctataaggtcgaaatcgataccaaatcctattggaaggccttgggaattagcccattccatgaacacgccgaagtggtgtttaccgcaaacgactctggtcctcggcgctacacgatcgctgctcttctgtcaccgtattcatactcaactatggcagtggtaactaaccccaaggag

SEQ ID NO: 20357 - DNA, 441 bp, Artificial Sequence
  Description of Artificial Sequence: Synthetic coding sequence
atggcctcgcacaggctgctgctgctttgtctggcagggctcgtttttgtcagcgaagccggaccaactggcaccggagaatcgaagtgcccgctgatggtgaaagtcctggatgccgtgcggggctcgccggccattaacgtggcggtgcatgtgttcagaaaggcagcagacgacacctgggagccgttcgctagcggaaagactagcgaatcaggggagctccacggcttgacgaccgaggaggaattcgtcgaaggtatctacaaggtcgagatcgataccaagtcttactggaaggcgctgggaatctccccctttcacgagcatgctgaagtggtgttcactgcgaatgactccggacctcgccgctacaccatcgctgccctcctctcaccttattcctactcgactatggccgtggtgactaacccaaaagaa

SEQ ID NO: 20358 - DNA, 441 bp, Artificial Sequence
  Description of Artificial Sequence: Synthetic coding sequence
atggcttcccacagactactactgctttgtttggctggccttgttttcgtgtcagaagcaggccccacagggactggcgagtccaagtgtcctcttatggtgaaggtgcttgatgcggtaagggggagcccagcaataaacgttgccgtgcatgtgtttcgcaaggctgccgacgacacctgggaaccctttgcctccggcaaaacatctgaatcaggtgagttacacgggctcacaacagaagaggagttcgtcgagggaatctataaagtcgagattgatacgaaaagttattggaaagccttaggtataagtccgttccatgagcacgcagaggtggtcttcactgcaaatgactcaggcccccgccgatatacaattgccgcgcttttgtccccctacagttacagtactatggctgtcgtgactaatccgaaggag

SEQ ID NO: 20359 - DNA, 1170 bp, Artificial Sequence
  Description of Artificial Sequence: Synthetic coding sequence
atgaacggcacccgaaattggtgtaccctggtcgacgttcatcccgaggaccaagctgccggatcagtggatatcctcagactgaccctgcaaggggaacttactggggatgagctagaacacatcgcccagaaagctggcaggaaaacctatgcaatggtcagctctcactcagcaggacattcattggccagtgagctggtggagtcgcacgacggccatgaggagatcattaaagtctacctaaaggggcgctctggcgacaagatgatccatgaaaagaacatcaatcagctgaagtcagaggtccagtatatccaggaggcaaggaactgcttacaaaagctgcgtgaggacatctcatctaaattggatcgtaatctaggcgattctctgcaccgccaggaaatccaggtcgtgctcgaaaagcctaacggattctctcagagcccaaccgccctgtactcatctccaccggaagtggatacctgcatcaacgaagacgtggaaagcttgaggaaaacagtacaggaccttcttgccaaacttcaggaggccaagcgacagcatcagtccgattgtgtggcctttgaagtgaccctgtcgaggtatcagcgtgaggcagaacagtcgaatgtcgcattacagagggaggaggatcgagttgaacagaaagaagccgaagtgggagagctccagcgcaggctgttgggcatggagacggaacatcaagccctcctggccaaagtgagggagggagaggtcgcgctggaggaactgagatctaataacgctgattgccaggccgaacgagaaaaagcagcaaccctggagaaggaagtcgcaggcctcagggaaaagatccaccacctagacgatatgctgaaaagtcagcagcgcaaggtacgacagatgatcgaacagcttcagaacagcaaagcggttattcagagcaaggacgctaccattcaggagctgaaagaaaagattgcctacctggaggcggaaaacctggagatgcatgatcgaatggaacacctgatcgagaaacagatctcccacgggaacttcagcacacaggcacgcgctaaaaccgaaaatcccggtagcattcggatttccaaaccaccttcccctaaacctatgcccgtcatccgtgtggtggagacg

SEQ ID NO: 20360 - DNA, 1170 bp, Artificial Sequence
  Description of Artificial Sequence: Synthetic coding sequence
atgaacggaacccgcaattggtgtaccctcgtggatgtccacccagaagatcaagcagcggggtcggtggatatactgaggcttacgctgcagggagaactcactggcgatgagctggaacatattgcgcaaaaggccggaaggaaaacctacgcaatggtgtcatcccattcagctggccactctcttgcatccgaactggtggaaagccacgacgggcatgaagagatcatcaaagtgtatctcaaaggaagatcgggggataagatgatccatgagaagaatatcaatcagctgaagagcgaagtccagtacatacaagaggcacgtaattgtctgcaaaagctcagagaggatatctcgtcgaaactcgaccggaacttgggtgacagcctgcaccggcaggagattcaggtcgtgctcgaaaaaccaaacggtttctcccagtcccctactgctctgtacagcagccctcccgaggtggatacctgtatcaacgaggatgtggaatcactccggaaaactgtgcaagatctcctcgcaaagctgcaagaagcaaaacggcagcatcagtccgattgtgttgcatttgaagtgactctgtcaaggtaccagcgggaggccgagcagtccaacgtcgcgctgcaaagggaggaggacagggtggagcaaaaggaggcagaagtcggtgaactgcaacgtcgtttgcttgggatggaaactgaacaccaagcattgcttgccaaggtgagagagggagaagtcgcattggaggaactgagaagcaacaacgccgattgccaagcagaacgcgaaaaagcagcaacccttgaaaaagaggtggcgggtttgcgtgaaaagatccatcatctggacgacatgcttaagtcgcagcaacgcaaggttagacaaatgattgagcaattgcagaactcgaaggctgtgatacagtcgaaagacgcaacgattcaagaactcaaggagaagattgcctaccttgaggccgaaaatcttgagatgcatgaccgtatggaacatcttattgagaagcagataagccacggcaacttttcgacccaagctcgggcaaagaccgaaaatcctgggtcaatccgaatttccaaaccccctagcccaaaacccatgcctgtcattcgcgtggtggaaact

SEQ ID NO: 20361 - DNA, 1170 bp, Artificial Sequence
  Description of Artificial Sequence: Synthetic coding sequence
atgaacgggaccaggaactggtgcactctggttgatgtccatccggaagatcaagccgcagggtcagtggatatcctccgcctgaccttgcagggagaacttactggagatgaattggaacatatcgcgcagaaggccggcagaaagacttacgccatggtgagcagccatagcgctggccattccctggcgtcggagctcgtggaatcacatgacggccatgaggagatcattaaggtgtatctcaagggacgctcaggagacaaaatgatccacgaaaagaacatcaatcagcttaagagcgaggtgcagtatatccaggaggcgcggaattgtctccagaaactgagggaggacatctcatccaaacttgaccgcaacctgggggactcccttcacagacaggaaatccaagtggtgttggaaaagccgaacggcttctcgcaaagcccgaccgctctctacagctcgccgccggaggtcgacacgtgcatcaacgaggacgtggaatcactccggaaaaccgtgcaggatttgctggctaagctccaggaggctaagcggcagcatcagtccgactgcgtcgccttcgaggtgaccttgtcacggtaccagagggaggcagagcaatcgaacgtcgccctccagcgggaggaggaccgcgtggaacagaaggaggccgaggtgggcgaactgcaaagacggctgctcggcatggagacggagcaccaggctctgctcgctaaggtcagagaaggagaggtggctctggaggagttgcgctcgaacaatgcggactgccaagcggagagagaaaaggccgcgactcttgaaaaggaggtggccggactgcgcgaaaagatccaccatctcgatgatatgctgaagtcccagcagcgcaaagtgagacagatgatcgaacaactccaaaactcaaaggcggttatacaatcgaaggatgccactatccaggaactgaaggaaaagatcgcctacctggaggcagagaatctcgaaatgcatgatcggatggaacatctgatcgagaagcaaatcagccacggaaacttttcgacccaggccagggccaagactgagaatccaggatcgatccggatctcaaaaccccccagcccaaagcctatgccggtcatccgggtggtcgagacg

SEQ ID NO: 20362 - DNA, 1170 bp, Artificial Sequence
  Description of Artificial Sequence: Synthetic coding sequence
atgaacggaacgaggaactggtgcacactggtggacgtgcaccctgaagaccaggctgcgggatctgtggacatcctgaggctgacccttcagggtgaactgaccggcgatgaactcgaacacatagctcagaaggccggccggaaaacttatgcgatggttagctcacactcagccggccactctctggcttccgagctggttgagagccacgatggccacgaggagatcatcaaagtgtatttaaagggccgcagcggagataagatgattcatgagaagaacatcaatcagttaaagtccgaagtgcagtacatccaggaggcgaggaattgtttgcagaaacttcgggaagatatttcttccaaactggatcggaacctgggcgatagcctgcacaggcaagagattcaagtggttcttgagaagcccaacgggttcagccagagccccacagccctgtattccagtccgcccgaggttgacacctgcatcaacgaagatgttgagagtttgaggaaaacagtgcaggatttgctggcaaaacttcaggaggctaagaggcagcaccagtcagattgcgtggcgttcgaggtcaccctgtctcgataccaacgggaggctgagcagtccaacgtggcgttgcagagggaggaagatcgcgtggagcagaaagaggccgaggtgggcgaactgcaacgcagactgctgggcatggagacggaacatcaggccttactcgctaaggtgagggaaggggaggttgccctcgaggagctgaggtcaaataatgccgattgccaggccgagcgagaaaaagccgccactctggaaaaggaagtggccggtttgcgggaaaagatccaccacttggatgatatgctgaagtcccagcagcggaaggtgcggcagatgattgagcaattgcagaactctaaagccgttatccagtctaaggatgccacaattcaagaactgaaggagaagatcgcctatctggaagctgaaaaccttgaaatgcatgaccgtatggagcatttaatcgaaaaacagatctcccatggtaatttctcgacccaggctcgcgcaaaaacggagaacccagggtcaatcaggatatctaagcctccatctccaaaacccatgcccgtaattcgggttgtggaaacc

SEQ ID NO: 20363 - DNA, 1170 bp, Artificial Sequence
  Description of Artificial Sequence: Synthetic coding sequence
atgaacggaactaggaattggtgtactctggtggatgtgcatccagaagatcaagctgcagggtctgtcgacattctgagactgaccctccagggtgagctgaccggagacgaactggaacacattgcgcaaaaggccggacgtaaaacgtacgccatggtgtcgtcacattccgccggacacagtctggcctctgaacttgtggaatcccacgatggccacgaagagatcatcaaagtctacctcaaaggcagaagcggagataagatgatccatgagaagaacattaaccagctgaaaagcgaggttcagtacatccaggaagcaagaaattgcctccagaaactcagggaggacatctcgtccaagctcgaccgcaatctgggtgactcccttcaccggcaggaaatccaggtggttctcgagaagccgaatggattttctcagtccccaaccgccctgtattcgtcgccacctgaggtggatacttgtatcaacgaggacgtcgagagcctgcggaaaactgtgcaggatctcttggctaaactccaggaggcgaagcggcagcatcaatcggattgcgtggccttcgaggtgacgctgtccaggtaccagagggaggctgaacaatccaatgtagctctgcaacgggaggaagatcgcgtggaacagaaggaagcagaagtcggagagttgcagcgacggctcctgggaatggaaaccgagcaccaggcactcttggcaaaggttcgcgaaggagaggtggctctcgaggaacttcgcagcaacaacgctgattgccaagccgaaagagaaaaggccgcgactctcgaaaaagaggtggccggactgagggaaaagatccaccaccttgacgacatgctcaaatcccaacaacgcaaggtccgccaaatgatcgaacagctgcagaacagcaaagccgtcatccaatcaaaggacgcaactatccaggagctgaaagagaagatagcttacctggaagccgagaatcttgaaatgcacgataggatggaacatcttatcgaaaagcaaatctcccatggaaacttcagcacccaagcaagagcaaagaccgaaaacccaggatcaatcaggatctccaagccgccatcaccaaagccgatgccggtgattcgcgtggtggaaacc

SEQ ID NO: 20364 - DNA, 1170 bp, Artificial Sequence
  Description of Artificial Sequence: Synthetic coding sequence
atgaacggcacaaggaattggtgcactctagtcgacgtgcatccagaggaccaggccgccggctctgtggatatcctgaggctgacgcttcagggcgagctcacaggagatgagctcgagcatatcgcccaaaaagctgggcgaaaaacatacgcaatggtctcttcccactctgcgggccattcccttgcgagtgagctggttgagtcacacgacgggcatgaggaaatcattaaagtgtacttgaagggtcgctccggggataaaatgattcatgaaaagaacatcaatcagttaaagtcagaggtccaatatatccaggaagccaggaactgtctgcagaagctacgcgaggacatttcctcaaaactggacagaaaccttggtgacagtctccacagacaggagattcaggtggttctggagaaaccaaatgggtttagtcaatcacctactgctctttattccagcccaccagaggtggacacctgtatcaacgaagatgtcgaatcactccgaaaaacagtgcaggatctgctcgccaaattgcaggaggctaaaagacaacatcaatctgactgtgtcgcctttgaggtgacactctctaggtatcagcgggaagccgaacaatccaacgtcgcgctgcagagagaggaagacagagtggagcaaaaagaggcagaggtcggagaacttcagagaagattgttggggatggaaactgagcaccaggctctgctggcaaaagtgcgagagggtgaggtggcccttgaggagcttcggagcaacaacgcggattgccaggcagagcgcgagaaagctgctaccttagaaaaagaagtagcaggcctgagggaaaagattcaccatctcgacgatatgttaaagagccagcagcgtaaagtgcgacaaatgatagaacagcttcagaactccaaagcagttatccagagtaaggacgcaaccatccaagagctaaaagagaaaatcgcctatctcgaggccgagaacttggagatgcatgaccggatggagcacctgatcgagaagcaaatttctcacgggaacttctcaacccaggcacgggctaagactgagaaccctgggagcatcaggataagcaaaccccccagtcccaagccaatgccggtgattagagttgtagagaca

SEQ ID NO: 20365 - DNA, 1170 bp, Artificial Sequence
  Description of Artificial Sequence: Synthetic coding sequence
atgaacggcacgcgcaactggtgtacacttgtggacgtccaccccgaggaccaagccgccggaagcgtcgatatcttgaggttgacgttgcaaggggagctgaccggcgacgaacttgagcatattgctcagaaagctggcaggaagacttatgctatggtgtcctcacactccgccggacatagcctggcttctgaactggttgaaagccatgatggccacgaggagataatcaaggtctacctgaaggggcgcagcggcgataagatgatccacgagaagaatatcaaccaactcaagtctgaggtgcagtatatccaagaagcccgcaattgcctgcagaaactccgggaggacatttcctcgaagctggatcgcaatctcggcgactctttacatagacaggagatacaagtcgtgctggaaaagccaaacggcttctcccagtccccgactgccctgtattcatcccctccggaggtggacacatgtataaatgaggatgtggaatcattgcggaaaactgtacaagatctccttgctaaattgcaggaagcaaaacgacagcaccagagcgactgtgtggccttcgaagtgaccctgtcaagataccagagagaagctgagcagagcaacgtcgccctgcagcgcgaagaagaccgcgtggaacaaaaggaagccgaagttggagaactccagcgcaggctcctgggaatggagaccgaacaccaggccttgctggctaaagtccgggaaggagaggttgctttagaggaattgagatccaataatgctgattgtcaagcagagagggagaaggctgctacacttgagaaagaggtagctggtctgagggagaagatccaccacttggatgacatgctgaagagtcaacagcgaaaagtccgtcaaatgatcgaacagttgcaaaactccaaagcagtgattcagagcaaggatgctaccatacaggagttgaaggagaagatagcgtatctagaggccgagaacttggagatgcatgaccggatggaacatctaatcgagaaacaaatttctcatggaaatttttcaacacaggccagagccaagaccgaaaacccggggtcaatcaggatctctaagcctccatctcctaaacccatgccggtgatcagggtggtcgagaca

SEQ ID NO: 20366 - DNA, 1170 bp, Artificial Sequence
  Description of Artificial Sequence: Synthetic coding sequence
atgaatgggactcgcaattggtgcacgctagtagatgtgcatcccgaggatcaggctgcgggctccgtggacatcctgaggttaacactgcagggtgagctgaccggggatgagctcgagcacatagcccaaaaagcaggacggaaaacgtatgccatggttagcagtcattccgctggacactctttggccagtgaactggtggaatcccatgatgggcacgaggagattatcaaggtctacctcaaaggccggagtggggacaagatgatacatgaaaagaatattaaccaactgaagagcgaggtccagtacatccaggaagcacggaactgtctacaaaaactgcgtgaggacatatccagcaagctggacaggaatcttggagattctctccataggcaagagatccaggtggtgctagagaaaccaaatggtttcagccagtcccccacagccctgtattctagcccgcccgaagttgatacctgcatcaacgaagacgtggaatctctccgcaaaactgttcaggacctgctcgcaaagttgcaggaggctaagaggcagcaccagtctgactgcgtggctttcgaagtcacgcttagcaggtatcagagggaggctgaacaaagtaatgtggcactgcagcgggaggaggaccgggttgaacagaaggaggccgaagtgggcgaactgcagagaagactgttagggatggagacagagcaccaagccctccttgccaaagttcgagaaggagaggtggcgctggaggagctgagatccaataacgcagactgccaagcagagagagagaaagcagcaacgcttgaaaaagaagtggccggattgcgagaaaaaatacaccatctggacgatatgctgaagagccagcagagaaaagtgcgacagatgattgaacagctacagaattcgaaagctgtgatccaatccaaagacgccactatccaggaactgaaagagaagatcgcctacctagaggccgagaacctggaaatgcatgaccggatggaacacctgatagaaaagcagattagtcatggcaattttagtacccaggcgcgggccaagaccgaaaatcctggctctattaggatcagcaagcccccctcccctaagcctatgcctgtgattagggtcgtcgaaaca

SEQ ID NO: 20367 - DNA, 1170 bp, Artificial Sequence
  Description of Artificial Sequence: Synthetic coding sequence
atgaacggaacccggaattggtgtaccctggtggacgtgcaccctgaagatcaagcagcgggctccgtcgacattctccggctgactcttcagggggagctgaccggagacgagctggagcacatcgcgcagaaggccgggcgaaaaacttacgcgatggtgtcctcgcatagcgcaggccactcattggcgtccgaacttgtcgaaagccatgatggccatgaagagatcattaaggtgtacttgaaaggacgatcgggggataagatgatacatgaaaagaacataaatcagctgaagtcggaagtgcagtatatccaagaagcacgaaactgccttcaaaaactgcgggaagatatctcctcgaagctggatagaaaccttggagactcccttcaccggcaagagattcaagtggtgctcgaaaagccaaacggtttttcgcagtccccaactgctctgtactcatccccgccagaggtggatacttgcataaatgaggacgtcgaatcccttagaaagaccgtccaggatctgttggccaaacttcaagaggctaaacgccagcatcaaagcgattgtgtggcattcgaagtgactctgtctaggtaccaaagggaggctgagcaatccaacgtagcactccaacgcgaagaggatcgtgtggagcagaaggaagcagaggtcggtgaattgcagagacgtctgttgggaatggaaaccgaacatcaagccctcctggcaaaggtgagagaaggggaggtggcactggaagagttgagatcaaacaacgcagactgtcaagccgaacgagaaaaggcagcaacgctcgagaaggaagtggcaggcctcagggaaaagatacaccatctcgacgatatgttgaagtcgcaacagcgaaaagtgcggcaaatgatcgagcaactgcaaaattcaaaagcagtgatacagtcaaaggatgccactatccaggaactcaaggaaaagattgcatacttggaagcagagaatctggagatgcacgatcgaatggagcatctgattgagaaacagattagccatggaaacttttccacccaggcaagggcgaaaaccgaaaatcccggcagcatcagaattagcaagcctccttctcctaaacctatgcccgtcattcgagtcgtcgaaacc

SEQ ID NO: 20368 - DNA, 1170 bp, Artificial Sequence
  Description of Artificial Sequence: Synthetic coding sequence
atgaacgggacgcgcaattggtgtactctggtggacgtgcatccagaagaccaggccgctggcagcgttgacattttgaggctgactttacagggcgagctcacgggcgacgagctcgaacacatcgcacagaaagcaggtaggaagacctatgctatggtaagttcacactctgccgggcacagtctggcctcagagctggtggagtcccatgacggtcacgaagagatcatcaaggtctacctgaaaggccgatcaggagataaaatgattcatgaaaagaatatcaaccagctgaaatctgaagtgcagtacattcaggaagcccgaaattgcctgcagaaactgcgagaagatatcagttccaaactcgacaggaatctgggcgattctttgcatagacaggagattcaggtggtgcttgagaagcctaacggattttcccagagccccactgccctttacagctcgccgcctgaggtcgatacatgcattaatgaagacgtggagtccctcaggaagacagttcaagacctgttagctaagctccaagaggcgaaaaggcagcaccagagtgactgcgtggcatttgaggttactctatctcgctatcagcgtgaagctgagcagtccaacgtggccttgcagcgggaggaggacagggtcgaacagaaagaggccgaggtcggagaactacagagacggcttctcggtatggagacagaacaccaggcactgctggctaaggtacgtgagggtgaggttgctctggaggagctaaggagtaacaacgccgactgtcaggccgaacgcgagaaggctgccacattagagaaagaagtggccggcctgcgagagaagattcatcaccttgacgacatgttgaagtcccagcagcggaaggtgagacaaatgatagagcagctgcagaactctaaagccgtgatacagagtaaagacgcgacaatccaggaattaaaggagaagatagcctatctagaagccgaaaatctggaaatgcacgataggatggagcatttgatcgagaaacagattagccacggtaacttttcaacccaggctagggctaaaacagaaaatccgggctcaattcgcatctccaagccccctagtcccaagccaatgccggttattcgggtggtggagaca

SEQ ID NO: 20369 - DNA, 1170 bp, Artificial Sequence
  Description of Artificial Sequence: Synthetic coding sequence
atgaacggaactcgcaactggtgcaccctcgtggacgtgcacccggaggaccaagctgcaggcagcgtggatattctgagactgacgctgcaaggcgaactgacgggggacgaactcgagcatatcgcacagaaggcggggcggaaaacttatgctatggtgtcatcacactcggccgggcactccctcgcctccgaactcgtcgaaagccacgatggacacgaagaaatcatcaaagtttatctgaagggccggtccggcgataagatgatccatgaaaagaacatcaaccaactgaagtcggaggttcagtacattcaggaggcccgcaactgtctccagaaacttcgggaagatatctcatcgaagctggatagaaatctgggagactcgctccaccggcaggaaatccaggtggtgcttgaaaagccgaatggattttcgcaatcccctaccgcactgtactcctcgcccccggaggtggacacctgcatcaacgaggacgtggagagcttgagaaagactgtgcaggaccttctcgccaagctccaagaagcaaaacggcagcatcagagcgactgtgtggcgttcgaagtcaccttgtccagataccaacgcgaggccgagcaatcgaacgtggcccttcagcgggaagaggatcgcgtcgaacaaaaggaagccgaagtcggggaactgcagcggcgactgctgggaatggaaaccgagcatcaggcgctgctggccaaggttagagaaggagaggtggctctggaagagctcaggtccaataatgcagattgtcaagccgaacgcgagaaggcagccactttggaaaaggaggtcgcaggactgcgcgagaaaattcaccacctcgacgacatgctcaagagccagcagcgcaaggtgaggcagatgattgagcagctgcagaattcgaaggccgtgatccagtctaaagatgcaacgatccaagaattgaaggagaagatcgcctatctggaggcggagaatctggagatgcatgacaggatggaacatctgatcgaaaagcaaatctcccacggaaacttctctacccaggcgcgcgccaaaaccgaaaacccaggaagcatcagaatctcgaagcctccatctccgaaaccaatgccggtcatccgcgtcgtcgaaact

SEQ ID NO: 20370 - DNA, 1170 bp, Artificial Sequence
  Description of Artificial Sequence: Synthetic coding sequence
atgaatgggacacgcaattggtgcacgttggtagatgtgcaccctgaagatcaggccgctggaagcgtcgatatattgcggctgacgctgcaaggtgaactcaccggcgatgagctcgagcacattgcgcagaaggctggacgcaaaacttacgcaatggtgtcctcacattctgctggccactctctggcttctgagttggttgagagccacgacggtcacgaggagatcatcaaggtgtatctcaagggacgcagtggcgacaaaatgattcatgagaaaaacataaaccaactgaaaagtgaagtgcagtatatccaagaggcaaggaattgtttgcagaagctgcgggaagacatctcatctaagctggaccggaacctgggggattcccttcacaggcaggaaatccaggtggtccttgaaaaaccaaacggattctcacagagtccaacagcactgtactcctccccacctgaagttgacacttgcattaacgaagatgtcgaatccttgcggaaaactgtacaggatcttctcgccaagctgcaggaagctaagagacagcaccagtctgactgtgtcgcatttgaggtcactctgagtcgatatcaaagagaagctgaacagtccaacgtggctctccagagagaggaagaccgagtcgagcagaaggaagccgaagttggcgagttgcaaaggagactgttgggcatggaaaccgaacatcaggccctgcttgccaaggtgagagagggtgaggtggcacttgaggagcttcgaagcaacaacgcagactgtcaggccgagagggagaaggcagcaactctggagaaggaggtggccggccttcgggaaaaaatccatcacctggatgacatgctgaaatctcagcaacgaaaagtgaggcagatgatagaacagctccagaactcaaaggctgtcatccagtctaaagacgccaccatacaggaattgaaagagaagatcgcttatctggaggccgaaaatctggaaatgcacgatcggatggagcatttgatcgaaaaacagatcagccacggcaactttagcacgcaggctagagcaaaaactgaaaatccaggatccatcaggatttctaaaccgcctagcccaaagccgatgcctgttatccgcgttgtcgagact

SEQ ID NO: 20371 - DNA, 1170 bp, Artificial Sequence
  Description of Artificial Sequence: Synthetic coding sequence
atgaacggaactagaaactggtgtaccctcgttgacgtgcacccggaagatcaggcggcgggaagcgtggacatcctgagactgactctccaaggtgaactgactggagacgagctggaacacatcgcccaaaaagcgggccgcaaaacctacgctatggtatcgtcgcactcggctggccactcccttgcatccgagctcgtcgaatcacatgacggccatgaagaaatcatcaaggtgtacctgaagggaagatccggagacaaaatgatccatgaaaagaacatcaatcaactgaaaagcgaagttcagtacattcaggaggcccgcaattgcctgcaaaagctccgggaagacatctcatccaagctggatcgcaacctcggcgactccctccaccgccaagaaattcaggtcgtgttggagaaacccaacggattctcccagagcccgaccgccctctactcgagcccgcctgaggtggatacctgcatcaacgaggatgtggagagcctgcgcaaaacggtccaagatctgctggccaaactgcaagaagctaaacgccagcatcagtcggactgcgtggcgttcgaagtgaccctgtcccggtaccagagggaggcagaacagtcgaacgtggccctccaacgcgaagaagaccgggtggagcagaaggaagccgaagtgggagaactgcaacgccggttgttgggaatggaaaccgagcaccaggctctgttggcgaaggttcgcgagggagaggtcgccctggaagaactgcgctcaaacaacgcagattgtcaagcggagcgtgagaaggcagccacgctggagaaagaagtggccggattgcgcgaaaagatccatcacctggacgacatgctgaagtcccagcagagaaaagtccgccagatgatcgaacagctgcagaattcaaaagccgtgattcagtccaaggatgcgaccatccaggaactgaaggaaaagattgcttacctggaagcagagaacctggagatgcacgaccggatggagcatcttatcgaaaaacagatctcacacggaaacttcagcactcaggcaagagccaagaccgaaaaccccggctcgatccgcatcagcaagcccccgagccccaagccaatgccagtgatcagagtggtcgaaact

SEQ ID NO: 20372 - DNA, 1170 bp, Artificial Sequence
  Description of Artificial Sequence: Synthetic coding sequence
atgaatggaacgagaaattggtgtactcttgtcgacgtgcatcctgaggatcaagcagccggctcggtggatatcctcaggctgactctgcagggtgaactgaccggagatgagctggaacacatcgcacagaaggccggccgcaagacgtacgcaatggtgtctagtcactcagcaggccattccctggcatcggaacttgtggaatcacacgatggacacgaggagatcattaaggtgtaccttaaaggacgaagcggagacaagatgattcatgagaagaacattaaccagctcaagagcgaagtccaatacatccaagaggcccgtaactgtctccagaagttgagggaagatatttcatccaaacttgaccgtaaccttggagactcgcttcatcggcaagagattcaagtggtcctggaaaaaccaaacggattttcccaaagccctaccgccttgtactccagcccgcccgaggttgatacctgtattaacgaggacgtggagtcactgcgcaaaaccgtccaagatctgcttgcgaagctgcaggaagccaaaaggcagcatcagtcagattgtgtcgcatttgaagtgacgttgtcccggtaccaacgcgaggccgagcagtctaacgtggcattgcagagagaagaggaccgcgtcgaacagaaagaggcagaagtgggcgagcttcaacgtaggctgctggggatggaaaccgaacaccaagcactcctggccaaggttcgggagggggaagtcgcactggaagaactgcgttcgaacaacgcggattgtcaagccgagagagagaaagcggcaaccctcgaaaaagaagtcgctggccttcgggaaaagatacaccatctggatgacatgcttaaaagccaacagagaaaagtcaggcagatgattgagcaactccagaattcgaaggcagtgatccaaagcaaagatgcaaccatccaagaactcaaggaaaagatcgcataccttgaagcagagaaccttgaaatgcatgacagaatggaacatttgattgaaaaacaaatttctcatgggaactttagcactcaggccagagccaaaactgagaatcccggatccattagaatctccaaaccaccaagccctaagcctatgcctgtgatccgcgtcgtggagacg

SEQ ID NO: 20373 - DNA, 1170 bp, Artificial Sequence
  Description of Artificial Sequence: Synthetic coding sequence
atgaacggcaccaggaactggtgtacccttgttgatgttcatccagaggaccaagctgctggatcggtggatattctgagacttactttgcaaggtgaactcactggtgatgaacttgagcacatagctcaaaaagccggtaggaagacatacgcaatggtttcttctcattcagcaggacactctttggcttctgagttggttgagtctcacgatggccatgaagagataataaaggtatatctgaaggggcgctcaggtgacaaaatgattcacgagaagaacatcaatcaattgaagtcagaagtgcaatatatacaggaagcaaggaactgcttgcaaaagcttcgagaagatatttcatcgaagcttgatcgtaatctgggagactccctccatcgccaagaaattcaagttgttcttgaaaagccaaatggattctcacaatctcctacggctttgtacagttcacctcccgaggttgacacttgtatcaatgaggacgtcgaatcccttaggaagactgttcaagatcttttggctaagttgcaggaagcaaaacgtcagcaccagtctgattgcgtagcattcgaagttactttgtcaagataccaaagggaagccgagcagtcaaacgttgcacttcagcgtgaggaagatcgcgtagagcaaaaggaagcagaagttggagaattgcaacgaaggttgctaggaatggagactgagcaccaagctcttttggctaaagtccgtgagggcgaagttgccctggaggagcttcggtcaaataatgctgactgccaggctgagcgagaaaaggctgctacccttgaaaaggaggtagccggacttagggaaaaaattcatcatttggatgacatgctcaagtcacagcagagaaaagttagacagatgattgaacaattacaaaattcaaaggcagtgatccaatccaaggatgccacaattcaagaattgaaggagaaaatcgcttatctcgaagcagagaatttggagatgcatgacagaatggaacacttaattgaaaaacaaatctctcacggaaacttttcaacacaggcccgcgctaagactgaaaaccccgggtctattcgtatatctaagccacctagtcccaaaccaatgccagttattcgtgtggtggaaaca

SEQ ID NO: 20374 - DNA, 1170 bp, Artificial Sequence
  Description of Artificial Sequence: Synthetic coding sequence
atgaacgggacaagaaactggtgtaccctggtcgatgtgcatcccgaggaccaagccgcgggtagcgtggacattcttcggcttacgttgcagggcgagcttacaggggacgagctggaacatattgcacagaaggcaggcaggaaaacctacgcaatggtcagcagtcatagcgccggtcactctcttgcctcagaactcgtcgagagtcacgatgggcacgaagaaattattaaggtttatctgaagggccggtctggcgacaagatgattcatgagaagaacatcaaccagctcaaaagcgaggtgcagtacatccaggaagcacggaactgcctgcagaaactgcgcgaagacatctcatctaaattggaccggaatctcggcgatagcttgcaccgccaggaaattcaggtagtcctggagaagcctaacgggttctctcagagccccaccgctctgtattcttcccctccggaggttgacacatgcattaatgaggatgtcgaaagtctgagaaagacggtgcaggatctgctcgccaaactgcaggaagcgaagagacagcatcagtccgactgcgtggcgtttgaggtaactctgagccggtatcagagagaggcggaacaaagcaatgtggccctgcagcgcgaggaggacagagtcgagcagaaggaagcagaggtcggggagctccagcgcaggctgctgggcatggagacagagcatcaggccctcctggccaaagtcagggagggggaggtggccctcgaggagcttcgctctaataacgcggactgccaagccgaacgcgaaaaggcggcaacactcgaaaaggaagtcgctgggctcagggaaaaaattcaccatttggatgatatgctgaagtctcaacaaagaaaggtcaggcagatgatagaacagcttcagaatagtaaggccgttatccagagcaaggacgccaccatccaggaactgaaggaaaagatcgcttaccttgaagcggaaaatctcgaaatgcacgatcggatggaacacttgatcgaaaaacagatttctcacggcaatttcagcactcaggctcgcgctaaaactgaaaatcccggttccatccggatcagtaagccaccaagcccgaagccaatgcccgtcatacgcgtggtggagacc

SEQ ID NO: 20375 - DNA, 1170 bp, Artificial Sequence
  Description of Artificial Sequence: Synthetic coding sequence
atgaacggaactaggaactggtgtactcttgtcgatgtgcacccggaggaccaagccgcggggtcggtggatatcctcaggctgaccctccaaggtgaacttaccggtgatgagttggagcatatagcacaaaaggctggacggaaaacctacgcaatggtatcttctcattctgccggacatagcctcgcttcggaacttgtcgagtcgcatgatggtcacgaggagattatcaaggtgtacctcaagggaagatcgggggataagatgattcatgaaaagaacattaaccagctgaagtcggaggtgcagtacattcaagaagcccgaaattgccttcaaaagctgagggaagatatttcatcgaagctggatcgcaatcttggtgatagcctgcacaggcaggaaattcaggtggtgcttgaaaaacccaacggcttttcacagtcgcccacggcactgtactcatcgccacctgaggtcgacacctgcattaatgaggatgtggagtcgcttcgaaagaccgtccaagatctgcttgcaaaactgcaggaagccaagcgacagcatcagtccgattgcgtggcctttgaagtgactctgagcaggtaccagagagaagcagaacaaagcaatgtcgctcttcagcgggaggaggaccgtgtggaacaaaaggaagcagaagtgggtgaacttcaaagaaggctgctcggaatggaaaccgaacatcaagcactgctcgcaaaggtccgtgaaggagaagtcgcgctggaagaacttcgttcgaataacgcagactgtcaggcagaaagagaaaaggctgccacgctggaaaaggaagtcgcgggactgagagaaaagattcaccatctggacgatatgcttaaaagtcaacaaaggaaggtgcggcaaatgatcgagcaactgcaaaattccaaagcagtgatccagagcaaggatgcaactattcaagaactcaaagaaaagatcgcataccttgaggccgagaaccttgaaatgcatgatcgtatggaacaccttattgaaaagcaaatctctcacggaaacttctcaacccaggcacgagcaaagaccgaaaaccctgggtcgattcgcatctccaaaccaccttcgcctaagcctatgcccgtcattcgcgtcgtggaaacc

SEQ ID NO: 20376 - DNA, 1170 bp, Artificial Sequence
  Description of Artificial Sequence: Synthetic coding sequence
atgaacggcactcgtaattggtgtacactggtcgacgtacaccccgaggatcaggcggcgggttccgtcgatattctgcggctgacactccaaggagagctgacgggcgatgagcttgagcacattgcccagaaggctggccgtaagacctacgcaatggtgtcatcccatagcgctggccactcgttagccagtgagcttgttgagagccacgacggtcacgaggagatcattaaggtttacctgaagggtcgtagcggtgataagatgatccacgaaaagaacattaaccagttgaaaagcgaggtccagtacatccaggaggctcggaactgtctgcaaaagcttcgcgaggacatttccagcaagctggatcgaaacctcggagactctctgcaccgccaagagattcaggttgtcctggagaagcccaacggcttttcccagagccctacggcgctgtatagcagcccccccgaggtcgatacgtgcatcaacgaagacgtcgagtccctgcggaagaccgttcaagatttgttggcgaagctccaggaggccaagcgccagcaccagtcggactgcgtcgcgtttgaagtgaccctgtctcgttatcagcgtgaagctgagcagtccaatgttgccctccagcgcgaggaggaccgagtagagcagaaggaggcagaggtgggtgagcttcagcgtcgtcttcttggcatggagactgagcaccaggccctgttggcgaaggtccgggaaggggaagtagccctggaagagctacgctctaacaacgccgattgtcaggccgagcgcgagaaggctgctaccctagaaaaggaagtggccggtctccgggagaagattcaccacctggacgatatgcttaagagccagcagcgcaaggtcaggcaaatgatcgaacagcttcagaactccaaagctgtcatccaatctaaggacgctaccattcaggagttgaaggaaaaaatcgcctacctggaggccgagaacctggagatgcacgaccgtatggaacacctgatcgaaaagcagatttcgcacggtaacttctcgacacaggcccgcgccaagacggagaaccccggctcgattcgaatctccaagcccccttcccctaagcccatgcccgtgattcgggttgtagagacc

SEQ ID NO: 20377 - DNA, 1170 bp, Artificial Sequence
  Description of Artificial Sequence: Synthetic coding sequence
atgaacgggacacgcaattggtgtacactggtggatgtgcaccctgaggatcaggccgctggctcagtagatattcttagattgacactgcaaggcgaattgacaggtgacgagctggagcacattgcccagaaagctggaagaaagacctacgcgatggtatctagccactcagccgggcacagcttggcgtccgaactggtcgaatcacatgatggacatgaagaaattatcaaagtgtacttgaaggggcggtctggcgataagatgattcacgagaaaaatatcaaccaactcaagtcagaagtgcagtatatccaggaagctcggaactgtcttcagaaactcagggaagatatttcaagcaagctggaccgcaacctcggtgattctctgcacagacaggagatccaggtggtcctggaaaagcccaacggtttctctcagtctccaacagccctgtattcaagccctcctgaggttgacacttgcattaatgaggacgtggagtccctgagaaagaccgtgcaggacctgcttgcaaagttgcaggaggctaaacgacagcaccaatctgactgtgtggcctttgaagtaaccctgtctaggtatcagcgtgaagctgagcagagtaacgtcgccttgcagcgggaggaagatcgcgtggagcaaaaagaagccgaagtgggagagcttcagcgacgccttctgggcatggaaaccgagcaccaggccctcttagcaaaggtgcgcgaaggcgaagtagccttggaagagctgaggagcaataacgccgattgccaagccgagcgcgagaaggcagccactctggagaaggaagtggctggacttcgcgaaaaaatacaccacctcgatgatatgcttaagtcccaacagcggaaagttagacagatgatcgaacaactgcagaatagcaaggctgtaatccagtctaaagacgccaccatccaggaactgaaagagaaaatagcttacttggaggccgaaaacctggagatgcatgaccgaatggaacaccttatcgagaagcagatttctcatggcaacttctctactcaggctagggcaaaaaccgagaatccaggatcgatcagaatatctaaacccccatctcccaaaccaatgcccgttatccgggtcgtggaaacc

SEQ ID NO: 20378 - DNA, 1170 bp, Artificial Sequence
  Description of Artificial Sequence: Synthetic coding sequence
atgaacggaaccagaaactggtgcacactggttgacgtccatcccgaggaccaggccgctggtagcgtggatattctgaggctcacactgcagggtgaattgactggtgacgaacttgagcacatcgctcagaaggccggacgtaagacttacgcaatggtgtccagtcacagcgctggccacagtctggcttccgagctcgtagagtcacacgatggtcacgaggagatcattaaggtgtatctgaagggtcgctctggcgacaagatgatccacgaaaagaatataaatcagctgaagagcgaggtccagtatatccaggaggctaggaactgccttcagaagcttagagaagacatatcttctaagctggatagaaacctcggcgactccctccacaggcaagagatccaggttgtgctcgagaaacccaacggattctctcagtctcctacagctctgtactctagtcctcctgaagttgatacatgcattaacgaagacgtcgagtccctgaggaagacagtacaggaccttctggcaaagcttcaagaagcaaagagacaacatcagagcgactgtgtggcttttgaagtcacactctcaaggtaccaacgcgaggccgagcagagcaacgttgccctccagcgtgaagaggatagagtggagcagaaggaggctgaggttggagaactgcagagaaggctgcttggaatggagacagagcatcaggctctgctcgccaaggttcgtgagggagaagtcgccctcgaggagctgaggagtaacaatgcagattgtcaggcagagcgcgagaaagccgccacactcgagaaagaggttgctggactcagagagaaaatccatcaccttgacgacatgctgaagagccagcaaagaaaggtgaggcagatgattgaacagttgcagaactccaaggctgtcattcagagtaaagatgccaccatccaggagctgaaggaaaagatcgcttacctcgaggcagagaacctggagatgcacgaccgcatggagcacctgatcgaaaaacagattagtcatggtaactttagtacccaggctcgtgccaaaacagagaacccaggctccatacgtatttcaaagcctccaagcccaaagcctatgcctgttatacgtgtcgtggaaacc

SEQ ID NO: 20379 - DNA, 1170 bp, Artificial Sequence
  Description of Artificial Sequence: Synthetic coding sequence
atgaacggaactcggaactggtgtacgctggtcgatgttcacccagaagatcaagcggcaggatctgtggacatcctccggctcactctgcaaggagagctcactggggatgagctcgaacacattgcacagaaagccggacgaaagacctacgcgatggtgtcatcccactcggccggacattcgctggcctcagagctggtagaatcccatgatggacacgaggaaatcatcaaggtttacctgaagggcagaagcggcgacaaaatgatccacgagaaaaacatcaaccagctgaagtcggaagtccagtacatccaggaggcacggaactgcctccagaagctgcgcgaggatatttcttcgaaacttgataggaacctgggcgattccctgcaccgccaggagatccaggtggtgctcgaaaagccaaacggattttcacagtcgccgactgccttgtactcatctcctcccgaggtggacacctgcatcaacgaggacgtcgaatcgctccggaaaactgtccaggatctgctggccaagttgcaggaagcgaagaggcagcatcagtccgactgtgtcgcgttcgaggtgactctgtcgagataccaaagggaggcagagcagagcaacgtggcgttgcagagagaagaagatcgcgtggaacaaaaagaagcagaagtgggcgagctgcagagaaggctcttgggaatggaaaccgaacatcaggccctcttggcaaaggtgcgggagggggaggtggccctggaggagctgcggagcaataacgccgactgccaagcagaacgcgaaaaggcggcaactctggagaaggaggtggccggtttgcgggaaaagatccaccacctggacgacatgcttaaatcgcaacagcgcaaggttaggcaaatgatcgagcaacttcaaaactccaaagccgtgattcagtccaaagatgccaccatccaggaacttaaggaaaagatcgcctacctggaggctgagaatttggagatgcatgatcgtatggaacacctgattgagaaacagatctcgcacggaaacttctcaacccaggcgagagccaagactgaaaacccgggaagcattcgcattagcaaacccccatccccgaagccgatgccagtgatccgggtggtcgagact

SEQ ID NO: 20380 - DNA, 1170 bp, Artificial Sequence
  Description of Artificial Sequence: Synthetic coding sequence
atgaacgggacccgcaattggtgcaccctggtcgacgtgcacccggaggaccaggctgctgggtcggtcgatatcctgcgcctcaccctgcagggagaattgaccggagacgagctggagcacattgcccaaaaagctggtcgcaaaacctatgcgatggtcagctcgcattccgcgggccactcgctggcctcggaactcgtcgagtcccacgacgggcatgaagaaatcattaaggtgtacctcaaggggcgctcgggagacaagatgatccacgagaagaatatcaaccaactgaaatccgaggtgcagtacatccaggaagcaagaaactgtctgcagaaactcagagaggacatttcctcaaagctcgataggaatctcggagactcgctgcatcgccaggaaatccaagtggtgctggagaagccgaatggattcagccagtcccctactgctctgtattcctcacctccggaagttgacacttgtatcaacgaagatgtggagagcttgaggaaaactgtccaagatctgttggccaaactccaggaagccaagcggcagcatcaatcagattgcgtggcgttcgaagtgactctttcgcggtaccagcgcgaggcggaacagagcaacgttgcactccaacgcgaggaggacagagtggagcaaaaggaagccgaggtgggagagctgcagcgccgtctgctggggatggagactgagcatcaggctttgctcgcgaaagtccgggaaggagaagtggcactcgaggaactgcgctcaaataacgccgactgccaggccgaacgcgaaaaggcagccacgctggagaaggaagtggcgggactcagggagaagatccaccatctggacgacatgctgaagtcccagcagcggaaggtccgacagatgatcgaacaactgcagaactcgaaagccgtgatccagtccaaagacgccaccatccaggagctgaaggagaaaatcgcctacctcgaagccgagaacctggaaatgcacgatagaatggaacacctgatcgagaagcagatctcgcacggcaacttcagcacccaagcgagagccaagaccgagaatcccggatccatccgcatctccaaacctccgagcccaaaaccgatgccggtcatcagagtcgttgagact

SEQ ID NO: 20381 - DNA, 1170 bp, Artificial Sequence
  Description of Artificial Sequence: Synthetic coding sequence
atgaacggcacgagaaactggtgcaccctggtcgacgtccacccagaagatcaggcagcggggagtgttgacatcctgagactgaccctgcaaggcgagctgaccggggacgagctggagcacatcgcacagaaagccgggcgaaagacttacgctatggttagctcgcactcggcaggtcatagcctggcgtcagagctcgtcgaaagccatgacgggcacgaggaaatcattaaggtgtacctcaaaggacggtccggcgataagatgatccacgaaaagaatatcaatcaactgaagtcggaagttcagtacatccaggaagcgcgtaattgtctgcaaaagctgagagaagatattagctcaaagctcgacagaaacctcggagattcacttcatcggcaggagatccaggtcgtgctcgaaaaaccaaacggattctcccagagcccgactgctctctactcgtccccgccagaggtggacacgtgcatcaacgaagatgtcgagtcattgaggaaaacggtccaggatctcctggcaaagctgcaggaggccaagcggcagcaccagtctgattgcgtggcatttgaggtcacgttgagccgctaccaaagagaagcggaacagagcaatgtggcgctgcagagagaagaagatcgcgtcgaacaaaaggaagcagaagtgggagaattgcagaggcgcctgctgggaatggagactgaacaccaagcactcttggccaaggtgcgggaaggagaggtcgcactcgaggaactccggtccaacaacgccgattgtcaggctgagcgcgaaaaagccgcgaccctggaaaaggaggtcgcaggactgcgggagaagatccatcatttggatgacatgcttaaatcccaacagcggaaggtcagacagatgatcgaacagttgcaaaactcgaaggccgtcatccaatcgaaagacgcgactatccaggaactgaaagaaaagatcgcgtacctggaagcagaaaatctcgagatgcatgacagaatggaacatctgattgaaaagcagatttcacacggcaatttctcaactcaagcgcgcgccaagaccgagaaccctgggtccatccggatatcgaagccgccaagcccaaagcccatgcctgtaatccgggtggtggaaacc

SEQ ID NO: 20382 - DNA, 1170 bp, Artificial Sequence
  Description of Artificial Sequence: Synthetic coding sequence
atgaacggcactaggaactggtgcacactcgttgatgtgcaccctgaggatcaggctgcgggttccgtcgacattttgcgccttacattgcaaggggagctcactggggatgaactcgagcatatcgcgcagaaagccggtcgaaaaacatatgcaatggtaagcagccatagtgctgggcactcattggctagtgagctcgtcgaatcccatgacggacacgaggagattatcaaagtctacctgaaagggcgaagtggcgacaagatgatacatgagaaaaacatcaatcagctgaaatctgaggttcaatacatccaggaggcacggaactgccttcagaaactccgcgaggatattagctcaaagttggatcgaaacctcggggattctctgcacaggcaagaaatccaggtggtcttagagaaaccgaatgggtttagccaaagccccactgctttgtatagcagtcctcccgaggttgacacttgcatcaatgaggacgttgagagccttcggaaaacggtgcaggacctgctcgccaagctgcaggaggccaaacgacaacaccagagcgactgtgtggcctttgaggtgacactctctaggtaccagcgagaagctgagcaatcgaacgtggcccttcagcgagaagaggatcgcgtcgagcaaaaagaggctgaagtcggggagctgcagcgacggctgcttggaatggaaaccgaacatcaggctctgttggccaaggtgcgggagggcgaggttgccctcgaagagctgagaagtaataatgccgattgccaggcagagagggagaaggccgccacattggaaaaagaggtggcaggactgcgagagaagatccatcacttagatgatatgctcaaatcgcaacaaagaaaggtgaggcagatgatcgagcagttgcagaacagcaaagctgtgatccagtccaaggacgccaccattcaggagctgaaagaaaaaattgcataccttgaagctgaaaacctggagatgcatgatcgtatggaacacctgattgaaaaacagatttcccacggaaactttagcacgcaagcccgagcgaaaacagaaaaccccggatctattcgcatcagcaagcccccgtcacccaaacctatgcctgtgattcgtgtggtagaaacc

SEQ ID NO: 20383 - DNA, 1170 bp, Artificial Sequence
  Description of Artificial Sequence: Synthetic coding sequence
atgaatggaacaaggaattggtgtacactggttgatgtacatcctgaagatcaggcagctgggtcggtggacatcctcaggttgactctccagggagagctcactggtgacgagcttgaacatattgcgcagaaggccggtcgcaaaacatacgccatggtttcaagccatagtgccggccacagcctggcctctgaattagtggagagccacgacggccacgaggaaatcatcaaagtttatcttaagggacgaagtggcgataaaatgatccatgaaaagaacatcaaccagctcaagagtgaggttcaatacattcaggaagcccgcaattgcctccagaagctgagggaggacatttcatcgaagctcgatagaaacctgggtgattcactgcatcgtcaggagatccaggtcgtactagagaagcccaatggattctctcagagcccaacagcattatacagtagcccaccagaagtggacacctgcatcaacgaagacgtcgaaagcctgaggaaaaccgtccaggatctgctcgctaagctccaggaagccaaaagacagcatcagtctgactgtgtggctttcgaagtaaccctgagccggtatcagcgagaagcagagcagagcaacgtggctcttcaaagagaagaggaccgtgtcgagcagaaggaggctgaggtcggggaactacagcggcggcttctgggcatggaaactgagcaccaggccttgctcgcaaaagtgcgggagggagaggttgctctcgaggagttgcgatctaacaacgccgactgccaagcggaaagagagaaggctgccactttggagaaggaggtggccggcctgcgtgagaaaattcatcatctcgatgatatgctgaagtcccagcagaggaaggttaggcagatgattgagcagctgcagaattctaaagcagtgatccagtcgaaggacgcaactatccaggagctgaaggaaaaaattgcctatctggaggcagagaatctagagatgcacgatcggatggaacacctaatcgagaaacaaatctctcatggaaacttttccacgcaagctagagcaaaaacggagaatcctggttcgattcgaatatccaagcctccatcccccaaaccaatgcctgtgatcagggtggtggagacg

SEQ ID NO: 20384 - DNA, 1170 bp, Artificial Sequence
  Description of Artificial Sequence: Synthetic coding sequence
atgaacgggaccaggaattggtgcacccttgttgatgtacaccccgaggatcaggcggccggtagcgtggacattttgaggctaacccttcaaggcgaactgaccggagacgagttggagcacatcgctcagaaagcgggacgcaagacatacgccatggtctcgtcacattctgcgggtcacagtctggcaagcgagttggtggaatcccatgacggccacgaagagatcatcaaagtgtacctcaaggggaggtcgggcgataagatgatacacgaaaagaatatcaaccagctgaaaagtgaagttcaatacattcaggaggcccgcaattgtctgcagaagcttcgagaagatatatcttccaagctggatcggaatctcggcgatagcctccaccggcaggagatccaggtcgtgcttgagaagccgaacggctttagccagtcacctacagctctctactctagccccccggaagtggacacctgcatcaatgaggacgtagagagtcttcgaaagaccgttcaggatctcttggccaaactgcaagaggcaaaacggcagcaccagtctgattgcgttgcattcgaagtgactctttcccgttaccagcgagaagcggaacagagcaatgtcgcactgcaacgggaggaggacagagtggagcagaaggaagcagaggtgggcgaactgcagcggagactgctgggcatggagacggagcatcaggctctgctagccaaagttcgagaaggcgaagtcgctctggaggagctgaggtctaataacgcagattgccaggctgaacgggagaaggccgcgaccctggagaaagaggttgccggtttgcgcgagaagatccatcacctcgatgacatgttaaagtcccagcagaggaaggtgaggcagatgattgagcagctgcagaacagcaaggcagtgatccaatcgaaggatgcaacaatacaagagttgaaggagaagatcgcgtacttggaggccgaaaacctagagatgcatgaccgtatggagcatctgatcgaaaagcagatttcccatggcaacttcagcactcaggcgcgtgccaaaaccgagaaccctgggtctatcaggatttcaaagcctccatcccctaaacccatgcccgtgattcgagtggtcgaaacc

SEQ ID NO: 20385 - DNA, 1170 bp, Artificial Sequence
  Description of Artificial Sequence: Synthetic coding sequence
atgaacggtacgagaaactggtgtaccctcgtggatgttcacccggaggaccaggccgccggatccgtcgatatcctgagactgacccttcaaggagagctgactggcgacgagttggagcacattgcccaaaaggcagggcggaaaacttacgctatggtatcaagccattcggccggtcactcgctggcctcggaactcgtggaatctcatgatggccatgaagaaatcatcaaggtgtacctgaaggggcggtcaggtgataagatgatccacgagaaaaacatcaaccaattgaagtcagaagtccaatacatccaagaagcacggaactgcctgcagaaattgcgcgaagatatctcctcgaagctggaccgcaatctgggagactcccttcaccggcaagagatccaggtggtcctcgagaaacccaatgggtttagccaatcacctaccgcgctgtattcaagtccacctgaggtggacacttgcattaatgaagatgtggaatcgttgcgcaagaccgtccaggacctgctggctaagctgcaggaagccaagcgccagcaccagtcggactgtgtcgctttcgaagtcaccctgtccagataccaacgcgaggctgagcagtcgaatgtcgcgcttcagcgcgaggaagatcgcgtggaacaaaaagaagctgaggtcggagagcttcaaagacggctcttgggcatggaaactgaacatcaggcgctgctcgctaaagtgcgggaaggggaagtggccctcgaggagctgcgctcgaacaacgcggactgccaggcggagagggagaaagcagcaactttggagaaagaagtggccggactgcgtgagaagattcatcacctggacgatatgctgaagtcgcagcaacggaaggtgaggcagatgatcgaacaactgcaaaattcgaaggcggtcatccagtccaaggatgccaccatccaggaactgaaggagaagatcgcctaccttgaggccgagaatctggaaatgcatgaccgcatggagcatctgatcgaaaagcagatatcgcacggcaacttctctacccaagcaagggccaagactgagaaccctggaagcatcaggatttcgaaacccccatcccccaagccaatgccggtgatccgcgtagttgaaacc

SEQ ID NO: 20386 - DNA, 1170 bp, Artificial Sequence
  Description of Artificial Sequence: Synthetic coding sequence
atgaatgggacacgaaactggtgcaccttggtggatgtccatccggaggatcaagccgccggtagcgtcgacatcctgcggctgacgctccagggggaactgacaggagatgagcttgagcacattgctcaaaaggccggacggaaaacttatgcaatggtaagcagccatagtgccgggcattccctggcaagtgagctcgtggagagccatgacggacatgaagagatcatcaaggtttacttgaagggtaggtccggggataagatgatccacgagaagaacatcaaccagttgaagagcgaagtgcagtatatccaggaggctagaaattgccttcaaaagttgagagaggacatttcttctaaactggaccgcaatctgggcgacagcttgcatagacaggagatccaggtagtgctcgaaaagcccaacggcttttctcagagccctactgcactgtattcaagcccgccggaagtggacacttgcattaatgaagacgtcgagagtctgcggaagaccgttcaggacctgcttgctaagctgcaggaggccaaaagacagcaccagagcgattgcgttgcttttgaggttacactttctcgctaccagagggaagctgagcagtccaatgttgccctgcagcgagaggaagatagggtcgaacagaaggaggcagaagtcggggagcttcagcgccgactgttgggcatggagacagaacaccaagcactcttggccaaagtgagggaaggcgaggtggcattggaggagctcaggtccaacaatgctgactgccaggccgagcgggagaaggctgccaccctcgagaaggaagtggccggcctccgcgaaaaaatacaccacttggacgacatgctcaaatctcagcagcgcaaagtccgacagatgatagagcagctgcagaatagcaaggctgtcattcagagcaaagacgctaccattcaggaactgaaggaaaaaatcgcttacctcgaggccgagaatttggaaatgcacgatcggatggagcatttgattgaaaagcaaatctcccacggaaacttctccacccaagctagagccaagactgagaatccaggatctatccggatatctaagcccccttccccaaagccaatgccagtaatcagggttgtggagaca

SEQ ID NO: 20387 - DNA, 1170 bp, Artificial Sequence
  Description of Artificial Sequence: Synthetic coding sequence
atgaatggaacccggaattggtgtaccctagttgacgtccaccctgaggaccaagctgctgggtccgtcgatattcttcggctgacattgcagggggagctgaccggcgacgaactggaacatattgcgcagaaagcaggaaggaagacctatgccatggtaagttctcattcggcgggccattcgctggcatctgagttagtggaaagccatgatggacatgaagagatcattaaagtgtatttgaaggggcggtccggcgacaagatgatccacgagaagaatatcaatcagctcaaaagtgaggtccagtacattcaggaggcccgtaactgtcttcagaagcttcgtgaggatatatcaagcaagctggacagaaatctcggcgattctctacatagacaggagattcaggtagtcctggagaagccaaatggatttagccagagcccgacagctctgtacagcagtccgccagaagtcgacacctgtatcaacgaagacgtcgagtccctcagaaaaactgtacaggatttgctggcgaagttgcaagaagcaaaaagacagcaccaaagcgactgtgtcgcatttgaggtgacactttcacggtatcagagggaggctgagcaatcaaatgtggcccttcagcgggaggaggaccgggttgagcaaaaagaggccgaagttggagagctccagcgccggttgctgggaatggagactgagcaccaggctttgctagcaaaggtaagggagggcgaggtggctctggaagaattgcggtcaaataacgctgattgccaagctgagagagagaaggctgccacattggagaaagaggtggcaggactgcgcgagaaaattcaccatctggatgacatgttgaagagccagcaaagaaaagtgaggcagatgatcgagcagctgcagaactccaaagcggtgatacagagtaaagacgccactatccaggagctcaaagagaagatcgcatacctggaggccgaaaatctagagatgcacgaccggatggaacacttgatcgaaaaacagatcagtcatgggaatttttcaacccaagccagggccaagacagagaatccaggctccatacggatcagcaagccgcccagcccaaaacctatgcccgtgatacgcgtagttgagacc

SEQ ID NO: 20388 - DNA, 1170 bp, Artificial Sequence
  Description of Artificial Sequence: Synthetic coding sequence
atgaacggaacccggaactggtgcaccctggtggatgtgcatccagaagatcaagcagcaggcagcgtggacattctcagactcacgttgcaaggggaacttaccggggatgagctggaacatattgcacaaaaggcaggacggaaaacttacgcaatggtgtcctcccattcggcaggacattcgctcgcctcggaattggtggaaagccatgatggtcatgaagagatcattaaggtgtatctgaaaggaagatcaggtgacaagatgattcacgaaaagaacataaatcagctcaagtcggaggtgcaatacattcaggaggcccggaactgtctgcaaaagctgcgagaagatattagctcaaaacttgatcgcaatctcggagatagtctgcacagacaggaaatccaggtggtgctcgaaaagcccaatggtttttcgcagagccccaccgctctttactcgagccctcctgaggtcgatacctgtatcaatgaagatgtggaatcgcttaggaaaactgtgcaagatctccttgcaaagctgcaggaagccaagcggcagcatcagtcggattgcgtggcttttgaggtgactctgtctaggtaccagagagaagccgaacaatcgaacgtggcccttcagagggaagaggatcgggtggagcagaaggaggcggaagttggggaactccaaaggagactccttggtatggaaaccgagcaccaagccctgcttgcaaaagtgagggaaggtgaggtggctctggaagagttgagatccaataacgccgattgccaggcagaacgtgagaaggcggccaccctggagaaagaagtggcaggtttgcgtgaaaagatccaccatctggatgacatgctgaagtcccagcagaggaaagtgcgtcaaatgatcgaacagctccaaaactcgaaggcggtgattcagagcaaagacgcaaccatccaagagctgaaggagaaaattgcatacctggaggccgaaaacctcgagatgcacgatagaatggaacaccttatcgaaaagcaaatatcccatggaaactttagcacccaagcacgggcaaagactgaaaacccaggctccattcgcatttccaagcccccctcaccgaagcctatgcccgtcatcagagtggtggaaacc

SEQ ID NO: 20389 - DNA, 1170 bp, Artificial Sequence
  Description of Artificial Sequence: Synthetic coding sequence
atgaatggtacgcgtaattggtgtacgctagtagatgtacatccggaagatcaagcggcgggttcggtagatatactacgactaacgctacaaggtgaattaacgggtgatgaattagaacatatagcgcaaaaagcgggtcgaaaaacgtatgcgatggtatcgtcgcattcggcgggtcattcgttagcgtcggaactagtagaatcgcatgatggtcatgaagaaataataaaagtttatctaaaaggtcgatcgggtgataaaatgatacatgaaaaaaatataaatcaactaaaatcggaagttcaatatatacaagaagcgcgaaattgtctacaaaaactacgagaagatatatcgtcgaaattagatcgaaatctaggtgattcgttacatcgacaagaaatacaagttgtactagaaaaaccgaatggtttttcgcaatcgccgacggcgctatattcgtcgccgccggaagtagatacgtgtataaatgaagatgtagaatcgttacgtaaaacggtacaagatttattagcgaaactacaagaagcgaaacgacaacatcaatcggattgtgtagcgtttgaagttacgctatcgcgttatcaacgagaagcggaacaatcgaatgtagcgctacaacgagaagaagatcgagtagaacaaaaagaagcggaagttggtgaactacaacgacgtctactaggtatggaaacggaacatcaagcgttactagcgaaagttcgagaaggtgaagttgcgttagaagaactacgatcgaataatgcggattgtcaagcggaacgtgaaaaagcggcgacgttagaaaaagaagtagcgggtttacgtgaaaaaatacatcatctagatgatatgttaaaatcgcaacaacgtaaagttcgtcaaatgatagaacaattacaaaattcgaaagcggttatacaatcgaaagatgcgacgatacaagaactaaaagaaaaaatagcgtatttagaagcggaaaatctagaaatgcatgatcgtatggaacatttaatagaaaaacaaatatcgcatggtaatttttcgacgcaagcgcgtgcgaaaacggaaaatccgggttcgatacgtatatcgaaaccgccgtcgccgaaaccgatgccggttatacgagttgtagaaacg

SEQ ID NO: 20390 - DNA, 1170 bp, Artificial Sequence
  Description of Artificial Sequence: Synthetic coding sequence
atgaacggaaccagaaactggtgcacactggtcgacgtccatcccgaagatcaagcagcaggttcagtggacatacttaggcttaccctgcaaggagaactgaccggagatgagcttgaacacatcgctcagaaagctggaaggaagacgtatgcaatggtttctagccactccgcaggacattcactggctagcgaactcgtcgagagccacgacggacacgaggagattatcaaggtctacttgaaagggagaagcggcgataagatgatccatgagaagaacataaaccagctgaagagcgaagtgcaatatatccaggaggctaggaactgcctacagaagctgcgggaggacatctccagcaagttggacaggaacctcggtgactctctgcatagacaggaaatccaggttgtgttggagaagcccaacggattctctcagtctcctaccgctctctattcgagcccgcctgaagttgatacttgtataaacgaagatgttgaaagcctgcgcaaaaccgttcaagatttactggccaaactgcaggaggccaaaaggcaacatcaaagcgactgcgttgcttttgaagtgacgctcagtagataccagagggaggctgagcaatctaatgttgccttgcagagagaagaagacagagtggaacaaaaagaagccgaagtgggggaactgcaaagaaggcttcttggaatggaaacagagcatcaggctctgctggctaaagtaagggaaggcgaggtagccttagaggaactccgaagcaacaacgcggactgccaggccgagcgcgaaaaggccgccacactggagaaggaagtcgccggcctccgggaaaagatccaccacttagacgacatgctgaagagccaacagaggaaggtgagacaaatgatcgaacagctgcaaaacagcaaagccgtcattcagtcaaaagacgcgactatccaggaactcaaggaaaagatcgcttatcttgaagccgagaatcttgagatgcatgaccgcatggagcatctgatagaaaagcaaatttcccacggaaactttagcacacaagccagggctaagacagaaaatcccggcagcatcagaatatccaaacccccatcacccaagccaatgcccgtcatcagggtggtggaaaca

SEQ ID NO: 20391 - DNA, 1170 bp, Artificial Sequence
  Description of Artificial Sequence: Synthetic coding sequence
atgaatggcaccaggaattggtgtacattagtcgacgtgcatcctgaggatcaggcagccggtagcgtggatattctgaggctgaccctacaaggggagctcacaggcgatgagctggagcatatagctcaaaaggccgggcggaagacatatgccatggttagttctcactccgccggccactctctggctagcgagcttgtggagagtcacgatgggcacgaagagatcataaaggtgtatctaaaggggcgtagcggcgataagatgatccacgagaagaacataaaccaactcaaatccgaagtgcagtacatccaggaagcaagaaactgcctccagaagttacgagaagatatatcaagcaaattggataggaacctgggcgatagtctgcacaggcaggagattcaggtcgtccttgagaagcctaatggcttttctcagagtcccacagcactgtacagctctcctcctgaggttgacacctgtatcaacgaggatgtggagagtttgagaaagaccgtgcaggacctcctggctaagttacaagaggcaaagcgccaacatcagagtgactgcgttgcatttgaggttactctcagtagatatcagcgggaagccgagcaaagcaatgtcgcattgcagagagaggaagacagggttgaacaaaaggaggctgaggtgggcgagctacagcgccggttattaggcatggaaacagagcatcaggccttactggcaaaggttagggagggggaagtcgcacttgaggaactgaggagcaacaacgccgattgccaggccgagagagagaaggccgctactctggaaaaggaggtggccggtcttcgcgagaaaattcatcaccttgatgacatgcttaagtctcagcagaggaaagtacgccagatgattgagcaactgcagaactccaaggccgtgatccagagcaaagatgccactatccaagagctgaaggagaaaatcgcctatctggaggctgaaaatcttgagatgcatgataggatggaacacctcatagaaaagcagatatcccacggcaatttctcaacccaggcccgcgcaaaaaccgagaatccaggatccattaggatctccaaaccaccttctcccaagcctatgcctgttattagggtggtcgaaact

SEQ ID NO: 20392 - DNA, 1170 bp, Artificial Sequence
  Description of Artificial Sequence: Synthetic coding sequence
atgaatggaacacgaaactggtgtactctagtggacgttcatccagaagatcaagcagctggatccgttgatattctccgtcttactctacagggagaactcacgggagatgaactcgagcacattgcacaaaaagcggggagaaagacctatgcgatggtgtcatcccactccgccggtcacagcctggcaagtgagctcgtcgagtcacatgatggacatgaagaaatcattaaggtttacctgaagggacggtcaggagataagatgattcatgagaaaaatattaatcaattgaagtccgaggtccaatatattcaggaagctcgcaattgtctacaaaagcttagagaagacatctcttctaaattagatcgaaatctaggagattctctacatagacaagaaattcaagttgtgcttgaaaagccaaacggttttagccagagcccaaccgcactctacagctcgcctccagaagttgacacgtgtattaatgaggatgtagagtcccttcgtaaaacggttcaagatctacttgctaaactgcaggaagctaaaagacaacatcagtcagattgcgtcgcatttgaagtaacattatccagatatcagcgtgaggcagagcagtcaaacgtggcccttcagcgtgaggaagaccgtgtggagcagaaggaagcagaagttggagaattgcaacgaaggcttcttggaatggagactgagcaccaagctcttttagctaaggtgagagagggtgaggtggcactcgaagagctacgctcaaataacgcggattgccaagccgaacgagagaaggcggctacccttgaaaaagaagtcgctggattgcgggagaaaatccaccacttagacgatatgcttaaatctcagcaaagaaaagtcaggcaaatgattgaacaattacaaaactcaaaagcagtgatccagtccaaagatgctacaatccaggagctaaaggagaagatcgcttacttagaggcggagaatctcgaaatgcatgatcgtatggaacaccttatcgagaagcagattagtcatggtaatttctctactcaagctcgggcgaagacggaaaaccctggaagtattcgtattagtaagccaccaagcccaaaaccaatgccagtgattcgtgtggtcgagaca

SEQ ID NO: 20393 - DNA, 1170 bp, Artificial Sequence
  Description of Artificial Sequence: Synthetic coding sequence
atgaacggaacgcgaaactggtgtaccctcgtggatgtccatccggaagatcaagcggctggatcggttgatattctgagactcaccctccagggtgaacttaccggagacgaactcgagcacatagcccaaaaagcagggcgtaaaacttacgccatggtcagctcccacagcgcaggacattcgctggcatccgagctggtcgaatcccatgacggtcacgaagaaatcatcaaggtgtaccttaagggtcgctcaggcgacaagatgattcatgagaagaacatcaatcagctgaaatctgaggtgcagtacatccaagaagcacgtaactgtctgcagaaacttagagaagatatctcttcgaaacttgatcggaaccttggggattcgcttcatcgtcaggaaattcaggtcgtgcttgagaaaccgaatggattttcgcagagcccgaccgcgttgtattcgagccctccagaagtggatacgtgtattaacgaggatgtggaatccctgcgtaagactgtgcaggatctgctggcgaagttgcaagaagcaaagagacaacaccagtccgattgtgtggcattcgaagtaacgctttcgaggtaccagagagaagcagagcagagcaatgtggcactccaaagggaggaggatcgcgtggagcaaaaggaagcagaggtcggagaactgcaaaggcggcttttggggatggaaaccgagcatcaggcacttctcgctaaggtgcgggaaggcgaagtcgcacttgaagaacttcgctccaataacgctgattgtcaggccgaacgggagaaggcagccactctcgaaaaagaagtcgcaggactccgagagaaaatacatcatctggacgacatgctgaagtcgcagcaaaggaaggtgagacaaatgatcgagcagctccagaacagcaaggcggtcatccaatcgaaggatgcaaccattcaggagcttaaggagaaaatcgcatacctggaagcagaaaacctcgagatgcatgatagaatggaacacctgattgaaaagcaaatttcccacggtaacttctctacccaagcaagggcaaagactgaaaaccccggttcgatcaggatttccaagcccccttctcctaaacctatgccagtgattagagtggttgaaacc

SEQ ID NO: 20394 - DNA, 1170 bp, Artificial Sequence
  Description of Artificial Sequence: Synthetic coding sequence
atgaacggtacccgtaattggtgcactttggtggacgtgcatccagaagatcaagcagcgggatccgtggacattctgcgccttactctgcagggcgaacttacgggggatgaactcgagcatatagcgcaaaaggcaggccggaaaacttacgctatggtgtcgtctcattcagcaggacatagcctggcatcggagctcgtggaatcacatgatgggcatgaggaaatcatcaaggtgtacttgaagggtaggtcgggcgataagatgattcacgagaagaacattaaccaactgaagtccgaagtgcagtatatccaggaagcgagaaactgccttcaaaaactccgagaggatattagcagcaaacttgatagaaaccttggggattcgctccataggcaggaaatccaagtcgtgctcgagaagcctaatgggttctcgcagagcccgaccgctctctactcgtcgcctcccgaagtggatacttgtatcaacgaagatgttgaaagcctcagaaagacggtgcaagatctgctggcaaagctgcaagaggcgaagcgacaacaccaatccgattgtgtggccttcgaagtcactctgtcgaggtaccaaagagaagccgaacagtcgaatgtggccctccagagggaagaggacagagtggaacagaaggaggcagaagtgggtgagcttcaacgccggcttctcggtatggagactgagcatcaagccctcctggcaaaggtgagggaaggtgaagtcgcgctggaagagcttcgctccaacaacgctgattgtcaagccgagagagaaaaagcagccacccttgaaaaggaggtggccggactgcgagaaaagatccatcacctggatgacatgctgaagtcgcaacaaagaaaggtcagacaaatgattgaacagcttcaaaactcaaaagctgtgattcaatcaaaggatgcgaccatacaggagctgaaagaaaagattgcatacttggaggccgagaatctggagatgcatgataggatggaacatctgattgaaaaacaaattagccatggcaacttttcaacgcaggctagagccaaaactgaaaatcccggttcgattaggatttcaaagcctccgtcccccaagccaatgcctgtgattcgtgtggtggagact

SEQ ID NO: 20395 - DNA, 1170 bp, Artificial Sequence
  Description of Artificial Sequence: Synthetic coding sequence
atgaacggcacccgcaactggtgtacattggtggacgttcatcctgaagatcaggctgcagggtctgtagatattctccggctgacactacagggagaactcacgggcgatgagctggaacacatcgctcagaaagctggcaggaaaacttacgctatggtgtcttcccacagtgcaggccattctcttgcctcagaactagtggagtctcatgacggacatgaggaaataattaaggtgtacctgaagggccggagtggcgacaaaatgatccacgaaaaaaacataaatcagttgaagagcgaggtacagtatattcaagaggcccgaaactgtctgcaaaagctgagagaggacattagcagtaaactggatcgtaacctgggtgacagtctgcaccgccaggagattcaagtggtgctggaaaagcccaacgggttcagccaaagccctactgctttatatagttctccacctgaggttgacacctgcatcaacgaggacgtggaatcactgcgtaagaccgtccaagacctcttggcaaagttgcaagaggccaaaaggcagcaccaatccgactgcgtggcctttgaagtcacactctcacgctaccagagagaggcagagcagtccaatgtagcgctgcagcgcgaagaggatcgcgtggaacagaaagaggctgaggtgggcgagctacaacgaagattattggggatggaaaccgagcaccaagcgcttctggctaaagtgcgggagggcgaggtcgctctggaggaactgcgcagtaataacgcagattgccaggcagagcgcgagaaggcggctaccctggagaaggaagtagctggtcttcgcgaaaaaatccaccacctggatgacatgcttaagagccaacaaagaaaagtacgccagatgatagaacagctacagaactccaaggctgtcatccagtcaaaggacgcaaccattcaagaacttaaagaaaagatcgcctacttggaagccgaaaatttggaaatgcacgataggatggagcatctgattgaaaagcaaatctcccacggcaatttctctacccaggcccgcgcgaaaaccgaaaaccctgggagcatccgtatcagcaaaccccctagccccaagcctatgccagtcattagggtggtggagaca

SEQ ID NO: 20396 - DNA, 1170 bp, Artificial Sequence
  Description of Artificial Sequence: Synthetic coding sequence
atgaatggaactcgaaattggtgcacgcttgtggatgtccaccccgaggatcaggcagccggttccgtggacatccttcgccttacccttcaaggtgagctgactggcgatgaattggaacatatcgcacaaaaggctgggagaaaaacttatgcgatggtgtcctcccacagcgcggggcattcactggcgtcggaacttgtggaatcacatgacggtcatgaggagattatcaaagtctacctcaaggggaggtcaggagacaaaatgattcatgagaagaatatcaatcagctcaagtcggaagtgcaatacatccaagaagcaaggaattgtctgcaaaaactgagagaagatatttcgtccaagctcgacagaaacctgggcgattcactccatcggcaggaaatacaggtggttcttgagaagccaaacggtttttcccaatcccctaccgccctttacagcagcccgccagaagtggatacctgtataaacgaagatgtggagagcctccgcaagactgtgcaggatcttcttgcaaagctgcaggaagcaaagcgtcagcatcaatcggactgtgtcgcatttgaggtgactctttccagataccaacgggaggctgaacagtcaaacgtcgccttgcaaagggaggaagatagggtggaacagaaggaagccgaggtcggagaactgcaacgcagactgctgggaatggagacggaacaccaagcccttcttgcaaaagtgcgcgaaggcgaagtggctttggaagaactgagatccaataacgcagattgccaggcggagagggaaaaggcggcaactctggaaaaagaggtggcgggactgcgcgaaaagatacaccatctggacgacatgctcaagtcccagcagcgaaaggtcagacagatgattgaacagctccaaaactccaaagcagtgattcaatctaaagacgcaacgatccaggaattgaaagaaaagatcgcataccttgaagcagagaatctcgaaatgcatgatcgtatggaacaccttattgagaaacaaatttcgcatggcaacttctcaacgcaagcacgcgcaaagaccgagaacccaggttcgatcagaatctccaagccgccatccccaaaacccatgccggtgattcgtgtcgtggagact

SEQ ID NO: 20397 - DNA, 1170 bp, Artificial Sequence
  Description of Artificial Sequence: Synthetic coding sequence
atgaatgggaccaggaattggtgcacattggtcgatgtgcaccccgaagaccaggccgccgggagcgtggatatattaaggctaacactgcaaggtgagctgactggcgatgaattggagcatattgcccagaaggccgggcgcaagacttatgccatggtgagctcccatagtgccggccatagcctggcctcagaactcgttgaatcacatgacggacacgaggaaattattaaggtctacttaaagggaagaagtggcgacaaaatgatccacgaaaagaatattaaccagctaaaaagcgaggtgcagtatatccaggaagctaggaactgtctccagaagctgagagaggatattagttctaagctggataggaatctaggagatagcctgcaccggcaggaaattcaggttgtgttagaaaagcccaacggattcagtcagagtccaaccgcgctttattcgtcgccgcctgaagtggacacctgtattaacgaggacgtggagtcactgcggaagaccgtgcaggacctgctagccaagctgcaggaagcaaagcgacaacatcagagcgattgcgtggctttcgaggtgacactttctagatatcagcgggaggccgaacagagtaacgttgcccttcaacgcgaagaggaccgcgtcgagcagaaggaggccgaggtcggggagctgcagagaaggctgttgggaatggaaaccgaacaccaagcattactggcaaaggtccgcgagggtgaggttgccctggaggaacttagaagcaacaatgccgactgccaagctgagagagagaaggctgctactctcgaaaaagaagtggctggcctgagggagaagatccaccatctggacgacatgctgaagagtcaacagagaaaagtgaggcagatgatcgaacagctccagaatagcaaagcagttatacagtctaaggatgccaccatccaagagcttaaagaaaagatcgcctatttagaggccgaaaacctggagatgcatgacaggatggaacatctgatcgagaagcagatctcacacggcaacttctccacacaggcccgcgccaagaccgaaaaccctggctccatcagaattagcaaacccccgtcgccaaaacctatgcctgttatccgagtggttgaaacc

SEQ ID NO: 20398 - DNA, 1170 bp, Artificial Sequence
  Description of Artificial Sequence: Synthetic coding sequence
atgaatggtacccgtaactggtgcaccttggtggacgtacacccggaagatcaggcggctgggtcggtggacatcttgagactcaccctccagggggagctgaccggagatgaactggaacatatcgcccagaaggccggacgcaagacttacgccatggtgtcgtcccattccgccggacatagtctggcctccgagctggtggagtcgcatgacgggcacgaagagattatcaaggtgtacctgaaaggacggtcgggcgacaaaatgatccatgagaaaaacatcaaccagcttaagtcggaggtgcaatacatccaggaagcacgcaattgcctccagaagttgcgcgaagatattagctccaaactggatagaaatctgggcgactccctccaccgccaggagatccaggtggtactggaaaagcctaacggttttagccagtcacctaccgcgctgtacagcagcccgccggaagtggacacctgtatcaacgaagatgtggagagcctgcgcaaaactgtgcaggacctgctggcgaagctccaggaggctaagagacagcaccaatcggactgcgtggcttttgaggtgaccctgtcacgctaccaaagggaggcagaacagtcgaacgtggccctgcagagagaagaggaccgggtcgaacaaaaagaagctgaagtgggcgaactccaacggaggttgctgggaatggagactgaacaccaagcactcttggctaaagtgcgtgagggggaggtcgccctggaagaactcagatccaacaatgccgattgccaggccgaaagggaaaaggccgcgacccttgagaaggaggtcgccggactccgcgagaagatccatcacctggacgatatgctgaaaagtcagcagcggaaagttcgacaaatgatcgaacaacttcaaaactccaaggccgtcatacaatctaaggatgcaaccatccaggagctcaaggaaaagattgcatatctggaggctgagaaccttgaaatgcacgaccggatggaacatcttatcgaaaagcaaatctcacacggaaacttctccactcaagcgcgcgccaagacggagaatccaggttcgattaggatttccaagcccccatctcctaagccgatgccggtgatccgcgtcgttgaaacc

SEQ ID NO: 20399 - DNA, 1170 bp, Artificial Sequence
  Description of Artificial Sequence: Synthetic coding sequence
atgaatggcaccaggaattggtgtaccctggttgacgttcatccagaagaccaagccgccggcagcgtcgatattctgcgcctgaccttgcagggtgagctcaccggcgatgaactggaacacatcgcccaaaaagccgggcgcaagacatacgctatggtgtcctcacacagcgctggccactctctggcttcggagttggtagaatcacatgacgggcacgaggagattattaaagtgtatttgaaaggccgctctggcgacaagatgatccacgaaaagaacattaaccagctgaaatctgaggtacagtatattcaggaagcacggaactgtctccagaagctgcgcgaggacatttcatccaaactggatcgtaatctgggcgattcattgcacaggcaggagatacaagtggtgctggaaaagcccaacggcttctcccagagccctacagccctgtactcttctccacctgaagttgatacctgcatcaacgaagatgttgaaagtctgcgcaagacagtccaggatcttttggcgaaactgcaagaagcaaagcggcagcatcagtcagattgtgtggccttcgaagttactctatctagataccagcgagaagccgagcagtctaatgtggcccttcagcgcgaggaagaccgtgttgagcagaaagaggctgaagttggtgaattgcaaaggcgcctgctgggcatggagactgaacatcaggcgctactggcaaaggttcgcgagggagaagtcgctttggaagaactacgctctaataacgcagactgtcaggccgagcgggagaaagccgccactctggagaaggaagtggccgggctccgagagaaaatacatcacctcgacgacatgctgaaatcccagcagaggaaggtccgccagatgattgagcaactgcagaacagcaaggccgttattcagtcgaaggacgccacaatccaggagttgaaagagaaaattgcttaccttgaagccgagaatctagaaatgcatgatagaatggaacacctgattgagaaacaaataagccatggcaatttcagcacccaggcccgggcgaaaaccgagaaccccgggtccattcgcattagtaaaccaccctctccaaaacccatgcccgttatacgggtagtagaaacc

SEQ ID NO: 20400 - DNA, 1170 bp, Artificial Sequence
  Description of Artificial Sequence: Synthetic coding sequence
atgaacggaacccggaactggtgtactctggtcgacgtccatccggaagatcaggcagccggttccgtcgacatcctccggctgactctgcagggagagctcactggagacgagctcgaacacatcgctcagaaggccggcagaaaaacctacgccatggtgtcctcccactccgccggccattcactggcgtcagaactggtggagtcacacgacggccacgaggagatcattaaggtttatctgaagggccggtccggtgataagatgatacacgagaaaaacattaatcagctgaaaagcgaagtccagtacatccaagaagcgcggaattgtctgcaaaagttgcgggaggacatcagcagcaagctggacagaaacctcggagactcgctgcatcggcaggaaatccaagtggtccttgaaaaacccaacggattcagccagtcgccgacggccctgtacagctcgcctccagaggtggatacttgtatcaacgaggacgtcgaatcgctccggaaaactgtccaagatctgcttgccaaacttcaggaagcaaagcgtcagcatcagagcgattgcgtggcattcgaagtgactctgtcgcgctaccagcgcgaagctgagcaaagtaacgtcgcgctccagagggaggaagatcgggtggaacaaaaagaggccgaagtgggggagctccagcgccggctcctgggaatggaaactgagcaccaggccctcttggcgaaggtccgcgagggcgaagtggcgttggaggaactgcggtcaaataacgcggactgccaagctgagcgcgaaaaggctgccactctcgagaaggaagtggccggactgcgcgaaaagatccatcatctcgacgacatgctgaaatcccagcagcgcaaggtcagacaaatgatcgaacagctccagaactcgaaggcggtcatccaatcgaaggatgccaccatccaggagctgaaagagaagatcgcgtacctggaggctgaaaacctggaaatgcatgaccggatggagcacctgatcgagaaacagatctcacacggcaacttcagcacccaggctagagccaaaaccgagaacccgggctccatccggatctcaaagccgccatcgccgaagcctatgccagtgatccgcgtcgtcgagact

SEQ ID NO: 20401 - DNA, 1170 bp, Artificial Sequence
  Description of Artificial Sequence: Synthetic coding sequence
atgaacggaacgaggaattggtgtaccctcgtggacgtacatcccgaagatcaggccgccgggagtgtagacattttgagactaacgctgcagggtgagcttactggggatgagctcgagcatattgcccagaaggctggccggaaaacttacgcaatggtgtcaagccattccgccggacattctttagccagtgaactggtggagtcacatgacgggcacgaggaaattatcaaagtctatcttaagggtcgtagtggagataagatgattcatgaaaaaaatatcaaccagctcaaaagcgaggtgcagtatatccaggaagcaaggaattgtctccaaaagctgagggaagatattagcagcaaactggataggaacctcggtgacagcctgcatagacaggagatccaggtcgtcctggaaaaaccaaacggcttttcacagagccccaccgccctgtattccagtccaccagaagttgatacctgcattaacgaagacgtcgaatccttgaggaagaccgtgcaggatttgttggcaaaactgcaggaagccaagcgacagcatcaatccgattgcgtggcgttcgaggtaacactctctagatatcagagagaggctgagcagagtaatgttgcactgcagagggaggaagaccgggttgaacagaaggaagctgaagtcggagaactgcagaggcgactactcggaatggaaactgaacaccaggctcttctggccaaagtgagggaaggcgaagtagcgctcgaagaactaaggtctaacaatgctgattgtcaggccgaaagagagaaagcggcaaccctggagaaggaagttgctggattacgtgagaagatccaccacctggacgacatgcttaagtcccagcagcgaaaagtaaggcagatgattgaacagttgcagaatagcaaggccgtgatccaaagtaaagatgcaaccatccaggagctgaaagaaaagatagcttacttggaggctgaaaatctggagatgcacgatagaatggaacacctgatagaaaaacagatttcgcatgggaatttcagcacccaagcccgggcgaaaaccgagaatcccggctccattaggatttccaaacctccaagccccaagccgatgccagttatcagggtcgtggagacc

SEQ ID NO: 20402 - DNA, 1170 bp, Artificial Sequence
  Description of Artificial Sequence: Synthetic coding sequence
atgaatgggaccaggaactggtgtacactggtcgacgtgcacccggaagaccaagcagcggggtcagtggacatattgagacttactctccagggcgagctgaccggcgacgagttagagcacatagcccagaaagctgggcggaaaacatatgcaatggtgtcctctcattctgctggccatagcctggcctctgagctggtggaatcccacgacggccatgaggaaataatcaaggtatatctgaaagggaggagtggggataaaatgatacatgagaagaacatcaatcaactcaaaagcgaagtgcagtatatccaggaggctagaaattgtctccagaaactacgtgaagacatttcaagtaagttggacagaaacttgggggatagcctgcaccgacaagagatccaggtggttctggagaaaccaaacgggtttagtcagtcccctaccgctctatactcgagcccgcccgaggtagacacttgtataaacgaagacgttgagtctctcagaaagacagtccaggatctgctggctaagctccaggaggctaagaggcagcaccagagcgactgcgttgccttcgaggtcactctgagcaggtaccagagggaagccgagcagagcaacgtagcactgcagcgagaagaagatcgggtggaacagaaggaggccgaggtgggcgagctgcagaggcggctcctaggcatggaaaccgaacaccaagccctgctcgcgaaagtccgcgagggggaagtggccctggaggaactgaggtctaacaacgcagattgtcaagcagaacgtgagaaagctgcaaccttggaaaaggaagtggccggacttagggaaaagatccaccacctggacgacatgctaaaatcacagcaacggaaggtgaggcagatgattgagcagcttcagaactcaaaggctgttattcagtctaaggacgctacaattcaggagctcaaagagaaaatcgcttacctggaggcagaaaacctcgagatgcacgacaggatggagcacctaatcgaaaagcagatctcgcatggcaatttctccactcaagcaagagccaagacggagaacccaggaagcatcagaatatccaagccgccgagtccaaagccaatgccagtgatccgggtggtggagact

SEQ ID NO: 20403 - DNA, 1170 bp, Artificial Sequence
  Description of Artificial Sequence: Synthetic coding sequence
atgaacgggacccgcaactggtgcacgctcgttgacgttcatccagaagatcaagcggctggatcggtggacatcctgaggctcacgcttcagggggagcttactggagacgaactggagcacattgcccagaaggctggacggaaaacctacgcgatggttagctcccattcagcgggacactcgctcgcaagcgaactcgtcgagtcacacgacggtcacgaagagatcatcaaagtgtacttgaagggacggagcggtgacaagatgatccatgaaaagaacatcaaccagctcaagtccgaggtgcagtatatccaggaagcccgcaattgcttgcaaaagctgagagaggatatctcctccaaactggataggaacctcggcgattcactccaccgccaggagattcaagtggtcttggaaaagccgaacgggttttcacaatcgcccaccgcactgtactcaagcccccctgaggtcgacacctgcatcaacgaggacgtggaatcactccgcaaaacggtgcaagacctgctcgccaagctgcaggaagcaaagcggcaacatcagtccgactgcgtcgcgttcgaggtgactctgtcacggtaccagcgggaggccgagcagagcaatgtggctctgcagagggaggaagatcgcgtcgaacagaaagaagcagaagtgggtgagctgcagagacgacttctggggatggaaaccgaacaccaggcccttctggccaaggtgagggaaggcgaggtggctcttgaagagttgcggagcaataatgcagactgccaagccgaacgcgagaaggcagccactctcgagaaggaagtggccggactgcgggaaaagatccaccatttggatgacatgctgaaatcgcaacagcgcaaagtcaggcagatgatcgagcagctgcaaaatagcaaggccgttatacaatccaaagatgccactatccaggaactgaaagaaaagatcgcgtaccttgaagccgaaaatctggaaatgcatgatcggatggagcacctgattgagaagcagatttcgcatgggaacttctcaactcaagcccgggcaaagactgaaaacccgggatcaatccgcatcagcaaaccaccttcccccaagccgatgccagtgatcagagtggtcgagact

SEQ ID NO: 20404 - DNA, 1170 bp, Artificial Sequence
  Description of Artificial Sequence: Synthetic coding sequence
atgaacggaactaggaattggtgtacactagttgacgtacaccccgaggaccaggcagcagggagtgtggacattcttagactcacgcttcagggggagttgacgggggatgagctcgaacatatcgcccagaaggccggacgaaaaacttacgcaatggtaagcagccattcggctggccacagccttgcgagtgagctggtggagagccacgacggccatgaggagattatcaaggtctatctgaagggtagaagtggggataagatgattcatgaaaagaacattaaccagctcaaaagcgaagtccagtatatccaggaggccagaaactgtctgcagaaactccgggaggatatatccagcaaactcgaccgcaatctgggggattcattacatagacaggaaatccaagtcgttctcgagaaacccaacggatttagccagtctcccaccgctttgtactcgtctcctccagaggtggacacatgtatcaacgaggatgtcgaatccctgcgtaagaccgtccaggacctgctggccaaattacaagaggcgaagagacaacatcaatcagactgcgtcgcttttgaagtgacactgtctaggtaccagcgagaggcagagcaatctaacgtcgctctgcaacgagaggaggaccgcgtcgagcagaaagaagcagaagtgggcgagcttcagcgtaggctgcttgggatggagacagaacaccaggcattgttggcaaaagtcagagagggggaggtagccttagaggagttacggtccaataacgcagattgccaagccgagagagagaaggcagctactctggagaaggaagtagctgggctgcgggaaaagattcaccacctagatgatatgttgaaaagccagcagcggaaggttcggcaaatgatcgagcaattgcagaactcaaaagccgtgatacaatccaaggatgctaccattcaagaactgaaagagaaaatcgcatatcttgaggcagaaaaccttgaaatgcatgatcgcatggaacacctgattgagaaacagatctcacatggtaactttagcacacaagctagggccaagaccgagaatcccggtagtattaggatcagcaaaccaccctctcctaagcccatgcctgtcatcagggtggtggaaaca

SEQ ID NO: 20405 - DNA, 1170 bp, Artificial Sequence
  Description of Artificial Sequence: Synthetic coding sequence
atgaacggtacgagaaactggtgtacgttggtggacgttcatcccgaagaccaggcagcgggtagcgttgacatcctgagactgaccctgcagggagagctgactggtgacgagcttgagcatattgctcagaaagccggaaggaagacgtacgcaatggtctcctcccattccgcgggccattccctcgcaagcgagctggtagagagccacgacggccacgaagaaatcataaaggtgtacttgaagggtcgcagtggagataaaatgatccacgagaagaatatcaaccagcttaagagtgaggtgcagtatattcaagaggctcgcaactgtctgcagaaattgagagaagacataagcagtaagttggacagaaatttgggtgatagtctccacagacaggaaatccaagttgtgctggagaagccaaatggatttagccagtcccctaccgcactttactcctcacctccagaagttgacacatgtattaatgaggatgtggagtccctgaggaaaaccgtccaggaccttttggcgaaactgcaggaggcaaagcgccagcaccagtcagactgcgtcgcttttgaggtaacgctgtcaagataccagagagaggctgagcagtccaacgtcgctctgcagcgcgaagaggatcgcgttgagcagaaggaggcagaggtgggtgaactgcaaaggcgcctgttgggcatggaaacggaacaccaggcactgttggccaaggtgagagagggcgaggttgctctggaagaactcaggtctaacaacgctgattgtcaggctgaaagagaaaaggccgccacgctcgaaaaggaagtggcaggactgcgcgagaaaatccatcacctggacgacatgcttaaatctcagcagaggaaggtgagacaaatgatcgagcaactccagaatagcaaggctgtcatccagagtaaggatgccacgatccaagagctcaaggagaaaatcgcgtacctcgaggctgagaatttggagatgcacgataggatggaacatctgatcgaaaaacaaatttctcatggcaatttttccacgcaagctagggccaaaaccgaaaaccctggttcaattagaatttcaaaacctcccagtccaaagcccatgccagtaatcagagtagttgagact

SEQ ID NO: 20406 - DNA, 1170 bp, Artificial Sequence
  Description of Artificial Sequence: Synthetic coding sequence
atgaatggtacccgcaactggtgcacccttgtcgacgtgcatcctgaagatcaggccgcagggtctgtggatattctgcggctcacccttcaaggagaacttaccggtgatgaactggagcatatagcccagaaagcaggtagaaagacctacgccatggtgtcgagccattcagcaggacatagcctggcatccgaactggtcgaaagccatgatggccacgaagaaatcatcaaggtgtatctcaagggaaggagcggagacaaaatgattcacgaaaagaacattaatcagcttaagtcggaagtgcaatacatccaggaggctagaaattgcctgcagaaattgagagaggatatctcaagcaaactggacaggaaccttggggactccctgcatagacaagaaattcaggtcgtgctcgaaaagcctaacggctttagccaatcacctactgcactttattcctccccacctgaggtggatacttgtatcaatgaggatgttgagtccctgagaaagactgtgcaagacctgcttgccaaactccaggaggccaagcggcagcaccaatcggactgtgtcgcgttcgaagtgactctgagccgataccaaagagaagccgaacagtcaaatgtcgcacttcaaagggaggaggatagagtggagcaaaaagaggcggaagtgggggagctgcaaagacgtctccttggaatggaaactgagcatcaggcgcttctggcgaaagtgagagagggtgaagtggctcttgaagagctgcgctccaacaatgcggattgtcaggcggagcgcgagaaagcagcgaccctggagaaagaagtggcaggtttgagagagaaaattcatcacctggatgacatgctgaaaagccaacaacgtaaagtgcgccaaatgattgaacaactgcaaaactcgaaggctgttattcaaagcaaggatgctaccattcaagaactgaaggagaagatcgcatacctcgaggcagagaacctggaaatgcacgacaggatggaacacctcattgaaaaacagatttcccatggtaacttttcgactcaagcccgcgcaaagactgagaatcctggctccatcagaattagcaagcctccctcccctaagccaatgcctgtcatcagagtagtggaaact

SEQ ID NO: 20407 - DNA, 1170 bp, Artificial Sequence
  Description of Artificial Sequence: Synthetic coding sequence
atgaatggcactaggaactggtgtactctggtcgatgttcatccagaagaccaggcggccggatctgtggacatactgaggctgactctccagggggagctaacaggcgacgagctggagcatatcgcgcagaaggccggccgtaaaacatacgccatggtgagctcacacagtgccgggcactccctggcctcagagcttgtggaatctcacgacggccacgaggagattatcaaggtgtaccttaagggacgctctggggacaaaatgatccacgagaaaaatattaaccagctgaagtccgaggtgcagtacatccaagaagcccgcaattgcttgcagaaactcagagaggacatctctagtaaactcgatcggaatctaggggattcgctccacagacaggaaatccaggtcgtactggaaaagcccaatggtttttctcagagccccaccgcactctattcttctccccccgaagtcgacacctgtatcaatgaagacgtggagtccctgcggaaaacagtccaggatctactagccaagctgcaggaggcaaagcggcagcaccagagtgattgtgtcgccttcgaagtaaccctgagtcgttaccagcgggaggcagagcagagcaacgttgcgctccagcgcgaagaagatcgagtggaacagaaagaagcagaagtgggcgagcttcagcggagactgctgggtatggagacggaacaccaagctctgctcgctaaggtgagggagggcgaagtggctttagaggaacttcgctcaaacaatgcggattgccaggccgaaagagagaaggctgccaccttggaaaaggaggtcgcgggtcttcgggagaagatccatcatttggacgatatgctcaagtcccagcagcggaaggtgcgacagatgatcgagcaactgcagaactcaaaagccgtcatccagtctaaggacgctacaattcaggagctaaaggaaaagatcgcgtacttagaagccgagaacctcgagatgcatgatcgtatggagcatttaatcgaaaaacagattagccatggaaatttttccacccaggcgcgggcaaaaaccgaaaatcccggttctatcagaattagcaagccaccctcgcccaagccaatgccggtcatccgggtagtggaaact

SEQ ID NO: 20408 - DNA, 1170 bp, Artificial Sequence
  Description of Artificial Sequence: Synthetic coding sequence
atgaacggtactagaaattggtgcacactagtagatgtgcatcccgaagatcaggccgcaggctctgtagacattctgagacttacactccaaggggaattaacgggcgacgagctcgagcacattgcccagaaagctggacggaaaacatatgccatggtgtcatcgcacagtgctggtcactccctagctagtgagctggttgagtcacacgacggtcacgaagagatcatcaaagtgtacctgaagggtaggagcggagacaagatgatacacgagaaaaatatcaaccaattgaagtcagaggtccaatatatccaggaagccagaaactgtctgcaaaagctgagggaagacatcagttctaagctggaccgtaacctgggcgattcacttcatagacaggaaatccaggtagtattggagaagcccaacggcttctcccagtcccccacggccttgtattccagccccccggaagtggacacctgtattaacgaggatgttgagtcactgcgaaagaccgtgcaagacttgttagccaaacttcaagaagccaaaaggcagcaccagagcgactgtgtggccttcgaggtaaccctgtctcggtatcaacgggaagccgagcaatctaatgtcgcccttcaacgggaggaggatagggtggagcaaaaggaggccgaggtgggggagctgcaacgcagattgctaggaatggaaaccgaacatcaagccctgttagctaaggtgcgcgaaggagaagtggcattggaagagctccgctctaataacgccgattgccaggctgagcgggaaaaggccgccaccctagaaaaagaggtcgctggcctgagggagaagatccaccatctcgatgacatgctgaagtcacaacagagaaaggtgagacagatgattgagcagttacagaacagtaaagctgtgattcagtcgaaagacgctaccatccaggagctcaaagaaaagattgcctatttagaagcagaaaatctggagatgcacgaccgaatggagcacctcatcgagaaacaaatcagtcatggcaatttctccacccaagcccgcgccaaaacagagaacccagggagcatcagaatctccaagcctccttctcccaaacccatgccagtaatccgagtggtcgaaaca

SEQ ID NO: 20409 - DNA, 1170 bp, Artificial Sequence
  Description of Artificial Sequence: Synthetic coding sequence
atgaacggaactcgcaactggtgtactctggtggacgtgcaccccgaggaccaggccgccgggtccgtggatattctgcgcttgaccctgcagggagaactcaccggagatgaactggagcatatcgcacaaaaagccggaagaaagacttacgcgatggtttcatcccactcggccgggcactcccttgccagcgaactcgtggaaagccacgacggacacgaagagatcatcaaggtctacctcaaaggacgcagcggagacaagatgatccacgagaagaacattaaccaactcaagtcagaagtgcagtacattcaggaagcgaggaattgtctgcagaagctgcgagaagatatctcctccaagctcgaccggaacctgggagactcgcttcacagacaagagatccaggtggtcctcgaaaaaccgaacggatttagccaatcacccaccgcactgtactcaagcccaccggaggtggacacctgcattaacgaagatgtcgaatcactgcggaaaaccgtgcaagatttgctggcaaaattgcaagaagcaaagcggcaacaccagtcggactgcgtggcatttgaagtgacgctgtcccgctaccagcgggaggccgagcagtcaaacgtggccctccagcgggaggaggacagggtggagcagaaggaagcggaggtgggcgagctgcagaggcggctgctggggatggaaaccgagcatcaggctctgctggcgaaggtgcgagaaggagaggtcgctcttgaggagctccgctcaaataacgccgattgccaggccgaacgggaaaaggctgctaccctcgaaaaagaagtggcgggactgagggagaagatccaccatctcgacgacatgctcaagtcccagcagcgcaaggtgcgccaaatgatcgaacagctgcagaactcgaaagccgtcattcagagcaaagacgctactatccaggagctcaaggaaaagatcgcatacctcgaagcagagaacctggagatgcatgaccgcatggaacaccttattgagaaacaaatcagccacggaaatttctccacccaggcccgcgctaaaactgagaacccagggtcaatccggataagcaaacctccgtcccctaagcctatgccagtgatccgagtcgtggaaact

SEQ ID NO: 20410 - DNA, 1170 bp, Artificial Sequence
  Description of Artificial Sequence: Synthetic coding sequence
atgaatggtacccggaactggtgcaccctcgttgatgtgcatcccgaagatcaagccgcagggtccgtcgatatcctgagactgactctgcagggcgaactcaccggagacgagcttgagcatattgcccagaaagcaggtcggaaaacttacgctatggtcagctcccatagcgctggtcacagcttagcatctgagctggtcgaaagccatgatggacatgaggaaataataaaggtgtacctgaaaggtcgcagtggtgataagatgatccacgagaagaacatcaaccagctgaagagcgaggtgcagtacattcaggaagcccggaattgtctccagaagctcagggaagacatctcaagcaagttagatcgtaacctgggcgatagtctgcatagacaggagatacaagtggtactcgagaaacccaatgggtttagccaatctcccaccgctctctattcttcacctcctgaagttgacacatgtataaatgaagacgtggaatctctccgcaagacggtccaggatcttctggctaagctccaggaagccaaaaggcaacaccagtccgactgcgtcgccttcgaagtcacccttagtcgctaccagcgggaggctgagcagtccaacgtggccttgcagagggaagaggaccgcgttgagcagaaagaagcggaagtgggggagctgcagcggaggctcttagggatggagacagagcatcaggccctattggcaaaagtgcgcgagggtgaggtagcactggaagaactccggagcaacaacgcagactgccaggcagaaagggaaaaagccgcgaccctcgaaaaggaagtggctgggttgagggaaaagattcatcatctggacgacatgctgaagtcccagcagcggaaagttaggcaaatgattgagcagcttcagaattccaaggctgtcatccagtctaaagacgcaacaatccaagaactaaaagagaaaattgcatacctggaagctgagaacctggaaatgcatgatagaatggaacacctgatcgaaaagcagattagccacggcaatttttctactcaggccagagctaagacggaaaacccgggcagtatcaggattagtaagccaccgtctccaaaaccaatgcccgtgattagagtggtggaaacc

SEQ ID NO: 20411 - DNA, 1170 bp, Artificial Sequence
  Description of Artificial Sequence: Synthetic coding sequence
atgaatggtactcggaactggtgtactctagtagacgttcatcctgaggaccaggcggcgggcagcgtggatatcttacgactcacgctgcaaggcgaacttacaggcgacgaacttgagcatattgcccagaaggctgggaggaaaacctacgccatggtctcttcacactctgccggacactccctggcttcggaactcgtcgagtctcacgatggtcacgaggaaatcataaaggtttacctgaaagggcgttccggagacaagatgattcacgagaagaatataaatcagctgaagtctgaggtacagtacattcaggaagctagaaattgcctgcaaaaattacgtgaggatatcagctctaagctcgaccgaaatttaggcgacagcctccaccgtcaggagattcaggtcgtcctcgagaagcctaatggtttctcgcagagcccgactgcattgtattcttctcctccagaggtcgatacatgcattaacgaggatgtggagtctcttcgaaagaccgttcaggacctacttgccaagcttcaagaggcaaagcggcagcaccagtcagactgcgtggctttcgaggtaactctgtccaggtatcaacgtgaagcagaacagtcaaatgtggctcttcagcgcgaggaggatagagtggagcagaaagaggctgaggtaggggagctccaacgacgcttgctcggaatggagactgaacatcaggcactgttggcgaaagtcagggagggcgaggtcgctcttgaggagctccggtctaacaatgcagactgccaagcggagagggaaaaggcagccaccctcgagaaggaggtagcgggcctgcgtgaaaagatccatcatttggatgatatgttgaagtctcagcagcgtaaggtgagacaaatgattgagcagctgcaaaattccaaggctgtcattcagagtaaggatgcaaccattcaggagttgaaggaaaaaatagcgtatctcgaggccgagaacctggaaatgcacgatcgtatggagcatctgatagagaagcaaatttcccacggcaacttcagcactcaggcccgtgctaaaaccgagaatcccggaagtatccgtatctccaaaccgccatcgccaaagccgatgccagtgatccgcgttgttgagact

SEQ ID NO: 20412 - DNA, 1170 bp, Artificial Sequence
  Description of Artificial Sequence: Synthetic coding sequence
atgaatggtacaagaaattggtgcactttagtggatgtacatccagaagaccaggctgctggaagcgtggacattctccgcctcaccctacagggcgagctgaccggtgatgagctagaacacatcgctcagaaggctggccggaaaacatacgctatggtgagctctcactccgccggccactcattggcctctgaactggtagaaagccatgatgggcatgaggaaatcattaaagtgtatctcaaaggaaggagtggagacaaaatgatccacgaaaagaacatcaaccaactgaaaagtgaggttcagtacatacaggaagcgaggaattgcctccagaaactaagggaggatatcagctctaagttggatagaaacctcggcgactctctgcacagacaggagatccaggtggttctcgaaaaacctaacggattctcccagtcacctacagcgctctactcctcaccacccgaggtggatacctgcatcaatgaggacgtggagtcgttacgcaagaccgtgcaagatctcctcgcaaaactgcaggaagcaaagagacagcaccagtcagactgtgtcgccttcgaggtcaccctctccaggtatcagcgggaggccgagcagtctaacgtggctctgcagcgagaagaggatagagtcgagcagaaagaggccgaggttggggagctgcagcgccgactcctgggtatggagacagaacaccaagcattgctggctaaagtcagggaaggcgaggtggcgctggaagaacttcgcagcaataacgcggactgccaggccgagcgggagaaggctgctactcttgagaaagaggtggcaggactgcgggagaagatccatcatttggatgatatgctgaagtctcaacagcggaaggtgaggcagatgattgaacagctccagaactcgaaggcagtcattcagagcaaggacgcaactattcaggagctaaaagagaagatcgcttacctcgaagccgagaatctagagatgcacgaccggatggagcacttgatcgagaagcagatctcccatggaaatttttctactcaggcaagagccaagacagaaaatccaggaagtattcggattagcaagcccccctcccctaagccaatgccggtgattagggtggtcgaaacc

SEQ ID NO: 20413 - DNA, 1170 bp, Artificial Sequence
  Description of Artificial Sequence: Synthetic coding sequence
atgaatggtacccggaattggtgcacactggtcgatgtccatcctgaagatcaggctgccggcagcgttgatattttgagactaaccctacagggcgagctcaccggcgacgaattggaacacatcgcacaaaaggccggaagaaagacctatgccatggttagctcccactccgccggacattcacttgcgtctgagctggtggagtctcatgacggtcacgaagaaattatcaaagtctatcttaaagggaggtcaggcgacaagatgatacatgagaaaaatataaaccagcttaagtccgaggtgcagtatatccaggaggcaagaaactgcctccagaaactgcgggaggacatatccagcaaattggaccggaacctgggcgactctttgcatcggcaggagatccaggtggtgctggagaaaccaaatggctttagtcagtcccccaccgctctctacagctcacctcctgaggtggatacctgcattaatgaagatgtggaaagtctgaggaagaccgtgcaggatctgctggcaaagctgcaggaggcaaagcggcagcaccaatccgattgtgttgcctttgaagtaacactatctcgatatcagcgagaggccgagcagtcgaacgtggccttacagagggaggaggatagggtcgagcagaaggaggctgaagtgggtgagctgcaaaggaggcttctgggaatggagactgagcaccaggccctgcttgctaaagtgcgcgagggggaagtcgcactggaagagctgagatcaaacaacgcagactgccaggccgaaagagagaaggccgctacgcttgagaaggaggtggccggactgcgcgaaaagatccatcatctagacgatatgctgaaaagccagcagcgcaaggttcgccagatgatcgagcagttgcagaattcaaaggccgtgatccagtccaaagacgctactatacaggaacttaaagagaaaattgcttatttggaagctgagaacttggaaatgcatgatagaatggagcacctgatcgaaaagcagatctcccacgggaattttagcacacaagcgcgggcaaagaccgaaaaccctggctccatacgaatatccaaacccccttcccccaagccaatgcctgtcataagggtcgtcgagaca

SEQ ID NO: 20414 - DNA, 1170 bp, Artificial Sequence
  Description of Artificial Sequence: Synthetic coding sequence
atgaacggaacgaggaattggtgtacgttggtcgacgtgcacccagaagatcaagcggccgggtcggtggacattctgcgattgaccttgcagggagaacttaccggggacgaactcgagcacatagcccaaaaggctggacgtaagacctacgcgatggtttcgagccacagcgctgggcattccctggcctctgagctggtcgaatcgcacgacggccatgaagaaatcatcaaggtgtacctgaagggacgcagcggcgacaaaatgatccatgagaagaatatcaaccagctcaagtccgaagtgcaatacatccaggaagcgcgcaattgccttcaaaagctcagagaagatattagttcaaagctggaccggaacctcggcgactcactccatcgccaagaaatccaagtggtcctcgaaaaaccgaatggctttagccagtcaccgactgctctgtactcgtccccgccggaagtggacacctgtatcaatgaggacgtcgagtcactgcgcaaaaccgtacaagacctgctggctaaacttcaagaagcaaagcgccagcaccagagcgactgcgtggcgtttgaagtcactctgtcgcggtaccagagggaggccgagcagtcaaacgttgcccttcagcgagaagaggacagagtggagcagaaggaggcggaagtgggtgaactgcagagacgcctgcttggaatggaaacggagcaccaggcactccttgctaaagtgagagaaggagaggtggcactggaggagctccgttcgaataacgctgattgccaggccgaaagagaaaaggctgcgactctggagaaggaagtcgcgggacttcgggagaaaatccaccatctggatgatatgctcaaatcacaacagaggaaggttcggcaaatgatagagcaattgcagaactcaaaagcagtgatccagtctaaggatgctactatccaggagctcaaggaaaagatcgcatatctcgaagcagagaacctggagatgcatgatcggatggagcatctcatcgaaaaacagatttcgcacgggaacttcagcactcaggcccgggcaaagactgaaaaccccggctctatcagaatctcgaaacctccaagcccgaaacctatgccagtgatccgggtcgtggagact

SEQ ID NO: 20415 - DNA, 1170 bp, Artificial Sequence
  Description of Artificial Sequence: Synthetic coding sequence
atgaacgggactcgcaactggtgcactttagtggacgtgcatcctgaggatcaggccgctggaagtgtcgatatacttcggcttactcttcagggagagcttacaggagacgaactcgaacacatcgcccagaaagccgggagaaagacatacgcaatggtttcctcacattcagccgggcatagtctggcatctgaattagtcgaatcacatgatgggcatgaggaaataatcaaagtttatctgaaagggaggagtggagacaaaatgatccatgaaaaaaatatcaatcagctgaaaagtgaagtccagtatattcaggaagctcggaattgtctccagaaattacgagaagatatctcatcaaaactcgataggaacctcggagattcactccatcggcaggaaattcaggtggttttggaaaagcccaacggattttcgcagagtcctacagccctctatagttcgcctcctgaggtggatacatgtatcaacgaagatgttgaatccctacgaaaaacagtgcaggatctgcttgcaaaacttcaggaagccaagcggcagcaccagtctgattgcgtggcgtttgaagtgactctcagtaggtatcaacgcgaagcagaacagtcaaatgtggctctgcagagagaagaggatcgagtggaacagaaagaagctgaggtaggagaactccagaggcggctcctcggaatggaaacagagcatcaggcattattagcaaaggtcagagagggagaggttgctctggaagaattacggtctaacaacgctgattgtcaggcagaaagagaaaaagccgccacattggaaaaggaggtggctgggttgagggaaaagatacaccaccttgatgatatgctcaagtcacagcagagaaaggtcaggcagatgatagaacagcttcagaattcgaaggctgttatccagtctaaagatgccactatccaggaattaaaagaaaaaattgcgtacctggaagccgaaaaccttgaaatgcatgataggatggagcatcttatagaaaagcagatttctcacgggaatttttccactcaggctagggcgaaaacagagaaccctggatcgatccgaatatctaagcccccctcccctaaaccaatgcctgttatcagagttgttgaaact

SEQ ID NO: 20416 - DNA, 1170 bp, Artificial Sequence
  Description of Artificial Sequence: Synthetic coding sequence
atgaacggaactcggaattggtgcactctggtggacgttcatccggaagatcaagcagcgggctctgtggatatccttagactgactctgcaaggcgaactcaccggcgatgagttggagcatatcgcccaaaaagctggaaggaaaacttacgctatggtgtcgtctcacagcgccggacacagcctggcctccgaactggtggaatcccatgacggccatgaagaaatcattaaagtgtacctgaagggacgctcaggagacaaaatgatccacgaaaagaacattaatcagctgaagtccgaggtgcagtacatccaggaagcgcggaactgtctgcagaagctcagagaagatatcagctccaagttggatagaaacctcggagactcactccatcgccaggagatccaagtggtgctggagaaaccgaacggattctcacaaagcccaaccgccctttactcaagcccgcctgaggtggacacttgcatcaacgaggacgtggaatccttgagaaagaccgtgcaagacctgctcgctaagctccaagaggctaaacgccagcatcaatcggattgcgtcgcttttgaagtcactttgagccgataccagagagaggcagaacaatcgaatgtggctctgcaacgggaagaagatagggtggaacagaaggaagctgaagtgggagaactgcagcgccgcttgctcggaatggaaaccgaacatcaggctttgctggccaaagtgagagaaggcgaggtcgccctggaagagctccgttcaaataacgcagactgccaagcggagcgcgaaaaggccgccaccctcgagaaggaagtcgccggcctccgggagaagatccatcacctggacgatatgctgaagtcccaacagcgcaaggtcagacagatgattgaacagctgcagaactccaaggccgtcattcagtcgaaggacgccaccatccaggaactgaaagaaaagattgcctacctggaggccgaaaaccttgagatgcacgacaggatggaacacctgatcgaaaagcagatcagccatgggaatttcagcacccaggcgcgggctaaaactgaaaacccaggatccataagaatctcgaaacctcccagccctaagccaatgccggtcatccgcgtggtcgaaact

SEQ ID NO: 20417 - DNA, 1170 bp, Artificial Sequence
  Description of Artificial Sequence: Synthetic coding sequence
atgaatggtaccagaaattggtgcactcttgtggatgtgcaccctgaggaccaggcagcagggtcagtcgatattctccgcctgactctgcaaggagaactcaccggggatgagctcgagcacatcgcacaaaaggccggtcgcaaaacctacgctatggtgtcctcgcattcggctggacactccctggcatccgaacttgtggagtcacatgatggacatgaagaaatcattaaggtctacctgaagggtcggagcggtgataagatgatacatgagaagaacattaatcagctgaagagcgaggtgcaatacattcaagaagcaagaaactgcctgcaaaagctgcgggaagatatttcctcgaagctcgaccgcaacctcggggattcactgcacaggcaagagattcaggttgtgcttgagaaacctaacgggttttcgcagagcccaactgcactttacagctccccaccggaggtggacacctgtattaacgaggacgtcgagagcctgcggaaaactgtgcaagacctgctcgcgaaactgcaggaagcaaagagacagcatcaatccgattgcgtggcgttcgaagtgactctgtcgcgttaccaacgtgaagcagagcagtcgaacgttgcgcttcagcgtgaggaggatcgagtggaacaaaaggaagccgaggtcggtgaactgcagagaagattgcttggaatggagactgagcaccaggctctgcttgcaaaggtgcgcgagggagaagtggcactcgaagaactgcggtcgaacaacgcggactgccaggcagaacgggaaaaggccgccaccctggagaaggaagtggcaggattgcgagaaaagatccatcatctggacgatatgctgaagtcccagcaaaggaaggtgagacagatgattgaacaattgcagaattcgaaagcagtgatacaaagcaaagacgcaactatacaagaacttaaagaaaagatcgcatacttggaggctgagaacttggaaatgcatgacaggatggaacatcttatcgaaaaacagatttcgcatggaaacttttccacgcaagcgcgagccaagactgaaaacccaggatcgattagaatttcgaagcctccttcccccaagcctatgccagtgataagagtggtggagact

SEQ ID NO: 20418 - DNA, 1170 bp, Artificial Sequence
  Description of Artificial Sequence: Synthetic coding sequence
atgaatgggacgcgtaattggtgtaccctcgttgatgtgcatcctgaagatcaagcagcaggtagcgttgatatacttagattgactcttcaaggagaactcacgggggatgaacttgaacatattgcccagaaggccggaagaaagacctacgctatggtgagctcgcattcagcaggtcattcgcttgcgagtgaactcgtcgaaagccacgatgggcacgaggaaatcattaaagtgtacctcaagggaagatccggcgataagatgattcacgaaaagaacataaaccagctcaaatcggaagtccagtacatccaggaggcacgcaactgcctgcagaaacttcgggaagatatttcctcaaagctggaccgaaacctcggggattcactgcatagacaggaaattcaggtcgtattggaaaagcctaatggtttttcacagtccccaactgcgctctacagctcgccaccagaggtcgatacttgtattaacgaggatgtggagtcacttcgcaagaccgtgcaggacctcctggcaaagctccaagaagcaaaacgacagcaccagtcagattgcgtggcatttgaggtcaccctgtcgcgttatcaaagggaagcagaacaaagcaatgtggcactgcagcgggaggaggacagggtcgaacagaaggaggcagaagtcggagagctgcaaagacgacttctgggaatggaaactgagcaccaagcacttctggctaaggtacgggagggggaagtggcacttgaagaactgagaagcaataatgccgactgccaagcagaacgggagaaggcggcaactctcgaaaaggaagtggcaggactcagggaaaagattcatcatctggacgatatgcttaagtcccaacaacggaaagtgagacaaatgattgaacaacttcagaactccaaggctgttatccaatcgaaggacgccactatccaagaactcaaagagaaaatagcgtatttggaagctgaaaacctggaaatgcatgaccgtatggaacacctgatcgaaaagcaaatttcccatggcaacttctcgacccaggcaagagcaaaaaccgaaaaccctggatcaatccggatatcgaaaccccctagcccaaagccaatgcctgtgatccgggtggtcgaaacc

SEQ ID NO: 20419 - DNA, 1170 bp, Artificial Sequence; identical to SEQ ID NO: 20395
  Description of Artificial Sequence: Synthetic coding sequence

SEQ ID NO: 20420 - DNA, 1170 bp, Artificial Sequence
  Description of Artificial Sequence: Synthetic coding sequence
atgaacggcactagaaattggtgcacattggtggatgtccacccagaggatcaggctgccggatcggttgatattttgaggctcactctccaaggggagctgaccggagatgagttagagcatattgcacagaaggcaggccgaaagacatacgctatggtctctagccacagtgctggacactctctggccagcgagttagtagaaagtcacgacggacacgaagagatcattaaggtatacctgaaaggacgtagtggtgataaaatgattcacgaaaagaacataaaccagttgaaatctgaggtgcagtatatccaggaggcgcgtaactgcctgcaaaaattgcgcgaggatatttccagcaaactggatcggaacctcggagacagcctgcatagacaggagatccaggtagtactcgagaaaccgaacggattctctcagtcccctaccgcactctacagttcaccccctgaggtggatacgtgcatcaatgaagatgttgaatccctcagaaagaccgtgcaggacctcctggcaaaactccaggaggccaagcgccagcaccaatctgactgcgtggcctttgaagtaaccctgagtaggtatcaacgggaggctgagcagtctaatgttgccctgcaaagggaagaagatagagtcgaacagaaggaagcggaagtcggggaacttcaaaggcgcctgttagggatggaaacggaacatcaagcccttctcgccaaggtccgggagggggaggtggctttagaggagcttcggtctaataatgcagattgtcaagccgagcgggagaaagcagctactctggaaaaggaagttgctgggcttcgggaaaagatccaccatctggacgacatgcttaagagccaacagcgcaaggtacgtcagatgatcgagcagttgcagaattcgaaagctgtgattcagtcaaaggacgccactattcaggagttaaaagagaagatcgcatacttagaggctgaaaatttggagatgcatgataggatggagcacttgattgagaagcagatcagccacgggaattttagcacacaggcccgagcaaagacggagaatccgggctccatccggattagcaagcccccgtctccaaaacccatgcctgtgataagggttgtagaaaca

SEQ ID NO: 20421 - DNA, 1170 bp, Artificial Sequence
  Description of Artificial Sequence: Synthetic coding sequence
atgaacggtactaggaactggtgtaccctagtggacgtgcacccagaagaccaggcggcgggctctgttgatatcctgcgactgactctccaaggcgagttaacgggagacgagttggagcacatcgcacagaaggctggacgtaaaacttatgctatggtatcctctcactccgctggccacagcttggcttctgaactggttgagtcacatgatggccatgaggaaataatcaaggtgtacctcaagggaaggtctggcgacaagatgatccacgagaagaatattaatcagctgaaatctgaggtccagtacatacaggaggctcgaaattgcctgcaaaagttgcgggaagatattagctctaagctcgaccgcaacctcggagactcactgcaccgccaggaaatccaggtagttttggaaaaaccgaacggattctctcagtctcccaccgccctgtactcttcccccccggaagtcgatacatgcatcaatgaggacgtggagtccctgcggaagaccgtgcaggatctgctggctaagcttcaggaagctaaacgtcagcatcagtctgactgtgtcgcgttcgaggtaacattgagtagatatcagcgggaggccgagcagtccaacgtggcccttcagcgggaagaagacagagttgaacaaaaggaagccgaggtgggagaactccaacggaggctgttagggatggagaccgagcatcaggcactgctggccaaagttcgggagggagaagtagccctcgaggagctgcgcagtaataacgccgattgtcaggccgagcgggaaaaagctgccacactagagaaggaagtggccggactgcgcgaaaagatccaccacctggatgatatgctgaagtctcagcagcggaaagtgcgccagatgatcgaacagctgcagaactccaaggcagtaatacaatccaaagacgcaacgatccaggaactgaaagaaaaaattgcttatctggaggctgagaacctggaaatgcacgaccgcatggaacacctgattgagaaacaaatttcacacggaaatttctcaacccaggcacgcgccaaaacggaaaaccctggaagcatcagaatcagtaagcctccatcacctaagcctatgcctgtgattcgcgtggtggaaact

SEQ ID NO: 20422 - DNA, 1170 bp, Artificial Sequence
  Description of Artificial Sequence: Synthetic coding sequence
atgaacggaaccaggaattggtgtacgctggtggacgtgcaccccgaagaccaagcagctggatctgtcgatatcctcagactcactctccaaggcgaactcaccggagacgaactggagcacatcgctcagaaggccggccgtaaaacctacgccatggtctcgtcccatagcgctggccactccctggccagtgagctggttgagtcccacgatggccatgaggaaatcatcaaggtgtatctaaagggacggagcggggataagatgatccacgagaaaaatatcaaccaactcaaatccgaagtccagtatatacaagaggcaaggaactgcctgcagaagctgcgtgaagacatctcatcaaagcttgacaggaatctcggggactcccttcaccggcaggagatccaggtggtccttgaaaaaccgaacgggttctctcaatctccaactgcgctctacagttctccccctgaggtggacacctgtattaacgaagatgtcgagagtttaaggaaaacagtccaggatctgttggctaagctgcaagaggccaaaagacagcatcaatccgactgcgttgcattcgaggtgaccttgagcagatatcaaagggaagccgagcagtccaatgtggccctgcagcgcgaggaagaccgagtcgaacaaaaggaagccgaggttggcgaactgcaaaggagactgctcgggatggaaactgagcaccaggcactgctcgctaaggtgcgggagggtgaagttgccctggaagagctgagaagcaacaatgccgattgtcaggcagaaagagaaaaggcagccacgctggaaaaggaggtcgccggactgcgcgaaaagattcatcacctggacgacatgctgaagtcacagcagcgcaaggtccgtcagatgattgaacagctgcaaaactcgaaggctgtgatacagtcaaaggatgcaaccatacaggagctgaaagaaaagatagcgtacctagaagctgaaaacctggaaatgcatgatagaatggagcacctgatcgaaaagcagatttcccacggaaacttcagcactcaggctcgggccaagactgagaaccctgggagcattcgaatatctaaaccaccatcccctaagccaatgccagtgattcgggtcgtggaaacc

SEQ ID NO: 20423 - DNA, 1170 bp, Artificial Sequence
  Description of Artificial Sequence: Synthetic coding sequence
atgaatggtacacgtaattggtgcaccctggtggatgtccatcctgaggatcaggccgcgggttcggtggatatcttgcgtctcacactacaaggagaactcaccggagacgaattggaacacatcgcccagaaggccggacgcaagacgtatgccatggtgtccagccacagcgccggtcatagtctggctagcgagctggtagaatcccacgatggccacgaggaaatcatcaaggtctatctgaagggccgaagtggcgataagatgatccacgagaaaaacatcaatcagctaaagtccgaagtgcaatatatccaagaggcccgaaactgcctccagaagctgcgtgaggatatcagtagcaagctcgatcgaaatctgggcgattctctgcaccgacaggaaattcaagtggtgcttgaaaaaccaaacggtttcagccagtcccctaccgcgctgtactcgagcccgcccgaggtggatacctgcattaacgaagacgtcgagagcttgcgaaagacagtgcaggacctcctagccaaactgcaggaggcgaaaaggcagcaccagtcagactgtgttgccttcgaagtcacgttgagccgttatcagcgcgaggctgaacaaagcaacgtggccctgcaacgtgaggaggacagagtggagcagaaggaagcggaggtgggagagctccagaggcgcttgttgggcatggagactgaacaccaagccctcctcgccaaggtgcgcgagggtgaagtggccttggaggagctgcggtccaataatgcggactgccaggcggaaagagagaaagccgccacgctggaaaaggaggtggcaggtctgagagagaagatccaccacttggacgacatgctgaagtcccagcaacgtaaggtgcggcagatgatcgagcaactgcagaactccaaagcggtgattcagtcgaaggatgctaccatccaggagttaaaggaaaaaatcgcctacctagaggccgagaacttggaaatgcacgataggatggagcatcttattgaaaagcagataagtcatggtaacttcagtacgcaggcgagagccaagacggagaaccccggatcgattcggatatctaaacctccaagcccgaaaccaatgccggtcatccgggtggtggagacc

SEQ ID NO: 20424 - DNA, 1170 bp, Artificial Sequence
  Description of Artificial Sequence: Synthetic coding sequence
atgaacggaactcgtaactggtgcacccttgtggatgtgcacccagaagatcaagccgccgggagcgtcgatatcctgagactcaccctgcagggcgagctcactggtgatgaactggaacacatagcacaaaaggcggggcgtaagacctacgcaatggtcagctcacattcagcaggacattcactggccagcgaactggtagaatcccatgatggacatgaagagattatcaaagtgtacctgaaggggcgttcgggtgacaaaatgattcatgaaaagaacatcaatcagctgaagagcgaggtgcagtatatccaagaagcacggaactgtctgcagaagctgagagaggatatctcaagcaagctggaccgcaaccttggagactccctgcatcggcaggagatccaagtggtgctcgagaaaccgaatggtttctcgcagtcacccactgcactgtactcctcacctcctgaggtcgacacctgcatcaacgaggatgtggaaagcctgcgtaagacggtgcaagatctccttgcgaagctgcaggaagcgaaacgccaacatcagtccgattgcgtggcgtttgaggtcaccttgagccgttaccaaagagaggcagagcagtcgaacgtggctttgcaaagagaagaggaccgagtggaacaaaaagaggcagaagtgggcgaactccaacgacgattgctcggcatggaaacggaacatcaagcactccttgcaaaggtcagagagggagaggtcgcactggaagaacttcgcagcaacaatgcagattgccaggcagaaagagaaaaagctgctaccctcgaaaaagaggtggccggactccgcgaaaagattcatcatcttgacgacatgctcaagtcgcaacagaggaaggtgcggcagatgattgaacagctccaaaactcaaaagctgtcattcaatcgaaggatgcaaccatccaagagcttaaggagaagatcgcataccttgaggcagaaaatctggagatgcatgatagaatggaacacttgattgaaaagcaaatatcccacggcaacttcagcacgcaggctagagcaaagactgaaaacccaggctccattcgaattagcaaacccccttcgcccaagccaatgcctgtcatcagagtggtcgaaacc

SEQ ID NO: 20425 - DNA, 1170 bp, Artificial Sequence
  Description of Artificial Sequence: Synthetic coding sequence
atgaacggaacgaggaattggtgcaccttggttgacgtccaccctgaagaccaagccgctggaagcgtggatatcctgcggcttacactgcagggcgaactgaccggggatgagctggaacacatcgcccagaaagcaggaagaaagacatacgcaatggtgtcctctcattcagccggtcatagcctggcatctgagctggtcgaatctcacgatgggcatgaagaaatcattaaggtgtatctcaagggtaggagtggcgacaaaatgattcatgaaaaaaatattaaccaactgaagtcggaagttcagtatatccaggaggctcggaattgcctgcagaaactgcgggaagacatctcttcaaaactagataggaatctgggagactcgcttcataggcaagaaatacaggttgttttggagaaacccaacggattctcacagtctccgacagcactgtatagcagccctcctgaagtggatacatgcattaatgaggatgtcgagtcattacgcaagacagtccaagatcttctggctaaactgcaggaagctaaacggcagcaccaatcagattgtgtggcgttcgaagtgactttgtcacgctaccagcgcgaggcagagcaaagtaacgtcgctctgcagagggaagaggatcgggtcgagcaaaaggaagctgaagtgggagaactgcagagacgcctgctgggcatggagactgaacaccaggcccttctggccaaggtgcgggaaggagaagtcgccctggaggagctcagatctaacaacgcagattgccaagcagagcgtgaaaaggccgcgacattggagaaggaagtggccgggctgcgggagaagattcaccacttggacgacatgctgaaatcccagcagaggaaagttaggcagatgatcgaacagctgcagaacagcaaagcggttattcagtccaaagatgccaccatacaggagctgaaagaaaagattgcttatctggaggcagagaacctggagatgcatgatagaatggagcaccttatagagaagcaaatctctcacgggaattttagtactcaggcgcgagcaaaaaccgagaaccccgggtccatcaggatctctaagcccccctccccgaaacctatgcctgtgatcagagtagttgagacc

SEQ ID NO: 20426 - DNA, 1170 bp, Artificial Sequence
  Description of Artificial Sequence: Synthetic coding sequence
atgaatggaactcggaattggtgtacgctcgtggacgtgcacccggaggaccaagctgccggatccgtggacatcctccgactgacccttcagggagagctgaccggagacgagctcgaacatattgcgcagaaggccggtcggaaaacctacgccatggtgagctcccactcagcgggacattccctggcctcggaactggtggagagccatgatggacatgaagaaatcatcaaggtgtacctgaagggaaggagcggagataagatgatccatgagaagaatatcaatcagctcaaaagcgaggttcagtacattcaagaagctcggaactgcctgcagaagctgagagaagatatctcgtccaagctggacagaaatctgggtgactcactccatcgccaggaaatccaagttgtgttggaaaagccgaacgggttctcgcagtccccgaccgccctttactcatccccgccagaagtggatacctgcatcaacgaggacgtggagtcactgagaaagactgtgcaagatctgctggcgaaacttcaagaggcgaagaggcagcaccaatcggactgcgtggccttcgaggtcaccctgtcacgctaccagcgggaagccgagcagtcgaatgtggcactccagcgcgaagaggatcgggtggagcaaaaggaagcggaggtgggcgagctccagagacgactcctgggcatggagactgagcaccaggccttgttggcaaaggtcagggaaggagaggtcgcgctggaagagctccggtcaaacaacgcggattgccaggcagagcgagaaaaggccgccactctggagaaggaagtggcggggcttcgtgagaaaatccatcatctcgatgacatgctgaagtcacagcaacggaaggtgaggcaaatgattgaacaactccaaaacagcaaggccgtgatccagtcaaaggacgccaccatccaggaactcaaggagaagatcgcctacctcgaagcggaaaacctggaaatgcatgataggatggaacacctgattgagaaacaaatttcccacgggaacttctcgactcaagctcgcgcaaaaaccgaaaaccctggctccattagaatctcgaagccgccatcgcctaaacctatgccggtgatccgggtcgtggagact

SEQ ID NO: 20427 - DNA, 1170 bp, Artificial Sequence
  Description of Artificial Sequence: Synthetic coding sequence
atgaacggaactagaaactggtgtactctggtggatgtgcatccggaagatcaagcagcgggatcggtggatatcctgcgcctcaccctgcagggcgaactgacgggagacgagttggaacacatcgcccagaaggctggccggaaaacctacgccatggtgtcgagccatagcgcgggccacagcctcgccagcgagctggtcgagtcgcatgacggacatgaagagattatcaaggtctacctgaaagggcggtccggtgacaagatgattcacgagaagaacatcaaccagctcaagtccgaggtgcaatacatccaagaggcacgcaactgcttgcaaaaactcagggaggacatcagctccaagctggatcgcaacctgggagattcgcttcatagacaagagatccaagtcgtgctcgaaaagccgaacggcttctcccagtcgccgactgccctctactcgtccccaccggaggtggatacctgcataaacgaggacgtggaatccctgaggaaaactgtccaggacttgctggccaagctgcaggaagctaagcgccagcatcagagcgactgtgttgctttcgaggtgactctgtcccggtaccaacgcgaggcggagcagtctaatgtggccctgcaacgggaggaagatcgcgtggaacagaaggaggccgaggtgggggaactgcagagacggcttttgggcatggagactgagcaccaggccctcctcgccaaagtgagagaaggagaagtggccctggaggaactgcggtcaaacaatgccgactgtcaagcggagcgcgaaaaggcggccaccctcgagaaagaagtggccggacttcgcgaaaagatccaccatctggacgacatgcttaagtcgcagcagagaaaggtccggcaaatgattgagcagcttcaaaatagcaaggcagtgatccagtcgaaagatgccaccatccaggaactgaaggaaaagatcgcctacctggaggccgagaacctcgagatgcacgacagaatggagcacttgatcgagaagcagatctctcatggaaatttcagcacccaggccagagccaagaccgaaaacccgggatccattcggatctccaagccaccctcgccgaagccgatgcctgtgatccgggttgtggaaact

SEQ ID NO: 20428 - DNA, 1170 bp, Artificial Sequence
  Description of Artificial Sequence: Synthetic coding sequence
atgaacggtacgcgcaattggtgcactctcgtcgacgtccaccctgaagaccaagccgcaggttcagttgacatactcaggctaaccctgcaaggcgagcttactggcgacgagctggagcacatcgctcaaaaagccggccggaagacatacgcaatggtgagctcccattccgcagggcactccctcgcgtccgagttagtggagtctcacgacggacatgaagagattattaaagtctatctaaaaggcagatcaggagacaagatgatacacgagaagaatattaaccagctcaagagcgaggttcagtacatccaggaagctcggaattgtctgcagaaacttagagaggacatctcatcgaagttggatcggaacttgggcgatagcctgcatcgtcaggagatccaggtggtgctcgagaaacccaacggcttttcacagagcccgaccgccctttactcaagtcccccagaggtggacacatgtattaatgaagatgtggagagtctgaggaaaacagttcaggaccttctggccaaactccaggaagctaagaggcagcaccaaagcgactgcgttgcattcgaagttacgctgagtaggtaccagcgcgaggctgagcaatccaatgtggctctacaacgagaggaagacagagtggaacagaaagaagcagaggtcggggaattgcagaggcggttattggggatggaaaccgagcaccaggccctgctggccaaggttagagagggagaggtggccttggaggagttacgttccaacaacgcggactgccaggccgagagagaaaaagcagccacgttagaaaaagaagtggccggcctccgtgaaaaaatccatcatctcgacgatatgctgaagagtcagcaaagaaaagtgcggcagatgatagaacagctgcaaaactctaaggcggtaatccaatcaaaggatgctacaatccaggagttaaaggagaaaattgcgtacctcgaagccgaaaatctggagatgcatgacagaatggagcatctgatcgaaaagcaaattagccacggcaatttctccactcaggcacgggccaaaaccgaaaatccgggcagtatacgaataagcaagcctccctccccgaagcccatgcccgttattcgagtcgtcgagact

SEQ ID NO: 20429 - DNA, 1170 bp, Artificial Sequence
  Description of Artificial Sequence: Synthetic coding sequence
atgaacggcacgcggaactggtgtactctcgtggatgtccacccagaagatcaggctgcaggatcggtcgacatcctccggctgacccttcaaggcgaactgacgggagacgaactcgaacacattgcccaaaaggcagggcgaaagacctacgcaatggtgtccagccacagcgccggacattcactcgcgtcagagcttgtggagtcgcacgatgggcatgaggagattatcaaggtgtacctgaaaggtcgctccggagataagatgatccatgagaaaaacatcaatcaactcaagtccgaagtgcagtacattcaagaggcaagaaactgtttgcagaagttgagagaagatatctcgtcgaaactggaccggaatttgggcgattcacttcaccgccaagagatccaggtggtgctggaaaaacctaacggattcagccaaagcccaaccgccctttacagctctcctcctgaagtggatacctgtattaacgaagatgtggaaagcctgcgcaagaccgtgcaggacctgctggcaaagctgcaagaagccaagcgccagcaccaaagcgattgcgtggcatttgaagtcactctgtcgcgctaccaaagagaggcggagcaatcgaacgtcgcgcttcaacgagaagaagatcgcgtcgagcagaaggaagctgaagttggagaacttcagaggagactgcttgggatggagactgaacaccaagctcttctggcaaaagtgagagagggagaagtggcgctggaagaactcaggtcaaacaatgcagattgccaagccgaaagagaaaaagcagcgacgctcgaaaaggaagtggcaggcctcagagaaaagatacatcatcttgatgatatgctgaagtcgcagcaacgtaaagttcggcaaatgattgaacagcttcagaattcgaaggcagtgatacagtctaaagatgcgaccattcaggagcttaaagaaaagattgcgtatttggaagcggaaaacctggaaatgcatgataggatggaacacctcatcgagaaacaaatttcgcacggtaacttttccacccaggcacgtgcaaagaccgaaaatcctggttcaatcaggatttccaaaccaccttccccaaagccaatgcctgtgatacgtgtggtggaaact

SEQ ID NO: 20430 - DNA, 1170 bp, Artificial Sequence
  Description of Artificial Sequence: Synthetic coding sequence
atgaatggtacaagaaattggtgcacgttggttgatgtgcatccggaagatcaagcagcgggatcagttgatattttacgtcttacgctacagggggaactgacgggggatgaactcgagcacattgctcaaaaagcggggaggaaaacgtacgccatggtctccagccatagcgctggtcattctttagcctcagagttggtagaatcgcatgacggacacgaagaaatcattaaagtctatctgaagggaagatctggcgacaagatgattcacgaaaaaaatattaaccaattaaaaagcgaggttcagtatatccaggaggccagaaactgcttacagaaattacgggaggatatctcctctaaacttgaccggaacttaggcgacagtctgcatcgacaggaaattcaggtggtgcttgaaaaaccgaatggtttttctcagtcaccgactgctctgtatagctcgcctccggaagttgatacatgcattaatgaggatgtggaatcacttagaaagacagttcaggacctccttgccaaacttcaggaggccaagcgtcaacaccagtccgattgcgttgcttttgaagttacactgtctagatatcagcgggaagcggaacaatccaatgtcgcgctccagagagaggaagaccgagttgagcagaaagaagccgaggtgggtgaattgcaacgtagattgcttggcatggaaacagagcaccaggcacttctggcgaaagtgcgtgagggggaggtcgcattggaagaactgcgtagtaacaacgcggattgtcaagcggagcgggaaaaggcagcgactctggaaaaagaagttgccggtctaagagagaaaatccatcatttagatgatatgctcaaatctcaacagcgcaaagttcgccagatgattgaacaacttcagaatagtaaagcagttatacagagcaaagatgctacgatacaagagctgaaagagaaaattgcttacttagaagcggaaaacctggagatgcatgaccgaatggaacatttaattgagaagcagatttctcacggcaatttttctacacaggcacgcgcgaaaacagagaatcccggtagtattcggattagtaaacccccgtctccgaagcctatgccggtaatacgcgttgtcgaaacg

SEQ ID NO: 20431 - DNA, 1170 bp, Artificial Sequence
  Description of Artificial Sequence: Synthetic coding sequence
atgaacggtaccaggaactggtgcacactagtggacgtgcatcctgaagatcaagccgctggctccgtggatattctgagactgactctgcaaggagagctgactggggacgagttggagcatatcgcacagaaggcaggacgcaagacatacgccatggtttcatcgcatagtgccggacatagcctggcctccgaactggtggagagccacgatggacacgaggagataatcaaggtctatctcaagggaaggagcggagataaaatgattcatgaaaaaaatattaaccagctcaagtccgaagtgcagtatattcaggaggccagaaattgtttgcagaaactccgcgaggacatcagtagtaaactcgacaggaatcttggagattcactccacaggcaggaaatccaggtcgtactggagaagcctaacgggttcagccagagcccgacagctttatatagttctcccccagaggtagacacctgtattaatgaggacgtggaaagcttaaggaaaacagtacaagacctgttggctaaactgcaggaagccaaaaggcagcatcagagcgattgcgtggctttcgaggtgaccttatcgcggtaccaacgtgaagcggaacagtccaacgtcgccttgcaacgggaggaggatagagtcgagcagaaagaggctgaagtgggagaattgcagcgtagactccttggcatggagacagagcaccaggcactcctggctaaggtgcgcgaaggtgaagtcgcactcgaagagctgagaagcaataatgcagattgccaggcagaacgggaaaaggccgccaccctagagaaggaagttgccggcctgcgagagaagatccaccaccttgatgatatgctgaaatcccagcagagaaaagtgcggcaaatgatagagcagctgcagaattcgaaagccgtgatccagtccaaagacgccacaattcaggaattgaaggaaaaaatcgcatatcttgaagccgaaaacctggagatgcatgataggatggaacatttgattgagaaacagattagccatggcaacttctctacacaggcacgagcaaaaaccgagaatcctggatctatcagaatttctaagcctccaagcccaaagcctatgccagtgatcagagtcgtcgaaaca

SEQ ID NO: 20432 - DNA, 1170 bp, Artificial Sequence
  Description of Artificial Sequence: Synthetic coding sequence
atgaacgggactagaaattggtgtactctggtggatgtgcaccccgaggaccaggctgccgggtcagtcgacatattgcggcttacccttcagggtgaactgaccggtgatgaactcgaacacattgcgcagaaggccggaaggaaaacgtatgccatggtgagctctcattcggcaggacattcgctggcttctgaacttgtggaatcccacgacggccatgaggagatcattaaggtgtacctcaaaggacggtcgggtgacaaaatgattcacgaaaagaacatcaatcaacttaagtccgaagtccaatacattcaggaagcacgtaactgtctgcagaagctgcgtgaggatatctcgtctaagctggatagaaacctgggggactccctccaccgccaagaaatacaagtcgtgcttgaaaagcccaacggcttctcgcagagccctactgccctttactcgagcccaccagaagtggatacctgtataaacgaggatgttgaaagccttcgcaagacggttcaggatctccttgcgaagctgcaagaggccaagaggcaacatcaatcagattgtgtggcttttgaagtgacgctgtcccggtaccaacgggaagcagaacaaagcaatgtggcactgcagagagaggaggatcgcgtggaacaaaaggaggcagaagtcggcgaacttcaacggagattgttgggaatggaaaccgagcatcaggcactcctggcgaaggtgagagaaggtgaagtggccctggaagaactgcgttccaacaacgccgactgccaggcagaacgggaaaaggcagccactttggagaaagaagtggctggactcagagaaaagattcatcatctggatgatatgcttaaatcacagcagcggaaggtccggcagatgatagaacagctgcaaaattccaaagcggtgatccagagcaaggatgctaccattcaggagctgaaggaaaagattgcctaccttgaggcagaaaaccttgagatgcatgacaggatggaacatcttattgaaaagcagatttcgcatgggaacttttctactcaagccagggcaaagaccgagaacccaggctccatccggatttccaagcctccttcacctaagcctatgccggtgatcagagtggtggaaact

SEQ ID NO: 20433 - DNA, 1170 bp, Artificial Sequence
  Description of Artificial Sequence: Synthetic coding sequence
atgaacggtactagaaactggtgtacccttgtggatgtccatcctgaggaccaggccgcaggtagcgtcgatatacttcggctcactttgcagggagaactcaccggagatgaacttgaacatatcgcacagaaggctggtcgaaaaacctacgcaatggtttcaagccattcggcaggacattcactggcatccgagctggtggaaagccatgatggccacgaagagatcatcaaagtgtacctgaaaggacggtcaggtgataagatgattcatgaaaagaacattaaccaacttaaaagcgaagtgcaatacatacaagaggcaagaaattgtctgcaaaagctgcgagaggacatctcatccaagctggataggaaccttggagattcgctccatagacaagagatccaggtggtccttgaaaagccaaatgggttttctcaatccccaacggcgttgtactcgagtccacctgaggtggatacttgcatcaacgaagatgtggaatcgcttagaaagaccgtgcaagaccttctcgccaaactgcaagaagcaaagagacagcatcagtcagattgcgtggcattcgaagtcacgctttctcgataccaacgcgaggcagagcagtcgaacgtggcacttcaacgcgaagaagatagagtagagcaaaaggaagcagaagtcggagaacttcagcgcagacttctgggtatggaaaccgaacaccaggcactgcttgctaaggtgcgagagggagaagtggcactggaagaactgagatcgaataatgccgactgtcaagcggaacgagaaaaggcagccactctggagaaggaggtggcaggattgagggaaaagatccaccatcttgatgacatgttgaagtcccaacaaagaaaggtgagacagatgattgagcaactgcagaacagtaaggccgtcatccagagcaaggacgcgactattcaagagctgaaagagaagattgcctaccttgaggcagaaaatcttgaaatgcacgacagaatggaacatctgattgaaaaacaaatttcgcatggtaacttcagcacccaggcgcgtgccaagactgaaaaccctggttcgattagaatctcgaagcctccttcacccaagcctatgccagtcattcgcgtcgtggaaacc

SEQ ID NO: 20434 - DNA, 1170 bp, Artificial Sequence
  Description of Artificial Sequence: Synthetic coding sequence
atgaacggcacgcgaaactggtgcaccttggtcgatgtgcacccggaggatcaagctgccggttcggtcgacatcctgcggctgaccctccagggtgaactcaccggggacgaactggaacatatcgcccagaaggccggaagaaaaacctacgctatggtcagctcacactcggccggacactcgctcgcctcggagttggtcgagtcgcacgatggccacgaagaaatcatcaaggtgtacctgaagggccgctccggggataaaatgatccatgagaagaacattaatcaactgaagtcagaagtgcagtacattcaggaggcgcgcaactgcctgcaaaagctgagagaggacatctccagtaagctcgatcggaaccttggagactcactgcatcggcaggaaatccaggtggtgttggagaaaccgaatggatttagccagtccccgactgctctttactccagccctccagaggtggacacttgcatcaatgaggatgtggaatcgctgcgcaagactgtccaagacctcctggccaagctccaagaggcaaagcggcagcaccaatccgactgcgtggccttcgaagtgaccctgagccgttatcagcgggaggcggaacagtccaacgttgcccttcagagagaggaggatagggtcgagcagaaagaagcagaggttggagaactgcaacgcagacttctggggatggaaactgagcaccaggcgctgttggcaaaggtccgcgaaggagaggtagcactcgaagaactgaggagcaataacgcggactgtcaggctgaacgagaaaaggcagccactctcgaaaaggaggtggctggactgagagaaaaaatccatcatctggacgacatgctgaagtctcaacagcggaaagtgcgccagatgatagagcagctccagaactcaaaagcggtgatccagtcgaaagacgccacgatccaagagctgaaggaaaagatcgcctacctggaagcggagaatctcgaaatgcacgatcgcatggaacatctcatcgaaaagcaaatttcccacggcaatttctcaacccaagcgcgggcaaagactgagaacccgggatcgattaggatcagcaaaccaccctctccaaagccgatgcctgtgatccgcgtggtggaaacc

SEQ ID NO: 20435 - DNA, 1170 bp, Artificial Sequence
  Description of Artificial Sequence: Synthetic coding sequence
atgaacggaacccgcaactggtgcacccttgtcgatgtgcatccggaggaccaggccgctgggtccgttgacatcctccggctgacccttcaaggtgaactgactggcgacgaattggaacacattgcacaaaaggcgggtcgaaagacttacgcaatggtcagttcgcattccgcgggacactccctggcaagcgagctggtggaatcgcacgatggacacgaggagataatcaaagtgtacctgaagggcagatccggagacaagatgatccatgaaaagaacataaatcagcttaagtcggaagttcagtacatccaggaagcccgcaactgccttcagaagctgagggaggatattagctcgaagctggaccgcaatctgggagattccttgcaccggcaggagatccaagtggttctcgagaagccaaacgggttctcgcaaagccccaccgccttgtactcatcgccccctgaggttgacacctgtatcaacgaggacgtggaaagcctccgaaaaactgtccaggatctccttgctaagctccaagaggcaaagcgccagcatcagagcgactgcgtcgcgttcgaagtcactttgtccagataccaaagggaggctgagcaatcgaatgtggcgctccagcgcgaggaggaccgggtcgagcagaaggaagcggaggtgggcgagctgcagcggcgcctgctgggtatggaaacggaacaccaggcacttctggccaaggtccgggaaggggaagtggcgctggaggaacttcggtccaacaacgctgattgtcaggcagagcgtgagaaggctgccactctggagaaggaagtcgctggcctgcgcgaaaagatccaccacctcgatgacatgctcaaaagccaacaaaggaaggtcagacagatgatcgaacagctgcaaaattccaaggcagtgatccagtccaaagatgctaccatccaagaactgaaggagaagatcgcatatctggaggctgagaacctggagatgcatgatcggatggaacacctgattgaaaaacagatcagccatggaaatttctccacgcaggcgcgggccaagacggaaaaccccggatcaatcagaatttcgaagccgccaagccctaaaccaatgcctgtcatcagagtggtggaaacc

SEQ ID NO: 20436 - DNA, 1170 bp, Artificial Sequence
  Description of Artificial Sequence: Synthetic coding sequence
atgaatggcacccgaaactggtgtaccctggttgatgtgcatcccgaagatcaagcagccggatcggtggatattcttcgccttacccttcagggtgagctgacgggtgatgagctggagcacatcgcccagaaggctggtcgtaagacttacgcaatggtatcatcgcactccgccgggcacagcctggcatcagaacttgtggaatcgcacgacggtcatgaggagatcattaaggtgtacctcaagggtcgctccggggataagatgatccatgaaaagaatatcaaccaactgaagtcagaagtgcagtacattcaggaagcaagaaactgtctgcaaaagttgagggaggacatatcgtcgaaactggaccgtaaccttggagattcgctgcataggcaagaaattcaagtggtgcttgaaaaacctaacggcttctcgcagagccctactgcgctgtacagctccccaccggaagtcgacacctgcattaacgaggacgtcgagagccttagaaagaccgtgcaggatcttctcgcaaaacttcaggaagccaagagacagcatcagtccgactgtgtcgcgtttgaagtgaccctgagccggtaccagagggaagcggaacagtcgaacgtggcactgcagcgtgaagaggaccgcgtcgagcaaaaggaggctgaagtgggcgaacttcaacggagactgctgggcatggaaacggagcaccaagcacttcttgcaaaagtgagagaaggagaggtggcattggaggaactgagatccaacaacgcagattgccaagccgagcgcgaaaaagcggcgactcttgaaaaggaggttgcaggcttgagggaaaagatccatcatctcgatgacatgctgaaatcccaacaacgcaaggtgagacaaatgatcgaacaactgcagaactccaaggcagtgattcagagcaaggatgcaaccattcaagaacttaaggagaaaatcgcatacctcgaagccgaaaaccttgaaatgcacgataggatggaacaccttattgagaagcagatttcccacggtaatttcagcactcaagccagagccaaaaccgaaaacccaggaagtattcgtatctccaagccaccatctccaaagcccatgcccgtgatccgggtcgtggaaacc

SEQ ID NO: 20437 - DNA, 1170 bp, Artificial Sequence
  Description of Artificial Sequence: Synthetic coding sequence
atgaatggaacaagaaattggtgtactttagtagatgtacatccagaagatcaagcagcaggtagtgtagatattcttagactaactcttcagggggaattaacaggagatgaattagaacatattgctcaaaaagcaggtagaaagacatatgctatggtctcaagtcatagtgctggacattctcttgcttccgaacttgttgagagtcatgatggtcatgaagaaataattaaagtttatttgaaaggaagatcaggagataaaatgattcatgaaaaaaatataaatcaattaaaatcagaggtccaatatattcaagaagcaaggaattgtttgcaaaaacttcgtgaagatattagtagtaaattagatcgtaatcttggagattctttacatcgtcaagaaattcaagttgtccttgaaaaaccaaatggattttctcaatcaccaactgcattatattcttcacctccagaggttgatacttgtattaatgaagatgttgaaagtcttagaaagactgtacaagatttattagctaaattgcaagaagctaaaagacaacatcaatctgattgtgttgcttttgaagtaacattatcacgttaccaaagagaagctgaacaatctaatgtagctttacaaagagaagaagatagagttgaacaaaaagaagcagaagttggagaacttcaaagaagattacttggaatggaaacagaacatcaagctctattagctaaagtacgagaaggtgaagttgctttagaagaattaagatcaaacaatgctgattgtcaagcagaaagagaaaaagcagcaactcttgaaaaagaagtggctggtcttagagaaaaaattcatcacttggatgatatgttaaagtcccaacaaagaaaagtaagacagatgattgaacaattacaaaatagtaaagctgttattcaatctaaggacgctactatccaagaattaaaagaaaaaattgcttacttagaagcagaaaaccttgaaatgcatgatagaatggaacatcttattgaaaaacaaatttctcatggaaattttagtacacaagcaagagcaaaaactgagaatcctggatcaatcagaatatcaaaaccaccttcaccaaagccaatgccagttattagagttgttgaaact

SEQ ID NO: 20438 - DNA, 1170 bp, Artificial Sequence
  Description of Artificial Sequence: Synthetic coding sequence
atgaacggaactcggaattggtgtactctcgtagatgtccatcccgaggatcaggccgctggatctgtggatatcttacggttaactctgcagggggagctaacaggggatgaactggagcatatagcacagaaagccggacggaaaacatacgctatggtctcgagtcacagtgccggacattcccttgcgtccgaactcgtggaatcacatgacgggcatgaggaaataattaaagtctacctcaaagggagatcaggagataaaatgatacacgaaaaaaacataaaccaactaaaaagtgaagtgcagtacatacaggaagccaggaactgcctgcagaaacttcgcgaagatatatcttccaaactcgataggaatctcggagattccctacatagacaggaaatacaggtagttttggaaaagccaaatggattctcacagtctcccactgctctctacagttcaccccctgaagttgatacatgcatcaacgaagacgtagaatccctccggaagacagtccaggatctattagcaaagttgcaagaagctaaaaggcagcatcagagtgattgtgtggcttttgaagtaacactgtctaggtatcagcgggaggccgaacaaagtaacgtcgccctacaacgtgaggaggatcgcgtcgaacagaaggaggccgaagtgggagagctccagagacggctgcttgggatggaaacagagcatcaggcactgctcgctaaagttcgcgaaggggaggtggctctagaggaactgaggtccaacaatgcagattgccaggccgaacgggagaaagctgcgacgctcgaaaaagaggtagccggacttagagaaaaaatacatcacctggatgatatgctcaaaagtcagcagcgcaaagtacgccagatgattgaacagctgcagaattctaaagccgtcatccagtctaaagacgctacaatccaggaactgaaagaaaagatagcctatctagaagccgaaaatctagaaatgcacgataggatggaacatcttatagaaaaacagatctctcatgggaatttttctacacaggcaagggccaaaacagagaatcccggatccatacgaatctctaaacccccaagtcctaaacctatgccggtgatcagagttgtggagaca

SEQ ID NO: 20439 - DNA, 1170 bp, Artificial Sequence
  Description of Artificial Sequence: Synthetic coding sequence
atgaatggcacccgcaattggtgtaccttggtggacgtgcaccccgaggatcaggccgctggctcggttgacatcctgagactgaccctgcagggcgaactgactggcgacgagctggagcacattgctcagaaagcgggccgcaagacctacgctatggtcagtagccacagcgccggccacagcttagccagcgaactagttgagagccacgatggccacgaagagattatcaaagtttatctgaagggtcgatctggtgataaaatgatccatgaaaagaacatcaaccagctgaaaagcgaggtccaatacatccaggaggctcgcaactgcctgcagaaactgcgcgaagatattagctctaagctcgacaggaacctgggggatagcctgcaccgtcaagagatccaagtcgtgttggagaaaccaaacggcttttctcagagcccgacagcgctgtatagctcaccgcctgaggttgacacttgcatcaatgaagacgtggagtccctgcgcaaaaccgtgcaggacctgctggccaagctgcaagaagctaagcgccagcaccagtccgattgtgtggccttcgaagtgaccttatctcgctaccagcgtgaggcggagcagagcaatgttgccctgcaacgcgaagaggaccgcgtcgaacaaaaggaagccgaggtgggtgaactccagcgtaggttgcttggcatggaaaccgagcaccaggccctgctggcaaaagtccgcgagggtgaggtcgcactggaggagttgcgttccaacaatgccgactgtcaggccgaaagagaaaaagcggcaaccctggaaaaggaggtggcaggtctacgcgaaaagatacatcacttggacgatatgctgaagtcacaacagcgtaaggtccgccagatgatcgaacaactccaaaatagcaaagctgttatacagagcaaggatgcaacaatacaggagctgaaggagaagatcgcatacctggaagctgagaacctggagatgcatgatcgcatggaacacctgatcgagaaacagattagccatggtaacttctctacccaagcccgcgccaaaactgaaaacccagggtctatcagaatctctaaaccgccgagcccaaagccaatgcctgtgattcgtgtggttgaaacc

SEQ ID NO: 20440 - DNA, 1170 bp, Artificial Sequence
  Description of Artificial Sequence: Synthetic coding sequence
atgaatgggacccggaactggtgcacactagtggatgtgcatcctgaagatcaggccgcgggctccgtcgatattctccggttgactcttcagggggaattgactggagacgaactcgagcacatagcccagaaagccggccgaaagacctatgcgatggtgtcctcccactcagctggccactccttggctagtgagctcgtggagtctcatgacggtcacgaggaaatcatcaaagtatatctgaaggggaggtccggcgataaaatgatccatgagaagaacataaatcaattaaagagtgaagtacagtatatccaggaagcccgaaactgcctccaaaagctgcgggaggatatcagcagcaaactagatcggaatctcggggatagtctgcatagacaggaaatccaagtggtgttagaaaagcctaatggattttcacagagccccacggcactttacagtagcccgcctgaagttgatacctgtattaatgaggacgtggagtccttgagaaagacggtccaggatcttctggccaaactgcaggaggccaagcggcagcaccagagcgattgcgtcgcatttgaggttacactcagtcgatatcagcgggaagccgagcagtcgaatgtagcgctgcagcgtgaggaggacagggttgaacagaaagaagcagaggtaggcgagttgcagcgacgtctgctgggaatggagacagaacatcaggcccttctggccaaggtgcgtgagggagaggtggcacttgaagaacttcgctccaacaatgcagattgtcaagcagagagagaaaaagccgctaccctcgagaaggaggtggccgggctgcgggaaaaaatccaccacctggatgacatgttgaaatcccagcaaagaaaagttagacagatgatagaacagctccagaactcgaaggcggtgatccaaagcaaagatgctacaatacaggaactcaaggagaaaatagcctacctggaagctgaaaacctggagatgcacgacaggatggagcatctgatcgagaagcagatatctcacggcaatttctcaacccaggcgagagctaaaactgagaaccctggttccattcggatctctaagccaccaagcccgaagccgatgcctgtgatcagggtagttgagaca

SEQ ID NO: 20441 - DNA, 1170 bp, Artificial Sequence
  Description of Artificial Sequence: Synthetic coding sequence
atgaatggaaccagaaattggtgcaccctggtggatgtacatccggaagatcaggcagctggtagcgtcgatatattaaggcttaccctccaaggtgagctgaccggggatgagctggagcacatcgcacagaaagcaggcagaaaaacttatgcaatggtaagcagccattctgcaggtcacagccttgctagcgaactggtcgaatcccacgacggccacgaagaaatcatcaaagtgtacttgaagggtcgttctggtgacaagatgatccatgaaaagaacatcaatcagctgaagtccgaggtacagtacatccaggaggcccgcaactgtctccagaagttgcgagaagatatttcatctaaattggatcgcaatctgggggattccttgcacagacaagagattcaagtcgtgttggaaaagccgaacggcttcagccagtcacccacagccttgtactcttcacctccggaagttgatacatgcatcaacgaggatgttgagtccctccgaaaaacggtccaagacttgttggcaaagttgcaagaggctaagaggcagcatcagtccgattgtgttgcatttgaggttacactgtccagatatcagagggaagctgagcagtccaatgtcgctttgcagagggaggaggatagggtcgaacagaaagaggcagaggtgggagaactccagagacgcctgctgggtatggagaccgaacatcaggccctactcgccaaagtacgggaaggcgaggttgccctcgaagagctgcgcagcaacaacgctgattgtcaggctgaaagagaaaaggcagcgacgctcgagaaggaggtggctggcctgcgggaaaagatccatcacctcgatgacatgctgaagtcacaacagcgcaaggtgcgtcagatgatcgagcagctgcagaatagcaaggcggtaatccagagtaaagacgcgaccattcaggaactgaaggaaaagatcgcctatcttgaagcagaaaacctggagatgcatgacagaatggagcacctgattgagaagcagatttcccacggcaacttttcgacccaggccagggccaagaccgagaatccgggctctataagaatttctaagcccccttcgcccaaacctatgccagtgatccgcgtggtagaaacc

SEQ ID NO: 20442 - DNA, 1170 bp, Artificial Sequence
  Description of Artificial Sequence: Synthetic coding sequence
atgaatggaaccagaaattggtgtacccttgtggacgtgcatccagaagatcaagccgcaggctcggtcgatatccttcgtttgacgctgcaaggtgaactcaccggagacgaactggaacatattgcacaaaaggctggaagaaaaacttacgcaatggtgtcctcacactcagccggtcatagcctggcatcagaacttgttgaatcccatgatggacatgaagagattatcaaagtctacctcaaaggaaggtcgggcgataagatgatacatgagaagaacattaaccaactgaagtccgaggtccagtatattcaggaggcacgaaactgccttcaaaagttgcgcgaagatatctcatccaaactcgatagaaatctgggagattcccttcatcgacaagaaatacaggtggtgctcgaaaagcctaacggattctcccaatcaccaactgcactgtacagctcaccacccgaggtcgatacgtgcattaacgaggatgtcgagtccctccgaaaaactgtgcaggatctgctcgcaaaactgcaagaagcgaagcggcaacatcaaagcgattgtgtggcatttgaggtcacccttagccgttaccaacgggaagcagaacaaagtaatgtggcgcttcaacgcgaagaagatcgagttgagcagaaagaagcagaagtgggcgaactgcagcgccggctgcttggaatggaaaccgaacatcaagctctgttggcgaaggtgcgagagggtgaagtcgcactcgaagaacttcggtccaacaacgcggattgccaagcggaaagagagaaggccgcgactcttgaaaaggaagtggccggacttcgggagaagatacatcacttggacgacatgcttaagtcgcagcagcgaaaggtgcggcagatgattgaacaactgcaaaacagcaaggcggtcattcagtccaaagatgccaccatccaagagttgaaagagaaaatcgcatacctcgaggcggagaaccttgaaatgcacgacaggatggaacaccttattgagaaacaaatcagccatggcaacttttcaactcaagcacgggcaaagactgagaaccctggttcgatcagaatctcaaagcccccaagccctaaacctatgccggtcattcgtgtggtggaaacc

SEQ ID NO: 20443 - DNA, 1170 bp, Artificial Sequence
  Description of Artificial Sequence: Synthetic coding sequence
atgaatgggaccaggaactggtgcacccttgtcgacgtccaccctgaagatcaggctgcgggctcggtcgacattctccggctcactctgcagggagaactgactggagacgagttggagcacatcgcgcagaaggccggccgaaaaacttacgccatggtgtcctctcacagcgcaggacattcactcgcttcggaactcgtggagtcccatgacggccatgaggaaatcattaaggtctacttgaagggacgcagcggggataagatgatccatgaaaagaatatcaatcagcttaagagcgaagtccaatacatccaagaagcaagaaactgcttgcagaagttgcgcgaggacatcagcagcaagctcgatagaaacctgggcgatagcttgcatcggcaagagatacaggttgtgctggagaagccgaacggattcagccagtcgcctacggccctgtacagctcaccgccggaagtcgacacctgcattaacgaggacgtagaatcactccgcaagaccgttcaagacttgctcgcaaaactccaggaagccaagagacagcaccagtcggattgtgtggccttcgaagtgaccctctcccgctaccagcgcgaagcggagcagtcaaacgtggccctgcagagagaagaagatcgcgttgagcagaaggaagccgaagtgggtgagttgcagaggcgcctcctggggatggaaacggagcaccaggcactgctggccaaagtgcgcgagggggaggtggctctggaagagcttcggtccaacaatgcagactgtcaagctgagagagaaaaggctgccaccttggagaaggaagtggctggattgcgggagaagatccaccacctggatgacatgctgaaatcacaacagagaaaggtgcgacagatgatcgagcagctgcaaaattcgaaggcggtcattcagtccaaggatgccactatacaggagcttaaggaaaagatcgcttatcttgaagccgaaaacctggagatgcatgatcgcatggagcacctcatcgagaaacaaatctcccatggaaactttagcacccaggcgcgagcgaaaactgagaatcctggctcaatcaggatctccaaacccccttcccctaaaccgatgccagtgatccgggtggtggaaact

SEQ ID NO: 20444 - DNA, 1170 bp, Artificial Sequence
  Description of Artificial Sequence: Synthetic coding sequence
atgaatggtacccgtaattggtgtacccttgtggacgtgcacccggaagatcaggccgcgggcagtgtagatatcctccgcctaactcttcagggagagctgacaggcgatgagctggagcacatagcccaaaaggcaggtaggaagacgtatgcgatggtgtcctcacactcagctggacactcgctcgcttcagaactggtcgagagtcatgacggccacgaggaaatcatcaaggtctatttgaagggacgatcaggcgacaaaatgattcacgagaaaaatataaatcagcttaagagcgaggtacagtacatccaggaggcaagaaattgtttgcagaagcttcgggaagacatctcctccaagctcgataggaacctgggcgacagtctgcaccgccaggaaattcaggtggtccttgaaaagcctaatggattctcacaaagtcccacagctctttattctagccctccggaagtggacacctgtattaacgaagacgtggagtccctcagaaagaccgtccaggacctgttagccaagctgcaagaggcaaagcgccagcatcaaagtgactgtgtggcattcgaggtgaccttatcaaggtaccagagagaggcggagcaaagcaatgtcgccctacagcgggaggaggaccgggtggaacagaaagaagctgaagtgggggagcttcagaggaggttgctgggtatggaaaccgaacatcaggcactactggcaaaggtacgggaaggtgaggtggcactggaagagctgcgatcaaataatgcggactgtcaagcagagagggaaaaggcggcgacactggagaaggaagtggcaggtcttcgcgagaaaatccatcacctcgatgatatgctgaagtcacagcagaggaaggtccggcaaatgattgagcagttgcagaactcaaaagcagtcatccaatcgaaggacgctaccatccaggagctgaaggagaaaattgcctatctggaagcagagaacctggagatgcatgacaggatggaacacctcatcgagaagcagatctcccacgggaacttctcaactcaggctagagctaagactgagaacccagggtctataaggatatctaaacctcccagtccaaaacccatgccagtgattcgggtggtcgagacg

SEQ ID NO: 20445 - DNA, 1170 bp, Artificial Sequence
  Description of Artificial Sequence: Synthetic coding sequence
atgaacgggacacgcaactggtgtaccctggtcgatgtgcacccagaagaccaagccgcaggcagcgtcgacatcttgcggctgacgctgcagggggagttgacgggtgacgagctcgagcacattgcgcagaaagccggtcggaaaacttacgcaatggtatccagtcactcggctggccacagcttggccagtgaacttgtcgaaagccatgatggccacgaggaaattataaaggtctatttaaaaggacggtcaggggataaaatgatacacgaaaagaacattaatcaactcaaatccgaggtgcagtacattcaggaagcccggaactgtctccagaaactacgggaggatatctcctcaaagctggatagaaatctgggggactccctgcatcgtcaggagattcaggtagtattggagaagcccaatgggttcagtcaaagtccaaccgcactatactcttcacctccagaagtagatacttgcatcaacgaagacgtagagtccctccgcaaaaccgtccaagaccttctggccaaacttcaggaagctaaaaggcagcatcagtccgactgtgtagcgttcgaggtaacactcagccgctatcagcgggaggcggagcagagcaacgtggcgctgcagcgggaggaagatcgagtggagcaaaaggaagccgaagtgggtgagctgcagagacgactactcggaatggagaccgaacatcaggccttgctggccaaggtgcgggagggcgaggtggcacttgaagaactgcgctccaataatgctgactgccaggctgagagagaaaaagcagcgaccctggaaaaagaagtggctggactacgcgagaagattcatcatctggacgacatgttaaagagtcagcagagaaaggtcagacagatgattgaacagcttcagaacagcaaggccgttatccagtccaaggatgccacaatacaagaattaaaagagaaaattgcgtatctcgaagcagagaatctcgagatgcacgaccggatggaacatctgatcgaaaagcagatttctcatgggaacttctcaacgcaggctcgcgccaaaactgagaacccgggcagcatcaggattagtaagccgccctcccccaagcccatgcctgtcattagggttgttgagacc

SEQ ID NO: 20446 - DNA, 1179 bp, Artificial Sequence
  Description of Artificial Sequence: Synthetic coding sequence
atggaagagccccaaagtgatcccagcgtggagccgcccctgtcgcaggaaacattttctgacctgtggaaactcctacctgagaacaacgtgctcagtcccctgcccagtcaagctatggacgatttaatgctgtcacccgacgacatagagcaatggttcacggaagatccgggacctgatgaagctcctcggatgccagaagcagctccaccagtcgcccctgctcccgccgcccctacccccgccgccccagcacccgccccctcatggcctctcagctcaagcgttccttctcagaaaacctaccagggcagctacggctttaggctcggctttctccatagcggcactgctaaaagcgttacgtgtacctacagtccggcactaaacaagatgttctgccagctcgccaagacctgtcccgtccaactgtgggtggattccacacctcctcctgggacacgagtgcgagctatggcgatctacaagcagtcccaacatatgacagaagtggtgcgtcgctgtcctcaccacgaacgatgctccgatagcgacggcttagcgcccccacaacacctcatcagggtagagggaaatctgagagtcgagtatttagacgataggaatacatttcggcatagcgtagttgttccatacgaacctcccgaggtgggtagcgactgtacgactatccactataactatatgtgcaactctagttgtatgggcggaatgaatagacgacctattctaacgatcataacacttgaggattcctctggtaacctcctgggtagaaactcctttgaggtcagggtgtgtgcatgtccgggacgggataggaggacagaagaggagaatctgcgcaagaagggtgagccacatcacgagctacctcctggatcaaccaagcgcgctctgccgaacaatacttcttccagcccgcagcccaaaaaaaagccccttgatggcgaatactttaccctccagataagaggaagagagaggtttgaaatgtttagagagctgaacgaggccctcgaactcaaggacgctcaggctggcaaagagccgggcggctctagagcccactccagccacctcaaaagcaagaagggacagtcaacatcccgccacaaaaaacttatgtttaaaacggaggggcccgattctgat

SEQ ID NO: 20447 - DNA, 1179 bp, Artificial Sequence
  Description of Artificial Sequence: Synthetic coding sequence
atggaagaaccgcaatcggatccgtcggtagaaccgccgttatcgcaagaaacgttttcggatttatggaaattattaccggaaaataatgttctatcgccgctaccgtcgcaagcgatggatgatttaatgttatcgccggatgatatagaacaatggtttacggaagatccgggtccggatgaagcgccgcgaatgccggaagcggcgccgccggtagcgccggcgccggcggcgccgacgccggcggcgccggcgccggcgccgtcgtggccgttatcgtcgtcggtaccgtcgcaaaaaacgtatcaaggttcgtatggttttcgactaggttttctacattcgggtacggcgaaatcggtaacgtgtacgtattcgccggcgttaaataaaatgttttgtcaattagcgaaaacgtgtccggtacaactatgggtagattcgacgccgccgccgggtacgcgtgtacgtgcgatggcgatatataaacaatcgcaacatatgacggaagttgttcgtcgttgtccgcatcatgaacgatgttcggattcggatggtctagcgccgccgcaacatttaatacgtgttgaaggtaatttacgtgtagaatatctagatgatcgtaatacgtttcgtcattcggtagtagtaccgtatgaaccgccggaagttggttcggattgtacgacgatacattataattatatgtgtaattcgtcgtgtatgggtggtatgaatcgtcgtccgatattaacgataataacgttagaagattcgtcgggtaatctactaggtcgtaattcgtttgaagttcgtgtatgtgcgtgtccgggtcgagatcgacgaacggaagaagaaaatctacgtaaaaaaggtgaaccgcatcatgaattaccgccgggttcgacgaaacgtgcgctaccgaataatacgtcgtcgtcgccgcaaccgaaaaaaaaaccgctagatggtgaatattttacgctacaaatacgaggtcgtgaacgttttgaaatgtttcgagaactaaatgaagcgttagaattaaaagatgcgcaagcgggtaaagaaccgggtggttcgcgtgcgcattcgtcgcatttaaaatcgaaaaaaggtcaatcgacgtcgcgacataaaaaactaatgtttaaaacggaaggtccggattcggat

SEQ ID NO: 20448 - DNA, 1179 bp, Artificial Sequence
  Description of Artificial Sequence: Synthetic coding sequence
atggaggagccacaatccgatccaagtgtggagcctcctctgagccaggagaccttcagtgacctctggaagctgctccccgaaaataacgttctgagccctctgcctagccaggccatggacgatctcatgctaagccctgacgacatcgagcagtggtttactgaggacccgggacctgatgaggccccacggatgccggaggctgcgccgccagtagcgcccgcacctgccgctcccacaccagccgcccccgcccccgctccttcttggcccctcagcagctccgtgccgagccagaagacgtaccagggcagttatggcttcagacttgggttcctgcatagcgggaccgcaaagagcgttacctgcacatattccccagccctaaacaaaatgttctgccagcttgcgaagacctgccccgtgcaactgtgggttgatagcactccgccgcctggaacccgcgttagagccatggccatctacaaacagagccagcacatgaccgaggtcgtgcgcaggtgtccccatcacgaaagatgctccgacagtgacggcctcgcccccccacagcatctgattcgggtcgaaggaaatctgcgcgtcgaatatctcgatgacagaaatacttttagacattctgttgtagtgccttacgagccccccgaagtaggctcagactgcaccacgattcattataactacatgtgcaactcatcgtgtatgggtggaatgaacagaaggccgatcctgaccattatcaccctggaggatagttccgggaacttgttagggcgaaatagctttgaggtcagggtctgtgcatgtcctgggagggaccgtcgtacagaggaggagaatctcagaaaaaaaggtgagcctcaccatgagctgccgccaggcagcactaaacgggcacttccaaacaatacatcctccagcccgcagcccaaaaaaaagcctctggatggcgaatactttaccctgcagataagaggaagggagcgattcgagatgtttcgcgagctcaacgaagctctggagctgaaagacgctcaggccggaaaggagccggggggttcccgggcacacagttctcatctgaaatccaaaaaggggcagtctacctcccggcacaagaaattgatgttcaaaaccgagggtccggattcagat

SEQ ID NO: 20449 - DNA, 1179 bp, Artificial Sequence
  Description of Artificial Sequence: Synthetic coding sequence
atggaagaaccccaaagtgaccctagtgtggagcctcccctctcacaggagaccttctcagatctgtggaaactgttgccagagaacaatgtgctgagccctctaccaagccaggccatggatgatttgatgttgtccccagacgacatcgagcaatggtttaccgaggatcccgggccagacgaggcgcctcgcatgcctgaagccgcaccccccgtggccccggctccagcagcgcccacccctgctgccccagctcctgccccttcatggccactctctagcagcgttccctcccagaagacatatcagggctcttatggctttcgactcggctttctgcacagcggcaccgctaagtctgtgacctgcacatacagccctgccttaaacaagatgttctgccagctggctaaaacgtgccccgtccagctgtgggttgactccacaccgcctcctggaactcgggttcgagcaatggccatctataaacagtcccagcacatgactgaggtggtgcggcgctgtcctcaccatgagcggtgtagtgactcagacggactggcgccaccgcaacatctcattcgagttgagggaaacctcagggttgagtacctggatgatagaaacaccttccgccattccgtggttgttccatacgagccccctgaagttggatcggactgcacgactatccattacaactacatgtgcaactcctcgtgtatgggtgggatgaatcggaggcccatcctaaccattataaccctcgaggactcatcaggtaatctcctgggtagaaactcctttgaggtccgggtctgcgcctgccctggaagagaccgacgcacagaggaggagaacctgcgcaaaaaaggagagcctcaccacgagctgcccccgggctccaccaaacgagcacttcccaataacacgtcctcatccccccagcccaagaagaaaccactagacggggaatactttacgctccagattagaggacgggaacgctttgagatgttccgcgagctcaacgaggccttagaactgaaggatgcacaggcaggcaaagagcctggaggctccagggctcattcatcacacctgaaatcaaagaaggggcagagtaccagccggcataagaagctgatgttcaagaccgagggtcctgactctgac

SEQ ID NO: 20450 - DNA, 1179 bp, Artificial Sequence
  Description of Artificial Sequence: Synthetic coding sequence
atggaggagccgcagtcagacccaagcgtggaaccgccgctgtcgcaggaaaccttctcggatctgtggaaactgctcccagaaaacaatgtgttgtcaccgctgccctcacaagcaatggacgacttgatgctgtcccctgacgacatcgaacagtggtttactgaagatcctggtcctgatgaggcaccaagaatgcctgaggccgctcccccagtcgcgcccgcccctgcagcgccgactccggccgcgccagccccggccccatcttggccacttagctcctccgtgccgtcgcaaaaaacctaccagggatcatacggtttcaggctcggctttctgcattcgggaacggccaaaagcgtgacctgcacttacagcccggcgctgaacaaaatgttttgtcaacttgcgaaaacttgcccggttcagttgtgggtggactccacccctcctccgggcactagagtgagagcaatggccatctataagcagtcgcagcacatgactgaggtcgtgcggcggtgcccacatcacgaaaggtgctcggactcggacgggctcgccccgccgcagcacctgatccgcgtggaaggcaaccttagggtcgagtacctcgatgatagaaataccttccggcattccgtcgtggtcccgtacgagcctcccgaagtcggatcggattgtaccaccatccattacaactatatgtgtaatagcagctgcatgggtggcatgaaccgccgcccgattctgaccatcatcaccttggaggattcatcaggaaatcttctgggcagaaactccttcgaagtcagagtgtgcgcttgccctggacgggacagacgtactgaagaggaaaatctgcgcaagaaaggggagccacatcacgagctgccgccggggtcaacgaaacgcgcacttccgaacaacacttcttcaagcccccagcccaagaagaaaccgcttgacggcgagtacttcactctgcaaattagagggcgcgagaggttcgaaatgttccgggagctgaacgaagcactggagctgaaggatgcgcaggccggaaaagaaccgggcggtagccgcgctcattcatctcacctgaagtcgaagaaggggcaatcgacttcgaggcacaagaagctgatgttcaagacggagggcccggattccgac

SEQ ID NO: 20451 - DNA, 1179 bp, Artificial Sequence
  Description of Artificial Sequence: Synthetic coding sequence
atggaagagccccagtcggatccttcggtcgaaccccctctctcgcaagaaactttcagcgatctctggaaacttcttcctgaaaacaatgtgctgagcccactcccaagccaggctatggatgatcttatgctttcgcccgacgacatcgaacaatggttcacggaagatcctgggcctgatgaggcacccaggatgcctgaggccgcacctccagtcgcaccagcaccagcagcgcctacgcccgctgcaccagcccctgctccttcctggccactgtcaagctccgtgcccagccaaaaaacttatcagggttcctacggattcagactgggttttctgcattcgggaaccgcgaagtctgtcacttgcacctacagccccgccctcaacaagatgttttgtcagctggcaaagacctgcccagtgcaactctgggtggattccaccccaccacctggaaccagggtcagagcaatggcaatttacaagcagagccaacatatgaccgaagtggtgagaagatgcccacatcacgaacggtgttcagactcagatgggctggccccacctcaacacctgattcgcgtcgaaggcaatttgagggtggaataccttgacgacagaaacaccttccgtcattcggtggtcgtcccttacgagcctcctgaggtgggtagcgactgtacgaccattcactacaactacatgtgtaattcctcttgtatgggtggaatgaatagacggccaatccttactatcattacgcttgaagattcgtcaggtaaccttctcggtagaaattcgtttgaagtgagagtgtgtgcctgcccaggtagagataggcgcactgaagaggaaaatcttaggaagaagggtgaaccgcatcatgaattgccacctgggtccactaagagagcactgcctaacaacactagctcctcaccacaacctaagaaaaagcccttggacggtgaatactttaccctccagattcgaggaagggaaagatttgaaatgttccgggaattgaacgaagccctcgaactcaaagacgcccaagcaggtaaagaaccagggggatcaagagcgcatagctcgcatctgaaatcgaagaaggggcagtcgaccagccggcacaagaagctgatgtttaagacggagggtccagattcagat

SEQ ID NO: 20452 - DNA, 1179 bp, Artificial Sequence
  Description of Artificial Sequence: Synthetic coding sequence
atggaagaaccacaatccgatccttccgtggagccacccctgtcacaggagacgttctcagatctctggaaacttctcccggagaataatgtcctcagcccactgcctagccaggccatggacgatttgatgctttcccccgatgatattgagcaatggttcactgaagatcctgggccggatgaagcgcctcgcatgccagaagccgcgccaccagtggcacctgcaccagcagcaccaactcccgcggcaccagcgccagccccctcgtggcccctttcttcgtcggtcccatcgcaaaagacctaccagggttcgtacggcttcaggctgggtttcctgcattccggtaccgctaaatcggtgacctgtacgtactcacccgctcttaacaagatgttttgtcagcttgcaaagacttgtccggtgcaactttgggtggattccacccctccaccgggcactagggtgcgcgccatggcgatttacaaacaaagtcagcacatgactgaggtggtccggcgctgtccccatcacgagagatgctcggactccgacggacttgcgcctccacagcatctgatccgggttgagggcaacttgcgggtcgaataccttgacgacagaaacaccttccggcattccgtggtcgtcccctacgagcctcccgaggtaggatccgattgtactaccattcattacaactacatgtgcaactcgagctgtatgggagggatgaatcggcggccgatactgactattatcaccctcgaggattcgagcgggaacctccttggtcgtaattcctttgaggtgagagtgtgcgcatgtcccggacgtgatcgccgtaccgaagaagaaaacctgagaaaaaagggagaacctcatcatgaattgcctcctgggagcaccaagagagccctgccaaataacacttcctcatccccgcagcctaaaaagaagccacttgatggtgaatacttcacgcttcaaattagagggcgcgaaagatttgaaatgttcagggaacttaacgaggcattggaactgaaggatgcacaagccggtaaggaacccggtggaagtcgggcgcacagctcacatctgaagagcaagaagggacaatctacctcacgccacaagaaacttatgttcaaaacggaaggtcccgactcggat

SEQ ID NO: 20453 - DNA, 1179 bp, Artificial Sequence
  Description of Artificial Sequence: Synthetic coding sequence
atggaggaacctcagtccgatccatccgtcgaaccccccctttcacaagagacgttctccgacctttggaagttattacccgaaaataacgtactgtcccctttaccatcacaagctatggacgacctgatgctcagtcctgacgatattgaacagtggttcacagaagaccccgggccagacgaggcccctcgaatgccagaggcagcccctccggttgcccctgctcctgctgccccaaccccggccgccccggcccctgccccttcctggccgctttctagcagcgtgcctagccagaaaacttaccagggaagctatggctttcgactaggtttcctccactctggaacagctaagagtgtcacttgtacgtatagcccagctttgaacaagatgttctgtcagctagcaaaaacatgccccgttcagctgtgggttgactccacccccccgcctgggacccgcgtgcgggccatggcaatttacaaacagtcccagcacatgacagaagtcgtaagacgatgtccacatcacgaacgctgctctgacagtgacggccttgctccaccccagcacttgatccgggtggagggcaacttgcgtgttgagtacctagatgacagaaacacgttcagacacagcgttgtcgtgccctacgaaccccctgaggtagggtccgattgcacaactattcactacaattatatgtgtaatagttcttgcatgggcggaatgaataggcgtcctatcttaacaatcattaccctggaggattcgtcaggcaatcttcttggccggaattcattcgaggttcgggtctgtgcatgtccgggcagggacaggcggacagaagaagaaaatctgagaaagaagggtgagccccaccacgagctgccacctgggagcaccaagagggcactccccaacaatactagctcctctccacaacctaagaagaaacctctggatggcgaatattttactctgcaaatcagggggagggagagattcgaaatgtttcgcgaattgaatgaggcgctggaacttaaagacgcccaggccggtaaggaaccagggggaagccgggctcacagctctcacctgaaaagtaagaaaggacaatcaaccagcaggcacaaaaaactcatgttcaaaactgaggggccggacagcgat

SEQ ID NO: 20454 - DNA, 1179 bp, Artificial Sequence
  Description of Artificial Sequence: Synthetic coding sequence
atggaggagccgcagtccgaccccagcgtcgagcctcctttgtcgcaggaaacctttagcgatctgtggaaactcctgccggagaacaatgtgttgtccccattgccatcccaggcaatggatgacctgatgctctcgccggacgacattgaacaatggttcactgaagatcctgggcctgatgaggcgccacgcatgccggaagccgccccgccggtcgcgccagcgcctgccgcgccgactccggccgccccagcacctgccccgtcctggccactcagcagctcggtgccgtcgcaaaaaacctaccagggatcatacgggtttcggcttggcttcttgcattccggaaccgcgaagtcagtcacgtgcacttacagcccggcactgaacaaaatgttctgccagctggctaagacttgccccgttcaactgtgggtggattccactccgccgccaggcactagagtgcgcgccatggctatctacaaacaatcccaacacatgactgaggtggttagacgctgcccacatcatgaaagatgcagcgactccgatggactcgccccgccacagcatctgatccgcgtggagggaaacctgagagtggaatatctggacgaccggaataccttccgccactcagtggtggtgccatacgaaccgccagaggtcggatcggactgtaccactattcactacaactacatgtgcaacagctcctgcatgggcggaatgaaccgcaggccaattctcaccattatcactctggaggactccagcggtaacctgctgggacgcaactcgttcgaggtccgcgtttgcgcatgccccggacgcgatcggagaaccgaagaggagaatctgcgcaagaaaggagaaccacatcacgagctgccaccgggatccaccaagagagcccttccaaacaacacttcctcgtcgcctcaaccaaagaagaaaccactggacggcgaatactttaccctccaaatcagggggcgggaaaggtttgaaatgttccgcgaactgaatgaggcactggaactcaaggatgcgcaagctggtaaggagcctggaggatcccgcgcacattcgtcccacctcaagtccaaaaagggacaatcaaccagcagacataagaagctcatgtttaagacggagggcccggattctgac

SEQ ID NO: 20455 - DNA, 1179 bp, Artificial Sequence
  Description of Artificial Sequence: Synthetic coding sequence
atggaagagcctcaaagcgatccttccgtcgaacctccactgtcacaggaaaccttcagcgatctctggaaactgcttccagaaaacaatgtgctttccccactcccttcacaggcaatggatgaccttatgctgtcacctgacgatatcgagcaatggttcactgaggaccctggacctgatgaagcaccaaggatgcctgaggcagccccaccagtggcaccggcaccggcggcacctaccccggccgccccagcacctgcaccttcgtggccgctttcatcctctgtgccatcccaaaaaacctaccaggggtcgtacggatttagactgggcttcctgcattcgggcaccgccaagtcagttacttgtacgtactcccccgcactgaataagatgttctgtcaattggccaagacttgccctgtccaactctgggtggactcgactcctccccctggaacgagagtgcgagccatggcaatctacaagcagtcacaacacatgaccgaagtggttcgccgctgtcctcatcatgaaaggtgctccgatagtgatggtctggcacccccgcaacatctgatccgcgtcgaaggaaacctgagagttgagtacctcgatgatagaaacactttcagacactcggtggtcgtcccttacgaaccaccagaagtcggatcggactgtactacgattcattacaactacatgtgtaacagctcgtgtatgggaggtatgaatagaaggcccattcttaccataatcaccttggaggactcatcgggaaacctgctcgggcgtaactcgtttgaggtgcgcgtgtgcgcatgtcctggacgtgatcgcagaaccgaggaggaaaatcttagaaagaagggtgagccacatcatgaattgccaccagggagcactaagcgagcacttccaaacaatacctccagctctccgcagccaaagaagaagcctctggatggagagtacttcactttgcagattagaggaagagagcgattcgaaatgtttagggagcttaacgaagcactggaactgaaggatgcgcaagcaggcaaagaaccaggaggttctcgcgcccattcgagccacttgaaatccaagaagggccaatcgacttccaggcacaaaaagctcatgtttaagaccgaggggccagactcggat

SEQ ID NO: 20456 - DNA, 1179 bp, Artificial Sequence
  Description of Artificial Sequence: Synthetic coding sequence
atggaagagccgcagtccgacccgagcgtcgaaccaccactctcgcaggaaaccttctcggacttgtggaagctcctcccagaaaacaacgtcctctccccactcccttcccaggcaatggacgacctgatgttgtccccagatgatattgagcagtggttcaccgaagatccaggcccagacgaggcgccgaggatgcctgaggcagccccaccagtggccccagcgccagccgcacctactcctgccgcccccgctcctgccccgtcatggccgctgtcctcctcagtgccgagccaaaagacgtaccaaggctcatacgggttccgcctcggattcctccatagcggaacggccaagtcggtgacttgtacctactcaccggctctgaataagatgttttgccagctcgcgaaaacttgcccggtgcagctgtgggtcgacagcacccctcctccaggcactagagtgcgcgccatggccatttacaagcagtcccagcatatgactgaagtggtgcgcaggtgcccacaccatgaacggtgtagcgattcagatggactggccccacctcaacacctcatccgcgtggaaggtaatttgcgcgtggagtacctggatgaccggaacaccttccggcactcggtggtggtgccgtacgaaccaccagaagttggatccgactgcactaccatccattacaactacatgtgcaattcgtcgtgcatgggagggatgaaccggaggccgatcctcactatcatcaccctggaggactcctcgggtaacctgctcggccggaactcgttcgaggtgcgcgtgtgcgcttgtccgggaagggaccggcgcacggaggaggagaacctgcggaagaaaggagaaccacatcacgagctgcccccggggagcaccaagagagctctgccgaacaatacgtcctcgtcgccacagcctaagaagaagccgctggacggagagtacttcactcttcaaatccgcggaagggagcgcttcgagatgttcagagagctcaacgaggccctggagctgaaggacgcacaggctggtaaagagccgggcggaagccgggcacactcatcacaccttaagtccaagaagggccagtcaacttccagacacaaaaagttgatgttcaagaccgaaggcccggattctgac

SEQ ID NO: 20457 - DNA, 1179 bp, Artificial Sequence
  Description of Artificial Sequence: Synthetic coding sequence
atggaggaaccacaaagtgacccctccgtagagccccccctgagtcaagagacgttctccgacctgtggaaactgctgcccgagaataacgtgcttagtccgcttccaagccaggccatggatgatctgatgttaagccccgacgacatcgaacagtggttcaccgaggatccggggccggatgaagcacctcgaatgccagaagctgccccaccagtcgctcccgctccagctgcacccactcctgctgctccagcccccgctcctagctggccactgtcctcatccgtgccgtcccaaaaaacgtaccaggggtcgtacgggttcaggctgggctttctgcactccggcacagcgaagtccgtcacttgtacttacagtcctgccctgaataagatgttctgtcagctggcaaaaacttgtcccgtccagctgtgggtagatagcaccccaccaccgggcacaagagtgagggccatggcaatctacaaacagagccagcacatgaccgaagtggttcgccggtgcccacaccatgagcggtgcagcgactccgatggcctagcacctcctcaacacttgatccgcgtggaaggcaacttaagggttgaatacctggacgataggaacactttccgacatagcgttgttgtgccctatgagccgccagaggtaggcagcgactgcactacgattcattacaactacatgtgcaactcttcctgtatgggcggtatgaaccggcgcccgattctcaccatcatcaccttggaggactcatccgggaatctgcttgggcgaaattccttcgaagtcagggtgtgtgcctgtcccggacgcgatcgccgaacagaggaggaaaacctcaggaagaagggcgaacctcatcacgagctccctcctgggtccacaaaaagagccctgcccaataataccagcagctctccgcagcctaagaagaaacctctcgacggcgaatatttcactctgcagattaggggccgagagcggttcgaaatgttccgcgagctcaacgaggccctcgagctgaaagacgcccaagcaggcaaagagcccggcgggtctagggctcattccagccatctcaagtcaaagaagggtcagtccacgtctaggcataagaaactgatgtttaagaccgaagggcccgactcggac

SEQ ID NO: 20458 - DNA, 1179 bp, Artificial Sequence
  Description of Artificial Sequence: Synthetic coding sequence
atggaagaaccccagtctgaccctagcgtggagcctcctctctcccaggagacattttcggacctgtggaaattattacctgaaaacaacgtgctgagcccactcccatctcaggctatggatgatctgatgctaagtccggacgacattgaacaatggttcaccgaggaccccggtcctgacgaagccccacgtatgcctgaggccgctccgccagttgccccagccccagccgccccaacgcccgctgctccggctccagccccttcatggccattgagctcctctgtcccgtcgcaaaagacatatcaaggatcttacggctttcggttaggttttctgcactccggaacagcaaagtcagttacctgcacctattctcccgctttaaacaagatgttttgccagcttgctaagacatgccctgtgcaactgtgggttgatagtactcctcccccaggcacgcgggtgcgggccatggccatctacaaacagagccagcatatgactgaggtagttagaaggtgcccacaccatgagaggtgtagcgactctgatggactggcgcctccccagcacctcataagagtggagggtaaccttcgggtggagtacctggacgataggaatacatttagacacagcgtggtggtcccgtatgaaccaccggaggttgggtctgattgcaccacaattcattataattatatgtgcaactccagctgtatgggagggatgaacagacggccaatactgaccatcatcacactggaggacagcagtggaaatctgctcgggagaaacagcttcgaggttagggtctgcgcttgccctggcagggacagacggacagaggaagaaaacctgcgcaaaaaaggggagccccatcatgaattacccccaggctcgaccaaaagggctctgccaaataatacatccagcagtccacaaccaaagaagaaacctttggatggcgagtatttcacacttcagatcaggggccgtgagagattcgagatgttccgtgagctgaacgaggctctcgagctgaaagacgcccaggcaggtaaagaaccagggggttcgagagcacattcttcccacctgaagagcaaaaaaggccagtcgacatcccgacacaagaagctgatgtttaaaaccgagggcccagattctgac

SEQ ID NO: 20459 - DNA, 1179 bp, Artificial Sequence
  Description of Artificial Sequence: Synthetic coding sequence
atggaagaaccacaaagtgaccctagtgttgaacctccgctgagccaggaaacattttctgacctgtggaaattattacctgaaaataatgtgttatcaccgttaccatcacaggcgatggacgacctaatgctctctccggacgacatcgagcaatggtttaccgaagatcctggtccggacgaggctccgcgcatgccggaagccgcgccccctgtagctccggcgcctgcagcgcccacacctgctgctcccgcccctgcgcctagctggcctttatcatcctcagtcccgtcacaaaaaacgtaccaaggtagctatggatttcgcttaggatttctccactcagggacggccaagtctgtaacctgcacgtactccccggccctgaacaagatgttctgtcaactggctaagacatgcccggttcagctgtgggtagattcgactcccccgcctggaacaagggtgagagccatggcgatctacaaacagtcccaacatatgacagaagtagtgcgacgctgtccccaccacgagagatgctccgacagtgatgggctcgctccaccgcaacacttgattcgggtggagggtaaccttagagtagaatacctagatgatcgtaatacctttaggcattccgtcgttgttccttatgaaccaccggaagtgggttctgattgtactacgatacattataattatatgtgtaattcgtcttgcatgggggggatgaatcgtagaccgatccttacaattattacattggaagatagctcaggaaacctgttgggccgcaactcattcgaagttcgggtgtgtgcctgtcctggaagggatcgacggacagaagaagaaaatttgagaaagaaaggggaaccacatcatgaattgccgcctggctctacgaaacgagcactgcctaataacacgagcagttccccccagccaaagaagaaacctctagatggtgagtactttacactgcagattcgaggccgagaaagatttgaaatgtttcgagagctgaacgaagcattggaacttaaagacgcacaagccgggaaggaaccgggcggtagtcgtgcccacagctcacacctgaagtccaaaaaaggccaatccactagccgccataaaaaactgatgttcaaaacagagggcccggactcagat

SEQ ID NO: 20460 - DNA, 1179 bp, Artificial Sequence
  Description of Artificial Sequence: Synthetic coding sequence
atggaggaacctcagtctgacccatccgtggagccccccctcagccaagaaaccttctctgacctttggaaactgctgccagaaaacaacgtcctgtcccctctccccagtcaggccatggacgacctcatgctgagtccagacgacatcgagcaatggttcactgaagatccaggacctgatgaggctcctaggatgcccgaggcagccccccccgttgctcccgctcctgcagctccaacaccagccgctccagcacccgccccttcttggcccctttcaagcagcgtgccttcacaaaaaacctatcagggttcctacggattccgcttgggcttcctccactcaggaaccgcaaagtccgtaacctgtacatactcacccgctctgaataaaatgttctgccagttggcaaaaacctgtccagtacagctgtgggtggattcaacaccacctcctggtacaagggttcgtgcaatggcaatctacaagcagagccagcacatgacagaagtggtaaggaggtgcccccaccacgagcgctgcagtgactcagatggtctcgcccctccccagcacctgatccgtgtcgagggcaacctgagagttgaatacctggacgatcgcaacactttcaggcactctgtggtcgtgccttacgagcctcccgaggtgggaagtgactgcaccacaatccactacaactacatgtgcaactcctcctgcatgggtggtatgaatagaagaccaatcctgacaatcattactctggaggacagctccggaaacctgcttggaaggaacagtttcgaagtccgtgtctgcgcctgccctggtcgcgacagaagaaccgaagaagagaacctgaggaagaaaggagaaccccatcatgagttgccacccggttccacaaaaagagccctccctaacaacacctcttcctcaccccagcctaaaaagaagccacttgatggcgagtacttcactcttcagatcaggggccgcgaaaggttcgaaatgttcagagaacttaatgaagcccttgaactgaaggacgcccaggccggtaaggaacctggcggctccagagcacactcaagtcacttgaagtctaagaaaggacaaagtacttcacgtcataagaagctcatgttcaagaccgaaggacccgatagcgac

SEQ ID NO: 20461 - DNA, 1179 bp, Artificial Sequence
  Description of Artificial Sequence: Synthetic coding sequence
atggaggagccacaatccgacccgtccgtggaacctccgctctcgcaagaaaccttttccgatctgtggaagctccttcccgagaacaacgtcctgagcccacttccatcgcaggcaatggacgatctgatgctttcgcctgatgacatcgagcagtggtttacggaagatcctggaccggacgaagcgcccagaatgcccgaagcagccccacctgtggcccctgcgccggccgcgcctacccctgcagcccctgcaccggcacccagctggccactgtcgtcgtccgtgccgtcgcaaaaaacctaccaggggtcgtacgggtttagactgggttttctccatagcggaactgctaagagcgtcacttgtacttactccccagcgcttaacaagatgttttgtcaactggccaagacttgcccggtccaactctgggtggattccactccgcctccaggaacccgcgtgcgtgcaatggctatttacaaacagtctcaacacatgactgaggtggtgcgtagatgtccacatcatgagcgttgttcagattccgatggcctcgcaccaccccaacatcttattcgggtggaaggcaatctccgggttgaatacctcgacgatcgcaacactttcagacattcggtggtcgtgccttacgagccaccagaggtcggtagcgattgtactaccatccactacaactacatgtgtaactccagctgtatgggaggaatgaaccgcagacctatcctgaccattatcaccctggaggactcatcgggaaatttgctgggtaggaattcgtttgaggtcagggtgtgtgcatgccccggaagagatagacgaaccgaagaggaaaatctcaggaaaaaaggagaaccgcaccatgaacttccacctggatcaacgaagcgcgctttgcctaataacacttccagcagcccccaaccgaagaaaaagcccctggatggagagtactttacgctgcagattagggggcgcgagagatttgaaatgttcagggagcttaacgaggccctcgagctgaaggacgctcaagccggaaaggaacccggtggatcaagagcacatagctcgcatctgaagtcgaagaaaggacaaagcaccagccgacacaaaaagctgatgttcaaaacggaaggcccagactcagat

SEQ ID NO: 20462 - DNA, 1179 bp, Artificial Sequence
  Description of Artificial Sequence: Synthetic coding sequence
atggaggaaccacaatcagacccctcagtggagcccccccttagccaggagaccttctctgacctgtggaaactgctcccagaaaacaacgtgctgtctcccttgccaagtcaggccatggacgatcttatgctttctcctgatgacatcgaacaatggttcacggaggaccccggaccagatgaggcgccccggatgcccgaagctgcaccgcctgtggcacctgcacccgcagcgcctacaccagcagcccctgccccagcaccgagctggccattatccagctcagtccctagccagaagacataccagggttcttatggattccgtctcggcttccttcacagtgggactgcgaagtccgtgacttgcacctatagtccggccctgaataagatgttctgccaactggcgaaaacttgccccgtgcagttgtgggttgactctactccgcccccaggaacacgggtaagggctatggccatatacaaacagagtcagcacatgactgaggttgtccgccgctgcccccaccacgaacgatgttccgattctgacgggctggctcctccacagcacttgattcgtgtggagggcaatctgagggtggaatacctcgatgacaggaacaccttcaggcactctgttgtcgtaccgtatgaaccacccgaagtggggtctgactgtacaacaattcattacaattacatgtgtaattcaagctgcatgggagggatgaataggcggccaattcttaccatcattacgttggaggacagcagcggcaacctgctggggcggaactcgtttgaggtgagggtgtgcgcgtgccccggccgcgataggagaactgaagaagagaatttgcgaaagaagggggagccccatcacgaactgccccccgggtcgactaagagagcattacccaacaatacgagttcatctccacagccaaaaaagaagcccctcgatggcgagtactttacactgcagatccggggtagggagaggtttgagatgtttcgggagctcaatgaagctttggagctgaaagacgcacaggcagggaaagaacccggcggatcacgtgcccatagctcccatctgaaatccaaaaaggggcagtctacaagccgccacaaaaagctcatgttcaagacggaaggccctgattccgac

SEQ ID NO: 20463 - DNA, 1179 bp, Artificial Sequence
  Description of Artificial Sequence: Synthetic coding sequence
atggaagaaccacaaagcgatccttccgtggaaccccctctctcgcaagaaaccttttctgacctctggaagctccttccggaaaacaacgttttgtcaccgctgccttctcaagctatggacgatctgatgctgtcaccagatgacatcgagcagtggttcaccgaggacccaggaccagacgaggccccccggatgcctgaagcagcacccccagtggcccctgcaccagcagcaccgacccccgcagcaccggcccccgccccatcctggcctctgagctcgtccgttccatcccaaaagacctaccagggcagctacggcttccgcctcggcttcttgcattcagggaccgccaagagcgtgacctgcacctactcccccgcactcaataagatgttctgtcaactggctaagacctgtccggtccagctgtgggtggattcaactccccctcctggaacgagagtgcgggcgatggcaatatacaagcaatcgcagcatatgactgaggtcgtgcggagatgccctcatcacgaaaggtgtagcgattcggatggtttggcacctccacagcatcttattcgagtggaaggaaacctcagggtggagtacctggatgatcgcaacacttttagacattcagtggtggtcccctatgaacctcctgaagtgggatcagactgcactactatccattacaactatatgtgtaattcctcctgtatggggggtatgaatagacgccccatccttactattatcactctcgaggactcctccgggaatttgcttggaagaaattcctttgaagtccgggtttgcgcctgtcctggacgtgatcgaagaactgaggaagagaacctccgtaaaaagggcgagcctcaccacgaactccctcctggatcaactaaaagggcgcttccaaacaatacttcaagctctcctcaacctaagaaaaagccactggacggagagtactttacgttgcagattcgcggacgcgaacgatttgaaatgtttcgcgaattgaacgaggcgcttgaactcaaggatgcacaggcaggtaaagaaccaggaggctcgagagctcattcctcacacttgaagtccaagaaaggtcaatcgacctcgaggcacaagaaactcatgtttaagacggaagggcctgattccgac

SEQ ID NO: 20464 - DNA, 1179 bp, Artificial Sequence
  Description of Artificial Sequence: Synthetic coding sequence
atggaagagccacagtctgacccgagtgtagaacctccgctttctcaggagacattcagcgatctgtggaagctcttgccggaaaacaacgttctatcacctctgcctagtcaggcaatggacgatcttatgttatcacccgatgacatcgagcagtggtttactgaagatcccgggccagacgaggcgccacggatgcccgaggccgcccctccggttgctccagcgcctgcagcacccactcccgcagctcccgcaccagctcccagctggccgttaagttccagcgtcccctctcagaagacctaccaaggatcctacggatttcgccttggattcttgcattctggaacagcgaagagcgtgacatgtacctactcgccagccttaaataaaatgttctgtcagttggcaaagacctgccctgtgcagttgtgggtggattccacaccgccccccggcacaagagtcagagcaatggcgatatacaagcagtcacagcacatgaccgaggtggtcaggcggtgtcctcatcatgaaagatgttctgatagcgacggcctcgcccccccccagcacctgattagagtggaaggcaatttgcgcgtcgagtatctcgacgatcggaatacatttcgccattctgtggtggttccttacgaaccgcctgaggttggtagcgactgtaccaccatccactataactacatgtgcaactccagttgcatgggaggcatgaatcgccgcccaatcctgactattatcaccctagaagatagtagcgggaatctgctgggtaggaactcatttgaggtacgcgtctgtgcgtgtcccggccgcgatcgccggacggaagaggagaacctccgtaaaaagggcgagccccaccacgaacttccaccagggtctaccaaaagggctctaccgaataacacgagttcatccccccagccaaaaaagaagcctttggatggggagtactttacactccaaatcaggggtagagaacggtttgagatgttcagggagctgaacgaggccttggagctcaaggatgcacaggctggaaaggagccaggcggctctagagcccattcatctcatctgaagtcgaaaaagggtcaatcaacctcaagacataagaaactgatgtttaaaaccgagggacccgattccgac

SEQ ID NO: 20465 - DNA, 1179 bp, Artificial Sequence
  Description of Artificial Sequence: Synthetic coding sequence
atggaagagccacagtccgatcctagcgtcgaaccccctctgtctcaggagactttctcagacctttggaagctgttgccagagaataatgtgctctcccccctcccttcacaagccatggatgatcttatgctgtcaccagatgacattgagcaatggttcaccgaggaccccggaccagatgaggcaccacggatgccagaggcagctcctcctgtggcacccgctccagcagcgcctactcccgcagcacctgcgcctgcaccctcatggcctctttcttcgtcggtcccatcccagaaaacctaccagggatcatacggattccggctgggatttcttcatagcggcactgctaaatcagtcacctgtacttactcccctgcactgaacaagatgttctgccagcttgccaagacttgtccagtccaactctgggtggattctaccccgccgccgggtactcgtgtgagagccatggcaatctacaaacagagccaacacatgacggaagtggtgcgccgctgtccgcatcatgaacggtgctcggactccgatggtctggctccaccacaacacctcattagggttgagggaaacttgcgcgtggaatacctcgatgatcgcaacacgttccggcactcggtggtggtcccttacgaacctcccgaagtgggttccgactgtactaccatccactacaactacatgtgtaactcatcctgtatgggaggaatgaaccggcggccaatcttgaccatcattacccttgaggactcgtcggggaacctgctggggcgtaactcttttgaagtgcgggtctgtgcatgccccggacgggaccggcgaaccgaagaggagaatcttagaaagaagggagagccacaccatgaactgcctccgggatcgaccaagcgcgccctgcccaacaatactagctcatcgcctcaacctaaaaagaagccactggatggcgaatactttaccctccaaattaggggaagggaacgctttgaaatgttccgggaacttaacgaggcactggaacttaaagatgcccaggccggcaaagaaccgggaggctcccgagcgcattcgtcacatcttaagtcaaaaaagggacagtcgacctcgcgtcataagaagctgatgtttaagaccgagggtcccgacagcgat

SEQ ID NO: 20466 - DNA, 1179 bp, Artificial Sequence
  Description of Artificial Sequence: Synthetic coding sequence
atggaagagcctcagagcgatcctagcgtcgaacctcctttgtctcaagaaacctttagcgatctatggaagctcctgcccgaaaataacgtgctgagccctttgccgtctcaggccatggacgacctgatgctctcccctgacgatatcgaacaatggtttaccgaagatcctgggccggatgaggcgcctcgcatgcctgaggccgcgcctcctgtcgcccctgcgcccgctgccccgacgccggctgcgcccgcgccggcacccagctggcctctaagctcgtctgtgcctagccagaaaacataccaggggagctacggtttccggttgggcttcctgcacagcggaaccgccaagtctgtgacctgcacctacagccctgcactgaacaagatgttttgtcagcttgccaaaacgtgcccagtgcagctttgggtcgacagcacgcctcctccagggacccgtgtgcgtgccatggctatctataagcagtctcaacacatgactgaggtggttcgccgttgccctcaccatgagcgctgctcagatagcgacggtctggccccaccgcagcacctgattcgcgtcgagggcaatctccgagttgagtacctggatgaccgcaatacgtttcggcatagtgtggtcgtcccttacgagccgcctgaggtgggcagcgattgtacgactattcactataattacatgtgcaatagctcttgtatgggcggcatgaaccgcagacctatcttgaccattataaccctggaagactcgtctggtaatctgttgggtcggaattccttcgaagtccgcgtttgcgcgtgcccaggccgggataggagaactgaggaggaaaaccttcgtaaaaaaggagagccgcatcatgaactgccgccgggtagcaccaaacgcgcgctgcctaacaacacctcgagcagcccgcaaccgaagaaaaagcctcttgacggggaatactttactctgcagatacgtggtcgtgagcgcttcgaaatgttccgcgaattgaacgaggccctggaactgaaagacgcacaggcaggcaaggagcccggcggtagcagagctcatagtagccatctgaagagcaagaaaggccagtccaccagccgtcataaaaaactgatgtttaagaccgagggccccgatagcgat

SEQ ID NO: 20467 - DNA, 1179 bp, Artificial Sequence
  Description of Artificial Sequence: Synthetic coding sequence
atggaggaaccccagtctgatccaagcgtggaacctcctctttcccaggagactttctcggacctgtggaagctgctgccggaaaacaatgtgctctccccgctcccctcccaggctatggatgacctcatgctctccccggacgacatagagcagtggttcacggaggacccaggcccggacgaagcgccgcgcatgcccgaggccgcgcctccagtggcaccagcaccggctgccccgactccagctgccccagccccggcgccatcgtggccgctgtcctcctcggtgccgagccaaaagacgtaccagggatcgtatggtttccggctgggattccttcattccgggacggccaagagcgtgacttgcacctactcccctgcgctcaacaagatgttctgccagctcgctaagacttgccctgtgcagctgtgggtggatagcacccctccaccgggtacgagggttagagccatggcgatctacaaacaatcacagcacatgaccgaggtcgtcagacggtgcccccaccatgagagatgctcggattcggatggactggcacccccacaacaccttatccgggtggaaggcaacctgcgggtggaatacctcgatgaccgcaatactttccggcattcagtggtggtgccgtacgagccgccagaggtgggatcggattgtactaccattcactacaactacatgtgcaactcctcgtgcatgggaggcatgaatcggcgcccgatcctcactatcatcaccctcgaggactcgtccggaaacctgctgggcagaaactcgtttgaggtcagagtctgtgcctgtccgggacgggaccggcgcactgaagaggagaatctgagaaagaaaggagagccgcaccacgagctgccaccaggatccactaagcgagcgctgccgaacaacacctcgtcatcacctcagccgaagaagaagccgctggacggcgaatactttaccctccagatccggggtcgcgagcggttcgaaatgttcagggagcttaacgaggccctggagctgaaggacgcccaggcgggcaaagagccgggaggctcgcgggcgcactcatcgcacctgaagtcgaagaagggtcagagcacttcgcgccacaagaagttgatgttcaaaaccgagggaccagattcagac

SEQ ID NO: 20468 - DNA, 1179 bp, Artificial Sequence
  Description of Artificial Sequence: Synthetic coding sequence
atggaggagccccagtccgacccttctgtggagcctcccctgtctcaggagaccttctctgatctgtggaagttactaccagagaacaacgtattgtcacccctaccttcacaggccatggatgatctcatgttatctcccgacgatattgagcagtggttcaccgaagatcctggcccagatgaagctcccaggatgccagaagcggctcctcccgtcgctccagcacccgctgctccaactcctgcggcacctgcccctgccccttcctggccattaagctcttccgttccaagtcagaagacttaccaggggtcttacgggttccgtctcgggttccttcatagcggaaccgcaaagagtgtcacttgtacctactctccggcactgaataagatgttctgtcagctggccaagacttgtccggttcagctttgggtggactcgaccccccctcccggaacacgggtccgagctatggccatttataagcagagccagcatatgaccgaggtcgtccggcgctgcccccatcacgaacgttgtagcgattctgatggactggcgccaccgcagcatctgataagagttgaggggaatttgcgggtggaatatcttgacgacaggaatacgttcagacacagtgttgtggtgccatatgagcctcccgaggttggcagtgactgtaccaccatacattataattacatgtgtaacagttcctgcatgggcggcatgaacaggcgtcctatccttactatcattacactcgaggacagctctggtaacctattgggccggaacagtttcgaggttagggtgtgcgcctgcccaggaagggatcgtcgaacggaagaggagaacttgagaaagaaaggcgagccccaccacgagctgcctccagggagtaccaaaagggcactcccgaataacactagttctagccctcagcctaaaaagaaacccctggatggagagtactttacgctccagatcagagggcgggagaggtttgagatgttcagagagctgaatgaggcactagagctgaaggacgcgcaagcgggcaaggaacctggaggctctagggcccattccagccacctgaaatctaagaaagggcagagcaccagtcgccacaaaaaactgatgttcaagactgaagggccagatagcgat

SEQ ID NO: 20469 - DNA, 1179 bp, Artificial Sequence
  Description of Artificial Sequence: Synthetic coding sequence
atggaggaacctcagtccgacccctctgtagagccaccactgtctcaagagaccttctcggatctgtggaagctgctgcccgagaacaacgtcctgtcacctctgccatcgcaggctatggacgatctgatgctgagccctgatgatattgaacagtggttcaccgaggatccaggtcccgatgaagcccctaggatgccggaggccgcccctccagtagcacctgctcctgctgcccccactcccgctgccccagccccagcacctagttggccactgtcaagctcagttccttcccagaagacctatcaggggtcttacgggtttcgattaggattcctccacagcggtacagctaagtctgtgacgtgtacttactcccccgccctgaacaaaatgttctgtcagctagctaagacttgcccagtgcagctgtgggtcgactcgacgccaccacccgggaccagggttcgggccatggccatctacaagcaaagccagcatatgaccgaggtagtcaggcgatgtccccaccacgaaaggtgttccgacagtgatggcctggcacctccgcagcacctaatacgcgtagagggcaatctcagggtagagtatctcgacgaccggaatacatttaggcactccgttgtcgtgccctatgaaccaccagaggtgggatcagactgcaccaccattcactataactatatgtgtaattcaagttgcatgggcggcatgaataggagacctatcttaactataatcactctggaagacagcagtgggaatttactggggcggaattccttcgaggtgcgcgtgtgtgcatgccctggcagggaccgaagaactgaggaagaaaacttgcgcaaaaagggcgaaccacaccacgagctgcctcccggctcgacgaaacgcgctctacctaataatacatcttccagcccacagcccaagaagaaaccactggatggggaatatttcaccctgcagatccgcgggcgggaacggttcgagatgtttcgcgaactgaatgaggcactggagctgaaggatgctcaggcgggaaaagaacccggcggttctagagcgcattctagtcacctgaaatccaaaaagggtcagtcaacctctaggcacaagaaattgatgttcaaaacagagggtccagattcagac

SEQ ID NO: 20470 - DNA, 1179 bp, Artificial Sequence
  Description of Artificial Sequence: Synthetic coding sequence
atggaagaaccacaatcagatccttctgtcgaacctccacttagtcaagaaacttttagtgatctttggaaacttttaccagaaaataatgttctttctccacttccatcacaagcaatggatgatcttatgttatcaccagacgatattgaacaatggtttactgaagacccaggtccagatgaagcaccaagaatgccagaagctgcacctccagtagctcctgctccagcagcacctactcctgctgcacctgcaccagcaccatcttggccattatcaagttcagttccatcacaaaagacatatcaaggaagttatggtttccgtttaggttttttacactcgggtacagctaagtcagtgacatgtacatatagtcctgcacttaataaaatgttttgtcaactagctaaaacttgtccagtacaattatgggtagattcaaccccaccaccaggtacaagagttcgtgctatggcaatatataaacaatcacaacatatgactgaggtagtaagaagatgtccacatcatgaacgatgttctgattcagatggattagcaccaccacaacatcttataagagtagaaggaaatttaagagtcgaatatcttgatgatagaaatacttttagacattctgttgttgtcccatatgaacctccagaagtgggaagtgattgtactactattcattataattatatgtgcaattcgtcatgtatgggtggaatgaacagaagaccaatacttactataattactttagaagacagttccggaaatttattaggaagaaattcatttgaggttagagtttgtgcatgtccaggtagagatagaagaacagaagaagaaaatcttagaaagaaaggtgaaccacatcatgagcttccaccaggatcaacaaaaagagctttacctaataacacatcatctagtccacaaccaaaaaagaaaccacttgatggtgaatattttaccttacaaattaggggtcgtgaaagatttgaaatgtttagagaattaaatgaagcacttgaattaaaggatgcacaagctggaaaagaaccaggaggtagtagagcacatagtagtcatttaaagtcaaaaaaaggacaaagtacaagtagacataaaaagttaatgtttaaaactgaaggaccagactcagat

SEQ ID NO: 20471 - DNA, 1179 bp, Artificial Sequence
  Description of Artificial Sequence: Synthetic coding sequence
atggaggaaccgcaaagcgatccttcggtcgagccgccactgtcccaagaaacgttctccgacctctggaaactgctgccagaaaacaacgtgctgtctccgctgccgagtcaggcgatggatgacctgatgctcagcccggacgacatagagcaatggtttaccgaggacccaggaccggacgaggcaccacgcatgccggaggccgctccgcctgtagctccagcaccagcggcgccgactcccgctgcccccgcccccgctccgtcatggcctttgtcgtcctcggtcccttcccagaaaacgtaccaaggatcgtacggttttcgcctgggtttcctgcactcaggaactgccaagtcagtgacctgcacctactcgcctgccctcaacaaaatgttctgccagctcgccaagacctgtcctgtccagctttgggtggattccactcctcccccgggaactcgggtgcgggcaatggcaatctacaagcagagccagcacatgaccgaagtcgtgcgcaggtgcccgcatcatgagcgctgctcagacagcgacgggttggccccaccgcagcatctgatccgggtggaaggaaaccttcgcgtcgaatacctcgacgaccggaatactttcagacactccgtggtggttccgtacgaacccccggaagtagggtcggattgcaccactatccactataactacatgtgcaattcgtcatgtatgggaggcatgaatcgtaggccgatcttgacgatcatcaccctggaggatagcagcggaaacctgctcgggaggaactccttcgaggtgcgggtgtgtgcgtgcccagggagggacagacggactgaggaagagaatctgcgcaagaagggcgagccacatcatgaactgccacctggaagtaccaagcgtgcactccctaataacacttcctcctcgcctcagccgaagaaaaagcccctggacggcgaatactttactctgcaaattagaggcagagaacggttcgagatgttccgggagctcaacgaagcactcgagctcaaggatgcccaggctggcaaagaacctggcggatcacgcgcccactcctcgcacctgaagtcaaagaaaggacagtcgacttcacgccacaagaagttgatgttcaagaccgaaggacccgattcggat

SEQ ID NO: 20472 - DNA, 1179 bp, Artificial Sequence
  Description of Artificial Sequence: Synthetic coding sequence
atggaagaacctcagtccgatccatcagtggaacccccgctttcacaggaaaccttctcggatctctggaagctgctccccgaaaacaatgtccttagtcctcttccttcgcaggcgatggatgatctgatgctcagcccagacgacattgagcaatggtttaccgaagatcctggaccagatgaagcacctagaatgccagaggccgcgccccctgtggcccccgcaccggcagcacccactcctgcagcaccagcccctgctccaagctggccactttcatcctcggtcccttctcagaaaacttaccaagggtcctacggttttcgcctcggatttcttcactcggggactgcaaagtccgtgacttgtacctactccccagcacttaacaaaatgttctgccaactggcaaagacttgccctgtccagctttgggtggatagcactccacctcctggaaccagagtgcgtgcaatggccatttacaagcaatcacaacatatgacggaggtcgtgcggaggtgccctcaccatgaacgatgttcggactcggacggactggcccctcctcaacatcttattcgagtcgaaggtaatctgcgagtggaataccttgatgatcggaacaccttcaggcatagcgtcgtggtgccttacgaacctccagaagtcggaagtgattgtaccaccatacattacaactacatgtgtaactcgtcctgtatggggggcatgaatagacgtcccattctgacgatcataaccctcgaagattcgtcggggaacctcctgggtcgcaacagttttgaagtgcgcgtctgcgcatgtccgggtcgcgataggagaaccgaagaagaaaatctccggaagaagggggagcctcaccacgaactcccaccaggctcgaccaaaagggctcttcctaataacacttcttccagcccccaacctaaaaagaagcctctggatggggaatacttcacgctgcagatcagaggaagagagagatttgaaatgttccgggagcttaacgaagcactggaactcaaggatgcccaagcaggcaaggaaccaggcggatcgagggcacactcatcccacctgaagtcaaagaaaggtcagtcgacctcgcgtcataagaaacttatgttcaagactgagggtccagactccgat

SEQ ID NO: 20473 - DNA, 1179 bp, Artificial Sequence
  Description of Artificial Sequence: Synthetic coding sequence
atggaagagccacagagtgatccctccgttgagccccccctgagccaggagacgtttagcgatttgtggaagctgcttccggaaaataacgtgctgtcacccctgccatctcaggccatggacgatctgatgctatcccccgacgacattgagcagtggttcacagaagatccggggcctgatgaggctccgcgaatgccagaggccgcaccaccagtcgcgcccgccccagccgcccctaccccggccgcgcccgctcctgccccttcttggcctttgagctctagtgtgccttctcagaagacgtaccagggctcctacggctttcgcctaggttttctccattccggtactgccaagtctgtgacttgtacatactcgcctgcactcaacaaaatgttttgtcagctggccaaaacctgccccgtccagttatgggtcgatagtacacccccccctggcacacgggtcagggccatggctatttataaacagtcgcagcacatgacagaggtcgtccgccgttgcccccaccatgaacgttgctctgactcggatggccttgctcctccccagcacctgatacgagtggagggcaacctgcgtgtagagtatctggatgatagaaataccttcaggcatagcgtggtggttccgtacgagccacctgaagtgggaagtgattgtaccacaattcattacaactacatgtgcaactcctcttgcatgggtgggatgaataggaggcctatcttgactataatcactctggaggactcatccggcaatctcctcggcaggaactctttcgaggtgcgagtgtgtgcctgtcccggtagggaccgcaggaccgaagaagaaaatctgcgcaagaagggcgagccccaccacgagctaccgccaggctctacaaagagagctctgccgaacaataccagcagctcgcctcagcctaaaaaaaagccactggacggagaatattttacgctacaaattcgaggccgcgaacggtttgagatgttcagagaactcaacgaggctctggaacttaaagacgctcaagccgggaaggagccaggaggatcccgggcccactctagtcatctgaaatctaagaagggccaaagcactagccgtcacaaaaagttgatgttcaagacagagggaccagattcagat

SEQ ID NO: 20474 - DNA, 1179 bp, Artificial Sequence
  Description of Artificial Sequence: Synthetic coding sequence
atggaggaaccacagagcgacccctcagtcgaaccccctctcagccaggagacctttagcgacctgtggaaacttctgcctgagaataatgtgctaagtccgctgcctagccaagccatggatgacctcatgctatcacctgacgatatcgaacagtggtttacagaagatccgggaccagacgaggcccctaggatgccagaagctgcacccccagtggcgcctgcgccggccgcccccactcccgctgcccccgctccggccccctcctggcctcttagttcgtccgtcccttcccagaaaacctaccagggttcctacggcttccgcctgggcttcctacacagcggcacagctaaaagcgttacttgcacatacagcccagctctgaacaagatgttctgccagctagctaaaacgtgtccagtgcagctgtgggtggacagtacgcctcccccagggacacgagtaagggcgatggccatctacaaacagagccaacatatgaccgaggtggttcggaggtgtcctcatcatgaacggtgcagtgactcagatggcctggctcccccacagcatctgatcagagtggaggggaacctgcgggtggagtacctggatgataggaacacattcaggcattctgtggttgtgccttatgaaccgcctgaagtcgggagtgactgtactaccattcactacaactacatgtgcaacagcagctgcatgggcgggatgaacaggcgcccaattttgactatcataacgctggaagatagttctgggaatctgctcgggcgaaactctttcgaggttcgggtttgtgcttgtcctggccgggatcgcagaacggaggaagagaaccttaggaaaaagggagagccgcatcacgagctgcctcctggttctacgaagagagctttgccaaacaatacctccagcagcccgcagccaaagaaaaaaccattagatggggagtatttcaccctccagattcgtggaagagagcgctttgaaatgtttcgggaactgaacgaggccttagaactgaaagatgcccaggccggtaaggagcctggggggagtagggcccacagcagtcatctcaagtcaaaaaagggtcagtcaacaagtcggcataaaaaactgatgtttaagacagagggtcccgactctgac

SEQ ID NO: 20475 - DNA, 1179 bp, Artificial Sequence
  Description of Artificial Sequence: Synthetic coding sequence
atggaagagccgcaatcagatccaagcgtggagcccccattgtcccaagaaaccttctcggatttgtggaagctcctcccagaaaacaatgtgctctctccactgccatcgcaggccatggatgatctcatgctctccccggacgatattgagcagtggttcactgaggacccgggcccagatgaggctccacggatgccagaggcagcgccgccagtcgctccggcgccggcagcacccacgccagcagcgccggcgccagcgccatcctggccgctctcatcctccgtgccgtcgcaaaagacttaccaaggatcctacgggtttcggctgggattcctgcatagcggtaccgcaaagtcggtgacttgcacgtacagccctgccctcaataagatgttctgccagcttgctaaaacctgcccggtgcagctgtgggttgactcaactcctccaccgggaaccagagtgcgcgccatggccatctacaagcaatcccagcacatgaccgaggtcgtgaggagatgtccacaccacgagagatgctccgactccgacggtctggcgcccccgcagcatctgatcagagtcgagggaaacctccgggtggagtacctcgatgaccggaatacctttaggcactcagtcgtggtcccttacgaaccaccagaagtgggttccgactgtacgactatccactacaactacatgtgtaattcgtcatgcatgggaggcatgaatagacggcctatcctgactatcatcaccttggaggacagctcgggaaatctgctgggacgcaacagctttgaagtgagagtgtgtgcctgccccggtagagataggcgtaccgaagaagagaacctgcgcaagaaaggtgagccacatcacgagctgccgcccggatccaccaagagagcactgccgaacaacacctcctcttccccccagccgaagaagaaaccactggatggcgaatacttcactctgcagattcgcggaagagaaaggtttgagatgttccgggaattgaatgaggctctggaactgaaggacgcccaggccggaaaagaacctggaggaagccgcgcccattcctcgcatctgaagtcaaagaagggccagagcacgtctcgccacaaaaagctgatgttcaagacggagggaccagactccgac

SEQ ID NO: 20476 - DNA, 1179 bp, Artificial Sequence
  Description of Artificial Sequence: Synthetic coding sequence
atggaagaacctcagtccgacccttccgtcgaacctcctctttcacaagagactttttcggatctgtggaaacttctccctgagaataacgtgctctcgcctctcccctcgcaggcaatggatgatctgatgcttagcccagacgatatcgaacagtggttcaccgaagatcctggacctgatgaagcaccaaggatgccagaagccgcacctccagtggcgcccgcccctgcggcccccactccagccgcacctgcccctgcaccatcgtggccgctctccagctcagtgccctcacaaaagacgtaccagggatcatatggatttcgtcttggttttctgcactcggggaccgctaagagcgtcacctgcacgtactcgcctgcactgaacaagatgttttgtcaacttgcaaaaacctgtccagtccaactgtgggtggacagtaccccgccccctggtactagagtgagagcaatggctatttacaagcagagccagcacatgaccgaagtcgttcggaggtgcccgcatcacgagcgctgttccgattcggatggtcttgcccctccacagcatctcatccgcgtggaagggaatctccgggtggaatacctggatgataggaatacctttagacattcagtggtggtcccatacgagcctcccgaggtcggctcggattgtaccaccattcactacaactatatgtgtaactccagctgtatgggaggaatgaatcgacgaccaatcctcactattatcactctcgaagattcctcgggcaaccttctgggtcgcaacagctttgaggtgagggtgtgcgcgtgtccaggacgcgatagacggactgaagaggaaaacctccgaaagaagggcgagcctcatcacgaattgccgccaggatccactaagagagctctccctaacaatacctcgtcatccccccaacctaagaagaagcctctggacggagaatactttacccttcagatacgcggaagagaaagattcgagatgtttcgagaacttaacgaagctcttgaactcaaagacgcacaagcaggaaaggaacccggagggtcgagggcacattcctcgcatcttaagtccaaaaaaggtcagtccaccagtagacacaaaaagctcatgtttaagacggagggtccagattcggac

SEQ ID NO: 20477 - DNA, 1179 bp, Artificial Sequence
  Description of Artificial Sequence: Synthetic coding sequence
atggaagagccgcagagtgatccgagcgtcgagccaccgttgagccaggagacgttctcggacctgtggaagctgctgccagagaacaacgtcctcagcccactgccgtcccaagcgatggacgaccttatgctgtccccagatgatatcgaacaatggttcaccgaagatccagggccagacgaagctccccgcatgcccgaggccgccccacctgtggccccagcccccgcggctccgactcctgcggcaccagcgccggcgccttcgtggcctctctcgagctctgttccatctcaaaaaacttatcaagggtcctacgggtttcggctcggcttcctgcactcgggaactgcaaagtccgtgacgtgtacttactcacccgctctcaacaaaatgttctgccagctcgctaagacctgcccggtgcagctctgggtggattctactccgcccccgggcactcgggtccgggcgatggctatttacaagcaatcccagcacatgaccgaggtggtgcgcagatgccctcatcacgagcggtgctcggactccgatggcctcgccccaccccagcacctcattcgcgtcgagggaaacttgcgcgtggaatacctggacgatagaaatacttttcgtcactccgtggtcgtgccctacgagcctccggaggtcgggtcggattgtaccacgatccattacaactacatgtgcaatagcagctgcatgggcgggatgaatcggcgtcctatcctgaccatcatcactctggaggactcgtcgggaaatctgctcggtcggaattcctttgaagtgcgagtgtgcgcgtgtccaggacgagatcggcgcactgaagaggaaaatctccggaagaagggagagccgcaccacgagctcccgccgggatccactaagagggctctgcctaacaacaccagctctagcccccagcctaaaaagaagcccctggacggagagtactttaccctgcagatccggggcagggaacgctttgaaatgttccgggaacttaacgaagcattggaattgaaagacgcacaagccggcaaggagccgggagggagcagagcccattcgagtcatcttaagtcgaagaagggacagagcacctcacggcataagaaacttatgtttaagaccgagggcccggactcggac

SEQ ID NO: 20478 - DNA, 1179 bp, Artificial Sequence
  Description of Artificial Sequence: Synthetic coding sequence
atggaagaaccgcaatcagatcccagcgtggaaccgccgctctctcaggagactttctcagacctctggaaactcctgccagaaaacaacgtgttgtccccactgccttcacaagcaatggatgacctgatgctgagcccagatgatattgagcaatggttcacggaggacccgggaccagatgaagcgccgcgcatgccggaagcagccccaccagtggctccggcccccgcggccccaactccggccgcaccggcaccggctcctagctggccgctctcttcgtcggtcccgtcccaaaagacctaccagggcagctacggcttccggttgggcttcctccactcgggaaccgccaaatccgtgacctgcacttatagcccggcactcaacaagatgttctgccagctggccaaaacttgcccagtccagctctgggttgatagcacccctccgccaggaactcgcgtgcgcgccatggcgatctacaaacagtcacagcatatgaccgaagtggtgcgcaggtgcccgcaccatgaaagatgtagcgactcggacggcctcgcccctcctcaacatctgattagagtcgaaggcaatctccgcgtcgaatacctggacgaccgcaacactttccggcattctgtggtcgtgccatacgaaccgccggaagttggatcggattgcactaccatccattacaactacatgtgcaattcgtcctgtatgggtggcatgaatcgacgcccaatccttactatcattactttggaggactcatccgggaacctgctcggacgcaattcattcgaagttagggtttgcgcctgtccaggacgcgaccgtcggactgaggaagaaaatctgcgcaagaagggcgaaccgcaccatgagcttccgccaggaagcaccaagagggcgctgcccaacaatacttcgtcgtcaccccagccgaaaaagaagccactggatggagagtacttcacgttgcaaatccgcggacgagagagatttgaaatgtttagggaactgaacgaagccttggagctgaaggatgcgcaagctggaaaagagccaggagggtcgagagcccacagttcccatctgaagagcaagaagggacagtcaacttcgagacataagaagctcatgtttaagactgagggaccggactcagac

SEQ ID NO: 20479 - DNA, 1179 bp, Artificial Sequence
  Description of Artificial Sequence: Synthetic coding sequence
atggaggagccacagtctgacccttctgtggaaccccctcttagtcaggagaccttttctgatctgtggaagttgctcccagagaacaatgtcctgagtccattgccaagtcaagctatggatgacctgatgctgagtccagatgacatagagcagtggttcacagaggatcctggccctgacgaggccccccggatgcctgaggctgcccctcctgttgcaccagcaccagcagccccaacacccgccgcccccgccccagcaccatcttggcccctctctagcagtgttccaagtcagaaaacttaccagggaagctacggctttaggctaggcttcctgcatagtgggacagccaaatcagtgacctgtacttattcaccagctctcaacaaaatgttttgccagctagccaagacatgccctgtgcaactgtgggttgactctactccacccccaggcacccgcgtgcgggctatggctatttacaagcagtctcagcacatgacagaagtggtgcggcgatgccctcatcatgaacgctgtagtgatagcgacgggctggctcccccacagcacctaatacgagtggagggtaatctgcgggtcgaataccttgacgatagaaatacctttcgtcactccgtggttgtgccatatgaaccaccagaggtcggatccgactgcacaacaattcactataattacatgtgtaatagttcttgcatggggggcatgaacaggagacccattctcaccataataacactggaagactcctctggcaatctgctcggcaggaacagttttgaggtaagagtgtgtgcctgtccgggcagagatcggaggacagaggaagaaaatctgcgtaagaagggggaaccccaccacgagctgccccccgggagtactaagcgagcactgcccaataataccagttcatcaccacaaccaaagaagaagccactggacggtgagtacttcaccctccaaatccgggggcgcgagcgtttcgaaatgtttcgggagttaaatgaggccttggagctaaaggatgcccaggcaggaaaagagccaggcgggtcacgggcccattcaagccacctgaagagcaagaagggtcagtctacatctcgccacaagaaactgatgttcaaaacagagggcccagacagtgat

SEQ ID NO: 20480 - DNA, 1179 bp, Artificial Sequence
  Description of Artificial Sequence: Synthetic coding sequence
atggaagagccacagtcagatcctagcgtggaacctcctttatcacaggaaaccttctcagatctgtggaaactcttaccagagaacaacgtcctgagtcctctgccatcacaggccatggatgacttaatgctgagcccagatgatatcgaacaatggttcaccgaagatccaggtccagacgaagctcctcgcatgcctgaggctgcacccccagtggcaccagctcctgcggccccgactcccgctgcccccgctcctgcacccagctggccgctttctagctctgttcccagccagaagacatatcaaggatcttacggattcagactgggcttcctgcatagcggcaccgctaagtctgtgacttgcacgtactcacctgccctgaacaaaatgttttgccagctggccaagacatgtccagttcagctctgggtcgactccactccacctccaggaacacgtgtccgggccatggcaatatacaagcaaagtcagcacatgaccgaggtcgtgagacggtgccctcatcacgagaggtgtagcgactctgacgggctggccccacctcaacaccttatacgggtggaaggtaatctgagagtggaatacctggatgacagaaatacttttcgccacagcgtcgttgtgccttatgagcctcccgaagtgggctctgactgcacaactattcattacaactacatgtgcaacagcagctgcatgggaggaatgaacagaagacccattttgactatcattacactggaagactcatcaggcaaccttctcgggcgcaatagctttgaggtccgtgtgtgcgcttgccccggacgagataggcgcaccgaggaagaaaacctcaggaaaaagggagaaccgcaccacgaactgccccctggtagtactaagcgtgctctcccgaataacaccagcagctcaccacagcctaagaagaaacctctggacggtgagtacttcaccctgcagatccgcggacgcgaaagatttgagatgttccgcgagctcaatgaggcccttgagctgaaggatgcccaggccggaaaggaaccaggagggagtagagctcatagtagtcatctcaaaagcaaaaaaggccagagcactagccgccacaaaaaattgatgtttaagaccgagggcccagattccgac

SEQ ID NO: 20481 - DNA, 1179 bp, Artificial Sequence
  Description of Artificial Sequence: Synthetic coding sequence
atggaagagccacaatcggaccccagcgtagaaccacctctctctcaggaaaccttctccgacttatggaagcttctccccgaaaacaatgtattgagccccctgccgtctcaggctatggatgacctgatgttaagcccagatgacattgagcagtggtttacagaggaccctggtcccgatgaagcccccagaatgcctgaggctgcgccgccagttgcacctgcccctgccgcccctacccccgccgctccggccccggccccctcatggcccctgtcttcttccgtcccctcacagaagacttaccagggaagctatggattccgcctcggctttctccacagcggcaccgcgaaatcagtaacttgcacatactcccctgcactaaataagatgttctgtcagctggccaaaacttgcccagtccagttatgggtggattccacaccaccaccaggcactcgggtgagagccatggcaatctacaaacaaagtcagcatatgacagaggtggtgaggcgatgccctcaccacgagcggtgctcagattcagacggtttagcccccccccagcatctcatccgtgtggagggcaatctgagagttgaatatttggacgacaggaacacctttaggcactcggttgtggtcccttatgaacctccggaggtgggcagcgattgtactacaatccactataactacatgtgcaattcctcctgcatgggggggatgaaccggagacccatattgactatcataactttggaagatagtagtggaaatctgctgggtcgtaattcgttcgaggttagggtgtgtgcctgccccgggagggatcgacggacagaagaggagaatcttcgaaagaagggagaaccccatcacgagctacctcccgggtccacgaagagggccctaccaaataacactagtagctcgcctcagccgaaaaagaaacctcttgatggggagtactttactttgcagattcggggccgtgaacgattcgagatgttccgagagctcaacgaggctctggagttaaaggatgcccaagccggaaaggaacccggaggaagtagggcccacagtagccacctgaaatctaagaagggccagagtacttcacgacataagaaactcatgttcaaaaccgagggacctgatagcgac

SEQ ID NO: 20482 - DNA, 1179 bp, Artificial Sequence
  Description of Artificial Sequence: Synthetic coding sequence
atggaagaaccacaatccgacccctcggtcgagccacccttatcacaagaaaccttctcggatctctggaaactcctcccagaaaataacgtcctctccccactgccctcccaggccatggacgatttgatgctgtctccagatgacattgaacagtggttcacggaggacccagggccggacgaggctcccaggatgccagaggcggctcctcctgtcgcccccgcacccgctgctcctacgccggccgcgccagcgcctgcaccttcgtggcctctcagcagttcagtgccatcccagaaaacttatcagggtagctacggtttccgcctcggcttcctccactcagggacagccaagtctgttacatgtacctattcccctgcactgaacaagatgttctgccagttggctaagacctgccctgtacagttgtgggtggattccaccccacctcctggcacacgcgtccgggccatggctatttataaacagagtcaacatatgaccgaagtcgtccgccggtgcccacatcacgagagatgtagtgactcggacggcctagcacccccccagcacctgatccgcgtggagggcaatttgagggtagaatatctagacgaccgcaacacctttcgccactcggttgttgtcccctacgaacccccagaagttggcagcgactgtacaacaattcattataattatatgtgtaacagcagctgcatgggaggcatgaaccgacggcccatcctgactattattaccctcgaagattcctctggcaatctcctcggacgcaacagcttcgaggtgagggtttgcgcctgcccagggcgagaccggcgcaccgaggaagagaatctccggaagaagggggagccccatcatgagttaccccctgggagcactaagagggctctgcccaacaatacatcctcatctcctcagccaaagaagaaaccactggacggtgaatacttcacgctacaaatccgtggccgcgagcgtttcgaaatgttccgggagctgaacgaagcgctggaactgaaagacgcgcaggctggcaaagaacccggcggatcgagggcgcactcatctcatctgaaatccaagaagggccagtctacttctcgccataagaaactgatgtttaagactgaaggtccggatagtgac

SEQ ID NO: 20483 - DNA, 1179 bp, Artificial Sequence
  Description of Artificial Sequence: Synthetic coding sequence
atggaagagccacagagtgatccatcagtcgagcctccgctgtcgcaggagacgttttccgatttgtggaagctgctacccgagaataatgtcctgtctccactgccttcacaggctatggacgacttgatgctgtctcctgatgatatcgagcagtggttcaccgaagacccgggacccgacgaggccccacgcatgccggaggccgcccctccggttgctcctgcacctgccgcacctacaccagctgctcctgcgcctgctcctagctggccactcagctcaagtgttccatcacaaaagacctaccagggcagctatggttttcggctgggattcctgcactcaggtactgcgaaatcagtcacctgcacgtattcacccgccctgaacaaaatgttttgccaactagccaaaacatgtccagtgcaactttgggtcgatagcacaccccctcctgggaccagagtgcgcgcaatggccatctacaagcagagccagcacatgacagaggtagtcagaaggtgcccacatcacgagcgatgtagtgatagcgacggcctagctccccctcagcatctcatccgagtggagggaaacctgcgagtggaatacctcgacgaccggaacaccttccgccattcggtagtggttccctatgaaccaccagaggtcggtagcgattgcaccacaatccattataactacatgtgtaactcctcttgcatgggcggaatgaaccggcgacctatcttgaccattataaccttggaagattcttctgggaacctcctaggccgcaattcatttgaggtgcgcgtctgtgcatgtcctgggcgggatcgtcgaactgaagaagaaaatctcaggaaaaagggcgaaccacaccatgagctgccaccaggatcaactaaaagggccctgcccaacaatacttcctccagtccccagcccaagaaaaagccactggacggagagtatttcacactacaaatacgcgggcgagaaagatttgagatgtttagagagctgaatgaggccctagagctgaaagacgctcaagccgggaaggagccaggtgggtctcgtgcacatagctcacatttgaagagtaagaaagggcaaagcacctccagacataagaagcttatgttcaagactgaggggcctgatagtgac

SEQ ID NO: 20484 - DNA, 1179 bp, Artificial Sequence
  Description of Artificial Sequence: Synthetic coding sequence
atggaagaacctcagagtgatccgagcgttgaaccaccgttaagccaggaaaccttctccgacttatggaaactacttcctgagaacaatgtgctgtccccgctgccctcgcaagcaatggatgatctcatgttgagcccagatgatatcgagcagtggttcaccgaagaccctggccctgatgaggccccacggatgcccgaggcggcgccgcccgtggctcccgcccctgcagcacccacccctgcggcccccgcccccgcgccatcctggcccctgtccagttcggtgccatcccaaaagacgtatcaaggatcctacggcttccgcctgggattcttgcacagcggcactgccaaatcagtcacctgcacctactcccccgctctgaacaaaatgttctgtcagttggcaaagacatgcccagttcaactgtgggtcgattcaaccccgccgcccgggacccgagttcgggccatggccatatacaagcagagtcagcacatgacggaggtggtgcggcgttgcccacatcacgaaaggtgttcggattcggatggactcgcgccgccccagcacctaattcgcgttgagggcaacctgagggtcgagtacttagatgaccgcaacacgtttcgccatagtgttgtcgtcccgtacgagcccccggaggtcggctccgattgcacgacaatccactataattacatgtgcaatagcagttgtatgggcggcatgaaccgacgccctatcctgacgatcattacgttggaagattccagtggaaacctgctggggcgcaacagtttcgaggtgcgtgtgtgcgcgtgcccggggcgtgatcgcaggacggaagaggaaaatctgcgcaagaaaggcgaaccccaccacgaattgccaccagggtccacgaagcgagccttgcccaacaacacgagttcatccccccaaccgaaaaaaaagccgctcgatggcgagtacttcactctgcagattcgcgggagagaacgttttgagatgttcagggagctaaacgaggccctggagttgaaagatgcgcaagcgggcaaagaacccggaggttcccgggcccattcctcgcacctgaagtccaagaagggtcaatctacctcccggcacaagaagctgatgttcaagaccgagggaccggactcggat

SEQ ID NO: 20485 - DNA, 1179 bp, Artificial Sequence
  Description of Artificial Sequence: Synthetic coding sequence
atggaggaaccacagagtgacccctcggtggagcctccgttatcgcaggagactttctctgacctgtggaagttactgccagaaaacaacgtgttaagtccactgcctagccaggctatggacgatcttatgctctcccctgatgacatcgaacagtggttcacggaagaccctggtccggacgaagccccacggatgcccgaggccgcacccccggtcgcccctgctcccgcggctccgacccccgctgcacctgccccggcgccaagctggcccctgagctctagcgtcccctcacagaagacttatcagggctcctacggctttaggcttggcttcctccatagtgggacggctaagtccgttacgtgtacctattcccccgcccttaacaagatgttctgccagctggccaaaacctgcccggtccagctgtgggtcgattcaaccccacctcctggcacacgcgtgcgcgcgatggcaatatacaaacagtcgcaacacatgaccgaggtcgtgagacgctgtccccatcatgagagatgctccgattcggatggcctggctccgccgcagcacttgatcagagttgaagggaatttaagggtggagtaccttgacgatcgaaacacatttaggcatagcgtggtggtcccttacgaaccgccagaagtggggagcgattgtacaacaattcattacaattacatgtgcaattctagctgcatgggagggatgaatcgccgtccaatccttacaatcatcaccttggaggacagttcaggcaacctactggggcgaaattcctttgaggtgcgtgtctgcgcctgccctggccgggaccgtaggacagaagaggaaaacttgcgcaagaagggtgagccacatcacgagttgccgcctggcagtactaaacgcgctctgcccaacaacactagcagctctcctcagccaaaaaaaaagccattggacggggagtacttcaccttacagataaggggtagggagagatttgagatgttccgggagttgaacgaggcactggagctcaaggatgcacaggctggcaaagaacccgggggttcacgagcacattcgtctcacctgaaatcaaagaagggacaaagcacttcacggcacaagaaactgatgtttaaaacagagggccctgactctgac

SEQ ID NO: 20486 - DNA, 1179 bp, Artificial Sequence
  Description of Artificial Sequence: Synthetic coding sequence
atggaagaacctcaatccgacccttcagtcgagccaccactttcgcaagagaccttcagcgatctgtggaagttgctgccggagaataacgtgttgtcgcctcttccttcccaagcgatggacgatctgatgctaagtccagatgatattgagcagtggtttacagaagaccccggtcctgacgaagctcctcggatgcccgaagccgcacctcctgttgcaccggctccagctgctccaacccctgcagcacccgcgccagcaccgagttggccactgtcttcttctgttccttcccaaaaaacctatcaaggaagttatggatttaggctcggcttccttcactccggaactgctaagtctgttacatgtacttactcgcccgcccttaataaaatgttctgtcaattggctaagacctgtccagtgcagctttgggtcgatagtactccaccgcctggtaccagggttcgggcaatggccatctataagcaatcacagcacatgaccgaagtggtgagaaggtgccctcatcatgagaggtgctcagattcagacgggctcgcacctccacaacatctaattcgcgtggagggtaacttgagggtcgagtatctcgacgacaggaacacttttagacatagtgtggttgtgccatatgaaccccctgaggttggtagtgattgtactaccatacattacaactacatgtgcaatagctcgtgcatgggaggtatgaacagacgaccaatactcaccattattacattggaagactcttccgggaatttgctcggtaggaattctttcgaggttcgagtttgcgcttgccctgggagagatcgtagaaccgaggaggagaaccttcgtaaaaagggtgagccccaccacgaacttcctcctggttctactaaacgcgctctgccaaacaacacatcgtcttccccccagcctaagaaaaagcctcttgatggcgaatacttcacactgcaaatcaggggccgagaaaggttcgagatgtttagagagctcaatgaagctttggagcttaaagatgcccaggctggaaaagagccaggaggttctagagctcatagctcccatcttaagtcaaaaaagggtcaaagcacctctcgtcataagaaattaatgttcaagacagagggtccagattccgac

SEQ ID NO: 20487 - DNA, 1179 bp, Artificial Sequence
  Description of Artificial Sequence: Synthetic coding sequence
atggaggaacctcagagtgatccttctgtagaaccaccactttctcaggaaactttctcagatctctggaaattactccctgaaaataatgttttgtctcccctcccctcacaggctatggacgacctcatgttgagtcccgatgatatcgaacagtggtttacagaagatcctggacctgatgaagccccgcggatgcctgaggcagccccacctgtcgcacccgcccctgcggccccaactcctgcagctcccgcccccgccccatcttggcccctatccagtagtgtgccatcccagaagacttatcaggggtcttatgggtttcggctgggatttctgcactccgggacagctaaaagtgtaacatgtacttatagtcccgcgctgaataaaatgttctgccagctcgccaaaacatgccccgtccagctctgggtggatagtacacccccacccgggacacgtgtaagagctatggccatttataaacagtctcagcatatgactgaagtggtaaggagatgccctcaccacgaacggtgctcagattccgatggactggcccccccccagcacctgataagggtggaaggaaatctgagggtggaatatctggacgatagaaacacttttaggcattcagtggtggtcccctatgaacctcccgaagtcgggtccgattgtacaactattcactacaactatatgtgtaattcttcttgtatggggggaatgaatcggagacccatattaacaatcataacactcgaggattcctctggaaacctccttgggcgcaatagttttgaagtgagagtctgcgcatgtcctgggcgggatcgccgaacagaggaagagaacctcaggaagaaaggggaaccccaccatgaactccctcccgggtctacaaaaagggcactccccaacaacacatcttctagtcctcagcccaaaaaaaaacctctggacggagaatatttcacactccagataaggggaagagaaagattcgaaatgtttcgggaacttaatgaagctctggaattaaaagatgctcaggcaggaaaagaacctggagggtctcgggcacactcttctcatttaaaaagtaaaaaggggcagtccacttcccggcacaaaaagctgatgtttaaaacagaagggcccgattctgat

SEQ ID NO: 20488 - DNA, 1179 bp, Artificial Sequence
  Description of Artificial Sequence: Synthetic coding sequence
atggaggagccacagtctgacccaagcgtggagcctcccttatcccaagagacgtttagcgacctgtggaaactgctgccggagaacaatgtgctctcccccctgccatctcaggccatggatgacctgatgctctcccccgatgatattgaacaatggtttacagaagacccaggacccgatgaggcaccccgcatgcccgaagccgcacccccagtcgctcctgccccggccgctcctacaccagcggcgccggcccccgcaccaagctggcctctatcgtcgtcggttccgtctcagaagacgtaccagggatcctatggtttccgcctggggtttttgcactccggcacggcgaagagtgtgacctgtacctacagcccagccctcaataaaatgttctgccagctggcaaagacctgccctgttcaattgtgggtggattccacaccgccaccgggaacccgagtccgggcaatggccatatacaagcagtcgcaacacatgaccgaggtggtgagacgatgtccccatcacgagcgctgctctgactctgacggcttggccccccctcagcacctgatccgagttgaggggaatctccgagtggagtacctggacgatcggaatacctttcgccactcggtggtagtcccttacgagccacctgaggtcggctccgattgtaccaccatccactacaactatatgtgcaactcaagctgcatggggggtatgaataggcgtcctattctgactatcatcacattggaggattcctcgggtaaccttttaggacggaactcctttgaagttcgggtgtgtgcctgccctggacgtgatcggcgcaccgaagaggagaatcttagaaaaaagggcgaaccccaccacgaactcccaccaggcagcaccaagcgggctctccccaataatacctcaagctcaccgcaacctaaaaagaagccattggatggtgagtatttcaccctccagattcgcggtcgggagaggtttgaaatgttcagggagctgaatgaagcgctagaactgaaagacgcccaggccgggaaggaaccaggagggagccgtgcacactcgtcccatttgaaaagtaagaaggggcagtccacttcacgtcataagaaactcatgtttaagacagaggggcctgactctgat

SEQ ID NO: 20489 - DNA, 1179 bp, Artificial Sequence
  Description of Artificial Sequence: Synthetic coding sequence
atggaggagccacagagtgatccgtctgtagaacccccgctctcgcaggagaccttctccgacctctggaagctcttgcccgagaacaacgtgctctcccctctccccagtcaggcaatggatgacctgatgctttcccccgatgatatagaacagtggttcacggaggaccctgggcctgatgaagcgcccagaatgcctgaggccgcaccccccgtcgcacctgcgcccgctgcgcccacaccagccgctcccgcacccgcccccagttggcctctgagctcctctgtgccctcccaaaaaacatatcagggatcttacggatttcggctgggattcctgcacagcggcactgccaaatctgtcacttgcacttactctccagccctgaacaagatgttctgccagttggcaaagacttgccctgtccagctatgggtggattcgacccctccacccggcacacgagtgagagccatggcaatttataagcaaagtcagcacatgacggaagtcgtgcggcgatgtccccaccacgagagatgctcagattccgacggactagcacccccccaacacttgattcgagtggaagggaatctgagggtggagtatcttgacgatagaaatacatttcgtcacagcgttgtggtaccctacgaaccaccagaggtcggcagcgactgcactactatacattacaactatatgtgtaattccagttgtatgggaggcatgaatcgacgtccgatccttaccattataactctggaggattctagcggcaacttactaggacgcaatagcttcgaggtgagggtctgtgcatgccctggcagagacaggcgaaccgaagaggaaaacttgcgcaaaaagggcgagccccaccatgagttgccccccggatccaccaagcgagccttaccaaataacacctccagctcccctcaacctaagaagaagcctcttgacggcgagtactttacactgcaaattcggggccgcgagcgtttcgagatgtttcgcgaactcaatgaggcactggaattgaaggacgcccaggccgggaaagagccaggcgggtctagggctcactcaagccacctgaaatcaaaaaaaggacagagtactagcaggcataaaaagttaatgttcaaaactgaggggccggatagtgac

SEQ ID NO: 20490 - DNA, 1179 bp, Artificial Sequence
  Description of Artificial Sequence: Synthetic coding sequence
atggaggaaccgcagtcggacccatccgtcgagccccctttgtcccaggaaactttttcggatctttggaagttgctgcccgagaacaacgtccttagcccactgccgagccaagctatggatgatctgatgctgtcgccggatgacatcgagcaatggttcacagaggatcccggtcccgacgaagcgccccggatgccggaagctgccccccccgtcgcaccagctcccgctgctcctacccccgccgcccccgcccctgccccgtcttggccgctcagcagctccgtgccctcgcagaagacgtaccagggctcgtatggtttcagactaggttttcttcactccggaaccgccaagtcagttacttgcacttactcacctgcgctgaacaagatgttttgccagctggccaaaacctgtcctgtgcagctgtgggttgacagtacgcccccccctggaacccgcgtccgcgccatggcgatttacaagcagagccaacacatgaccgaggtggtacgtcgctgtccacaccatgaacgatgtagcgactccgatggtttggcgccaccccagcacctcatccgagtcgagggaaacctccgcgtggaatacctggacgaccggaatactttccgccactctgttgtcgtgccctacgagccgccggaagttggcagcgattgtaccaccatccactacaactacatgtgtaatagttcctgcatgggaggcatgaatcgccggcccattcttaccatcatcaccttggaggattcttccggtaatctacttggacgtaattctttcgaggtgcgagtctgcgcatgtcccggacgcgatcgtcgtacggaggaggagaacttgcggaagaagggagagccccaccatgagttgccacctggttccaccaagcgcgctttacccaacaacacgtcttcgtcgccccagccgaagaagaagccattggacggcgagtacttcacccttcaaatccgtggacgtgaacgcttcgaaatgtttcgtgagttgaacgaggctctggaattgaaggatgctcaggcgggtaaagaacccggcggtagtcgcgctcattcatcccacctcaagtccaagaagggccagagtacgtctcgccacaagaagctaatgtttaagaccgaggggcctgacagcgat

SEQ ID NO: 20491 - DNA, 1179 bp, Artificial Sequence
  Description of Artificial Sequence: Synthetic coding sequence
atggaagagccacagtcggatccttccgtggaaccaccgctttcccaggagacttttagcgacctgtggaaacttcttcctgagaacaatgtgcttagccctctcccttcgcaggccatggatgacctgatgctttcacctgatgatattgagcagtggtttactgaggaccctggtcctgatgaagcgccaagaatgccagaggcagcacctcctgtcgcaccagcacctgcagccccaaccccggctgcaccggcgcccgcaccttcgtggcctctctcctcttcagtgccatcgcagaaaacctaccaaggaagctacggttttagactgggattcctgcattccgggaccgcaaagtccgtgacctgcacgtactcccctgcgctgaacaaaatgttttgccaactggcaaagacctgccctgtgcagttgtgggtggatagcaccccaccaccaggcactcgcgtgcgtgcaatggccatctacaagcaatcgcagcatatgactgaagtggtgcgtcggtgtcctcaccatgagagatgttcagactcagatggcctcgctccaccacaacatcttatacgggtcgaaggaaacctgagagtcgagtaccttgacgaccggaacacttttcgccattcggttgtggtgccctacgaaccgccagaagtgggtagcgattgcaccactatccactacaactacatgtgcaactcctcctgcatgggcggaatgaatcgccgtcctatccttaccattatcaccctcgaagattcctcgggaaacctgcttggtcggaactccttcgaagtgcgagtgtgcgcgtgtccaggtcgtgaccgcaggactgaagaagaaaacctgcgcaagaagggagaaccacatcacgaactgcctcctggatcaactaagagagcactgcccaacaatacttcaagctcacctcaacctaaaaagaagcctcttgacggagagtactttacgcttcaaattcgaggaagggaacgctttgaaatgtttcgcgaattgaacgaggccttggagctgaaggatgcccaagcaggcaaggaacctgggggctcacgagcccacagctcacatttgaagagcaagaaaggacaaagcacgtcaaggcataagaagctgatgttcaagaccgaaggtccggattcagat

SEQ ID NO: 20492 - DNA, 1179 bp, Artificial Sequence
  Description of Artificial Sequence: Synthetic coding sequence
atggaagaaccgcaaagcgaccccagcgtggaacctccgctgagtcaggaaactttctccgatctctggaagttgctgcctgagaacaacgtgctcagcccgctgccttcccaagcaatggacgatcttatgctgagcccggatgatatcgagcagtggttcactgaggacccaggccctgatgaggcaccacggatgcctgaggctgctcctccggtggcgccggccccagccgcgccaaccccagctgctccagcccccgccccgtcctggcctctgtccagctcagtgccatcgcaaaagacttaccagggatcctacgggtttaggctcggctttcttcactcagggactgccaagtccgtgacctgcacctatagcccggcgctgaacaaaatgttctgtcagctggcgaaaacttgtccggtccagctgtgggtcgacagcacccctccaccgggcactagggtgagggccatggcaatctacaagcaatcccagcatatgacggaagttgtgaggagatgcccgcatcacgagcggtgctccgacagcgacggcctggcgcctccgcagcacctcattcgggttgagggaaatctccgcgtggagtaccttgacgacaggaacaccttcaggcactctgtggtggtgccttacgaaccgccggaagtaggttccgattgtactaccattcactacaactacatgtgcaactcctcttgcatgggtggaatgaaccggcgccccattctgactattatcaccttggaggatagcagcggcaacctgctgggtcgcaattcatttgaagtcagagtgtgcgcatgccccggacgcgaccggcgcactgaggaggaaaacctccggaagaaaggagaaccacaccatgaactcccaccagggtccaccaagcgggctctcccgaacaatacgtcctcgagcccgcagcccaagaaaaagccgctcgacggggagtacttcaccctgcaaatccggggtagggagcgcttcgaaatgttccgggagctgaatgaagctctggagcttaaggacgcccaggcgggaaaggagccaggcggatccagagcccattcgtcgcacctgaagagcaagaagggccaaagcacctcacggcacaaaaagctcatgttcaaaaccgaaggaccggactccgac

SEQ ID NO: 20493 - DNA, 1179 bp, Artificial Sequence
  Description of Artificial Sequence: Synthetic coding sequence
atggaagaaccgcagagcgacccatctgttgaaccgccacttagtcaggagactttctcagacctctggaaacttctccccgaaaacaatgtcctgtcgccccttccaagtcaggccatggacgatttgatgctgagccccgacgatatcgaacagtggtttactgaggacccagggccggacgaagctccaagaatgcctgaagctgctccccccgtcgcaccagcacccgcggccccaaccccggctgcaccagcacccgctccatcctggcccctttccagctcagtgccgagccagaaaacttaccaggggtcctatggcttcagactcggcttcttgcacagtggtacagccaaatcagtgacatgcacctacagtccagctctcaacaagatgttttgccagctggccaagacttgccccgtgcagctgtgggttgattcaacaccccctcccggaacccgggtgcgggctatggccatctacaagcagagtcagcatatgaccgaggtcgtaagaaggtgtcctcaccacgagaggtgtagcgacagtgacgggctcgccccaccccagcatctgatcagagtagaaggtaatctgagagtggaataccttgacgatcggaacacattccggcatagtgtggtggtaccctatgaaccacctgaagttggctccgattgcaccaccatccactacaattatatgtgtaatagcagctgcatggggggaatgaatcgccgaccaatcctaacaatcattaccctcgaggattcgtccgggaacctgctgggccgtaactcattcgaggtacgcgtctgtgcatgccccggaagggaccggcgaaccgaagaggagaacttgcgtaagaaaggtgaacctcatcatgagctgcccccaggctccaccaaacgagccttacccaacaatacgtcctccagcccccagccaaagaagaaacctctggacggcgaatatttcacactccaaattagaggccgggagcgatttgagatgttccgcgagctgaacgaagccctcgagcttaaagatgcccaggctggtaaagagccgggcggaagccgcgcccactcttcacatcttaaaagcaagaaagggcagtccaccagtcgacacaagaaacttatgtttaaaactgaggggcccgactctgac

SEQ ID NO: 20494 - DNA, 1179 bp, Artificial Sequence
  Description of Artificial Sequence: Synthetic coding sequence
atggaagaacctcaatcggacccgagcgtcgagcccccactgtcccaggagacatttagcgacttgtggaagttgttgccagagaataacgttctgtcccccctgccgagccaggccatggacgacctgatgctctctccagatgatatcgaacagtggtttactgaggatccggggcccgatgaagcgccacggatgccggaggccgctccccccgtcgcgccagctcccgccgcacccacgcctgccgcccctgctcctgccccatcatggcctctgtctagttctgtcccctcacagaaaacatatcagggcagctacgggtttcgtctgggatttctgcactcaggaactgccaaaagcgtcacttgtacctactcaccggcgctgaataaaatgttttgccagctagctaagacatgcccagtgcagctgtgggtggattccaccccacccccagggacaagagtgcgcgccatggccatatataagcagtctcagcacatgaccgaggtagtacggcgatgcccacaccacgagcgatgcagtgactcagacggattggccccaccacagcatctcatccgtgtggaggggaacttgcgggtcgaatatctggacgacagaaacaccttcaggcattctgttgtggtgccgtacgaacctcccgaggttgggagcgattgtactacgatccattacaattacatgtgcaactccagctgtatgggtggaatgaataggcgcccaattctgactattattacactggaggactcctccgggaatctcttgggcaggaactcttttgaagtccgagtgtgtgcctgtcccggccgagacaggcgaaccgaagaggaaaacctgaggaaaaagggagaaccacatcatgagctaccgcctgggtctaccaagagggccctgcctaacaatacaagtagttctccacagcccaaaaagaaaccattggatggtgagtattttacgctgcagattcgaggtcgtgaacggttcgagatgtttagagagctaaatgaggctctggaactgaaggacgcccaggctggaaaggaaccgggcgggtccagggcccatagctcccatctcaagtctaaaaaggggcaatctacttcccgccacaaaaaactcatgtttaagaccgaagggccagacagtgac

SEQ ID NO: 20495 - DNA, 1179 bp, Artificial Sequence
  Description of Artificial Sequence: Synthetic coding sequence
atggaagaacctcagtcggacccatcggtcgaaccgccgctctcgcaggagactttctccgacctgtggaaactgctgccggagaataacgtcctgagcccactgccgtcacaggcaatggacgatctgatgctttctccggacgatatcgagcagtggtttaccgaggaccctgggccagacgaggccccgcgcatgccggaagccgcacctccggtggcacctgcgcccgccgcacccaccccagccgcacccgcgccggccccttcgtggccattgtcctcttcggtcccatcgcaaaaaacttaccagggatcatacggattccgcctgggattcctgcactcagggacggccaagtccgtgacctgcacctactcgccggccctgaataagatgttctgccagttggctaagacttgtccagtgcaactctgggtggatagcacgcctccgcctggaactcgggtccgagctatggctatttacaaacaatcacagcatatgaccgaggtggtcagaaggtgcccacaccacgagaggtgctccgactccgatggccttgcgccccctcaacatctgatccgcgtggaaggaaacttgcgcgtggaatatctcgatgatcgtaacactttcagacattcagttgtggtgccatacgaaccgccagaagtgggtagtgactgcactaccattcactacaattacatgtgcaactccagctgtatgggcggaatgaacagacgcccgatcctgaccatcatcactctcgaggacagcagcggtaacctccttggccgcaatagctttgaggtccgcgtgtgcgcgtgtcccggaagagatcggcggacggaggaagaaaacctccggaaaaagggagagccgcaccacgaactcccgcctgggtcgaccaagcgggcgctcccgaacaacacctcctcctcaccgcaaccaaagaagaagccgctggacggtgaatactttactctgcagatcagaggccgcgaacgcttcgaaatgttccgggagctgaatgaagcgttggagctgaaagacgctcaggccggaaaggaacccggaggctcgagggcccacagctcccatctcaaatcaaagaagggacaatccacctcgcggcataagaagctgatgttcaagactgagggcccggatagcgac

SEQ ID NO: 20496 - DNA, 1179 bp, Artificial Sequence
  Description of Artificial Sequence: Synthetic coding sequence
atggaagagccccagagcgatccttccgtggaaccgccactgtcccaggagactttttcagatctgtggaaactgctccctgagaacaatgtgttgtcgccgctgccgtcgcaggccatggacgacttgatgctttccccggacgatattgaacagtggttcaccgaggatccaggcccagacgaggcgccgcgaatgcccgaagcagcaccgcctgtggccccggcaccagccgccccaaccccagccgcccccgcgcccgctccgtcctggcctctgagcagcagcgtgccaagccaaaagacctaccagggttcatacggatttagactcggctttcttcacagcggaacggcaaaatccgtgacctgcacttactccccggcgctgaacaagatgttttgccagttggccaagacgtgcccggttcaactttgggtcgacagcacccctccaccaggaactagagtgcgcgcgatggcgatctacaagcagtcgcagcacatgaccgaagtggtgcgccggtgcccacatcatgaaagatgttcagactcagacggactcgccccaccgcaacatctgatcagagtggaaggaaatctgagggttgaatacctggatgatcggaacaccttccggcactcggtcgtggttccctacgaaccgccggaagtgggatccgactgcactaccatccattacaactacatgtgcaactccagctgcatgggcgggatgaacagacggcctatcctgaccatcataactcttgaagattcgtcaggcaatttgttgggccggaactcgttcgaggtccgggtgtgcgcttgtccgggacgcgaccggcggactgaggaagagaacctgagaaaaaagggcgagccgcaccatgagctgccgcccggatctaccaagcgagctctgccaaacaacaccagctcgtcaccacagcctaagaaaaaaccgcttgacggtgaatacttcaccctgcagatccgcggacgtgagcggttcgagatgttcagggaactgaacgaagcgctggagttgaaagacgcccaagccggcaaggagccgggaggtagcagggcccattcttcccatctcaagtccaaaaagggccaatcaacttcgcggcacaagaagctgatgttcaagaccgaaggcccggactccgac

SEQ ID NO: 20497 - DNA, 1179 bp, Artificial Sequence
  Description of Artificial Sequence: Synthetic coding sequence
atggaggaaccacagagcgacccctccgtggagcctccgctgtcgcaagaaacgttcagcgatctgtggaagctcctgccggaaaataacgtgctgtccccgctgccttcccaggccatggatgatctcatgctgtcacccgacgacatcgaacagtggttcactgaagacccagggcccgacgaagcaccccgcatgccagaggcggccccaccggtggccccagcaccagcggccccaacgccggccgccccggcgcctgcgccgtcctggccgctgtcgtcgagcgtgccgtcccagaagacctaccaaggatcatacggatttagactgggattcttgcattcaggaaccgctaagtcggtcacgtgtacctactcgcctgcattgaacaagatgttctgccagctcgccaagacttgcccggtgcagctgtgggtggattcgactccgccaccgggaaccagagtgagggctatggccatctacaagcagtcgcagcacatgactgaggtggtgcgccgatgcccacatcacgaacgctgctcggattccgacggacttgccccaccgcaacacctgatccgcgttgaagggaatctgcgggtcgagtacctggatgacagaaatactttccgccactcagtggtggtgccgtacgaacctccggaagtgggatcggactgcacgactatccactacaattacatgtgtaactcgtcgtgtatgggcgggatgaatcggcgcccgatcctgactatcatcactctggaagacagcagcggaaacctcctcggacgcaattcattcgaagtccgcgtttgcgcgtgtcccggaagggaccgccggactgaggaggagaatttgcggaagaaaggagagccacaccacgagctgccgcctggctcaacgaaaagagcactgccgaacaacacctcgagctcaccacagccaaaaaagaagccgctcgatggtgaatacttcactcttcaaatccgtggccgcgagcgcttcgaaatgttccgggaactgaatgaggcgctggagctcaaggacgcgcaggccggcaaagaaccgggcggaagcagagcccactcttcgcatttgaaaagcaagaaaggccagtccacgtccaggcataagaaacttatgtttaagaccgaaggaccagactcagac

SEQ ID NO: 20498 - DNA, 1179 bp, Artificial Sequence
  Description of Artificial Sequence: Synthetic coding sequence
atggaagagcctcagagtgatcccagtgttgagccccccttgtcccaggaaacgttctctgatctttggaagctgcttccggaaaacaacgttctgtccccccttccatcccaggccatggacgatcttatgctgagcccagacgacattgaacagtggttcaccgaggacccagggcctgacgaggctccccggatgcccgaagccgccccccccgtggcgccagccccagctgcgcccacacctgccgcgcctgcacccgcaccttcctggcctctgtcctctagcgtgccatcacagaagacctatcagggatcttatggctttcgactgggctttctgcatagcgggacagcgaaatctgtgacctgtacctatagccccgctttgaacaaaatgttctgccaactggccaagacatgcccagtacaactgtgggtggacagcactccaccacctggaaccagggtgcgggctatggctatctataagcaaagtcaacacatgaccgaagtcgtccgccgatgccctcaccacgaacgctgtagcgattctgacgggctcgcaccaccccaacatctgatcagagtggaagggaaccttagggtggaataccttgacgaccgaaatacgttccgccactctgtggtagtcccatatgagcctcccgaggtgggatctgactgtaccaccatccactataactatatgtgtaatagctcctgcatgggaggcatgaatagacgtcccattctcacaattataactctcgaagatagcagcggaaatctcctagggcggaactcattcgaggtgagggtgtgtgcctgccctggccgggaccgcaggactgaggaggaaaatctgcggaagaaaggggaaccacatcatgagttaccacccggtagcactaagcgagccttgcccaataatacttccagcagcccacagcctaagaaaaaacctttggacggcgaatacttcacgctgcaaatccggggtcgagagcggttcgagatgttcagggagctgaatgaagcgcttgaattgaaggacgctcaagcaggaaaagagcccggtggcagtcgcgctcattcctcgcacttgaagtcaaagaagggccagtcaacatcaagacataagaagctcatgtttaaaaccgaagggcccgatagcgac

SEQ ID NO: 20499 - DNA, 1179 bp, Artificial Sequence
  Description of Artificial Sequence: Synthetic coding sequence
atggaagagcctcagtcagacccctcagtggagcctcctctttcacaggagactttttcagacctttggaaattgctccccgagaacaacgtgctgtcgcctcttccttcccaagccatggatgatcttatgctttccccagatgatattgaacagtggtttaccgaggacccaggtccggatgaggccccccgaatgcctgaggctgctcctccggtggctccagcacctgcggctcccacgccggcagcaccggccccggcaccatcgtggcctctctcatcaagcgtgccatcacagaaaacttaccaaggtagctatggctttcggctcgggttcctgcactctggaaccgcaaaatccgtcacctgcacgtattcgccagcgcttaacaagatgttttgtcagctcgcaaaaacctgtccagtgcaactgtgggtcgacagcactccccctccaggtactagagtccgggcaatggcaatttacaaacaatcgcaacacatgaccgaagtggtgcggaggtgtccccatcatgagagatgctcggactccgatgggcttgccccgccccaacatctcataagggtggagggaaaccttcgggtcgaatacctcgatgatcgtaacaccttcaggcactctgtggtggttccctatgaaccgcctgaggtcgggtcagattgtactactattcattacaactacatgtgtaattccagctgtatggggggaatgaacaggcgccccatcttgaccattatcactctcgaagattcaagcgggaatttgctcggaagaaactcgttcgaagtccgcgtgtgtgcatgtcccggtcgcgatcgcaggaccgaagaagaaaacctcagaaagaagggggagccacatcatgaattgccccctggttccaccaagcgagcgctgcctaacaacacttccagcagcccacaacctaagaagaagcctctcgacggcgagtactttacgcttcagatccgcggcagggagagattcgaaatgtttagagagctgaatgaagcccttgaactgaaggacgcacaagcaggtaaggaacctgggggaagccgagcgcatagcagccatctgaagtccaagaagggacaatccacgtccagacacaaaaaacttatgtttaagaccgaaggtccagatagcgac

SEQ ID NO: 20500 - DNA, 1179 bp, Artificial Sequence
  Description of Artificial Sequence: Synthetic coding sequence
atggaggaaccacagagtgatccctctgtagagccaccattgagccaggaaaccttttcagacctctggaagctgctccccgagaacaatgtgctgtcgcctctgccctcgcaggcaatggacgacctgatgttgtctcctgatgacatagaacagtggtttacagaggaccctggccctgacgaagccccccggatgcctgaggctgcgcccccagttgcccccgctcctgctgccccaacgccagccgctcccgcgcctgctcccagctggcccctctccagctctgtgccctcccaaaagacttaccaaggtagttatggattcaggctcggctttttgcacagtggaacggctaaatcggtgacgtgcacttacagccccgctctaaataaaatgttttgccagctggctaagacatgtccagtgcagctgtgggttgatagcacacccccacctggcacacgcgtaagggccatggcaatttataaacaatcacagcacatgacagaagtggttaggaggtgtccccatcacgagcgttgttccgattcagacggtttggctccacctcaacatctgatccgagtggagggcaatctaagagtggaatacctggatgatcgcaatacatttcggcattccgtcgtggtgccctatgaaccgcccgaggtggggtccgattgtaccacgatacattacaactacatgtgcaattcgtcctgcatgggtggtatgaataggcgacccatcctgaccataatcactctggaagactcctcaggaaatctgctcggtcgaaactcatttgaagtccgcgtgtgcgcttgtccggggcgcgatcgccggaccgaagaagagaatctgaggaaaaagggggaaccccatcatgaacttccaccgggcagtaccaaacgggcactacccaacaataccagttcttcaccacagccgaagaagaagccactcgacggggaatacttcaccctccaaattagaggacgagaacggtttgagatgttccgggaactgaacgaagctctggaactgaaggacgcacaggctggcaaagaacccggggggagtcgcgcccactctagccatctgaaaagcaagaaggggcagagcacatcacgccacaagaagttaatgtttaagacagaagggcctgacagtgac

SEQ ID NO: 20501 - DNA, 1179 bp, Artificial Sequence
  Description of Artificial Sequence: Synthetic coding sequence
atggaagaacctcagtcagatccctctgtcgagccccccctaagtcaggagacctttagcgatctgtggaagctcctacctgaaaacaatgtcctatctccactgcctagtcaggccatggatgatctcatgttgtctccagatgacattgagcagtggttcacggaggatcccggacctgatgaagccccacgaatgccagaagctgcccctcccgtggccccagcccccgccgcacctaccccagctgcacccgccccggctcccagctggccactgtcctcttcggtgccttctcaaaagacctaccaagggtcatatggcttccgactgggctttctccatagcggaaccgccaagtccgtgacttgtacctattctccggcactcaacaagatgttttgccaactagctaagacctgccccgtgcagctctgggtggacagtacccctccacccggaacacgagtgcgggcaatggcaatatacaaacaaagtcagcacatgaccgaagttgtacggcgttgcccgcatcatgagaggtgcagcgattctgacggacttgcccctccgcagcatcttatccgagtggagggcaatctacgagttgagtatctggacgacagaaacacctttaggcactcagtggtggttccatatgagccgccggaagtgggttccgactgcactaccatccactacaattacatgtgtaacagctcctgcatgggaggaatgaatcgacgaccaattctgactatcatcaccctcgaagattctagcggaaatctcctcggccgaaattcctttgaagtgagggtgtgtgcctgccctgggcgagataggcgcaccgaagaggaaaatctgaggaagaaaggtgaaccccaccatgaactgccccccggttccactaagagagcgctccctaataatacgtccagctcaccacagccaaaaaaaaagccactggatggggaatatttcaccctgcaaataagaggacgggagcgttttgagatgttccgcgaacttaacgaggcactcgaactcaaggatgcacaggccggcaaggaacctgggggatctagagcacacagcagccaccttaagtcgaaaaaaggacaatcaacatcccggcacaaaaagctcatgttcaaaacggaaggcccggattccgac

SEQ ID NO: 20502 - DNA, 1179 bp, Artificial Sequence
  Description of Artificial Sequence: Synthetic coding sequence
atggaggagcctcaatcagatccgtcggtcgagcctcctctgagccaagaaaccttcagcgacctttggaaactcctccctgagaataacgtgctttccccccttccgtcgcaggcaatggacgatctgatgctctcccctgatgatatcgaacagtggtttactgaggacccaggccctgatgaggcccctagaatgccagaagccgcacctccagtggcacccgcacctgcagcgcctacccccgcagcaccagctccagcaccgtcgtggcctctttcatccagcgtgccatcgcaaaaaacttaccaaggctcatacggcttcagactcggattcttgcattcgggaactgcaaaatcggtgacttgtacttactcccctgcgcttaacaagatgttttgtcaacttgcaaaaacctgtccagtgcagctgtgggtcgattccactccgccgcccggaacccgggtgagggcaatggcgatttacaagcaatcgcaacatatgaccgaggtggtgagacgctgcccccatcacgaacggtgtagcgattcggatggtctggcaccaccccaacatctcatcagagtggaagggaatctgcgtgtcgaatatcttgacgatagaaatacctttcggcatagcgtggtggtgccatatgagccacctgaagtgggcagcgattgcacgaccatccattacaactacatgtgcaattccagctgcatgggaggcatgaatcgtaggcctatccttactattatcacccttgaagattcatccggaaaccttctgggtagaaacagcttcgaagtgagagtgtgcgcctgcccaggaagagatcgccgcactgaggaagagaaccttcgcaaaaaaggagaacctcatcacgaactgccacctgggagcaccaagcgggcccttccaaacaacacttcgtctagccctcaacctaagaaaaagccactggatggtgagtactttaccctgcagattcgaggtcgggagcggtttgagatgtttcgggagctcaacgaggctctcgaattgaaggacgcacaagcaggcaaagaacccggtgggtcgcgggcacactcatcgcatcttaagtcgaagaaaggccaatcaacttccagacacaaaaagctcatgtttaagactgaaggacctgactccgat

SEQ ID NO: 20503 - DNA, 1179 bp, Artificial Sequence
  Description of Artificial Sequence: Synthetic coding sequence
atggaagagccacagtcggaccctagcgtggagccacctctcagccaagagaccttttccgacttgtggaaactgttgcctgaaaacaatgtgctaagtccccttccgtctcaggccatggacgacctcatgctgtctccagacgacatcgagcaatggtttacagaggacccagggcccgacgaggcgcccaggatgccggaggctgcccccccagtggcccctgcccccgccgcccccacaccagctgctccggctccggccccttcctggcccctctcaagctccgtaccctcacagaagacttatcagggaagctacgggttccgccttggcttcttgcatagcgggaccgccaaatcagtaacttgcacatatagccccgctttgaacaagatgttctgccaattagccaagacctgtccagtgcagctgtgggtggacagcacgccacctcctgggaccagggtgagggcaatggccatttacaaacaatctcagcatatgacggaggtggttcggaggtgcccacatcacgagaggtgtagcgacagcgatggcttggctccgccacagcatctaatcagggtcgagggtaaccttcgcgttgaatacctcgacgaccgcaatacattccggcactccgttgtggtgccttatgaacctcctgaggtgggatctgattgcacaaccatccactacaattacatgtgtaactcaagctgcatgggcgggatgaatagaagaccaatacttacaataatcactctggaggactcctcggggaacctcttggggaggaatagcttcgaggtcagggtttgtgcctgtccgggcagagaccgcagaacagaggaagagaatctgcgtaaaaaaggcgagccccatcacgaattaccacctggctccacgaaaagggccctccctaataacacctcatcttccccacagcccaagaaaaaaccgctggacggggagtattttaccctgcagatcagaggaagagaacggttcgagatgtttcgggaacttaacgaggcacttgaactcaaggatgctcaggcagggaaagagcctgggggatccagggcccactccagtcaccttaaatctaaaaaaggccagtctacctctaggcacaagaaactgatgtttaaaactgaaggaccagacagcgat

SEQ ID NO: 20504 - DNA, 1179 bp, Artificial Sequence
  Description of Artificial Sequence: Synthetic coding sequence
atggaggaaccacagtccgatccatccgtggaacccccgttgtcccaggaaacttttagcgacctgtggaagctgctgcctgagaataacgtgttgtctcctctgccaagtcaagctatggatgacctgatgctttcccccgacgatattgagcaatggtttaccgaagaccctggacccgacgaggccccccggatgcccgaagccgccccgcccgtagcccctgcccctgcagcccccactccggccgctccagctcccgcacccagctggccactgtccagttccgtcccgtctcagaagacctaccaggggtcttatggctttcggctgggattcctgcattctggcactgcgaaaagtgtgacctgcacttactctcccgcccttaataagatgttttgtcagctggcaaaaacgtgtcccgtgcagctctgggtagactccaccccccccccgggtacccgggttcgagcaatggcaatttataagcagtcacagcatatgaccgaggtagttcgtaggtgtccacaccacgaaaggtgctctgactctgatgggttggcgcccccgcagcacttgataagggttgagggaaatctgcgggtggagtatctcgacgataggaatacattccggcattctgtggtggttccctatgagcctccggaagttgggtcggactgtaccacaatccattacaactatatgtgcaactcctcctgcatgggaggtatgaatcggaggcctatcctcaccattattaccctcgaagacagctcaggtaatttgctggggaggaacagttttgaggtgcgtgtttgtgcctgcccagggcgcgacagacggacagaggaggaaaacctgcgaaaaaagggtgagccgcaccacgaactgcccccagggtcaaccaagcgagcgctgccaaataacacctctagctctccccagccgaagaagaaaccgctcgacggggagtatttcacattgcagatccggggcagagagcgatttgagatgtttcgggagctgaatgaggccctggaactgaaagatgcccaagccggcaaagaacctgggggcagtcgtgcgcatagttcccacttgaaaagcaaaaagggacagagcacttcaaggcacaagaaactaatgtttaagaccgagggtcccgacagcgat

SEQ ID NO: 20505 - DNA, 1179 bp, Artificial Sequence
  Description of Artificial Sequence: Synthetic coding sequence
atggaggagcctcagtccgatccaagcgttgaaccccctctgtcccaggaaacattttccgacctgtggaagctcttgcctgagaacaatgtactctcacctctgccctctcaggctatggacgacctgatgttgtcaccagatgatatcgagcagtggttcacagaagacccagggccggatgaggcacctagaatgccagaggccgccccgccagtagctcctgcaccagccgcccccacaccggcagcacctgcccccgccccatcctggcccctgagcagtagcgtgccctctcagaagacttaccaggggagctacgggtttaggctgggatttctgcattccggcaccgccaagagcgttacttgtacatacagccctgccctcaataagatgttctgtcaactggcaaagacctgcccggtgcaactttgggtggacagtacaccaccccccggaactcgagtgagggctatggctatctacaaacaatcacagcacatgaccgaggtcgttaggcggtgcccgcatcacgaaaggtgcagcgatagcgatggcctggcacctccacagcatctcatcagggtagaaggcaacctgcgagtcgagtatctcgacgaccggaataccttccgccattccgtggtggtgccctacgagcctcccgaggtgggcagtgattgtaccacaatccactataattacatgtgcaattcatcttgtatgggcggcatgaatagacggccgatcctgactatcatcacactcgaggacagctccgggaatttgcttgggaggaactcattcgaagtgcgcgtatgtgcttgccctgggagggacaggcgaaccgaagaggaaaaccttaggaagaagggggaaccccatcacgaacttccaccaggtagcactaaaagggccctccctaacaacacctccagtagtccgcagccgaagaagaagccactcgacggcgagtattttactctgcagatccgcggacgcgaaaggtttgagatgtttagagagctgaatgaagccctggagttgaaggacgcccaggctggaaaggaaccggggggcagcagggcccactcatcacacttgaagtcaaaaaagggtcagagcactagccggcacaagaaactgatgttcaagacggaaggtccagattcagac

SEQ ID NO: 20506 - DNA, 1179 bp, Artificial Sequence
  Description of Artificial Sequence: Synthetic coding sequence
atggaagagccccaaagtgatccatccgtggagcctcccctctctcaggaaacattttcagacctgtggaagttactaccagagaataatgtgctttcgcctcttccatcacaggctatggacgacctaatgttgagcccagacgatatcgaacaatggttcaccgaagatccaggccctgacgaggcaccgagaatgcccgaagccgcccccccagtggcccctgcgcccgccgctccaacacctgcggctcctgcccccgccccgagctggcccctgtctagttcggtgccgtcccagaaaacctaccaggggtcctacgggttccgcttggggttcctacattctggcactgcaaagtcagtgacatgtacctacagtcccgctcttaacaagatgttttgccagcttgcaaaaacctgtcccgtgcaattgtgggttgattctactcccccccctggcacacgcgtgcgtgcgatggcaatatacaagcaaagtcagcacatgacggaggttgttaggagatgtccgcaccacgaacggtgtagcgactctgatggactggccccgccacagcatctgatcagggtcgaggggaacctgcgtgttgagtatctcgacgaccggaatactttccgtcactctgtggtcgtaccatatgagccaccagaggtaggctccgattgtaccacgatccattacaactacatgtgtaatagctcttgtatgggtggaatgaataggagaccaattctgactatcatcacgctggaggattcgtcggggaatctcttaggacgaaactcttttgaagtccgtgtgtgtgcgtgccctggtcgcgatagacgtaccgaagaggagaatttgcgtaaaaaaggtgagccccatcacgagctcccccccggatccaccaaacgggcccttcccaacaatactagtagttctcctcagcccaaaaaaaaaccacttgacggggagtattttacgctgcagattagaggtcgggagcgtttcgagatgttccgggagctcaatgaagccctcgagctcaaggacgcccaggccggcaaggagcctgggggaagtagggctcatagttcccacctgaagtccaaaaaaggtcagtctacctcccgtcataaaaagctgatgtttaagacagaaggaccagattcggac

SEQ ID NO: 20507 - DNA, 1179 bp, Artificial Sequence
  Description of Artificial Sequence: Synthetic coding sequence
atggaggagccacagtctgaccccagcgtcgagcccccattgtcccaggaaacgttttctgatctctggaagttgctccccgaaaacaacgtgctgagtcccctcccctcacaggctatggacgacctgatgctttccccagatgatattgagcaatggttcaccgaggatcctggtcccgacgaggccccgaggatgccggaagctgcaccaccagtcgctcctgcaccagccgccccgacgccggcagctcctgctccagcgcccagctggcctctgtcctcatcagttccctctcagaaaacttatcaaggatcatacggcttcagactgggattcttgcattcaggaactgctaagtccgtgacctgcacatactcacccgctttgaataagatgttttgccagttggccaagacatgccctgttcagctctgggtggatagtacccctccccccggtacccgcgttagggccatggccatctacaagcagtcccagcacatgactgaggtagttagacgctgccctcaccacgagaggtgcagtgatagtgacggactcgcccccccacagcacctgatcagagttgaaggaaatttgagggtcgagtacttggacgacagaaatacattcagacactccgtagtcgttccttacgagcccccggaggtcggatctgactgtactacaattcactacaattatatgtgcaactcttcttgcatgggcggaatgaatagacgcccaatccttactatcattacgctggaggactcttcaggaaacctcctcggcagaaactctttcgaggtcagggtctgcgcctgccccggtcgcgaccgcagaactgaggaggagaacctgaggaaaaagggtgagcctcaccacgagctgcctccgggttcaacgaagagggctttgccgaacaacacctcttccagcccgcaacccaaaaagaagcccctggacggtgaatacttcaccctgcaaattaggggtagggagaggttcgagatgttcagggaattgaatgaagccttggaactgaaagacgctcaggcaggcaaggaaccaggaggttccagggcacattcttcacaccttaaatctaagaagggccagagcacaagccgccataagaagctgatgtttaagacggagggtccggacagtgac

SEQ ID NO: 20508 - DNA, 1179 bp, Artificial Sequence
  Description of Artificial Sequence: Synthetic coding sequence
atggaagaacctcaatcggacccatcagtcgaaccacccctgagccaggaaacctttagcgatctctggaagttgctgcctgagaataatgtgctgtcgcctctgccaagccaggcaatggacgaccttatgctgagtcctgatgacatcgaacaatggttcactgaggacccaggacctgacgaggccccacgaatgcccgaagcagcaccgccggtggcccctgctccggcagcccccactcccgcggcccccgccccagctccctcctggcctctttcctcaagtgtgccatcgcaaaagacttaccagggctcatatggttttcggcttggattcctccactccggaacggcaaaatccgtgacgtgtacttactcaccggcactgaacaagatgttctgtcaactggcaaaaacttgtcccgtgcagctctgggtcgattcgactcctccgcccggcacccgggtcagagcaatggcaatctacaaacagtcccaacacatgactgaagtcgttagacggtgtccccatcacgaaagatgctcggatagcgatggtttggcacctccacaacacctcatcagagtggaggggaaccttcgtgtggaatacctcgatgatcggaacacctttcggcattccgtggtggtcccttacgaaccacccgaggtgggatctgactgtactactatacattacaattacatgtgcaacagctcctgtatgggaggcatgaacaggaggccaattctcaccatcattacgctcgaagatagctccggaaaccttctcggaagaaacagctttgaagtgcgtgtgtgcgcatgcccaggacgggacagaagaaccgaggaagagaatcttcgaaagaaaggcgagccacatcacgaacttccacctgggtcgaccaagcgagcccttcctaacaacacttcctcgtcccctcagccaaagaagaagccgttggatggagagtactttacgctgcaaataagaggcagagaacgatttgaaatgtttcgagaactcaacgaagcactggagctgaaagatgcacaggcgggcaaggagcccggaggatcgcgtgcacatagctcccacttgaaaagcaagaagggacaatcgacctcccggcacaagaagttgatgtttaagaccgaaggacctgattctgat

SEQ ID NO: 20509 - DNA, 1179 bp, Artificial Sequence
  Description of Artificial Sequence: Synthetic coding sequence
atggaagagcctcagtctgatccatcggtggaacctccacttagccaggaaacgttctcggatctttggaaactccttcccgagaataatgtgctgtcgccccttccttcccaagcaatggacgatctcatgctctcacctgacgatattgaacaatggtttactgaggacccaggaccagacgaggcacctcgaatgcccgaggcggcacctcccgttgcaccagcgcctgctgcgcctactccagcagcacctgcacctgcaccctcgtggcctctctcatccagcgtccctagccagaaaacttatcagggctcctacgggtttcgactcgggtttttgcattcaggaactgcaaaatccgtgacttgcacctactcgcccgcacttaacaaaatgttttgtcagctcgccaaaacctgtcctgtgcaactgtgggtggattcgactccccctcctggcactcgtgtcagagcaatggctatatacaagcagtcgcaacatatgactgaagtcgtgaggcgctgtccacaccacgaacgttgttcagattctgatggacttgccccaccacaacatctgatcagagtggaaggcaaccttagagtggagtacctggacgataggaacacctttaggcacagcgttgtggtgccatacgaaccaccggaggtcggctcggattgtactactatccattacaattacatgtgcaactcatcctgtatgggtggtatgaatagacggccgatcctgaccattatcactcttgaagattcgagcggaaacctgctgggccgaaactcgtttgaagtcagggtctgtgcgtgtcctggtcgagatagaagaacggaagaggagaaccttcggaagaaaggagaaccccatcatgagctgccacctggatccaccaagcgcgccctgcccaataacacctcttcgagcccgcaaccgaaaaagaagccgctggacggcgagtactttaccttgcaaatccgaggtcgggaaaggtttgagatgtttagggaactcaacgaagcactggaactgaaagacgcacaagcaggaaaggaacccggtggttccagagctcactcatcacatctgaagtcgaagaaaggacagtcaacctccagacacaagaaacttatgttcaagaccgaaggcccagattccgat

SEQ ID NO: 20510 - DNA, 1179 bp, Artificial Sequence
  Description of Artificial Sequence: Synthetic coding sequence
atggaagaacctcaatcggatccgagcgtggaacctcctttgagccaagaaaccttttccgatctgtggaagctcctcccagaaaacaacgtgctctcacccttgccatcgcaggccatggatgatctgatgttgtcgccagacgacatcgaacaatggtttacggaggatcccggcccagatgaagcccctcgtatgcctgaggccgcgccgcctgtggcccccgcaccagcagcccccactcctgcagccccggccccagcaccaagctggccactttcctcctccgtgccaagccagaaaacttaccagggttcgtatggttttcgacttgggtttctccactcgggcaccgcaaagtcggtgacttgtacttactccccggcactcaacaaaatgttttgtcaattggcaaagacttgtccagtccagctctgggtggatagcaccccaccgccaggtacgagagtgcgcgcgatggctatttacaagcagtcacaacacatgacggaggtcgtgcgaagatgcccacaccacgaacgatgttcagactccgacgggctggcaccaccacagcatcttattagagtcgaaggaaatctgagggtggaatatctggatgaccgaaacacctttcgtcattcagtggtggtcccttacgaacctcccgaggtgggctcagattgtactaccatacattacaactatatgtgcaactcgtcctgtatgggtggtatgaaccggcgacccattctgaccatcataacccttgaggactcaagcggaaaccttcttggtcggaactcctttgaagtgagagtgtgcgcatgcccaggaagggatagaaggaccgaagaagaaaatctccgcaagaagggcgagccccatcatgagcttccgcctgggtctactaagagggcactgccaaacaatacctcgagctccccacagccgaagaagaagcctctggatggagagtacttcactctgcagattagaggtcgcgagagatttgaaatgtttcgagaactgaatgaagcactggagcttaaagacgcacaagccggaaaagaacctggagggagcagagcccatagctcacatcttaagtccaagaaaggacaatcgactagccgtcataagaagctgatgttcaaaactgaaggcccggatagcgat

SEQ ID NO: 20511 - DNA, 1179 bp, Artificial Sequence
  Description of Artificial Sequence: Synthetic coding sequence
atggaagagccccaatctgacccgagcgtggaaccccctctatctcaggagacttttagtgatctgtggaagttgctgcccgagaacaatgtgctctccccgctccccagtcaggcaatggacgacttaatgttgagtcctgacgatattgagcagtggtttaccgaggaccccggtccggatgaagccccaagaatgcctgaggctgcgccccccgtggcccctgctccagccgcacctacgcccgccgccccagcaccggctccatcctggccactcagctctagtgtgcccagccagaagacctatcagggcagctatggattccggctcggctttcttcattcaggtacagccaagtcagtgacttgtacctattctccagcactgaataagatgttctgccagctagccaagacgtgccctgttcagttgtgggtggatagtactccccctcctggcactagagtgcgggctatggccatctacaagcagtcacagcacatgaccgaagtggtgcgaaggtgtccccaccatgagagatgttccgactcggacggcctcgctccgcctcagcatcttattagagtcgagggcaacctgcgcgtggagtatctggacgataggaatacttttcgccattcagtggtggtgccgtacgaaccgcccgaggtgggttctgattgtactaccattcactataattacatgtgcaatagcagttgtatgggaggtatgaatcgacgtccaattctgacaattatcacattggaagactcttctgggaatcttcttggaaggaactcttttgaggtcagagtctgtgcatgtccgggacgcgacaggaggaccgaggaggagaacctgcggaagaagggtgagccacaccacgagttgcctcccgggtccactaagagagctctccccaataacacgagttctagtcctcagcccaagaaaaagccactggacggagagtatttcaccctgcagatccgcgggcgtgaaaggttcgaaatgttccgcgaactaaatgaggccctagagcttaaagatgcccaggctggcaaagagcctggcggaagcagagcccattcctcacacttgaaatctaaaaaaggacagtcaacctcgagacacaaaaagctcatgttcaaaactgaagggcctgatagcgat

SEQ ID NO: 20512 - DNA, 1179 bp, Artificial Sequence
  Description of Artificial Sequence: Synthetic coding sequence
atggaagaaccacagtctgatccctcagtggaaccccccctgagtcaggagacattttctgatctatggaaactcctaccagagaataatgtgctatccccacttccttcccaggccatggatgatctaatgctttcacctgatgacattgaacagtggtttactgaagaccctgggcccgatgaagcccctcggatgcctgaagcagcaccaccagtggccccagctcctgctgctccaacacctgcggccccagccccggctcctagttggcctctatcctcgtccgtcccctctcagaaaacttatcaggggtcctacggatttaggctcggattcctccattctgggacagccaaatccgtcacatgcacatattctccagccctaaataaaatgttctgtcagctggccaaaacatgtcccgtgcagctctgggtcgatagtacaccccctcctggaactcgcgtgagagctatggctatatacaagcagagtcagcatatgactgaagttgtccgtagatgtcctcaccacgagcgatgctcggatagtgatggactcgcccccccccagcatcttattcgcgttgagggaaacctgagagtagagtatctagatgatagaaacacattccggcacagtgtggtagtgccgtatgaaccacctgaagtcgggagtgattgcactactattcattataattatatgtgtaactcaagttgcatgggggggatgaatcgccggccaattctcacaatcataactttagaggatagttcaggaaatctgctcggaagaaatagttttgaggtacgggtctgtgcgtgccctggacgagatagacggactgaggaagaaaaccttagaaaaaagggagaacctcatcacgaactgcccccaggatcaacaaaaagggctctcccaaataatacgtcatcctcaccacagcccaaaaagaaacctctcgatggagaatattttacgttgcagattagaggaagagaaaggtttgaaatgttccgcgagctcaatgaagcactggaacttaaagatgcccaggcggggaaggagccaggagggtcacgcgcacactcatcacatctaaaatctaaaaaaggacagtctacatctcggcataaaaaactcatgttcaaaactgaggggcccgattcagat

SEQ ID NO: 20513 - DNA, 1179 bp, Artificial Sequence
  Description of Artificial Sequence: Synthetic coding sequence
atggaggaaccacagagcgacccttctgtggagcctcccctgagccaagaaacctttagcgacctgtggaagcttctgccagaaaataacgtgttgtcgcctctgccttcacaggcaatggacgatctgatgctaagcccagacgacatcgagcagtggttcaccgaggaccctggccccgacgaagccccccgcatgcctgaagctgcaccccccgtggcccctgcccccgccgcaccgacccctgcggccccagcaccagctccttcttggccactctcatccagtgtaccaagccaaaagacctaccagggctcctatggattccggttggggttcctgcacagcggcaccgccaaatctgtgacttgtacatacagccctgcattgaacaagatgttctgtcagcttgctaaaacatgccccgtgcagttgtgggtggacagtacgcctccccctggaaccagagtccgagccatggcgatttacaaacaaagtcagcacatgacggaggtcgtgaggaggtgtccccaccatgagcgttgttcggatagtgacggccttgcccccccccaacatctgatcagggtggaagggaatctaagggtcgagtatctcgacgaccgaaacacttttaggcattcagtagtagtgccttatgagccccctgaagtgggcagtgattgtacaaccatccactataattacatgtgtaattcgagctgcatgggtgggatgaataggcggccgattcttactattatcacacttgaggattcttctggaaatctgctggggcggaattcgtttgaggtgcgagtctgcgcgtgccccggccgagaccgcaggactgaggaggaaaatctgcgtaagaagggcgagccccatcatgaacttcctcccgggtctaccaagagagccttgccgaacaacacaagctcctccccccaaccaaaaaaaaagcccctggatggcgagtacttcactttgcagatccggggtagagagcgatttgaaatgttcagggaacttaacgaggctctcgagctcaaggacgcccaggcaggaaaagagcccggtgggtccagggcgcacagtagccatctgaaatctaagaagggtcagagcacaagtcgtcataaaaagttgatgtttaagactgagggtcccgactcagat

SEQ ID NO: 20514 - DNA, 1179 bp, Artificial Sequence
  Description of Artificial Sequence: Synthetic coding sequence
atggaagaaccgcagagcgacccgtcggtcgagccaccgctctcccaagaaaccttctcggacctttggaagctcctcccggagaataatgttttgtctccgttgccgtcccaggctatggacgatctcatgctgtcccccgatgacatcgaacaatggttcactgaagatccaggaccagatgaagctcctagaatgccggaggccgcgccgcccgtggccccggctcccgccgctcccactcctgccgctcctgccccagcaccatcgtggccactctcgtcatcagtcccgtcgcaaaagacctaccagggatcctacggattccgccttggcttcctgcattcaggaaccgcaaaatctgtgacgtgcacctattccccagcactgaacaaaatgttttgtcagttggcaaagacctgcccggtgcagctgtgggtggactcgactccgcctccgggaacccgggttagagcaatggccatctacaaacaaagccagcatatgactgaggtggtccggcgctgtccacatcacgaacgttgcagcgactcagacggcctggcgcctccccagcacctgatcagagtggaaggaaatctgcgggtggagtacctggacgatcgcaataccttcagacattcggtggtcgtgccgtacgaaccaccagaagtgggaagcgattgcacgaccatccactacaattacatgtgtaacagctcatgcatggggggtatgaataggcggccgattcttactattatcactctggaagattcaagcggaaatttgctcggaaggaactcctttgaggtcagggtgtgcgcttgcccgggccgggaccgtcgaacggaagaggagaatctccgcaaaaagggggagccccaccatgagctgccccccggaagcactaagagggccctgcctaacaatacgtcgtcgagcccgcagccgaagaagaagcctctggacggcgaatacttcactctccaaataaggggacgagaaagattcgaaatgtttcgcgagcttaacgaggctctcgaactcaaagacgcccaagccggtaaggaaccggggggttcgagagcgcactcctcacaccttaaatcaaagaaggggcaatcaacctcccgccacaagaagctgatgttcaagaccgaaggaccagattcggac

SEQ ID NO: 20515 - DNA, 1179 bp, Artificial Sequence
  Description of Artificial Sequence: Synthetic coding sequence
atggaggagccacaaagcgacccctctgtggagccccccctttctcaagagaccttctcagacctttggaaactcttgccggagaataacgtgctgagcccattgccctcccaggccatggatgaccttatgctgtcccccgatgacattgagcagtggttcactgaggaccccggcccggacgaggcaccacgcatgcccgaggctgccccgcccgtcgccccggcacctgctgcaccaacgccggccgcccccgcacctgctccctcatggcccctcagtagtagcgtaccgtcccagaagacttaccaaggcagctatggttttagactcggctttctccacagtggaacggccaaatccgtcacatgcacatattcacccgcacttaacaagatgttctgccagctggctaagacttgtccggttcagctgtgggtggattccactccaccccctggaacacgggtgagagccatggccatatataaacagtcacagcatatgactgaggtagtcagaaggtgccctcaccacgaaagatgcagcgactccgatggtttggccccgccccaacatctcattagggtggagggcaacctgcgcgtcgaataccttgacgaccgaaacacgtttcgccacagtgtagttgtcccttatgagccccccgaggtgggatccgactgtaccaccatacactataactatatgtgcaatagttcatgcatgggcggtatgaacagacggcctatcctgaccatcatcaccctggaagattcaagcgggaatctgcttggacgcaatagctttgaggtccgggtgtgtgcctgtcctggaagggacaggagaaccgaagaagaaaatctgcggaaaaagggcgaaccacatcacgaactcccgccggggagtacgaaaagagcactcccgaataacacatcttccagcccccaaccgaaaaagaaacccctcgatggcgaatatttcacactgcagatcagagggcgcgagaggttcgaaatgttccgggaacttaatgaagccctcgagctgaaagatgcccaggccggaaaggagcctggagggtccagagcccatagctcacacctcaagtcaaaaaaaggacagagtacgagcagacacaaaaaattgatgtttaagactgaaggacctgactctgat

SEQ ID NO: 20516 - DNA, 1179 bp, Artificial Sequence
  Description of Artificial Sequence: Synthetic coding sequence
atggaagaaccccagagtgacccgtcagtcgagccaccgttatcacaagagactttttccgacctatggaagctgttgccagagaacaacgtgctgtcaccactcccaagccaagcaatggacgacctgatgctgagtcctgacgacattgagcagtggtttacagaggatccaggaccggacgaagcgccacgtatgcccgaggccgctccccccgttgcccccgcccccgctgcacctacacctgcggccccagcacccgccccctcttggcctctgtctagcagcgtgccatctcaaaaaacctaccaggggtcatacggtttcagactggggtttctgcactccggtacagctaaatcggtgacctgcacatactccccggccctgaataagatgttctgtcagctggctaagacatgtcccgttcagctatgggtagactcgactcctcctcctggcacccgcgtgagggcaatggccatctacaagcagtcacagcatatgaccgaggttgttcggaggtgtccgcaccatgaaaggtgctccgattccgacgggctcgcgcctccccaacacctaatacgcgtagaaggcaatctgcgggtagagtacctggatgatcggaacactttccggcactccgtggtagtgccttacgagcctcccgaggtgggcagtgactgtactactattcactataactacatgtgcaatagcagctgcatggggggaatgaacaggaggcccattcttaccattatcaccctggaggatagctctggtaacctgctcggacggaatagcttcgaggtgagggtgtgtgcttgccccggtcgtgatagacgcaccgaggaagagaatttgcgcaagaagggggagccgcatcatgaactaccacccgggtccaccaaaagggctctgcccaataatacttcaagttccccccaaccgaagaagaaaccattggacggcgagtattttaccctccaaatcagaggtagagagcgattcgaaatgttcagagagctgaatgaggccctggaactcaaagatgctcaagcagggaaggagcccggaggatcacgggcccactcttcccacttaaaaagcaaaaaggggcaatctacgtcacgccataagaaactcatgttcaagacggaggggcctgatagtgac

SEQ ID NO: 20517 - DNA, 1179 bp, Artificial Sequence
  Description of Artificial Sequence: Synthetic coding sequence
atggaggaaccccaatccgatccatcagtagagcccccgctgagccaagaaactttttccgatctttggaagctactccctgaaaataacgtcctttccccccttccaagccaagctatggacgacttgatgttgtcccctgacgacatcgagcaatggtttacagaagatcccggcccagacgaagctcccaggatgccagaagcagcccctccggtggcgccggcaccggccgctccaactcctgcggcccccgctccagcgccctcttggccgttgtcgtcctcagtcccgagccagaagacgtaccagggctcgtatggatttcgtcttggattcctacattctggaaccgccaaatccgtaacctgtacctattcgcctgcccttaataagatgttctgccagttggctaagacgtgtcctgtgcagctttgggtggacagcactcctccacctgggactcgggtacgtgctatggctatttacaagcagtctcagcacatgacagaggtcgttcggcgctgtccccatcacgaacgctgttcggattcggatggccttgccccaccccagcacctgatcagagtcgagggaaatctccgagtggaatatttggatgaccgaaacaccttccgtcatagtgtcgtggttccctacgagcctccagaggtgggtagcgactgcaccactatccattacaactacatgtgcaatagctcctgtatgggaggcatgaatcggagacccatacttacaatcatcactttagaggattcctctggtaacttgttgggccggaacagcttcgaagtgcgtgtgtgcgcgtgtccgggccgcgatcgtcgcacagaagaagagaatcttcggaagaagggggagccccaccatgagttgccacctggcagcacaaagcgagcgcttccgaataacacaagttcaagtccccaaccaaaaaaaaagcctcttgatggagagtacttcacgttgcagattagaggccgcgagcgcttcgagatgttccgggagctcaacgaagccctggagctaaaggacgctcaggcaggaaaggaacccggtggttcccgcgcccactcttcccatcttaagagcaagaagggccagtctacatctagacataagaagctgatgtttaagacagaaggacctgattcggat

SEQ ID NO: 20518 - DNA, 1179 bp, Artificial Sequence
  Description of Artificial Sequence: Synthetic coding sequence
atggaggagcctcagtccgatccttcggtggaaccacctctgtctcaagagactttttccgatctttggaaacttctgccagaaaacaacgtcctctcccctctgcctagccaagcaatggacgacttgatgctgtcgcctgatgatattgaacagtggtttaccgaggatccgggtcctgatgaagcccctagaatgcccgaggctgcgccccctgtggccccggcacccgccgcacccacccccgcagcgcccgcacctgccccatcctggcctctgtctagctcagtcccttcgcaaaaaacttaccaaggttcgtacgggttccgcctcggctttctgcattcgggaacggcgaaatcggtgacttgtacttactcgcctgcactgaataagatgttctgtcagcttgctaaaacttgtcctgtgcaattgtgggtggattcgactcccccaccagggacccgggtgagagcgatggcaatttacaagcagtctcaacacatgactgaagtggttagacggtgcccacaccatgaacggtgttcggatagcgatggtcttgcaccgccccagcatctgatccgcgtggaaggcaaccttcgcgtcgaatacctcgacgacagaaatacttttcgtcacagcgtggtggtgccatacgaacccccagaagtagggagcgactgtacgaccatccattacaattacatgtgtaacagctcgtgtatggggggaatgaacaggaggccaatattgaccattatcactctcgaagatagctcaggtaatcttctcggtcgcaactcgttcgaggtgcgggtgtgcgcctgcccagggcgggatcgccgcaccgaggaggagaatctcaggaaaaagggagaaccccaccatgagctcccacctgggtccacgaagagagcccttccgaataacacctcaagctcgccacagccaaaaaagaagccccttgatggtgaatactttacccttcagattagaggaagagagagatttgagatgttcagggaactcaacgaggcactggagcttaaggatgcacaggcaggaaaggaaccaggtgggtcgagagcacatagctcccaccttaagtccaagaagggtcagtcgacgagcagacacaagaagctcatgttcaagactgaaggtcctgatagcgat

SEQ ID NO: 20519 - DNA, 1179 bp, Artificial Sequence
  Description of Artificial Sequence: Synthetic coding sequence
atggaggaaccgcagtccgacccctcggtcgaacctcctctctcgcaggaaaccttctcggatctttggaaacttctgcccgaaaacaatgtcctgagccctctcccctcccaggcaatggatgaccttatgctttcaccggacgatatcgaacagtggttcaccgaagatcccggacctgacgaagcaccacggatgccagaggcagcgcctccggtggcccccgcaccggcggcccctactccagcagcacctgcaccagcaccttcttggccactgtcgtcgtccgtgccgtcacagaaaacctatcagggctcatacggttttagactgggattcctgcattcagggaccgccaagtcagtgacttgcacctactcccctgcactgaataagatgttttgtcagctggctaagacctgcccagtgcaactttgggtggactccacgccaccacctggcaccagggtgagggcaatggcgatctacaagcaatcccaacatatgaccgaagtggtccgtagatgccctcatcatgaacgttgctccgactcagatggacttgcacctccacaacatttgattagggtggaaggtaatctgcgcgtggagtacctggatgataggaatacttttcggcactcggtggtggtgccatacgaacctccagaagtgggcagcgattgtacgaccattcattacaactacatgtgtaattcaagctgtatgggaggtatgaatcgtagaccaatcctgaccatcataaccctggaagatagctcgggaaatcttctcggcagaaactcgtttgaagtgagagtctgtgcatgcccaggaagggacaggagaaccgaagaagaaaacctgcgcaagaagggtgaaccacatcacgagcttccaccaggtagcactaagcgggcgcttcctaacaacacctcctcctcaccacaaccaaagaaaaagcctcttgatggagaatactttactctgcaaatccgtgggagggagcggtttgagatgtttcgtgaacttaacgaagcacttgaactcaaggatgcacaagcaggaaaggagccgggaggttcgagggctcattcgtcgcatcttaagagcaaaaaaggacaaagcacttcacgccacaaaaagctcatgttcaaaaccgaggggcctgatagcgac

SEQ ID NO: 20520 - DNA, 1179 bp, Artificial Sequence
  Description of Artificial Sequence: Synthetic coding sequence
atggaagaacctcagagcgatccatccgtggagccgcctcttagccaggagacgttctccgacctctggaaactgctgccggaaaacaacgttctctcgcccctgccatcgcaggcgatggatgacctgatgctttcgccggatgatatcgaacaatggtttactgaggatccaggaccggatgaagccccacggatgcccgaagcggcaccgccagtggcgcccgctcctgccgcacccactccagcggcccctgctccggcacctagctggcctctcagctcatcggtcccgtctcagaaaacctaccagggttcctacggtttccgcctcggattcttgcactcaggaactgccaaatcagtgacctgtacttatagcccggcactgaacaagatgttctgccaactggcaaaaacgtgcccggtgcaactgtgggtggactccactccaccaccagggactcgcgtgcgggctatggccatctacaagcagtctcagcatatgactgaggtcgtccgccggtgcccgcaccatgaacgctgttcggatagcgatggactcgcgccgccgcaacatctcatccgcgtggagggaaatcttcgggtcgaataccttgacgacagaaatacgtttcgccattcggtggtggtgccctatgagcctcctgaagtcggatcagactgcaccactatccactacaactacatgtgcaactcatcctgcatgggaggaatgaaccgtcgaccaatcctgacgatcattacccttgaggactccagcggtaacctcctgggacgcaactcctttgaagtgagggtgtgcgcctgcccggggcgggaccggcgcactgaagaggagaacctgcgcaagaagggagaacctcatcacgagctgccaccgggttccaccaaacgggcactcccaaacaatacctcgagctcaccgcagccgaagaagaagccacttgacggagagtactttaccctgcagatcaggggtagagaaagattcgaaatgttccgggaactgaacgaagccttggaactgaaggatgcgcaggccgggaaggagccggggggttcccgggcgcacagctcccaccttaagtcaaagaaggggcaaagcacctcgcgccataagaagttgatgttcaaaactgaaggcccggacagcgat

SEQ ID NO: 20521 - DNA, 1179 bp, Artificial Sequence
  Description of Artificial Sequence: Synthetic coding sequence
atggaggaaccgcaatctgacccctccgtcgagccaccactgtcgcaagaaactttctcggacctgtggaagctgctgccggagaacaacgtcctctcgccgctcccaagccaggcgatggatgatctgatgctctcaccagatgacatcgagcagtggttcactgaggacccgggaccggatgaagcaccgaggatgccggaagcagccccgccagtggccccggccccggcagcccctacccccgctgccccggcccccgctccgagctggccgctgtcatccagcgtgccgtcccaaaagacttaccaaggctcatacggcttcaggcttggattcctgcactcgggcactgctaaatccgtaacgtgcacctacagcccagctctgaacaagatgttctgccagctggcgaaaacttgtccggtccagctgtgggtggactcaaccccgccgccgggcacccgcgtgcgggcaatggcgatctacaaacagtcgcaacatatgactgaggttgtcagaagatgtccccaccacgagcgctgttcagattcagatggactcgcaccgcctcagcacctgatcagagtggaaggtaaccttcgcgtggaataccttgacgatcgcaacactttcagacactcggtcgtggtcccgtatgagccgcccgaggtcggctctgattgcacgactatccactacaattacatgtgcaactcgtcatgcatgggcggtatgaatcggcggcccatcctgactatcatcaccctggaggacagctcggggaaccttctgggacgcaactcgttcgaggtgcgcgtgtgtgcctgccccgggcgcgacagacggaccgaagaagaaaatctcagaaagaaaggagaaccacatcatgaacttccgccgggttccaccaaacgcgcgctgccaaataacacctcctccagcccgcaacctaagaaaaaaccactggacggcgagtacttcactctgcagattcggggacgggagaggtttgaaatgttccgggagctgaacgaggcactggagctgaaggacgctcaagcaggtaaggaaccaggaggctcaagagcccactcttcgcacctgaagtccaagaaaggacagtccacctcacgccataagaagctgatgtttaagaccgaaggcccggattccgac

SEQ ID NO: 20522 - DNA, 1179 bp, Artificial Sequence
  Description of Artificial Sequence: Synthetic coding sequence
atggaggagccacaaagcgacccgtccgtggaaccaccgctctcgcaggagactttcagcgacttgtggaagttgctgccagaaaacaacgttctgtcgcctctgccctcgcaggccatggacgatcttatgctctcccctgacgatatcgagcagtggttcactgaagatccgggacctgatgaagcacctcggatgccagaagccgcacctccggtggctccggcgccggcagcgcctacgccagcagcccccgccccggccccttcatggcctttgtcgtcgtcagtcccctcgcaaaagacttatcagggatcctacggattcagactggggttcttgcactccggaaccgccaaatccgtgacgtgcacttactcgccggccctgaacaaaatgttttgccaactcgccaagacctgtccagtccagctctgggtggactccaccccgcctcctggaactcgggtccgcgcgatggctatctataagcagtcacagcacatgactgaagtggtgcgccgctgcccgcaccacgaaagatgttcagactccgatggactcgctccgccgcagcacctcatcagggtggagggaaacctgcgggttgagtacttggacgacaggaatacgttccgccatagcgtggtggtgccatacgagccacctgaagtcggtagcgattgcaccaccattcactacaactacatgtgcaactcttcgtgcatgggaggtatgaatcgacggccaatcctgacgatcatcaccttggaagattcttcaggaaacctcctggggcgcaatagcttcgaagtccgcgtctgcgcctgtccagggcgggatcgtagaacggaggaggagaacctccggaagaaaggcgagccgcaccacgagctgccgccgggatccaccaagcgcgcacttcctaacaatacctcctcatcgccgcagccgaagaaaaaacctttggacggagagtacttcactctccagatccgaggaagggaacgcttcgaaatgttccgcgagctgaatgaagcgcttgaactgaaagacgctcaggctggaaaggagccgggcggaagccgcgcccattcctcccacctcaagtcaaagaagggccaaagcacttcgagacacaaaaagctcatgtttaagactgaaggcccggattctgat

SEQ ID NO: 20523 - DNA, 1179 bp, Artificial Sequence
  Description of Artificial Sequence: Synthetic coding sequence
atggaagaaccccagtcagacccgtccgtcgagccccccctgtcccaggagacgttttccgacttgtggaaattgctcccagagaataacgttcttagcccactgccctctcaagccatggacgatctgatgttgtcccctgatgatatcgaacagtggtttaccgaggacccagggccggacgaggctccacggatgcctgaggccgcacccccggttgctcccgcgcccgcagccccgactccagccgcccctgccccagcgccttcttggccactgagtagcagcgttcccagccagaagacttaccagggatcctacggcttccgcttgggcttcttgcactcgggtacagcgaagtcagtgacctgcacttattcaccagcgctgaataagatgttttgccaattagcgaagacatgtcctgtacagctgtgggtggattctaccccgcctccgggaacaagggtccgagccatggccatctataaacagtcacagcacatgacggaggtcgtcaggaggtgcccacatcacgagaggtgttcggacagcgatgggctggccccaccacagcatttgataagggtagagggaaatcttcgcgtagaatatcttgacgaccgcaataccttcagacacagtgtggtggtgccttacgagcccccagaggtaggcagcgactgcactacgattcactataactacatgtgtaatagcagctgtatgggaggtatgaaccgacgaccgatcctgactatcataacccttgaggactcgtccgggaacctgcttggccgtaattctttcgaggtgagggtatgcgcatgtcctggccgggaccgccggacagaagaggagaacttaagaaagaagggagaaccccaccacgaactcccacctggcagcaccaaacgcgctttgcccaacaacacgtcatcatctccacagcctaagaaaaaaccccttgatggagagtacttcaccctccagatcaggggccgcgaacggtttgagatgttcagagagctgaatgaagcccttgaattgaaggatgcacaagccgggaaagaacccggcgggagtagagcccacagtagccaccttaagagcaaaaagggccaatctaccagcaggcataaaaaactgatgttcaaaactgagggcccagatagtgac

SEQ ID NO: 20524 - DNA, 1179 bp, Artificial Sequence; identical to SEQ ID NO: 20516
  Description of Artificial Sequence: Synthetic coding sequence

SEQ ID NO: 20525 - DNA, 1179 bp, Artificial Sequence
  Description of Artificial Sequence: Synthetic coding sequence
atggaggaaccacaatccgatccgtcggtggagccaccgctctcccaggaaaccttctcggatctgtggaagttgttgccggagaataacgtcctgtcgcctctgccttcgcaggctatggacgacctcatgctctccccagatgatatcgaacagtggttcactgaggaccctgggccggatgaggccccacgaatgcctgaagcggcaccgccagtcgccccagccccagctgcccccactccggccgctccggcccctgccccctcttggccgctgtcctcctcagtcccctcgcaaaagacctatcaaggttcctacggattccggctgggcttcttgcactcaggcaccgccaagtcggtgacttgcacttactccccggcactgaacaagatgttttgccagcttgcaaagacgtgcccggtccagctgtgggtggattccactccgccgccgggaacgagggtgagagcgatggctatctacaaacagtcacagcacatgacggaagtcgtgcgtcgctgcccgcaccatgagcggtgctcggacagcgacgggctcgctccgcctcagcatctgatcagagtggaaggaaaccttcgcgtagagtacctggacgaccgaaatactttcaggcactcagtggtcgtgccttacgagcccccggaagttggctccgactgtaccacgatccattacaactacatgtgcaatagcagctgcatggggggaatgaatcggcggcccatcctgactataatcaccttggaagattcctctggaaatctgcttggcagaaattccttcgaagtccgcgtgtgtgcatgtcctggccgcgaccggcgcaccgaagaagaaaatctgagaaagaagggagaaccgcaccatgaactgccgcctggtagcactaagagagcgcttccgaacaatacctcgtcctccccacagccaaagaagaagccactggatggcgaatacttcactctccagatcaggggacgggaacggttcgaaatgttcagggagctgaacgaggcactggaactgaaggatgcccaagcgggaaaggagcctggaggatcgcgggcacactcctctcaccttaagtcgaagaagggtcaatcgaccagccgccacaagaaacttatgttcaaaaccgagggaccggactcggat

SEQ ID NO: 20526 - DNA, 1179 bp, Artificial Sequence
  Description of Artificial Sequence: Synthetic coding sequence
atggaggaacctcaatcggatccgagcgtggaaccgcctctgtcacaggaaaccttcagcgacctctggaagctgttgccggagaataatgtgctgagcccactgccgtcccaagcaatggacgatctgatgctgagcccagatgacattgagcagtggtttaccgaggaccctggtcctgatgaagcacctcgaatgcctgaagctgcacctcccgttgcccccgcaccagcagctccaactcctgcggccccggcaccagccccctcgtggcctctttcctcttcagtcccttcgcaaaaaacttaccagggctcctatggatttcgccttgggttccttcatagcggcactgcaaagtcggtgacctgtacttacagccccgcgttgaacaagatgttctgtcagctggccaagacctgccctgtgcagctttgggtggactccaccccaccacctgggacccgagtgcgagcgatggcgatctacaagcagagccaacacatgaccgaagtggtgcggcggtgtcctcaccatgagagatgctcggactcggacggactcgcaccaccccaacatctgatccgagtggagggaaacctccgcgtggaatatctggatgatcgcaatacttttcggcatagcgtggtcgtcccctacgagcccccggaagtgggatcagattgtacgaccattcactataactacatgtgcaattcctcttgtatgggcgggatgaataggcgccctattcttaccataatcaccctggaagattctagcggaaaccttcttggtcgcaattcctttgaagtcagggtgtgtgcatgcccaggacgagatagaaggaccgaggaagaaaacctgaggaaaaaaggtgagccgcaccacgagctgccacccggatcgaccaaacgcgcccttccaaataacacttcgtcgtccccccaaccaaaaaagaagcctctggacggagagtactttaccctgcagattagagggagagaaaggttcgaaatgttccgcgaactgaatgaagcactggagcttaaggacgcgcaggccggtaaggagcctggcgggtcgagagctcattcgagccatcttaagtcgaagaagggacagagcacttcgcggcacaagaagttgatgtttaagaccgagggaccagactccgat

SEQ ID NO: 20527 - DNA, 1179 bp, Artificial Sequence
  Description of Artificial Sequence: Synthetic coding sequence
atggaggagccgcaatccgaccctagtgtggaaccaccgctgagccaagagaccttttccgatctttggaaactgttgcctgagaataatgtgctgagcccactcccttctcaggccatggatgacctgatgttgagtccagacgacattgaacaatggttcactgaggatcctgggcctgatgaagcacctcgcatgcccgaggcggccccaccagtggcgccggcccctgctgcaccaactccagctgcccctgctcccgcgccgtcatggcctctttcctcctccgtgccatctcagaagacataccaggggagctatggcttcagactcggattccttcatagcggtaccgctaaatccgtgacatgcacctacagtcctgctcttaacaaaatgttctgtcaactcgctaagacctgccccgtacagttgtgggtggatagtacccctccgcccggtacccgggtgcgagcaatggctatttacaaacagagccagcatatgactgaggtggtgagaagatgtccgcatcacgaaaggtgttccgactctgatgggctggctccaccccaacatttgatcagggtggaggggaaccttcgcgtcgagtatctcgacgacaggaatacttttaggcactcagtggttgtgccttacgaaccgccagaggttggtagcgattgtacgactatacattacaattacatgtgcaacagtagctgcatgggggggatgaaccggcgacctatcctgactattattacactggaagacagctctggaaatcttctcggtcggaattccttcgaagtccgcgtgtgcgcttgtcccggtcgcgacagacgcactgaggaggaaaacctgaggaagaagggggaacctcatcacgaactgccacccgggtccactaagagagcactcccaaacaatactagttcctcaccacagccaaaaaagaagcctttggatggtgaatactttacactgcaaatcaggggtagggaacgctttgaaatgttcagggagctcaacgaagcactggagctcaaagacgcccaggcgggcaaagagcccggaggaagcagggctcactctagtcacctgaaatcaaagaagggccagagcacttcccgccacaaaaagctcatgtttaagacagagggtccagacagtgat

SEQ ID NO: 20528 - DNA, 1179 bp, Artificial Sequence
  Description of Artificial Sequence: Synthetic coding sequence
atggaggaacctcaatccgacccgagcgtggagccaccgctctctcaggaaactttctcggatctgtggaagctcctgcctgaaaacaacgtgttgtcccctctcccgagccaggccatggacgacctgatgctctccccggatgacatcgaacaatggttcactgaagatccaggcccagacgaagcgcctcggatgccggaagccgcgcctccagtggcgccggcaccagcggcacccaccccggctgcgccggcaccggctccttcctggcctctgagttcatctgtcccttcacagaaaacttaccaagggagttacggtttccgactcggatttctgcactcagggaccgcaaagtccgtcacgtgtacctactcgccagcgctgaataagatgttctgccagctggccaagacttgtccggttcagctctgggtcgactcgacccctccaccaggaacccgggtgagggcaatggccatctataagcagtcgcaacatatgaccgaagtggtacgccggtgcccgcatcacgagcggtgcagcgactccgacggcctcgccccgccccagcacctgattagggtggagggaaacctgagggtggagtaccttgacgatcggaacactttccgccattcagtggtcgtgccctacgagccccccgaagttggatccgactgtaccaccatccattacaattacatgtgcaactcatcctgcatgggaggcatgaatcggcggccgatcttgactatcataacgttggaggatagctcaggcaatctgctcggcagaaactcgttcgaggtgagggtgtgcgcgtgccctggacgcgaccgtaggactgaagaggagaacttgcggaaaaaaggggaaccgcaccacgagctcccaccgggatcgacgaaaagggcccttccaaacaacacctccagctccccgcagccaaagaagaagccgctggatggagagtactttacccttcagatccgcggacgcgaacggttcgaaatgtttagggaactcaatgaagctctggaactcaaagatgcacaggccgggaaggaaccaggaggatcgcgggctcactcttcgcatctgaaatctaaaaagggacaatccacctcgcgccacaagaaacttatgtttaagactgagggacccgattccgat

SEQ ID NO: 20529 - DNA, 1179 bp, Artificial Sequence
  Description of Artificial Sequence: Synthetic coding sequence
atggaagaaccacagtcggacccatcagtagaacctccactttctcaggagacgttttcagatctttggaagttgttgccagaaaacaacgttctgtccccacttccatcccaagcgatggacgatttaatgctttctccagatgatatcgaacaatggtttactgaagacccaggtcctgatgaagcacctcgcatgccggaggccgctcctccagtagcccccgctccggcggcaccaacaccggctgcgccagctccggctccatcgtggccattgtcatcttcagtcccatctcaaaaaacctatcaaggctcatacggattcagactcggttttcttcacagtggcacagccaagtcagtgacgtgcacctacagtccagccctgaataaaatgttctgtcaattggcaaaaacctgtccggttcagctctgggtagattcgacaccaccaccaggtactagggtacgtgctatggctatttataaacaatcacaacacatgactgaggtagtaagaaggtgtccacaccatgaaagatgttcagatagtgatggattggcgcctccacaacatctgattcgggttgaaggaaatttaagagtggaatacttagatgatcgtaacaccttcaggcactctgttgtagttccatacgagccaccagaggttggaagtgattgtacaactattcattataattatatgtgcaattcatcgtgtatgggcggaatgaaccgtcgtccaatccttacaatcatcacactcgaagattcgtctggaaaccttttaggcagaaattcgtttgaagtaagagtgtgtgcatgccctggtagggatcgtcgtactgaggaagaaaatctgcgaaagaaaggtgaaccacatcacgaattgccaccgggttctacaaaacgggcattgcctaataacacttcaagttctccgcagccaaagaagaagccactcgatggggagtactttacgttgcaaataagaggtcgtgaacgattcgaaatgttccgagaacttaatgaagctttagaattgaaggacgcccaggctggaaaggaacctggaggatcgcgcgcacactcatcacaccttaaatcgaagaagggacaatccaccagccgacataagaaattgatgttcaagacagaaggaccagattcggat

SEQ ID NO: 20530 - DNA, 1179 bp, Artificial Sequence
  Description of Artificial Sequence: Synthetic coding sequence
atggaggaacctcagtcggacccgagcgtagagccccctttatctcaggagactttttcggacctctggaagctcctgcccgaaaacaacgttctgtcccctctgccgtcacaggccatggacgacctgatgttaagccctgatgatatcgagcaatggttcaccgaagacccaggacccgacgaggcccccagaatgccagaggccgcaccacctgtcgctcctgctcccgccgccccaactccggctgctcctgcccccgcgccaagttggcccctctcgtcttcggtacccagccagaagacctatcaggggtcttacgggttccggctgggattcttgcactctggaacggccaagtccgtgacgtgcacatacagtcctgcgctgaataaaatgttttgccagctcgcgaagacttgccctgttcagttgtgggttgattcaacgccccccccgggaacccgggtgcgagctatggctatctataagcagagtcagcatatgacggaggtggttcggcgatgtccacaccacgagcgttgctcggacagcgatgggcttgcccccccccagcatctgatccgcgttgaagggaatctgagagtggagtaccttgacgaccgcaacacttttcgacatagtgtcgtagtaccttacgaaccaccggaagtcgggagcgactgtacaaccatccattacaattacatgtgtaattccagttgcatgggcgggatgaaccgccgtccaatactgaccatcataacgctcgaagactcatctggcaacctattgggtaggaactccttcgaggtgcgggtgtgtgcctgccccgggagggatcgcagaaccgaggaagagaatctgcgcaagaagggcgagccacatcacgaactgccacccggctcgacgaaaagagccttgcccaataacacctcttcaagcccacaaccaaagaagaaaccccttgacggagagtacttcactctacagatccgtggtagagagcggtttgaaatgtttcgcgagctaaatgaggcactggagctgaaagatgcccaggccggcaaggagccaggaggttcccgtgcacattctagtcacctgaaaagcaaaaaaggacagtccaccagcagacataagaaactgatgttcaagacggaggggcccgacagcgac

SEQ ID NO: 20531 - DNA, 1179 bp, Artificial Sequence
  Description of Artificial Sequence: Synthetic coding sequence
atggaagagccccagtcagatccatcagtagagccccccctcagccaagagaccttctctgatctctggaaactcctgcccgagaacaacgtcttgtctcccctgcctagccaggctatggatgatttaatgctgtctccagacgatatagagcagtggttcaccgaggatccaggaccggacgaagctccaaggatgcccgaggctgcacctcctgtcgcccctgctccagccgcacctactccagccgctcctgctcccgctcccagctggccactcagcagttctgttccctctcagaagacatatcaagggtcatacggcttcagattgggatttcttcatagcggcactgcaaaaagcgtgacgtgcacttactctccggctctgaataagatgttctgccaactcgctaagacctgtccagttcagctgtgggtggattctacgcccccacctggtacccgtgttcgggctatggccatatataagcagagtcagcatatgactgaagtcgtgaggagatgcccccatcatgagaggtgtagcgacagcgatggcctggctcctccacagcaccttatccgggttgaggggaacctgagagtggaatatctggatgacaggaacactttccgccacagcgtggtagtgccatacgagcctcccgaggttggaagcgactgcactaccatccactataactatatgtgcaacagctcttgcatgggcggaatgaacagaaggccaatcttaaccattatcacactagaagacagcagcggcaaccttctgggcagaaactccttcgaggtgcgtgtgtgcgcttgtcctggaagggatcgccgaactgaagaagaaaaccttaggaagaaaggcgaaccacaccacgaactgcctcccggatctaccaaaagggcgctcccgaacaataccagctcgagccctcagcctaaaaaaaaacctctggatggcgaatattttacactccagatccgtggtcgcgagcgttttgaaatgtttcgggagttgaatgaggccttggaactcaaggatgcacaggcaggcaaggagcccggagggtcccgtgctcacagctcacacctgaaaagcaagaagggccagtccacctcccgccacaagaagctcatgtttaagaccgagggccctgattctgat

SEQ ID NO: 20532 - DNA, 1179 bp, Artificial Sequence
  Description of Artificial Sequence: Synthetic coding sequence
atggaggagccgcaatcggatccttccgtggaaccgcctctcagtcaggaaactttctccgacctgtggaagctgctgcccgagaacaacgtcctctctccacttcccagccaggcaatggatgacctgatgctgagccctgacgacatcgaacagtggttcactgaagatccaggaccagacgaggctccgagaatgcccgaagccgcgccaccggtagccccggcacccgccgcaccgaccccggctgcacctgctcccgcgccatcatggccacttagttcgtctgtcccatcgcaaaaaacttaccaaggatcgtacggctttcgtcttggttttctgcactctggaaccgcgaagtcggtgacctgcacgtattcgcctgcgctgaacaaaatgttctgtcaactcgccaagacgtgcccggtgcagctgtgggttgactccaccccgccgccggggactagggtgcgggccatggccatctacaaacagagccagcacatgactgaggtggtgcgccggtgtccacaccatgagcggtgtagcgactcggatggattggctccaccacagcacctgatccgtgtggaaggtaacctgcgggtggaatacctcgacgatagaaacacttttagacactcggtggtggtcccctacgaaccacctgaggtcggatcggactgcaccacgatccattacaattacatgtgcaattcctcgtgcatgggaggcatgaatcgccgcccaatcctcactatcattaccctggaagatagctccgggaatctgctgggcaggaattcgttcgaagtccgggtgtgcgcatgcccgggacgggacagacgcaccgaggaagaaaacttgcgcaagaagggcgagccgcatcacgaactccctccgggttccaccaagcgcgccctcccaaacaacacctcctcgagtccccagcctaagaaaaagccattggatggcgagtacttcactcttcaaattcggggacgcgaaagattcgaaatgtttagggagctcaacgaggcgctcgaactgaaagacgcccaggccggaaaggaacctggaggctcacgcgctcactcatctcatctgaagagcaaaaagggacaatctacttcccggcataagaaattgatgttcaagaccgaggggccagactcggat

SEQ ID NO: 20533 - DNA, 1587 bp, Artificial Sequence
  Description of Artificial Sequence: Synthetic coding sequence
atgcttctcgccgtcttgtactgccttctttggtccttccaaacttcggcaggtcactttccacgggcatgtgtgtcgtccaagaatcttatggagaaggagtgctgccctccttggagcggtgatagatcaccctgcggtcaactttcggggcgcggatcctgtcaaaacattcttctctcaaatgcacctcttggacctcagttccctttcaccggagtcgatgatagggaatcatggccttccgtgttttacaatcggacttgtcagtgctcaggaaactttatggggtttaactgcggaaattgcaaatttggattttggggcccaaactgtaccgaaagaagattgctggtgaggagaaacatctttgatctgtccgcaccagaaaaggataagttcttcgcctacctgacgctcgcaaagcacacgatttcctcggattacgtgatacccatcggaacctatggacaaatgaagaacgggagcactcccatgtttaacgacataaacatctacgacctctttgtctggatgcattactacgtttcaatggacgcccttctgggcggttccgaaatctggcgcgatatcgatttcgcgcacgaagccccagcatttcttccatggcataggctttttctgctgaggtgggaacaagagattcaaaaactgactggagatgaaaactttactatcccttactgggactggagagacgcagagaaatgcgacatctgcaccgatgaatacatgggcggtcagcacccaaccaatccgaatctgctttcgccagcctcattcttttcgtcgtggcagattgtctgttcacgcctggaagaatacaactctcaccagtcactttgcaatggaacgccggagggtccactcagacggaacccaggtaaccatgataagtcgagaacccctcggctgccgagctccgcagatgtcgagttttgtctttcgttgacccagtacgagagtggctcgatggacaaagcagcgaacttttcattccgcaatactctcgagggattcgcttcgcctcttaccgggattgcagatgcgtcgcaatcctcaatgcataacgcacttcacatctacatgaatgggactatgagccaggtccaaggaagcgctaacgacccaatattcctccttcatcatgcctttgttgactctatctttgagcagtggctgcgtcggcatcgcccgcttcaggaagtctaccccgaggccaacgcgcccatcggtcataaccgtgaatcgtacatggttccatttatccctctctaccggaatggagactttttcatatcctccaaggatttggggtatgattactcctatctccaagactcggacccggattcctttcaggattacattaagagctacctcgagcaagcctctcgtatttggtcatggctcctgggtgcagcaatggtgggtgccgttcttactgctctcttggccggccttgtcagccttctttgtagacataaacggaagcaactgccagaggagaagcaaccgcttctgatggagaaagaagattaccactcgctgtaccagtcgcatctc

SEQ ID NO: 20534 - DNA, 1587 bp, Artificial Sequence
  Description of Artificial Sequence: Synthetic coding sequence
atgctcctggcagtgctgtactgcctcctgtggagttttcagacaagcgccggccattttcctagagcatgcgtctcaagtaaaaaccttatggaaaaagagtgctgccccccttggagtggagacaggagcccctgtggtcaactctctggacgcggatcttgtcagaacatcctgctgtcaaacgccccactcggcccccagtttcccttcaccggtgtcgatgatagggagagctggccaagtgtgttttacaatagaacttgccagtgctcagggaattttatgggcttcaactgtggtaactgtaaatttgggttctgggggcctaactgtaccgagagaaggctgcttgttagaaggaacatcttcgatctgagcgctcccgaaaaagacaagttctttgcctacttgacactggctaagcatactattagctcagactacgtgattcccatcggaacatacggccaaatgaagaacggttccacccctatgtttaacgatataaacatctacgatctctttgtgtggatgcactattatgtaagcatggatgcgctacttggcggctccgaaatctggagggatatcgattttgcccatgaggcaccagccttccttccttggcacagattgttcctgctgcgttgggagcaagaaatccaaaagctgaccggggacgaaaacttcaccataccctattgggactggagggacgccgagaagtgcgatatatgcacagacgaatacatgggtggacaacacccgactaaccccaacttgctctctccggccagctttttttcttcctggcagatcgtgtgttccagattggaagaatataactcacaccagagcctctgcaacggcactccagaaggacccttgcgccggaatccaggaaaccacgacaagagtagaacacccagacttccttccagtgcagatgtggaattttgcctgagtctcacacagtatgaatccggctctatggataaagctgccaactttagcttcaggaacaccctggagggtttcgcaagcccactgactgggattgccgatgcttctcaatcttctatgcacaacgcactccatatatacatgaacgggactatgagtcaagttcagggaagtgcgaacgacccgatctttctcttacaccatgcgttcgttgattctatctttgagcaatggcttcgccgccaccgcccactgcaggaagtgtatccagaagccaacgctcctatcggccacaatcgcgaatcttatatggttccattcatcccactgtatcgtaacggcgatttcttcatttccagcaaggacctgggatatgattactcttacctgcaggacagcgatccagattcatttcaggactatattaaatcttacttggagcaggcttcgcgtatatggagttggttgctgggagcagcaatggtgggggcagttttaacagccctgctggctggtctggtatcactgctttgcagacacaagcggaagcagcttcctgaagaaaagcagcctctgctgatggaaaaggaggactatcatagtctgtaccagtctcatctg

SEQ ID NO: 20535 - DNA, 1587 bp, Artificial Sequence
  Description of Artificial Sequence: Synthetic coding sequence
atgctgctcgctgtgctctactgtctgctttggtcgttccagacgtccgcgggacattttccgagagcatgtgtctcatcgaaaaatctgatggaaaaagagtgctgccctccgtggagcggagacagaagcccgtgcggccagctgtcggggcggggctcctgtcaaaacatcctgctttctaatgccccgctcggaccgcagttcccattcaccggagtggatgatcgggagtcgtggccctcagttttctacaatcgtacctgccaatgttcaggaaatttcatgggatttaactgcggcaattgcaagttcggattctggggccctaactgtaccgaaaggagactgctcgtgcggagaaatatctttgatttgagcgcccctgaaaaggataagttctttgcttatctgacgttggcgaaacacaccatctccagcgattacgtgattccgattggcacctacggccaaatgaaaaacggctcgaccccaatgtttaacgacatcaacatttacgacctctttgtgtggatgcactactacgtgtcgatggacgcactgctgggaggatcggaaatctggagagacatcgatttcgctcacgaagccccagccttcctcccgtggcaccggctctttcttctgagatgggagcaagaaatccagaagctgactggagacgaaaacttcaccatcccgtactgggattggcgcgacgccgagaagtgcgacatctgcactgatgaatacatgggcggacagcacccgaccaacccaaacctcctgtcgcctgcgagcttcttctcctcctggcagatcgtgtgcagtcgcctggaagaatacaattcacatcagtccctgtgcaacggtacccccgaaggaccgctgagacggaatccgggcaatcacgataagtcacgcaccccgcgcttgccgtcctccgccgacgtagaattctgcctgagcctgacccaatacgagtccggatcgatggataaggcagcgaatttctcattccgcaacactctggaaggcttcgcgtcccccctcactggcattgccgatgcatcccaaagcagcatgcacaatgcgctgcatatctacatgaatggaactatgtcgcaggtgcaggggtccgctaacgatccaatctttttgcttcaccacgctttcgtcgatagtatcttcgagcaatggctgcgccgccatcggccccttcaggaggtgtacccggaggcaaacgcccctatcggccacaatagggaatcatacatggtccccttcatcccgctgtaccggaatggtgacttctttatcagcagcaaagatctcggctacgactactcgtacttgcaagattcggatcctgattcgtttcaagactacatcaaatcgtatctcgagcaagccagccgcatctggagctggcttctgggagccgcgatggtgggagcggtccttactgctctgctggcagggttggtgtcgctgttgtgcaggcacaagcgcaagcagctgccagaagaaaagcaaccacttctgatggagaaagaagattaccacagcctctaccaatcacatctt

SEQ ID NO: 20536 - DNA, 1587 bp, Artificial Sequence
  Description of Artificial Sequence: Synthetic coding sequence
atgctcctcgcagttctgtattgcctcctgtggtcttttcagacttccgcgggacattttcccagggcatgtgtgtcgtcaaagaaccttatggaaaaagaatgctgtcctccgtggagcggggatagatcgccatgcggacagttgtccggtcgcgggtcctgtcaaaacattctgcttagcaacgcacctctgggtccccagttcccttttaccggtgtcgatgacagggaatcctggccttccgtcttttacaaccggacctgtcaatgttcaggtaacttcatggggtttaactgcggaaattgcaagtttggattctgggggcccaactgtaccgagagaaggctgcttgtgcgaaggaacatatttgatcttagcgcacctgaaaaggacaagttttttgcgtaccttacccttgcaaagcataccatcagctccgattacgtgattcctatcggaacttatggccagatgaagaacggatcgactccgatgtttaacgacattaacatctacgatctttttgtgtggatgcattactatgtgtcaatggatgcactccttggaggttctgaaatctggcgtgatattgattttgcccatgaggctcctgcatttcttccttggcatcgcctgttccttctgaggtgggaacaggaaattcagaagctgactggggacgagaatttcaccatcccttactgggattggcgcgatgctgagaaatgtgatatctgtacggatgaatacatgggtggacagcatccgaccaaccccaacctcttgagtccggcctcgttcttttcgtcatggcagattgtctgttcacgccttgaagaatacaattcccaccagtcgctctgtaacggaacccctgaagggcctctgcgaagaaaccctggtaatcacgataaaagcagaaccccacggcttccctcctcggcagatgtcgaattctgtctttcacttacccaatatgaatcaggaagcatggataaggcagccaactttagctttagaaacactttggagggttttgcttcgccacttaccggaattgcagatgcatcacaatcgagcatgcataacgcattgcacatctacatgaatggcactatgtcgcaggttcagggctcggctaacgatcctatctttctgttgcaccacgcctttgtggattcgatcttcgagcaatggcttcgccggcataggccactgcaagaagtgtaccccgaagcaaatgctccgattggacataacagagaaagctacatggtgccttttatcccactgtacagaaacggcgactttttcatctccagcaaggatttgggctacgattactcgtacctgcaggactcggatcctgactcctttcaagattacattaagtcatatctggaacaggcatcccgtatttggtcctggcttcttggtgccgcaatggtgggggccgtgcttaccgccctcctggcaggacttgtctccctgctgtgccgacataagagaaagcagcttcctgaagaaaagcaaccactccttatggagaaggaagattaccattcactctatcagtcgcacctg

SEQ ID NO: 20537 - DNA, 1587 bp, Artificial Sequence
  Description of Artificial Sequence: Synthetic coding sequence
atgctccttgcagttctttactgccttctttggtcattccaaacctcggccggccactttccgcgagcctgcgtcagctccaagaatctgatggaaaaagaatgttgccctccgtggtccggtgaccgcagcccttgtggacaactcagcggccggggaagctgtcagaacatcctcctgagcaacgcgccgttgggaccacagttcccgttcaccggcgtggacgaccgcgaatcctggccgtccgtgttttacaatcgcacctgccagtgcagcggaaacttcatgggattcaattgtggcaattgcaagtttggtttttggggtccgaactgcactgagcgccgccttttggtccggcgtaacattttcgatctgtcagcgccggagaaagacaagttcttcgcgtacctgacgctggccaagcacaccatctcttcggattacgtcatccctatcggcacttatggccagatgaagaatggaagcactccgatgttcaacgacatcaacatctacgacctgtttgtgtggatgcactactacgtgtcaatggacgcgctgctcggcggttcagaaatttggcgggatattgattttgcacacgaagctcctgcctttctgccgtggcatcgcctgttcctgctgcggtgggagcaagaaattcagaaactgaccggagacgaaaacttcacgatcccatattgggactggcgtgatgcagagaagtgtgatatctgcacggacgagtacatgggaggacagcacccgactaatccaaacctgctctcgcctgcctcctttttctcatcttggcaaatcgtgtgctccagactcgaggaatacaattctcatcagtcgctgtgcaatgggaccccagaaggaccgctccgtcggaacccgggcaaccatgataaatcaaggactccgcggctcccttcttctgcagacgtggagttctgcctctccttgacccagtacgagtcgggatcgatggataaggctgcaaacttctccttccggaacactctcgaggggttcgcctccccactgactggaattgcagacgcctcacagtcctctatgcataacgccctccacatctacatgaacggaaccatgtcgcaggtccagggtagcgctaacgacccaatctttctcttgcatcatgcattcgtggattccatcttcgaacagtggctgagacgccacagacctctgcaagaagtctacccagaagcaaatgctcccatcggacacaatcgcgaatcttacatggtgccgttcatccccctgtacagaaatggggactttttcatctcgtcaaaggacttggggtacgattactcatatctgcaagacagcgaccccgatagcttccaagactacatcaagtcgtaccttgaacaggcctcgaggatctggagctggctcttgggggccgcgatggtgggagccgtgttgaccgccctcttggcgggcctggtgtccctgctgtgcaggcacaaacgcaagcagctcccagaggagaagcaacccctgctgatggagaaggaagattaccattccctctatcagagccacctg

SEQ ID NO: 20538 - DNA, 1587 bp, Artificial Sequence
  Description of Artificial Sequence: Synthetic coding sequence
atgctgttggctgtactttattgtctgctctggtccttccagactagcgctggacactttccaagagcctgcgtctcatctaaaaacttgatggagaaggaatgttgtcccccctggagtggcgaccggagcccatgtggccaactctctgggagaggttcttgtcagaacatactgctgtccaacgcacctctgggcccacagttccctttcactggagtcgatgacagggagtcctggccttctgtgttctacaaccgaacatgccagtgctccggtaattttatggggttcaactgcgggaactgcaagttcgggttttggggtccaaactgtacagagaggcggctcctggtgcgacgcaatatttttgacttgtcagcccccgaaaaagacaagttttttgcctatctgacattggctaagcacacgatctcatccgattacgtgatccccatagggacctacggccaaatgaagaacggtagtaccccgatgttcaatgacatcaatatttatgaccttttcgtgtggatgcattattatgtatctatggacgctcttttgggtggttcagaaatctggcgggacatcgattttgcacacgaagcgcccgcctttcttccctggcatcgactgtttctcttgaggtgggagcaggaaatccagaagctcactggcgatgagaacttcaccattccatattgggactggagggacgctgaaaagtgtgatatctgcactgacgagtacatgggcgggcagcaccccaccaatcccaatttgctgtcccccgcatccttcttttcatcatggcagattgtctgctctagactggaggagtataactcacaccaaagtctgtgtaacggtacgcctgagggtcccctgcgacgaaaccccggaaaccacgataagtcacgaactccccggctgcccagcagtgcggacgttgaattctgccttagcctgacccaatacgaatctggctctatggataaggcagcaaactttagttttaggaatacactcgaaggctttgctagtccccttaccggtattgcagatgccagtcagtcttcaatgcataacgcgctgcatatttacatgaacgggactatgagccaggtgcagggtagcgctaacgatccaatctttcttctgcaccacgctttcgtcgacagcatctttgagcagtggctcagacgccaccggcccctccaggaggtctatccagaggccaacgcacccattggccacaaccgagaaagctatatggtgcccttcataccactgtacaggaacggtgacttcttcattagctctaaagacctgggatatgactattcttacttgcaggactcagatccagacagcttccaggactatattaaatcttatctggagcaggcaagtaggatttggagttggctgctgggggctgctatggtcggcgctgtccttacggccctgctggccgggctggtgagcctcctgtgtcgccacaaaagaaaacagctgccagaagagaagcagccattgctgatggagaaggaagactaccacagcctctatcagtctcacctc

SEQ ID NO: 20539 - DNA, 1587 bp, Artificial Sequence
  Description of Artificial Sequence: Synthetic coding sequence
atgctactagccgtcttgtattgtttgctgtggtcgtttcagaccagcgccgggcacttcccaagagcgtgtgtctcgagcaagaaccttatggagaaggaatgttgcccaccatggagcggcgataggagcccatgtgggcagttatcgggaagaggctcatgtcaaaacatcctcctgagcaatgcacccttgggtcctcaattcccattcaccggagtggacgacagagaatcttggcccagcgttttttacaataggacatgtcaatgttctgggaatttcatggggtttaattgtggtaactgcaaattcggcttttggggacccaactgtacagaacgacgcctgctcgtgagacgaaacatttttgatctatcagcacctgaaaaggacaagttcttcgcttacttgactctggcgaaacacactatatctagcgactatgtgattccaataggtacttatggccagatgaaaaatggctcaacccctatgtttaacgacataaacatatatgacctctttgtatggatgcattattacgtgagtatggacgctctgttgggaggatctgagatctggagggatattgatttcgctcatgaagcgccagccttcctgccatggcaccgcctgttcctgttgcggtgggagcaggagatccagaaactgactggcgacgaaaatttcaccatcccttactgggattggcgcgacgcagagaagtgtgatatctgcacggatgagtatatgggaggccagcacccaacaaacccaaatctgctttcccctgctagctttttctcgtcctggcagattgtatgttcccgcctggaagaatataattcccatcagtctttgtgcaacggcactcccgaaggccctttgcgaaggaaccccggcaaccatgacaagagtcgcacacctaggttgccctcctccgcagacgtcgaattttgcctgagccttacccagtatgagagcggttctatggacaaagccgctaacttctccttcagaaacacattggagggtttcgcctccccattgactggcatagctgatgcatcccagagttcgatgcataacgctctgcacatctatatgaacggcactatgtcccaggtacagggcagcgcaaatgaccccatctttttactgcatcacgcctttgtggatagcatatttgaacagtggttacggaggcaccgacccctccaagaggtttacccagaggccaacgcacccatcggtcacaaccgagagagctacatggtgcctttcatccctctctataggaacggcgacttttttataagcagtaaggatttgggatacgattactcttacctgcaggactctgaccccgattccttccaagactatataaaatcctacctggaacaggcttctcgcatctggtcatggctgctaggggccgccatggtgggggctgtactgaccgccttgctcgcaggattggtgtccctgttgtgcaggcacaagcggaagcagttaccggaagaaaagcagcctcttctgatggagaaggaagattatcatagcctctaccagtcacacctc

SEQ ID NO: 20540 - DNA, 1587 bp, Artificial Sequence
  Description of Artificial Sequence: Synthetic coding sequence
atgctcctggcggtcctctactgtctgctctggtctttccagacctccgccggtcattttcctcgggcctgcgtgtcgtccaagaacttgatggaaaaggaatgctgcccaccatggtccggggatcgctcaccgtgcggacaacttagcggacgcggttcatgtcaaaacattctcttgtccaacgcgccgttggggccgcagtttccattcaccggtgtggatgacagagagtcctggcccagcgttttctacaatagaacttgtcaatgctccggaaatttcatgggcttcaactgtggcaactgtaagttcggcttctggggaccgaactgcaccgagcggcgccttctcgtgcggcggaacatcttcgacctgtccgccccggagaaagacaagttctttgcatatctcactcttgccaaacatactatcagctcagactacgtgattcccattggaacttacggacaaatgaaaaacgggtcgactccaatgttcaacgacatcaacatatatgatcttttcgtctggatgcattactacgtgtcgatggacgcgctgctcggggggtccgagatatggcgcgacatcgacttcgctcatgaagctcctgcattcttgccgtggcatagactcttcctcttgagatgggaacaggagatccaaaagctcactggtgacgagaacttcactatcccgtactgggattggcgcgacgccgaaaagtgtgatatttgcacggatgagtatatgggaggacaacatcccaccaacccgaatttgctgtcgccagccagctttttcagctcctggcagatcgtgtgctcccggctggaggaatacaactcgcatcagtcgctctgtaatggaacgccggagggcccactgcggcgcaatcccggaaaccacgataagtctaggacccctagacttccgtccagcgcggatgtggaattttgcctgtcgctgacccagtacgaatcgggctcgatggacaaagccgccaacttctcctttcggaacaccttggaaggattcgcctcgcccctgaccggtatcgctgacgcgagccagagttccatgcataatgctctgcatatctacatgaacgggaccatgtcccaggtgcagggctccgcaaatgacccgatctttctcctgcaccacgcctttgtcgatagcatctttgagcagtggctgaggcggcaccgaccgctgcaggaagtgtacccggaagctaacgcccctatcggtcacaacagggaatcgtacatggttccgtttatccctctgtacagaaatggtgacttcttcatctcatcgaaggacctgggctacgattactcctacctgcaggacagcgaccctgactccttccaggattacatcaagtcatacctggaacaagccagccgcatctggtcgtggttgctgggggcggcaatggtgggagccgttcttactgcactgctcgccggtctggtatcgcttctgtgcagacataagcgcaaacagctgcctgaggagaagcaaccacttctgatggagaaggaggactaccactcgctgtaccagtcacatctg

SEQ ID NO: 20541 - DNA, 1587 bp, Artificial Sequence
  Description of Artificial Sequence: Synthetic coding sequence
atgcttctggcagtgctttactgtcttttgtggtcatttcagacgagcgcaggtcattttcctcgggcatgcgtgagttccaagaatcttatggaaaaagagtgctgccccccgtggtccggtgaccggtccccctgtggacagctttcaggtagagggtcgtgccagaacattcttctctcgaacgctccacttggccctcaatttccatttaccggtgtcgacgatagagaaagctggccatcggtgttctacaaccggacctgccagtgtagcggcaacttcatgggattcaactgcggaaactgtaagttcggtttttggggtcctaattgtaccgaaaggcgcctcctggttagacggaatatcttcgatctctccgcacctgaaaaggacaagtttttcgcataccttacgctggccaagcacactatctcatccgactacgtgatcccgatcggaacctacggccaaatgaaaaatggttcgacccctatgttcaacgatatcaacatatacgatctttttgtgtggatgcactactatgtgtcgatggatgcactccttggaggctccgaaatttggcgagatattgattttgcacacgaagccccagcgttcctgccgtggcaccgtctgttcctgctccgatgggaacaagaaatccagaaactgaccggagatgagaatttcactatcccatactgggactggcgcgacgccgagaagtgtgatatctgcaccgatgaatacatgggaggtcaacacccaactaaccctaacttgctgagcccggcgagctttttcagctcctggcagatcgtgtgttcgagattggaggagtacaattcccatcaaagtctgtgtaatggaacgccggaagggccccttagaagaaatcccggaaaccatgataaatcccgcaccccgagacttccctcatcggcggatgtggagttttgtctttcgctgacccagtacgaatccggatcgatggataaagcagccaacttttcgtttcgaaatactctggaaggatttgccagccccctcactggaatcgccgacgcatcccaaagttcaatgcataacgcacttcacatatacatgaacggcaccatgagccaggtgcagggaagcgcgaacgacccaatctttctgctccatcatgcatttgttgattccatctttgaacaatggctccggagacatagaccactgcaagaggtgtatcccgaagcgaacgctccaatcggtcataatcgcgaatcgtacatggtcccatttatccctctgtacaggaacggtgatttcttcatttcatccaaggatctggggtacgactactcctacctccaagattccgatcccgattcgtttcaggattacatcaaatcgtacctggagcaagcatcacggatctggtcatggctgctcggtgcagccatggtcggtgcagtgctgactgcactgttggctggactcgtctcccttctgtgtagacacaagcgtaagcaactgcctgaagagaaacaacctctccttatggaaaaggaagattatcactctctttatcaatcccatctg

SEQ ID NO: 20542 - DNA, 1587 bp, Artificial Sequence
  Description of Artificial Sequence: Synthetic coding sequence
atgcttttggcggtcctgtattgtcttctgtggagtttccagacctccgctggccatttcccgcgggcttgtgtgagtagtaagaatcttatggaaaaggagtgttgcccgccctggtccggcgacagatccccttgcggacaactctcagggaggggctcctgtcagaatatcttactgagtaatgcgcctctgggtccccagtttccgtttaccggagtagacgatagagaaagctggccttccgtcttctacaatcgcacctgccagtgcagcggtaatttcatggggttcaactgcggtaactgcaagttcggattctggggacccaactgtactgagcgaaggttgctcgtgaggagaaatatctttgatttgtccgcgcctgaaaaggacaagttctttgcgtatctgaccttggccaaacacaccatatcctcggactacgtgatacctattgggacttacggacagatgaaaaacggcagcacacccatgttcaacgacattaacatatacgatctgttcgtatggatgcactactacgtcagtatggatgccttacttggaggatcggagatctggcgcgacattgatttcgctcatgaagctccagccttcttaccctggcaccgattgttccttttgagatgggaacaggagatccagaaactgacgggcgatgagaatttcaccattccctactgggattggagggacgctgagaaatgcgacatttgtactgatgaatacatggggggacaacacccaaccaatccaaacctgttatctcccgccagctttttctcctcttggcagattgtctgttcacgcctcgaggaatataacagccatcagagcctgtgtaacggcacgcctgagggccccttacgcaggaaccctggcaaccatgacaaatctcgaacaccacgcttgccctcctcggccgatgtcgagttctgtttgagcctgacccagtatgaaagcggtagcatggataaagccgccaactttagctttcgcaatacactcgaaggctttgccagccctttgaccggcattgcagatgcttcccagagtagtatgcataacgctctgcacatatatatgaatggtactatgagccaggtgcagggttccgcgaacgatccaatattcctgctccatcacgccttcgtggacagcattttcgaacagtggctccgtcgtcatcggcctctccaggaagtctacccagaggctaacgcccctataggccacaaccgcgaatcttacatggtcccttttatcccgctgtacagaaacggtgattttttcatatcctccaaggatctgggatacgattattcatacctccaggactccgaccccgactccttccaggattacattaaatcatatctggaacaggccagcagaatttggtcctggctattgggagcagccatggtaggggccgtgctcacggccctcctggctggattggtgtcgttgctttgccgccacaagaggaaacagctgccagaagaaaagcaaccactgctaatggagaaagaagactaccattccctgtatcaatcccattta

SEQ ID NO: 20543 - DNA, 1587 bp, Artificial Sequence
  Description of Artificial Sequence: Synthetic coding sequence
atgctgttggccgtcctgtactgtctgttgtggagcttccaaacttccgcgggacactttcctcgtgcatgtgtctcctccaaaaatctcatggaaaaggaatgctgcccaccttggtcaggggacagaagcccgtgtggacaactgtccggacgcggctcatgtcaaaacatcttgctttcaaatgcaccacttggccctcagtttccttttaccggagtagacgacagagaaagctggccttcagtgttttacaaccggacttgtcagtgctcgggtaatttcatgggatttaactgtggcaactgtaagtttggattttggggacccaactgcactgagcgccgacttcttgtgcgtcggaacatttttgatctcagcgcccccgaaaaggacaagtttttcgcttaccttactcttgccaaacatactattagctcggattacgtgattcccattggaacttatggacagatgaaaaatggttccacccccatgttcaacgatatcaacatttatgatttgtttgtgtggatgcactactacgtgtcgatggacgcattgctcggtggttccgagatatggcgtgatattgattttgcccacgaagcacctgcctttctcccctggcatcgactgtttctgctccgctgggaacaagaaattcagaaacttactggcgatgaaaactttaccataccatactgggattggcgcgacgccgaaaaatgcgatatttgtactgatgagtacatggggggacagcatccaaccaatcccaatcttctctcccctgcaagttttttcagctcgtggcaaattgtgtgctcccgtctggaagaatacaatagccatcaaagcctttgcaacgggacccccgaaggaccccttcggcgcaaccctggaaaccatgataagtcgagaacccccaggctcccctcgtccgctgacgtcgaattctgcctttccttgacccaatacgaatccggtagcatggataaggccgcgaacttttcgttcaggaataccttggaaggatttgcatcgcccctgacggggatcgccgacgcgtcacaaagctcgatgcataacgcactccacatttacatgaacggaaccatgagtcaagtccagggatccgcaaacgacccgatttttcttcttcatcatgcgttcgtcgacagcatatttgaacagtggctgcgcagacatcgccctctgcaagaagtgtatccagaagcaaacgcccctatcggccacaacagagaatcatatatggtcccttttatccctctgtacagaaatggcgatttcttcatctcctcgaaggaccttgggtacgattactcatacctccaggattcggacccagattcgtttcaagattacattaagtcataccttgaacaggcaagccgcatttggtcttggctgcttggtgcagcgatggtcggagcagtcctgacggcactgcttgcagggcttgtgagcctcctttgccggcataagcgtaagcaactcccagaagagaagcagcctttgctgatggagaaggaagattaccactccctgtaccaatcccatctg

SEQ ID NO: 20544 - DNA, 1587 bp, Artificial Sequence
  Description of Artificial Sequence: Synthetic coding sequence
atgctccttgctgtgctttattgcctcctttggtccttccagacctccgctggccatttcccgcgagcttgtgtctcctcgaagaacctcatggaaaaggagtgttgtccgccctggtccggggatcgcagcccttgtggacagctgtccggccgtggtagctgccagaacattctcctcagcaacgcccctcttggcccacagttcccgttcacaggtgtggacgaccgcgagtcctggccctctgttttctacaaccggacctgccagtgctccgggaatttcatgggtttcaactgcggcaactgcaagttcggtttctggggacccaattgtaccgagcgccgtctactcgtgaggcgtaatatttttgacttgtccgctcctgagaaagacaagttcttcgcctatcttactctggccaagcatacaatctcgtctgattacgtcattcctattggtacgtatggccagatgaagaatggatctactcccatgttcaacgatatcaacatatacgacctcttcgtgtggatgcactattacgtcagcatggacgcgctgttgggaggatccgagatttggcgcgacattgatttcgctcatgaggctcctgccttcttgccgtggcaccgcctatttcttctgcgttgggagcaggagattcaaaagctgacgggggacgagaatttcaccattccgtactgggactggcgcgacgccgaaaagtgcgacatttgcactgatgaatatatgggtggccagcaccccacgaacccgaacctcctgtcacccgccagcttcttttcgtcgtggcaaatcgtgtgctcccgcttggaagagtacaactcccatcagtccctgtgtaatggtacccctgagggccccctgcggcgcaaccccggcaaccacgacaagtcgcgtacaccgcgcctgcctagctccgccgacgtcgagttctgcctcagtctcactcagtacgagtctggttccatggacaaggccgccaatttttcgtttcggaacacattggagggctttgcctctccactgacgggtatcgccgatgcttcccagtccagcatgcacaatgcactccacatctacatgaacggaactatgtcgcaagttcagggttccgctaacgatcccattttccttcttcaccacgcatttgtggacagcatattcgagcagtggctgcgtaggcaccgtccgcttcaggaggtctaccctgaggcgaatgcgcctatcggacacaaccgcgaatcctacatggtccccttcatcccgctttataggaacggagatttcttcatctcttcaaaggatctaggttacgactactcctacctgcaggacagcgatcccgatagcttccaggattacatcaagtcctatttggagcaggccagtaggatctggtcttggctactcggcgcggcaatggtcggcgcagtgctgaccgccctgttggcgggtctggtctcactgttgtgcagacataagcgcaagcaactaccggaggagaagcaaccgctgctgatggaaaaggaggactatcattccctataccagagccacctg

SEQ ID NO: 20545 - DNA, 1587 bp, Artificial Sequence
  Description of Artificial Sequence: Synthetic coding sequence
atgcttctagctgttctttactgtcttctttggtcgtttcagacatccgcggggcactttccgcgcgcatgcgtctcctcaaaaaatctgatggaaaaggaatgctgcccaccatggagtggtgatcgatccccatgtggccagctttcaggtcgtggatcttgtcaaaacattcttctatcaaatgctccattgggtccacaattcccctttacaggagttgacgatcgggaatcgtggccgtcagtcttctacaataggacgtgccagtgttctgggaactttatgggtttcaattgtggaaattgcaagtttggcttttggggacccaactgcactgaaaggcgtctgcttgttcgccgtaacatattcgacttgtcagctcccgaaaaggacaagttctttgcctatttgaccttggccaaacatactatctcgtctgattacgtcatcccaattggaacttacggtcagatgaaaaatggatctacaccaatgttcaatgatatcaacatctatgacctctttgtttggatgcactattacgtcagcatggacgcgttattgggaggctctgagatttggagagacatcgacttcgcccatgaggctccggctttcttgccatggcaccggttatttctacttagatgggaacaggagattcaaaagcttacaggtgatgaaaattttactatcccatactgggattggcgtgatgccgaaaagtgcgacatctgcaccgatgaatacatgggaggccaacacccaacaaaccctaatttgttgtccccagctagcttcttctcttcgtggcaaatagtgtgctctcgtcttgaagagtataatagccatcaatcgttatgcaacggcactccggaaggtccattgcgacgaaatcccggaaaccacgataaatcgaggacaccgaggctaccctctagcgcagacgtggaattctgtctgtcattgacacaatacgagtcaggctccatggataaagccgctaacttctcctttagaaataccttggaagggttcgccagtcctttgacaggcatcgcagacgcttcccaaagctcaatgcataatgctcttcatatctacatgaatggaactatgtcacaagtacagggatctgccaacgatcctattttccttttgcatcacgccttcgttgacagtatttttgaacaatggttgagaagacatcgaccgctgcaagaagtctatccagaagcgaatgctcctatcggacataatagagaatcttatatggtgccattcatcccactgtatcgtaatggagatttctttatttcctctaaggatctcggctacgactacagctatctacaagactcagacccggatagctttcaagactacattaaatcgtacttggaacaggcgagcagaatctggtcatggctgttgggagcggctatggttggagcagtcttgactgccttacttgcaggcttagtgtccctcctttgtcgtcataagagaaagcagttgcctgaagagaaacagccgctgcttatggaaaaagaagactaccactcgctgtatcaatctcatctg

SEQ ID NO: 20546 - DNA, 1587 bp, Artificial Sequence
  Description of Artificial Sequence: Synthetic coding sequence
atgctcctggccgttctctactgtctgctgtggagctttcagacttcagcagggcactttccccgtgcctgtgtaagctcgaagaacctcatggaaaaggagtgttgccccccgtggagcggcgatcggtcaccatgcgggcagctgagtggccgtggctcctgccaaaacatcctactcagcaacgctccactgggcccccagtttccattcaccggagttgacgaccgggagtcttggccatccgtgttctacaaccgcacgtgtcaatgttctggtaattttatgggctttaattgtggcaattgtaaatttggattctggggaccaaactgtactgagagaaggctgttggtaagaagaaacatttttgacttgtcagcccccgagaaggataagttcttcgcttatctaactttagccaagcacactatatcaagcgactatgtcatccccataggaacttacgggcaaatgaagaatggatccacccccatgttcaatgatatcaacatctacgacttgttcgtctggatgcactactatgtcagcatggatgcccttcttgggggcagtgaaatctggagagacatagacttcgcccacgaggcacccgccttcctcccttggcacaggttgttcctactgcggtgggagcaagaaatacagaaactgacaggcgatgagaactttacgattccatactgggactggcgagatgcggaaaaatgcgacatctgtacagacgaatatatgggcgggcagcacccgacaaaccccaatctgctgtcacccgcttccttttttagtagctggcagatcgtctgcagccgcctggaggagtataacagtcatcagtccctctgtaacggcacacccgaaggccctttaaggaggaacccggggaatcacgataagagtcgtacccccaggctcccctcgagcgccgatgtggagttttgtttgtctctgactcagtacgagagcggaagcatggataaggcagccaatttcagttttcgaaatactctggaggggtttgcctcacccctcacagggatcgccgatgccagccagtctagtatgcacaacgcactgcatatctatatgaatggaactatgtctcaggtacaggggagcgccaatgacccaattttcctgttgcaccacgcattcgtggactccatattcgagcagtggttacggaggcacaggcccttgcaggaggtttaccctgaggcaaatgcccccatagggcataatagagaatcctatatggtccccttcattcctctgtaccgcaacggcgacttcttcataagttccaaggatttaggatacgattattcatacttacaggacagtgaccccgattcattccaggactatatcaaaagttatctggagcaagccagccgtatctggtcttggctgcttggcgctgcaatggtcggcgcggtactgacagcacttctggcaggcctggtgtcactgttatgccgccataagcgaaaacagctacccgaagaaaagcaacccctactgatggagaaagaggactaccactccctctaccaaagccacctg

SEQ ID NO: 20547 - DNA, 1587 bp, Artificial Sequence
  Description of Artificial Sequence: Synthetic coding sequence
atgctgctcgccgtgctgtattgtttgctgtggtcattccagaccagcgcagggcactttccgagggcctgcgtctcatccaagaatcttatggagaaggaatgctgtcccccgtggtctggcgaccggtcaccctgcgggcagctgagtggaagggggtcctgtcagaacattctcctgtccaatgccccgctgggcccacagttcccctttacaggcgttgacgatagggaatcttggccgtccgtgttctataaccgcacatgtcaatgcagcggtaattttatgggctttaattgcgggaattgtaagttcggattctgggggcccaattgcaccgagcgtcggctgttagtccggagaaatatttttgacctcagtgcgcccgagaaggacaagtttttcgcgtatcttacactggctaaacataccatcagttccgactatgttatccccataggtacctatggtcagatgaagaatgggtcaacacctatgtttaatgacattaacatctacgacctattcgtgtggatgcactattacgtttctatggatgcacttttggggggctcagagatttggagggacatcgatttcgcacacgaggcccctgctttccttccttggcacagactgtttctgctgcgctgggagcaggagatccaaaaactgactggcgacgaaaacttcaccataccttactgggattggagggatgccgaaaagtgtgacatctgtacagatgagtacatgggaggtcagcatcctacaaatcctaacttgctttcaccggcctcctttttttctagctggcagattgtatgcagcaggctggaggagtacaattctcatcaatccctgtgtaacgggacaccggaaggtcccctgagacgcaatcctgggaaccacgacaaaagtagaaccccccggctccctagcagtgctgacgtggagttctgcctgtctctgacccagtatgaatcaggatcaatggacaaggcagccaatttcagcttccgcaataccttggagggcttcgctagccccctgacaggaatcgccgatgcgagtcagtcatctatgcacaatgccttgcacatttacatgaatggcactatgtcccaggtgcagggctctgccaacgaccccatattccttctgcatcacgccttcgttgacagcatttttgagcaatggctgcgacgacacagacctcttcaggaagtgtaccctgaggccaatgcccccataggacataaccgggagtcatacatggtcccatttatccccctctacaggaacggagatttttttatttctagcaaagatctgggttacgattattcttacctccaagattccgaccccgactccttccaggattacattaagtcttatctggaacaagcgagccggatctggtcttggttgctcggtgcggccatggtgggggctgtgctaaccgcccttctcgcgggcctcgtcagcctgctttgccggcataagcgcaagcagctccccgaggaaaagcaacctctgctgatggagaaagaggactaccattctctctatcagtcccatttg

SEQ ID NO: 20548 - DNA, 1587 bp, Artificial Sequence
  Description of Artificial Sequence: Synthetic coding sequence
atgctcctggccgtcctatactgcctgctctggtcttttcagactagtgctgggcattttccaagggcctgtgtgtcatccaagaacctgatggagaaggaatgctgtcccccatggagtggcgacaggtccccatgcggccagctctctggacgaggctcctgccaaaacattcttttgtccaacgccccacttgggccccagttccccttcacaggggtggacgaccgggagtcctggccttcagtgttctataacaggacttgccagtgttccggaaacttcatggggtttaactgcggcaattgcaaattcggtttctgggggccgaattgtactgaacgaaggcttcttgttcgacgaaacatttttgacctcagtgccccagagaaagacaagtttttcgcctatttgactttagcgaagcacacaatctctagcgattatgtaattcctatcggcacatatggccaaatgaaaaatggcagtacacctatgttcaacgatatcaacatatatgatctttttgtgtggatgcattactacgtctccatggatgcactgttgggtggctccgaaatatggcgggatattgacttcgcccacgaggcacctgcctttctgccatggcaccgcttgtttctgctgcgctgggagcaggagattcagaagctgacaggcgatgagaacttcaccattccttactgggattggcgcgacgcagaaaaatgtgatatatgcacggatgagtacatgggagggcagcaccctaccaatcccaaccttttatctcctgctagttttttttcctcctggcagatagtgtgttcacgactcgaagagtacaactcacaccagtcactctgcaacggaacacctgagggtccccttagacgaaaccccggaaatcatgacaagtcgagaacaccccggctgccgtcaagtgcagatgtggagttctgcctcagcctcacgcagtatgagagcggctccatggataaggccgccaactttagctttcgtaacactctcgagggcttcgccagtccactgacaggcattgccgacgctagtcaatctagcatgcataatgctttgcatatctacatgaatggcactatgagccaagtgcaggggtctgccaatgatcccatatttctgctccatcacgcctttgttgattccatattcgagcagtggttgcggcgccatcggcccttgcaagaggtgtatcctgaagcaaacgcaccaataggacacaaccgcgagtcatatatggtgccatttatacctttgtataggaatggagactttttcattagctcaaaggatctgggatacgactacagttatcttcaagactcggaccccgattcctttcaggactacatcaaatcctacctggaacaagcctcgcgaatctggtcttggctgctgggtgctgcaatggtgggtgctgtgttgacagccctgttagcgggactagtgtcattactatgccgtcataaacgtaaacagcttcctgaggaaaagcagcccctgctgatggaaaaggaagattatcattccttataccaaagccatctg

SEQ ID NO: 20549 - DNA, 1587 bp, Artificial Sequence
  Description of Artificial Sequence: Synthetic coding sequence
atgctcttggctgtgctttattgtctgttgtggtcttttcagacaagtgcgggacacttcccacgggcctgtgtaagttcgaagaacctgatggagaaggagtgttgcccaccttggtcaggagacagatccccctgcggacaacttagcgggagagggagctgtcagaatatcctgctcagtaatgcacctctaggcccccagtttccattcacaggtgtagacgatcgagagtcctggcccagtgtcttctacaacaggacctgtcaatgttcaggaaacttcatggggttcaattgcggcaactgcaagtttggcttttggggacctaattgcacggagcggagattattggtccggcggaatatttttgacttgtctgcgcctgaaaaggacaagttttttgcgtatctaacgcttgccaagcatactatctcttcagactacgtgataccaatcggaacttacggccagatgaaaaacggttccactcccatgttcaacgacatcaacatttacgacctttttgtttggatgcactactacgtatctatggatgctttgcttggcggctccgaaatttggagagatatagacttcgcacatgaggccccggcatttctgccttggcatcgtctcttccttcttcggtgggaacaggaaatccagaaattaaccggggacgaaaactttaccatcccctactgggattggcgagatgcagaaaaatgtgacatctgcactgacgaatatatggggggacaacaccccactaaccccaacttgttaagcccagccagctttttcagttcttggcaaatcgtctgttctaggctggaagaatataactcacatcagtcgctatgtaatggtacccctgaaggtcctcttcgccggaatccggggaatcacgataaatccaggactccccgtttgccgtcgtcagccgacgtggagttttgcctttccctcacgcagtatgagtcgggctctatggataaagcagctaacttctctttccgcaacaccctggagggtttcgcatcccccctcactggtatagctgacgcatctcagtcaagtatgcacaacgcgctgcatatttatatgaacggaacaatgagccaggtgcaaggatctgcaaacgatccaatttttttgctgcatcacgcattcgtggactccatcttcgagcagtggttacgccggcaccgtcctctgcaagaagtttatccagaggcaaacgcccccattggccacaacagggaatcctacatggtgccttttatcccgttgtatcgaaacggcgatttttttatttcctcaaaagacctgggctacgattacagctacctccaggatagcgacccagattcgtttcaagactacattaaatcctacctggagcaggcgtcacgtatctggtcttggctgttgggagcggccatggtgggtgcggttctcaccgccctactggccggtcttgtgagcctcctgtgtagacataagaggaaacaactccccgaggagaaacagccacttcttatggaaaaggaagactatcacagcctctaccagtcacacctg

SEQ ID NO: 20550 - DNA, 1587 bp, Artificial Sequence
  Description of Artificial Sequence: Synthetic coding sequence
atgctgctcgctgtattgtattgcttgctctggtcattccagacatctgcaggtcactttcctcgcgcctgtgtctcctctaagaatctgatggaaaaggagtgttgccctccctggtccggcgataggagcccctgcggccaactttccggtagaggctcctgccagaacattctgctctcaaacgctcccctgggaccacagttccctttcaccggcgtcgatgatagggaaagttggccatccgtcttctacaaccgcacttgtcagtgttctggaaatttcatgggattcaattgcggcaactgcaagttcggtttctggggtccgaactgcactgagcgccgccttttggttcgcaggaatatcttcgatcttagtgcccctgaaaaggacaaattcttcgcttacctgacattggcgaagcacactatttcttctgattacgttatccccattggcacttacggccagatgaaaaatggatcaacacctatgttcaacgacatcaacatatatgacttgtttgtttggatgcactactatgtctccatggacgccctgctgggtggatcagaaatctggagggatatcgacttcgcgcacgaagccccggccttcctcccatggcacaggctgtttctgcttcgctgggaacaggaaatccagaagcttacaggtgatgaaaatttcacaattccatactgggactggagggacgctgaaaaatgcgacatctgtacagacgagtatatgggaggccagcatccaaccaacccaaatcttctctcaccagcctcttttttctccagttggcagatcgtttgcagtaggcttgaagagtacaactctcatcagtctctgtgcaatggtacacccgaaggccccctgagacgcaaccctggaaaccacgacaaaagtaggaccccaagactgccctcttctgctgacgtcgagttctgtctgtctctcacccagtatgagagcggctctatggacaaggcggcaaacttcagtttccgcaatacgctggagggttttgccagtcctttgaccggtatagcggatgcttctcaaagtagcatgcataatgctctgcacatatacatgaacggcactatgagccaggtgcaaggcagtgctaacgatccgatctttctgctgcatcacgccttcgttgattcaatcttcgagcaatggttgcgcaggcaccgccccctccaggaggtgtaccctgaagcaaacgcgccaattggtcataacagagaatcatatatggttccattcatacctttgtacaggaacggcgacttcttcatttcaagcaaagatctgggctatgactactcttatctccaggacagtgacccagactctttccaggactacatcaaatcatacctggagcaggctagcagaatttggagctggttgctgggagccgccatggttggcgccgtgctgacagcactcctggccggcctcgtaagtctcctctgtagacacaagcgcaaacagttgccagaagagaaacagccactgctgatggagaaagaagactaccattccctctaccaaagccacctg

SEQ ID NO: 20551 - DNA, 1587 bp, Artificial Sequence
  Description of Artificial Sequence: Synthetic coding sequence
atgctcctggcggtgctctactgtctgctttggtcgttccagacttccgcgggacactttccgcgggcttgcgtttcgtctaagaatctgatggagaaggaatgctgtccgccgtggagcggtgaccgctccccgtgtggccagctgtcgggtagaggaagctgccagaacattctgttgagcaacgctccgcttggaccgcaattccctttcacgggtgtcgatgacagggaatcatggcctagcgtgttctataatcggacctgccagtgctcgggtaatttcatgggcttcaactgtggtaactgcaagttcggattttggggaccaaactgtactgaaagacggctccttgtccggcgcaatatcttcgatctctctgcccccgaaaaagacaagttcttcgcttaccttacccttgccaagcatactatatcttctgattacgtcattcctatcggaacgtacggacagatgaagaacgggagcaccccaatgtttaacgatatcaacatttatgatctgttcgtgtggatgcactactacgtgtcgatggacgcgctgctcggcggctcggaaatctggagagatattgacttcgcccacgaagcgccggcttttctcccatggcaccgcttgtttcttctgcgctgggaacaggaaatccaaaagctgaccggggatgagaacttcactatcccatactgggactggagagatgccgagaaatgcgatatctgcaccgacgagtacatgggcgggcagcatccaactaacccgaatcttctctccccggccagcttcttcagctcctggcagatcgtgtgcagccggcttgaggagtacaacagccaccagtccctctgcaacgggacccctgagggtccgctgaggaggaatcccggaaaccatgataagagtaggaccccccgcctgcccagttcggccgacgttgaattctgtctgtcgctgactcagtacgaatcaggaagcatggataaagcggccaacttttcattcaggaacaccctcgagggcttcgcgtcgccactcactggaatcgcagacgcctcccaatcttctatgcataacgcattgcacatttacatgaatggaaccatgagccaagtccaagggtcagccaatgacccaatcttcctgctgcatcacgccttcgtggactctatcttcgaacagtggcttagacggcatagaccactgcaggaggtctaccccgaagctaatgccccgatcgggcacaatcgcgagtcatacatggtcccttttatccctttgtaccgcaacggtgactttttcatcagctctaaggacctgggctacgactattcctacctgcaggactcggatccggattcgtttcaagactacatcaaaagctacttggaacaagcatcgcggatctggtcatggctgctgggagcagcaatggtgggagcggtgctgactgctctgttggccggactcgtgtcactcctctgtcgccacaaacggaagcaactgccagaggaaaagcagccattgctgatggaaaaagaggactaccactccctctaccagtcacatctg

SEQ ID NO: 20552 - DNA, 1587 bp, Artificial Sequence
  Description of Artificial Sequence: Synthetic coding sequence
atgctgctggcagtcctctactgtctgctgtggtctttccagacaagcgccggtcacttccctagagcttgcgtgtcttcgaagaacctcatggaaaaggaatgttgccccccatggagtggcgatcgcagcccgtgcgggcagctgtctggacggggtagttgtcagaatatcctcctgagcaatgcaccgctcgggccccagttcccttttaccggcgtggacgatagggagtcctggccatccgtgttctacaataggacctgccagtgcagcggaaactttatgggtttcaactgtgggaattgtaagtttggcttctgggggcccaactgcaccgaacgacgtttgttggtgcggcgcaatatattcgacctgagcgcgcccgagaaagacaagtttttcgcctacttgaccttagctaagcacaccatctccagcgattatgtaatcccaattggtacatacggacaaatgaagaatggctcaacgccgatgtttaacgatattaatatctatgacctctttgtatggatgcattattacgtatcaatggacgccctcttgggcggctccgagatctggagagatattgatttcgcccatgaggcccctgcctttctaccctggcataggctgtttctgcttcgctgggaacaggagattcagaaactcactggggatgaaaattttaccataccttactgggactggagggatgctgaaaagtgcgacatctgcacggatgaatacatgggcggccaacatcccacaaaccctaacttgctctctccagcatccttcttctctagttggcaaatcgtttgctctcggctcgaggaatacaattctcaccagtctttgtgcaatggaactcctgagggccctctgcgcagaaatcccggcaaccatgataagtccaggacgcccagacttccctcctctgccgacgtggagttttgtctgagcctgactcagtatgagagcggaagtatggacaaggccgcgaatttttcattcaggaacacccttgaaggattcgccagccccttgaccggaattgctgacgcctcccagtcaagtatgcacaacgctctgcacatttacatgaacggcaccatgtcgcaggtgcagggtagcgccaatgatcccattttccttctgcatcacgcctttgtggattccattttcgaacaatggctgcgccggcaccgccctctgcaggaagtgtatcctgaagcaaacgcccccatagggcacaatcgagaatcgtacatggtgccatttatcccactgtaccgtaatggagattttttcatttccagcaaagaccttggctatgattattcgtatctccaggactcagatcccgattccttccaggactatattaagagttatctggagcaggcttctaggatctggtcatggttactgggcgccgcaatggtgggcgctgtgttgaccgctctcctcgcaggccttgtctcactgctgtgtcggcacaagcgaaagcagctacccgaggagaagcagcccctgttaatggaaaaggaggactaccactcactttatcaatcccactta

SEQ ID NO: 20553 - DNA, 1587 bp, Artificial Sequence
  Description of Artificial Sequence: Synthetic coding sequence
atgttacttgctgtgctgtattgtctactgtggtctttccaaactagcgcaggccattttccgcgagcttgcgtttcgtccaaaaacctgatggaaaaggaatgttgtccgccgtggtctggcgataggtccccctgcggccagttatcgggcagaggttcctgccagaatattcttctctcaaacgccccccttggaccacaatttccgttcaccggcgtggacgacagagagtcatggccctctgtgttttacaaccgaacgtgtcagtgttcaggcaatttcatgggtttcaattgcggtaattgcaaatttggattttggggacctaactgcactgaacgcaggttgcttgtccgcagaaatatcttcgacttgtcagcacctgagaaggacaagttcttcgcctatttaaccctggccaaacataccatatcttccgattatgtcataccaattggaacgtacggacagatgaagaatgggagtacacccatgttcaatgacataaacatttatgacctttttgtgtggatgcactattatgttagcatggatgcattactggggggttctgagatctggcgtgatattgacttcgcccatgaagctcccgcctttctaccgtggcaccgactgtttctgctgaggtgggaacaggagattcagaaactgacaggcgatgagaatttcacaatcccttactgggattggagagatgcagagaagtgcgacatctgcaccgacgagtatatgggtggacagcatcctaccaacccaaatctgttgtccccagcctccttcttctcatcttggcagatcgtgtgctcgagactggaagaatataactctcatcagtccctgtgcaatggtacacctgaaggccccctccggcggaatccgggcaatcacgacaaatcgcgtactcccagactgccttcatcagccgatgtcgagttctgtttgagtctcacacagtacgagtccggatcaatggacaaagctgccaatttctcatttcgcaacacactggagggttttgccagccctctgaccgggatcgccgatgcctcacagtctagcatgcataatgcactgcacatatatatgaatggaaccatgtcgcaggtccagggcagtgcaaatgacccaatcttcttgctgcaccatgcctttgtagacagtatttttgagcagtggttgcggaggcatcggcccctgcaggaagtttaccctgaagccaacgcccctataggccacaacagagaaagctatatggttccgtttataccactctatcgaaacggtgatttctttatctcctctaaagatctggggtacgactatagttatctgcaggatagcgatccagacagtttccaggattacatcaagtcatatctcgagcaagctagtaggatttggtcttggctcctcggggcggctatggtgggcgccgtactgacagccctgctcgccggcctggtgtctctgttgtgcaggcacaaacgcaaacagttgcccgaagaaaaacaaccgcttcttatggaaaaagaggattatcattctctgtaccagagtcacctc

SEQ ID NO: 20554 - DNA, 1587 bp, Artificial Sequence
  Description of Artificial Sequence: Synthetic coding sequence
atgcttcttgctgttctctattgccttctttggagctttcaaaccagcgccggtcactttcccagagcatgtgtgagctcaaaaaaccttatggaaaaagaatgttgtcccccttggtcaggagatcggtccccgtgcggacagctgtctggacggggatcgtgtcagaacatcctcctttccaatgcaccacttggacctcagttcccttttactggggtggatgatcgagaatcctggccgagcgtgttttacaacagaacttgccagtgtagcggtaacttcatggggttcaattgtgggaactgtaagtttgggttttggggaccaaactgcaccgaaagaaggctcctcgtccgtagaaacattttcgatctttccgccccagagaaggataagtttttcgcataccttacccttgcgaagcatacgatctcatctgactacgtcattcctattggaacttacggacagatgaaaaacggatcaactccaatgtttaacgacatcaacatttatgatctctttgtgtggatgcattactacgtgagcatggatgcacttctcggcgggtccgagatctggagggatatcgactttgctcatgaggcacctgctttcctcccctggcatagactgttcttgctgaggtgggaacaggaaatccaaaaactgactggtgatgagaactttaccataccatactgggattggagggatgcggagaagtgcgatatctgcacggacgagtacatgggtggccaacatcctaccaaccctaacctgctttcaccagcatcttttttctcgtcatggcaaatcgtgtgcagcaggctcgaggaatacaactcccatcaaagcctctgtaatggaaccccagaaggtcccctgcgtaggaatcctggaaaccacgacaagtcacggactcctcggcttccttcatcggccgacgtggaattttgtctctcactcactcagtacgaatcaggttcgatggataaggccgcgaatttcagcttcaggaacactcttgagggattcgcaagtccacttaccggaatagcggatgcaagccagagctcaatgcacaatgcacttcatatctacatgaacggcacgatgtcacaagtccaggggtcagctaatgatccaatcttcctgttgcatcatgcctttgtggattcgatttttgaacagtggctccggcgacatcgccctctgcaggaagtgtaccccgaagcgaatgcacccattggtcataatcgggaatcctatatggtgccattcatacccctctacagaaacggtgacttcttcatttcctccaaagacctcggctacgattacagctaccttcaagactccgatcctgattcgtttcaggattacattaagtcgtacctcgaacaagccagcagaatctggtcctggcttcttggagccgcaatggtcggtgcagtcctgactgccctgctcgctggactggtgtcattgctctgcagacacaagagaaaacagcttcctgaagagaagcagccacttcttatggagaaggaggattaccattcgctgtaccaaagccatctg

SEQ ID NO: 20555 - DNA, 1587 bp, Artificial Sequence
  Description of Artificial Sequence: Synthetic coding sequence
atgcttctggctgtcctgtactgtttgctttggtcgttccaaaccagtgcagggcatttcccccgagcatgtgtttcgtcgaagaacctaatggagaaggaatgctgcccaccctggagcggggatcgatcgccgtgtggccagctatccggacgaggatcatgccagaacatactcctctccaacgctcccctcggaccgcagtttccgtttaccggcgtggacgaccgagaatcatggccgtccgtgttttataacaggacgtgccagtgttccggaaattttatggggtttaattgcggcaactgcaagtttggcttctggggaccaaactgcaccgaacggcgacttttggtccgcagaaacattttcgacctgtcagctccggaaaaagacaaattttttgcttatttaaccctcgctaagcatacaatttcatctgattacgtgattcctattggcacgtatggacaaatgaagaatggctctacacccatgtttaacgacatcaatatttacgatttgttcgtgtggatgcattactatgtttcaatggatgcactccttggtggatcggagatctggcgtgatatagatttcgcacacgaggctcctgcctttttaccgtggcatcgattgttcttacttcgctgggaacaagagatacagaagttaacgggggatgaaaattttacaataccctactgggattggagggacgccgagaaatgcgacatttgtactgatgagtacatgggtgggcagcatcccacgaatccaaacctcctttctccggccagtttcttctcctcttggcagatcgtgtgctctagactggaggagtataactcgcatcagagtctatgtaacggaacgccggagggcccacttaggcgaaacccaggaaatcatgacaagtctagaacgcctcggcttccgagctcagccgacgtcgaattctgcctgtcgctgacgcagtatgagtctggatccatggacaaggcggccaacttttctttccggaataccctcgaggggttcgcttcgccccttaccggcatcgcggacgcgagccaatcaagtatgcataatgctttgcatatttacatgaacggcaccatgagtcaagttcagggctccgccaatgatccgatattcttgttacatcatgcctttgtggattccattttcgagcagtggcttaggcgccacaggcctctacaggaagtttatcctgaggccaatgcgcctataggtcataatcgcgagtcctacatggtcccatttatacctctatacaggaatggcgattttttcatttcgagtaaggatttgggttacgactattcttacctgcaggattccgaccccgacagctttcaagattacattaaatcctatctggagcaggcgtcgcggatttggtcgtggctgctgggtgctgctatggtaggagctgtactgacagcattgctcgccggcctggtctctctgctctgccggcacaagcggaagcagctcccggaggaaaagcagccactgcttatggaaaaggaggactaccatagtctataccaaagtcacttg

SEQ ID NO: 20556 - DNA, 1587 bp, Artificial Sequence
  Description of Artificial Sequence: Synthetic coding sequence
atgctgcttgcagttctgtattgtctcctgtggtcctttcagacatcagctgggcatttcccccgtgcttgtgtcagctcaaagaatctgatggagaaagagtgttgcccaccctggtctggtgatcgctctccctgcggacagttgagcggacgggggagttgtcagaatatactgttgtctaatgctcctcttgggccccagttcccctttaccggggtggacgatcgtgagtcctggcccagtgtattctacaaccgcacctgccaatgttctggtaacttcatgggctttaactgcggaaattgtaagttcggcttctgggggcctaactgcacagagcgtcgcctcctggttaggagaaacattttcgatctttccgcccccgagaaggataaattcttcgcttacttgactttagccaagcacaccatcagcagtgattacgtaatcccgatcggaacatatggacagatgaaaaatggatctaccccaatgttcaacgacatcaatatttacgacctcttcgtatggatgcactactatgtgagcatggacgccctcctcgggggatctgaaatctggagagatatcgactttgctcacgaggcccctgcatttctcccctggcacaggctgttcctccttagatgggaacaggagatccagaagttaaccggcgacgagaactttaccataccatactgggattggagggacgccgaaaagtgcgacatttgcacagatgagtacatggggggacaacaccctactaatcctaacttgctgtctccagcttccttcttttcttcctggcagatagtgtgctcaaggctggaagaatataatagccaccagtcgttatgtaatggaacccccgaggggccacttaggaggaatccgggaaatcacgataagtcacgcaccccacgactcccatcatccgcggatgtcgaattttgtctgtcattgacacagtacgagtccggatccatggacaaggccgccaacttctcatttaggaacactctcgagggatttgccagtccgctgactggaatcgcagacgcaagtcagtcatctatgcacaatgctctgcacatatacatgaacggtacgatgtcacaggtgcagggatccgcaaatgatccaattttcctgctgcaccacgcatttgtggacagtatcttcgagcagtggctgcggcgccatagacccttacaagaagtctatcctgaagctaatgcccctatcggacacaatagagagtcatatatggttccattcatccccctgtatcgcaatggggatttcttcatttctagcaaagacttaggctatgactatagctacctgcaggatagtgatccagactcgttccaggactatatcaagtcctacttggagcaggcgtctcgaatctggtcatggctgcttggcgcggctatggttggagctgtgctgactgctctgctcgccggactcgtcagtctgctgtgccgtcataagcggaaacagctgcctgaggagaaacagcccctcctgatggaaaaggaagattatcatagcctctatcagtcgcatctg

SEQ ID NO: 20557 - DNA, 1587 bp, Artificial Sequence
  Description of Artificial Sequence: Synthetic coding sequence
atgcttctcgcagtgctgtactgcttactgtggtccttccaaaccagcgcaggccacttccctcgcgcgtgcgtctctagcaaaaacctgatggagaaagaatgctgtccgccttggtccggggatcggagcccgtgtggtcaactgagcggccgcgggagttgccaaaacattctgctgagcaacgcacccctgggtccccagtttcctttcacaggggtagatgatcgggagagttggccaagcgtgttctataatagaacctgtcagtgctccggcaacttcatggggttcaattgtggcaactgtaagttcggtttctggggccctaattgcactgagcgccgtctgctggtgcgtagaaacatcttcgatctgtcggcgccggagaaagacaaattctttgcctatctcaccctggcgaagcacactattagcagcgattacgttatccctatcgggacctacggccagatgaaaaatggaagcacgccaatgtttaatgatatcaacatctatgatctgttcgtatggatgcactattacgtgagcatggacgctctgctgggcggctcagaaatttggcgagacattgacttcgcgcacgaagctccagccttcctgccgtggcatcgtctgtttctactgcgctgggaacaggaaatccagaagctcactggtgatgagaatttcaccattccatactgggactggcgtgatgcggagaaatgcgacatctgcactgatgagtatatgggcgggcagcaccctactaatcctaatctgctgtcaccagcaagcttcttcagctcttggcagattgtctgcagccgcctggaggagtataattctcatcagagcctgtgcaatggaaccccagaaggaccactgcgccgtaacccgggtaaccacgataagtctcgcaccccaagactgccatcaagcgccgacgtggaattctgtctgtccctcactcaatatgagtctggtagcatggataaggctgcaaatttttctttccgtaatacccttgaaggctttgcaagccctctgactggtatcgcagatgccagccaatcatctatgcacaacgctttgcacatatacatgaatggtaccatgagccaggttcagggctcagcaaatgaccctatctttctgctgcaccatgcctttgtcgattcaatattcgagcaatggttgaggcgtcatcgcccactgcaggaagtttatccggaggctaatgcaccgataggccacaaccgcgagtcttacatggttccatttattcccctttatcggaatggggatttcttcattagtagcaaagacttgggttatgactattcgtacctgcaggattccgaccctgatagcttccaagattacattaagagctacctcgaacaggcttcccgcatttggtcgtggctgttgggtgccgcaatggtaggggccgtgctgaccgcactgctggctggcttggtttctctgctgtgtcgtcataaacgcaagcagctgccagaggagaagcagccactcctgatggaaaaagaggattaccatagcctctaccagagccacctt

SEQ ID NO: 20558 - DNA, 1587 bp, Artificial Sequence
  Description of Artificial Sequence: Synthetic coding sequence
atgctcctggccgttctctactgcctgctctggagctttcaaacttcagccggccatttccctcgagcatgtgtctcatccaagaatctcatggaaaaggaatgctgcccgccgtggtcgggtgacaggagcccatgtggccagctgtccggacgggggtcatgccaaaacatccttctgtccaacgccccactcgggcctcaattcccattcaccggagtggacgatagagaatcatggccgagcgtgttctacaaccgcacttgccagtgctcaggaaatttcatgggcttcaactgtggaaattgcaaatttggattctggggcccgaactgcactgaaaggcgactgctcgtccgccgcaatatctttgacttgtcggctccggaaaaagataagttcttcgcctacctcaccctggccaaacacactatctcttcagactacgtgatcccaattggaacctacggtcagatgaaaaacggatcaactccgatgttcaacgacatcaacatatatgatctgttcgtgtggatgcattactacgtgtcgatggacgccctccttggtggttcggaaatctggagggatatcgatttcgcacacgaggccccagctttcttgccgtggcaccgcctgttcctcctcagatgggagcaggaaatccaaaaacttaccggcgatgaaaacttcaccattccttactgggactggcgcgacgctgagaagtgcgatatttgcacggacgaatacatgggaggacagcatcctaccaatccgaacctgctgtcacctgccagcttcttctccagctggcagatcgtgtgtagccgcctcgaggagtacaactcacaccagtccctgtgcaatggaacgccggaagggccgctgaggcgcaacccaggaaatcacgataaatcccggacgccgcggctcccgagctcagcggatgtggagttttgcctgtcgttgactcagtacgaatctgggtcgatggataaagcggcaaacttttccttccgcaatactctggaaggattcgcctcccccttgacgggcatcgcggacgcctcgcagtcctcaatgcataatgctctgcacatctacatgaatggtactatgtcccaggttcaagggagcgccaatgacccgattttcctgctccaccacgccttcgtggatagcatttttgagcaatggctgcgccggcaccggcctcttcaggaagtctacccagaggccaatgcccccatcggccataacagggaatcgtatatggtcccatttatccctctgtaccggaacggagatttcttcatcagttccaaagatctgggatacgattacagctacctgcaggatagcgaccccgactcgttccaggactacatcaagtcctacctcgaacaggcaagcaggatctggtcgtggctgctgggagcagcgatggtgggcgcagtcctgactgcccttttggcaggcctggtcagcttgctgtgtcgacataaacggaagcagctgccagaggaaaagcagccgctgctgatggagaaagaggactaccatagcctgtatcagagccatttg

SEQ ID NO: 20559 - DNA, 1587 bp, Artificial Sequence
  Description of Artificial Sequence: Synthetic coding sequence
atgcttttagctgtgttgtactgtttattgtggtcattccagacgtccgccgggcacttcccccgagcttgcgtgtctagtaagaacctgatggaaaaggaatgctgtcccccatggagtggtgatagatccccgtgtggacagctctcgggcaggggctcatgccagaacattctcctgagcaacgctccgctcggaccacagtttccattcacgggcgtggatgatcgagagtcttggcctagcgtgttctacaatagaacttgtcagtgcagcggcaacttcatggggtttaactgtggtaattgtaaattcggcttctgggggcccaattgtactgaaagaagactgctcgttaggaggaatatcttcgacctgagcgctccagagaaggataaattctttgcctacttaacattggctaagcacacaattagtagcgattatgtgattcctattggcacctatggccagatgaagaacggctctacaccaatgttcaacgatatcaatatctatgatctgttcgtgtggatgcattactacgtgtcaatggacgccttattgggcgggagcgagatatggcgggacatcgactttgcacacgaggctcccgcgttcctgccatggcaccggctattcctcctgaggtgggaacaggaaatccaaaaactgacaggcgacgagaacttcaccataccatactgggactggcgcgatgctgaaaagtgcgatatttgtacagacgagtacatgggcggacaacacccaactaatccgaatctgttaagccccgcaagttttttcagcagttggcagatcgtgtgctccagactggaggagtataacagccatcaaagcctgtgcaacgggaccccggagggcccattgcgccgcaatccaggcaaccacgataagtcccgcacaccccggctcccttcctccgcagatgtggagttctgcctgagcctcacccagtatgagagcggtagcatggacaaggcggctaattttagcttcaggaacactcttgagggatttgcttcacctcttactggaattgcagatgcaagccagagctccatgcacaatgcgttacatatttacatgaacgggaccatgtcgcaggttcagggatccgctaacgatccgatcttcctgctgcaccacgccttcgtggattctatctttgagcagtggctacgcagacatcgcccacttcaggaagtgtatcccgaggccaacgccccaatcggtcacaaccgcgagagctatatggtgcccttcatccccttatatcgcaatggagactttttcataagttccaaggacttgggttacgattatagctatcttcaagacagtgacccagactctttccaggactacattaaatcctaccttgagcaggcgagtaggatctggtcgtggttgctgggcgccgcaatggtgggggcagtgttgaccgcgttactggctggcctggtttccttgctctgccgtcataaaaggaagcagctacccgaagagaagcagccactgttgatggaaaaagaggactatcactccttatatcaatctcatttg

SEQ ID NO: 20560 - DNA, 1587 bp, Artificial Sequence
  Description of Artificial Sequence: Synthetic coding sequence
atgttactggccgtcctttactgtttgctatggtccttccagactagcgctggacattttcctagagcttgtgtctcatcaaaaaacctgatggaaaaagagtgttgccccccttggtcaggggatcggagcccttgcggccagctgtctgggcgcggcagttgccagaatattttgctttccaatgctccactgggcccacaatttccattcacgggcgtggacgaccgcgagagctggcccagcgtcttctataatcgaacttgtcagtgctccggtaattttatggggttcaactgcgggaattgcaaattcggattctggggccctaactgcaccgagcgccgtcttctcgtccgtcgcaacattttcgatctcagcgcacccgagaaggacaagttctttgcatatctgacattggctaagcacactatctctagcgactacgttatccccatcggtacctacggacagatgaagaacggttcaacgcccatgtttaacgatattaacatctatgaccttttcgtgtggatgcattactacgtctccatggatgcgttactgggaggatctgaaatttggcgggacatagatttcgcacatgaagccccggcgtttctcccatggcacaggctgtttctattgaggtgggaacaagagatccaaaagttaacaggagatgagaattttacaattccctattgggattggagggatgccgagaagtgcgacatctgtactgacgaatatatgggtgggcaacaccccacaaaccctaacttactatcccccgcctctttctttagtagttggcagatcgtgtgctcgcggttagaggaatacaactctcatcagagtttatgcaacggcacacctgaggggcccctgaggcgaaatccagggaatcacgataagtctagaacaccgcgactaccgtccagcgcagacgttgagttttgtctgtcactgacacagtatgagagtggttccatggacaaggctgcaaattttagctttcgtaacacccttgaggggtttgcctcccctctcacaggtatcgctgatgccagccagtctagtatgcacaatgctctgcatatttacatgaacggcaccatgtctcaagtgcagggctccgccaatgacccaatattcctgctgcaccatgctttcgtggattccattttcgaacagtggttaagacgtcacaggcccctgcaggaagtttaccccgaagccaatgcgcctattggccacaatcgcgagtcctatatggttcccttcatcccactatatagaaacggtgactttttcatttcctctaaagatctcggctacgattattcttacctgcaagattctgaccccgattccttccaggactacattaagtcatatctcgaacaggccagccggatctggagctggctgttgggggctgcaatggtcggggcagtgctgacagctcttcttgccggccttgtgtcgctgctgtgtcggcacaagagaaagcagctcccggaagaaaaacagccactccttatggaaaaagaggattaccacagcctgtaccagtctcacttg

SEQ ID NO: 20561 - DNA, 1587 bp, Artificial Sequence
  Description of Artificial Sequence: Synthetic coding sequence
atgctgttggccgtgctgtattgtctgctatggtcatttcagacatcagcaggtcattttcctcgggcgtgcgtaagctctaagaatctgatggaaaaagagtgctgcccaccatggtccggggatcgaagcccatgtggccaactatctggaagagggagctgtcagaacatcctgttatctaatgcccccctgggacctcaattccccttcactggagtggatgaccgggagagctggccgtctgtgttctataaccgaacctgtcagtgtagcggcaatttcatgggctttaactgcggcaactgcaaatttgggttctggggtccaaactgtactgaaagaaggctgctggttaggagaaatatctttgatcttagcgcacctgagaaggataaattcttcgcatatttgacactcgccaagcatacaatctctagcgattacgttatccccatcggcacttatggacagatgaaaaatgggtcgacccccatgttcaacgatatcaatatttatgacctcttcgtgtggatgcattactacgtttccatggatgctttactggggggttcagagatctggagagatattgattttgctcatgaagccccagcctttctgccttggcacaggctctttctcctaagatgggaacaggagatccaaaaactgactggagatgaaaacttcacaattccatattgggactggagggatgcagagaaatgtgatatttgcacggatgaatacatgggcggccagcatcccactaaccccaatctgctgtcaccggctagctttttctcatcatggcagatcgtgtgctcccgcctggaagagtacaactctcatcagagtctgtgtaacgggacacctgagggcccccttagaaggaaccccggcaatcacgacaaatctcgaactccccggctccccagttctgccgacgtggaattttgccttagcctgacccagtacgaaagcgggtcaatggacaaagcggcaaacttttcatttcgaaacacactggagggatttgccagtcccctgaccgggatcgccgacgcaagccagagttcgatgcataatgctctgcatatttacatgaatggtactatgtcccaggttcaaggcagcgcgaacgaccctatttttctgctacatcatgctttcgtggactccatcttcgaacagtggcttcgcagacacaggccacttcaggaggtataccccgaagccaacgcccctatagggcataatagggaatcctatatggttccatttatcccgttgtacagaaatggcgattttttcatctcctccaaggatctgggctatgattactcctaccttcaggatagcgatcccgacagttttcaggattatattaagtcctacctagaacaggcttcgagaatctggtcctggctactcggtgctgccatggtcggtgcagtgcttactgcattgcttgcggggttggtctcactactttgtagacacaagaggaagcaactgccagaagaaaagcaacccctccttatggagaaggaggattaccacagcctttatcagtcccatctc

SEQ ID NO: 20562 - DNA, 1587 bp, Artificial Sequence
  Description of Artificial Sequence: Synthetic coding sequence
atgctcctagccgtactgtattgtctcctctggtcctttcagacttcagcgggacactttcctcgggcctgcgtatctagtaaaaacctcatggaaaaggaatgctgtcccccttggtccggggaccgctcaccctgcgggcagttgtctgggcggggaagttgccagaatatattactgtctaatgcaccccttgggccccaattcccgttcactggagtcgatgatcgggagtcctggccaagtgtgttctataaccgcacttgtcagtgtagtgggaactttatggggtttaattgtgggaattgcaaattcggattctggggacccaactgcacagagcggcggctgctcgtcagaagaaacatattcgatctctctgccccagagaaagataaattcttcgcttacctgacattagctaaacatactatctcatctgattatgtgatcccaatagggacatacgggcagatgaaaaacgggtctactccaatgtttaatgatataaatatttatgatttgtttgtgtggatgcactattatgtgtccatggatgcactattgggaggaagtgaaatctggagggatatagattttgcacatgaagcaccagccttcttaccttggcatagactatttttgttacgatgggaacaggaaatacagaaacttacaggggatgaaaatttcacaatcccttattgggattggagggatgccgaaaaatgtgacatatgcacagatgaatatatggggggacagcatcccacaaatcctaacctcctctcccccgcttctttcttctcttcctggcagatcgtgtgctccaggctcgaagagtacaattcccatcagtcactctgtaatgggactcccgaagggcctcttagacggaatccagggaatcacgataaatcacgaactcccagactaccttcgtctgcagatgtcgaattctgcctttcactaacacagtacgagagtgggtcaatggataaggctgctaatttctcttttcgaaatacattggaagggttcgcatccccattaacagggatcgccgatgcctcacagtcttccatgcacaacgccttacatatatatatgaacgggacaatgtcccaggtgcaggggtcagctaatgatcctatatttctgctacatcacgcttttgtggattccatcttcgaacaatggctccgtcggcatcggccactccaggaggtctatcccgaagccaacgcccctataggacacaatagggaaagttatatggttcccttcatccccctgtacagaaacggagatttttttatttcttcaaaagatctaggatacgattattcctatcttcaggattccgaccccgatagttttcaggattatataaaatcttatctcgaacaagcatcacgaatctggtcatggctactgggggctgcaatggttggagcagttctgactgctctgctggccgggctagtctctttgttatgccgacataaaaggaaacagctgcctgaagaaaaacagcccctcttgatggagaaagaagattatcactctctctatcaatcccatctc

SEQ ID NO: 20563 - DNA, 1587 bp, Artificial Sequence
  Description of Artificial Sequence: Synthetic coding sequence
atgctgcttgccgtcttgtactgtctgctgtggtcctttcaaacgtccgcaggccactttcctagagcatgtgtgtcgtcgaaaaacctgatggaaaaagagtgttgtccaccctggtccggggacaggagcccttgtgggcaactgtcgggtcgggggtcctgccaaaacattctgcttagcaacgcaccactggggcctcagtttccctttacgggcgtggatgaccgggaatcgtggccgagcgtcttttacaacaggacctgccagtgctccggcaacttcatgggattcaactgtggaaactgtaaattcggattctggggacccaattgtactgaacgcaggctcctggtaagacggaatatcttcgacctgtcggctcccgagaaggataagtttttcgcatacctcaccttggcaaagcatactatttctagcgactacgtgatcccgattggcacttacggacagatgaagaatggatcaactcccatgtttaacgatatcaacatctacgatctttttgtctggatgcactactacgtcagtatggatgcgttgctcggtggatcagaaatttggagggatatagattttgcacatgaagcgcccgcattccttccctggcatagactgtttctgttgaggtgggagcaggaaattcaaaaacttaccggtgatgaaaactttaccataccttactgggactggagagacgcagaaaagtgcgatatctgtacggatgagtacatgggcggccagcatcctactaatcctaaccttctgtcacctgctagctttttcagctcgtggcagatagtgtgttcaagactcgaagaatacaatagtcatcaatcgctttgtaatggaacccctgagggaccgctgcgaagaaatccaggaaatcatgataagagccgtaccccccgcctgccgtcctccgcggacgtcgagttctgtctgtcacttactcaatacgagtcaggttctatggacaaggccgccaacttttcatttagaaacactcttgaaggattcgcatctcccctgactggtattgcggacgcatcgcaatcgagcatgcataatgctctccacatttacatgaacggtaccatgagccaagtgcagggttccgctaacgaccccatctttctgctgcaccatgcgtttgtggattccatttttgagcagtggctgaggagacaccgccctttgcaggaggtgtaccctgaagccaacgcacccattggacataaccgtgaatcatatatggtgccgtttattcccctttaccgaaacggtgatttcttcatatcttcaaaagaccttggatatgactattcgtacctgcaagacagcgatccggatagcttccaggactacatcaaatcgtaccttgagcaagcctcacgcatttggtcgtggctcctcggagccgcgatggtgggtgcagtgcttaccgcactgcttgcagggttggtgtccttgctttgcagacataagcggaaacagctgcctgaagaaaaacagccactcttgatggagaaggaagattaccattccctctaccaatcccacttg

SEQ ID NO: 20564 - DNA, 1587 bp, Artificial Sequence
  Description of Artificial Sequence: Synthetic coding sequence
atgttgttagctgtcctctactgtctgctttggtcattccagaccagcgcaggtcacttcccgcgggcctgtgtctcaagtaagaatcttatggaaaaggaatgctgccctccgtggagtggagatcgctctccttgcggacagctgtccggccgaggatcgtgtcaaaacatcttacttagtaatgctcccctcggaccgcaatttccgtttacaggcgtcgacgatagagagtcttggccatcagttttctataaccggacctgccagtgttcggggaactttatgggatttaattgcggaaattgtaaattcgggttctggggtcccaactgcaccgaacgaaggcttcttgtaaggcgtaacattttcgatctgagcgcccctgagaaagacaagttcttcgcatatctgacccttgctaagcacactatatcatcagattatgtgatcccaattgggacctatggtcagatgaagaatggcagtacgcctatgtttaacgatattaatatttatgatttgtttgtatggatgcattattatgtgtccatggacgccttgcttggtggctctgaaatctggcgtgatattgactttgctcatgaagcaccagctttcctcccatggcatcgtctgtttctgcttagatgggaacaggaaattcagaaactcactggtgacgaaaattttactataccgtattgggactggcgagacgctgaaaagtgcgacatttgtacagatgaatacatgggtggtcaacatcctacgaaccccaacctgttgtcccctgcctcttttttttctagttggcaaatcgtatgcagtaggcttgaggagtacaactcccatcaatcactctgtaacggtacgcctgaaggtccactcagacgtaaccccggaaaccatgataagtctagaacccccagactaccttcaagtgctgatgtggaattttgtttgtcacttacgcaatatgagtctgggagtatggataaagcagctaatttttcttttaggaacacgttggaaggctttgctagtcccctcaccggtatagcagatgcttcacaatcctctatgcataatgctcttcacatatacatgaacggaaccatgtcccaagtacaagggtctgctaacgatccaatttttttgcttcaccatgcattcgtcgatagcattttcgaacaatggttgagacggcatagaccgcttcaagaggtctacccggaggcaaacgcaccaattggtcacaaccgggagagctatatggtcccatttatcccactctaccgaaacggtgatttttttataagttccaaggacctggggtatgattattcttatcttcaggatagtgatcctgactcgttccaagattatattaaaagctaccttgaacaggccagtcgtatatggtcttggctgttaggagctgctatggttggggcagtgcttacagcgttacttgcaggtctcgtgtccttgctgtgccgacacaagcgaaagcagctcccagaggagaaacagcctctgttgatggagaaagaagattatcattcactatatcagtctcatttg

SEQ ID NO: 20565 - DNA, 1587 bp, Artificial Sequence
  Description of Artificial Sequence: Synthetic coding sequence
atgctcttggccgttttgtactgcctcctgtggtccttccagacctcggcgggccacttcccacgggcgtgtgtctcctcgaagaacctgatggagaaagaatgctgtccgccgtggtcgggtgatcgctcgccttgcggccagctctcgggtcggggaagttgtcaaaacattctgctgtcaaatgccccgttgggaccgcagtttccgttcaccggagtggacgatcgggaatcgtggccatcggtgttctacaatcgaacttgccaatgttccgggaatttcatgggctttaactgtggaaattgcaagttcggattctggggcccaaactgtacggaacgccggctcctcgtcaggcgcaatatcttcgatctttcagcgccggaaaaggacaagttcttcgcttacctgacgctggcaaagcacactatctcctccgactacgtaatcccgattggcacttacgggcagatgaagaacggctcgacgccgatgtttaatgacatcaacatctacgatctcttcgtgtggatgcattactatgtgtcaatggacgctcttctggggggctccgaaatctggcgtgacatcgacttcgctcatgaggctccggcgttcctcccttggcaccggctctttttgctgcggtgggaacaggagatccaaaaactgaccggtgacgagaatttcaccatcccatactgggactggagggacgccgaaaagtgcgatatttgtaccgacgagtatatgggtggacagcacccgactaacccgaatctgttgagccccgcctcgttcttctcatcctggcagattgtctgctcgcggctggaagagtataactcccatcaaagcctctgcaatggcaccccggagggcccgctcagaagaaatccaggaaatcatgacaaatcacggaccccgcggctgccgtcatcggccgacgtcgagttctgtcttagcctgactcagtacgagagcggttcgatggacaaggctgcgaacttttccttcagaaacaccctggaaggattcgcgagccctctgactggaatcgcagacgcctcccaatcaagcatgcacaatgcgctgcacatttacatgaacggaactatgtcgcaggtgcagggatcagccaatgacccgattttcctgttgcaccatgcgtttgtggattccatctttgagcagtggctcagaaggcaccggccactccaagaggtgtaccccgaagcgaacgcgccgatcggacataaccgcgaatcgtacatggtgccgtttattccactctaccggaacggtgatttctttatctcgtcaaaagatcttggttacgattacagctacctgcaggactccgatccggactcctttcaggattacatcaagagctaccttgaacaagcatcgaggatctggtcgtggctgctcggcgctgccatggtgggagccgtgctgaccgccctgctcgcaggactcgtgtcactgctctgccgccacaagaggaagcagctcccagaagaaaaacagccgctgttgatggaaaaagaagattaccactccctctaccaatcgcacttg

SEQ ID NO: 20566 - DNA, 1587 bp, Artificial Sequence
  Description of Artificial Sequence: Synthetic coding sequence
atgcttttggcggttctgtactgtttgctttggtcattccagactagcgccggccactttccgagagcctgcgtgagctcaaagaacctgatggaaaaggaatgttgccccccgtggtcgggggacagaagcccatgtggacagctgtcgggtagaggcagctgccaaaacatcctgctgtcaaacgccccgctcgggccgcagttccccttcaccggcgttgatgacagagaaagctggcctagcgtcttttacaaccggacttgccagtgctccggcaactttatgggattcaactgcggaaactgcaagttcggtttctggggtccgaattgcactgaacggcggctgctcgttagacggaacatcttcgacctgagcgcgccggagaaggataagtttttcgcgtaccttactctggctaagcacaccatctcctctgattacgtgattcctatcggaacttacgggcaaatgaagaacggatcaaccccaatgttcaacgatatcaacatctacgatctcttcgtctggatgcactactatgtctcgatggatgcactgctcggaggctctgaaatctggagagatatcgactttgcacatgaggcccctgcgttcctcccatggcaccgattgttcctgctgcgatgggaacaagagatccaaaagctgaccggggacgagaacttcaccattccgtactgggattggcgcgacgcagagaaatgcgacatctgtaccgatgaatacatggggggtcagcaccctacgaacccgaacctcctctcaccggcatccttcttttcgtcgtggcaaattgtgtgctcaagactggaagaatacaattctcatcagtccctgtgcaacggtaccccggaaggccccctccggagaaaccctggaaaccatgataagtctcgtaccccccggctcccatcatccgctgacgtggaattttgcctgagcctgactcagtacgagtcagggtctatggacaaagccgccaacttttcctttcggaatactctggagggattcgcctcgccgctgaccggtattgcagacgcttcccagtcgagcatgcataatgccctgcacatctacatgaatggaactatgtcccaagtgcagggatccgctaacgatcccatctttctgctccatcacgccttcgtcgactcgatcttcgaacaatggctgaggcgccatagaccgctgcaagaagtctacccggaggcaaatgcgccgatcggtcacaatcgcgaaagctacatggtgcctttcatcccattgtaccggaacggcgatttcttcatctcttccaaggacctgggatacgattactcatacctgcaagacagcgaccctgacagcttccaggattacatcaagtcgtacctcgaacaggcgtcgcgcatctggagctggctgctgggagcggcaatggtcggggccgttctcaccgcattgttggctggactcgtctcgctcctgtgccgccacaaacgcaaacagctgccagaggaaaaacagccacttctgatggagaaggaggactatcactcactgtaccagtcacacctg

SEQ ID NO: 20567 - DNA, 1587 bp, Artificial Sequence
  Description of Artificial Sequence: Synthetic coding sequence
atgctcctggcagtcctttattgcctgctgtggtcctttcagacgtccgcgggtcacttcccccgcgcctgcgtttcttccaagaatctgatggagaaagagtgctgtcccccctggagcggggacagatctccctgcggacagctttccgggagagggtcgtgccaaaacatcctcctctccaacgctcctctaggcccccagttccctttcactggggtggatgacagagagtcttggcctagcgtgttttataacagaacttgtcagtgctccggtaacttcatgggattcaattgcggcaactgtaaattcggcttttggggtccaaactgcaccgagcgccgcctcttagtgcggcgaaatatctttgacctaagtgcccccgaaaaggacaaatttttcgcctacctgactttggccaagcatactatctcatctgactacgttattcctatcggaacctacggccagatgaaaaatgggagtaccccgatgtttaatgacattaacatttatgatttgtttgtttggatgcattattacgtgtccatggacgctctcctgggaggaagtgagatttggcgcgatattgatttcgcccatgaggcgcctgcattcctcccctggcataggctgtttcttctgcgctgggagcaggagatacaaaaattaaccggcgatgagaactttaccatcccttattgggactggcgcgacgcagaaaaatgcgacatttgtacagacgagtatatgggaggccagcatccaacaaatccgaacctcctcagccccgctagcttcttcagttcctggcaaatagtgtgctcgcgtctcgaagagtacaatagccaccaatcactgtgtaacggaacacccgaagggcccctgaggcggaaccccgggaaccacgacaagagccgaactccccggcttccatcttccgctgacgtggaattttgcctgtctctgactcaatacgaatcaggctcaatggacaaagccgccaacttcagcttccggaataccctggagggattcgcaagtccactgaccggcatcgctgatgcgtctcagtcaagtatgcataatgcactgcatatctacatgaacggaaccatgtcccaggtgcaagggagcgcaaatgatcctatatttctgctccatcacgctttcgttgatagcattttcgagcagtggctcagacgacacaggcccctccaagaagtgtaccctgaggctaatgcccccatcggccataaccgtgagagctatatggtgcctttcattccattgtatagaaatggggatttcttcatctctagcaaggatctaggatatgactactcttatctccaagactccgatcccgactcctttcaggactacatcaagagctaccttgaacaagcatcgaggatctggtcttggctgctgggggcagcaatggtgggcgccgtccttacagcattactggccggactagtgtccctgctttgtcggcataagcggaagcagcttcccgaggaaaaacagcccttacttatggagaaggaggattatcactctctctaccagtcccacttg

SEQ ID NO: 20568 - DNA, 1587 bp, Artificial Sequence
  Description of Artificial Sequence: Synthetic coding sequence
atgttactcgccgttctgtactgcctgctctggtcctttcaaacatcagctggacacttccctcgggcctgtgtgagttcaaagaatctcatggagaaggaatgctgccctccgtggtctggagatagatccccttgcgggcagctgtcagggcgggggtcctgccagaatatcctgctgtccaacgccccactgggaccacagttcccatttactggtgtcgacgatcgtgaatcctggccttctgtgttctataaccgcacctgtcagtgtagcggaaacttcatgggattcaactgcggcaattgcaaatttgggttttgggggccgaattgcactgagcggagactgcttgtccgccgaaacattttcgacctgagcgctcccgaaaaagacaagttcttcgcctacttgactttggccaagcacacaattagctccgattacgtaatacccatcggaacctacggccagatgaagaatgggtctacacctatgttcaacgatatcaacatatacgacttatttgtgtggatgcattactatgtatcgatggacgccctgctagggggcagcgaaatctggagggatatagactttgcacacgaagcgcccgcatttttaccatggcacaggttgttccttttgaggtgggagcaagaaatacagaaactgactggcgatgaaaacttcactatcccgtactgggattggcgggacgccgaaaagtgtgacatttgtaccgatgaatatatgggtggacagcaccccaccaatcctaacttgctatcgcccgcgtccttcttctcatcgtggcagatcgtctgctcccgcctcgaagaatataactctcaccagagtttatgtaatggcactcccgaagggccacttaggcgaaaccccggaaatcacgataaatcaaggaccccgcggctgccaagttctgcagatgtggagttctgccttagcctcacgcagtacgaatccggtagcatggacaaggccgctaatttttctttccgcaataccctagaggggttcgcttcaccactgacaggtatcgccgatgcctctcagtcgtctatgcataacgccttacatatctatatgaacggaaccatgtcccaggtgcagggttctgcaaatgatccaattttcctccttcaccatgccttcgtggattcaattttcgaacaatggctgcgacggcacagacccttgcaagaagtttaccccgaggcgaatgcgcccataggccacaaccgggagtcctacatggtcccattcataccgctatacaggaatggagatttttttatcagtagcaaggacctgggctacgattatagttatctgcaagactctgatccggattcgttccaggattatatcaagtcttacctggagcaggcgtcgcggatctggagctggctgctgggcgcggctatggtgggagcagttctgaccgcactactggcaggtctcgtgtccctgttatgtcgccataagaggaaacagctccctgaggaaaaacagcctttactgatggagaaagaggattaccactcgctatatcagagccacctc

SEQ ID NO: 20569 - DNA, 1587 bp, Artificial Sequence
  Description of Artificial Sequence: Synthetic coding sequence
atgctgctggccgtcctgtattgcttactctggtcctttcagacttctgcaggtcacttccccagggcgtgtgtgtcatctaaaaacttgatggaaaaggagtgttgcccgccatggagtggagatcgttctccttgcggccaacttagtggccgcggctcttgccagaacatacttttgagcaacgcgcccctaggaccacagttcccctttacaggagtggacgaccgagagagctggccctccgtgttttataaccgcacttgtcagtgttctggtaactttatgggattcaattgtggaaactgtaagttcgggttctggggtcctaactgcaccgagcggcgcctgctggtgagaagaaatattttcgatctgtcagccccagaaaaagataagtttttcgcatacctgactcttgcaaaacatacgatcagttcagactacgtgattcctatcggtacttacggccagatgaagaatggcagcacaccaatgtttaatgacataaacatttacgatctctttgtgtggatgcactattacgtaagcatggacgcactgctcgggggatctgaaatttggcgggacattgactttgctcatgaagcgccagccttcctcccctggcaccggctgttcctcttgcggtgggagcaggaaatccaaaagcttaccggcgacgaaaatttcacgataccctactgggactggcgcgacgctgagaagtgtgacatttgcaccgacgagtatatgggcgggcagcaccccacgaatccaaatcttctgtcccctgcctcgttttttagttcatggcaaattgtttgcagccggcttgaagagtataactctcaccagtcactgtgcaatggcacgcctgagggacccctgcggcgtaacccagggaatcacgataaatccagaactccccgcctgccgagcagcgcagacgtcgagttctgtctgtctttgacacaatacgagagcggctcaatggacaaggcggcgaattttagttttcgtaacacactggaagggttcgcctctcccctgactgggatcgccgatgccagccagtccagtatgcacaatgcgctccatatttacatgaacggtacgatgtcacaggtgcaggggtcggctaatgaccctattttcttgctgcaccacgcgtttgtggattctatttttgaacaatggctgcgcaggcaccggccattgcaggaagtgtatcccgaagccaatgccccaataggacacaatagggagtcctatatggtgcctttcattcctctatatcgaaacggggacttttttatttccagtaaggatttgggctatgattattcatacctgcaggatagcgacccagattctttccaggattacataaaatcctatctggagcaggcctcccgcatctggtcatggctcctcggcgcggccatggtgggagcagtactgactgcacttctggcagggctggtctccttgctgtgcaggcataagaggaaacagcttccagaagagaaacaacctctgctgatggaaaaagaggactaccatagtttatatcaatcacacctg

SEQ ID NO: 20570 - DNA, 1587 bp, Artificial Sequence
  Description of Artificial Sequence: Synthetic coding sequence
atgctactggccgttctgtactgcctgctttggtccttccagacatctgcgggccattttccgcgagcctgtgtgtcatcaaagaatctcatggagaaagagtgctgtccgccttggagtggcgataggagtccttgtggtcaactcagtggccggggatcctgtcaaaacatcctgctcagcaatgccccactgggaccccagtttccgttcacaggtgtggacgatcgtgagtcatggccttcagtcttttataacagaacctgtcagtgtagcggtaacttcatgggcttcaattgcggaaattgtaaatttgggttttggggacccaattgcacggaaaggaggctgctggtgagacggaatattttcgacttgtccgctcctgaaaaagacaagtttttcgcgtatctcacactggcgaagcacacaataagtagtgattatgtgattcccatcggcacatacggccagatgaaaaacgggtccactcctatgtttaatgacattaacatttacgatttgtttgtgtggatgcactactacgtcagtatggacgctctattggggggctccgagatctggcgagatatcgactttgctcacgaagcccccgccttcctaccctggcaccgattgttcctcctgagatgggagcaggaaattcagaaactgaccggggacgaaaacttcaccatcccttattgggactggagggacgcagagaagtgcgatatatgtacagatgagtacatgggcgggcagcatcccacgaaccccaacttacttagcccggcctcttttttttcttcctggcaaattgtctgctctcgtctcgaggagtataactctcatcaatccctgtgtaacggaactccagagggccctcttagaagaaatcccggcaatcacgacaagagccggactcccaggcttccgtcttctgccgacgtggagttttgcctctcgttgacccagtacgagagcggcagtatggacaaggcagcaaacttctcctttcggaatacgcttgagggctttgccagccctctgaccggcattgcagacgccagtcaatcaagtatgcacaatgcattgcacatttatatgaatgggacaatgtctcaggtgcaaggatccgccaatgatcccatcttcttgctgcaccatgcgtttgtcgacagcatcttcgaacaatggctgaggaggcaccggccgctacaagaggtgtacccagaggcgaatgctccaatcggtcacaatcgcgagtcctatatggtcccttttattcctctgtacaggaacggggactttttcattagttccaaagatctgggatacgactactcctacctgcaagactccgaccccgactcatttcaggattacataaagtcctatttggaacaggcctcacgtatctggtcgtggctgctcggtgccgccatggtgggggcagttctgacagcactcttggccggtttggtgagtctgctgtgtaggcacaaaaggaagcagctgcccgaagaaaagcagccactgcttatggagaaagaggactatcactccctttaccagagtcacctt

SEQ ID NO: 20571 - DNA, 1587 bp, Artificial Sequence
  Description of Artificial Sequence: Synthetic coding sequence
atgctgctcgcagttttatactgcctgctgtggagctttcaaacaagcgcagggcatttccctagggcctgcgtgagctccaagaacctaatggaaaaagaatgctgtcctccttggtccggtgataggtccccctgcggacagctctccggcaggggttcatgtcagaacattctcctgtctaacgcccccctcgggccacagtttcccttcacgggggttgacgatcgggagtcatggccttcggtgttttacaacagaacctgccaatgttctggaaactttatgggttttaactgtggaaactgcaaattcggtttctggggtccaaactgcacagagagacgtctccttgtgcgccgaaatattttcgacttgtctgcgccagaaaaagacaagttctttgcttacctgacactggcaaaacacaccattagctcagactacgtcataccaattggcacctacggtcagatgaagaatggttcaactcccatgttcaacgacattaatatctacgatttgtttgtctggatgcactattacgtctccatggatgcactgctgggcggatccgagatttggcgagacattgatttcgctcatgaggctcctgcctttctgccctggcaccgtctgtttctgctgcggtgggagcaggagattcagaaacttaccggtgacgaaaactttactattccttattgggattggcgggatgctgagaagtgtgacatatgcactgatgagtatatgggtgggcaacacccaactaaccctaatcttctgtcgcccgcctccttcttttcgtcatggcagatcgtgtgttcgcggctcgaagagtacaattcgcaccagtctctgtgtaacgggacaccggagggaccgctgcgccggaaccccgggaatcatgataagtctcggacgccccgcctgccatcctccgctgatgtcgaattctgtttatctctgacccagtacgaaagcggttcaatggataaagccgcaaatttttccttccgcaacaccctggaggggttcgccagccccttaacaggaattgcagacgcctctcaatcttctatgcataacgctttgcacatctatatgaacggaacaatgtcccaagtccaggggagcgccaacgatccgatctttctgctgcatcatgcctttgttgatagtatctttgagcagtggctgcggaggcacagaccccttcaggaagtctaccccgaagctaacgcgccgattggccacaaccgggagagctacatggttccttttatcccattatacaggaacggggattttttcatttcgagtaaagacctcgggtatgactactcatacttgcaggactcagacccggacagtttccaggattatattaaatcatatctggaacaggcttcgaggatttggtcttggttgttaggtgctgccatggtaggcgccgtgctcaccgctctgttggctggacttgtaagcctgttgtgtcgccacaagcggaaacaactgcccgaagagaagcagccattgctcatggagaaggaggattaccactctctgtatcagagccatctc

SEQ ID NO: 20572 - DNA, 1587 bp, Artificial Sequence
  Description of Artificial Sequence: Synthetic coding sequence
atgctgcttgccgttctctattgcctgttatggtcctttcaaacctctgctgggcacttcccaagggcctgcgtgtccagtaaaaatctcatggagaaagaatgttgtcccccttggtctggcgataggtctccgtgcgggcagctgagcggacggggatcctgccaaaacatcttactgagtaacgctcccctgggcccacagtttccattcacaggggttgatgaccgggagtcatggccaagtgttttttacaaccggacctgccagtgctcaggaaatttcatgggatttaactgtggcaattgcaaattcggattttggggtcctaactgcacagagcggcggctcctggtgcgcaggaacatcttcgatttgagtgcccctgaaaaggataagtttttcgcttacctcacattagcgaaacacaccatttcttccgactacgtgatacccataggtacgtacggtcagatgaagaacgggtcaacaccgatgttcaatgacatcaatatctacgatttgttcgtgtggatgcactattacgtctcaatggatgccctattaggtgggagcgagatctggagggatatcgacttcgcacacgaagcaccagcctttctcccgtggcacaggctttttctccttaggtgggagcaggagattcaaaagctcacgggcgacgaaaactttaccatcccatactgggattggagggatgccgaaaaatgtgatatctgcacagacgaatacatgggcgggcagcatcctaccaaccctaatctcctaagtcccgccagcttttttagttcctggcagatcgtctgctccagattagaggaatacaattcacaccagtccctttgcaacggaacccccgaagggccgttgagacggaatcctggtaatcacgacaagtctcgcacaccacgcttaccctctagtgcggatgtggaattttgtttatcccttactcagtacgagtccggctccatggacaaagctgccaatttcagcttcaggaacaccctcgaaggttttgcctctcctctgacaggaattgcagatgcttcccagagttctatgcataacgctctccatatatacatgaatggtacaatgtcccaggtccagggcagcgccaatgaccctattttcctgctgcaccacgcgtttgtagactcgatcttcgagcagtggttaagacgccatcggccccttcaggaagtctatccagaggctaatgcaccaatcggacacaatcgggaatcttatatggttccctttattcccttgtatcggaacggtgactttttcatttctagcaaggatctgggatacgactacagctatctgcaggactctgatcccgactcttttcaggactatatcaagtcttatcttgagcaagcatcgcggatctggtcatggctgctgggcgccgctatggtgggggccgttttaactgctttactcgctgggctcgtctcactgctctgcagacataaaaggaagcagctccctgaggaaaaacagccccttctgatggagaaggaagactatcactctctataccagtctcactta

SEQ ID NO: 20573 - DNA, 1587 bp, Artificial Sequence
  Description of Artificial Sequence: Synthetic coding sequence
atgctcctggcagtgctgtactgcctgctgtggtccttccaaaccagcgcgggccacttcccgagggcttgcgtcagctcgaagaatctgatggaaaaggaatgctgtcctccgtggtcgggcgaccgaagcccctgcggtcaactgtccgggaggggaagctgccagaatatcctcctgtcgaacgctccgctcggcccccagtttccgttcactggcgtggatgaccgcgagtcctggccctcagtattctataaccgtacctgccagtgttctggcaacttcatgggattcaattgtggaaattgcaaatttgggttctggggtcctaactgtaccgagcggcggctgctggtgcgcagaaacatcttcgacctgtcggcaccggaaaaagacaagttcttcgcctacctgaccctcgcaaagcacacgatcagctcggattacgtcattccaatcggcacttacggacagatgaaaaacggtagcacgccgatgtttaatgacatcaacatttacgacctctttgtctggatgcactactacgtgtcgatggacgccctgctgggtgggtccgaaatctggagagatattgactttgcacacgaggcgcctgccttccttccgtggcataggttgttcctcctgcgctgggagcaggagatccagaaactcaccggagatgaaaacttcaccattccgtactgggactggcgagacgcggaaaaatgcgacatctgcactgatgaatacatggggggtcagcatccaactaatccgaaccttctgtccccggcctcctttttctcgtcgtggcagatcgtctgcagccgcctggaggaatacaattctcatcaatcactgtgcaacggaactccggagggaccactgcggcgcaatcctggtaatcacgacaagtcgcggactccacggctgccgagcagcgctgacgtggaattctgtctgtcgctgacccagtacgaatcgggctcaatggataaggcagcaaatttctcattccggaacactctggaaggatttgcatcgcctctgaccgggatcgctgacgcctcccaatcgtcaatgcataacgcgttgcacatatacatgaacggaactatgtcccaggtgcagggtagcgcgaacgatccaatctttctgttgcatcacgctttcgtggattcaatctttgaacagtggctcaggcggcacagaccgctgcaagaggtgtaccccgaggcaaacgcccctatcggacacaatagggaaagctacatggtcccgtttatcccgctgtaccggaacggagatttcttcatctcaagcaaagatctcggatacgactattcgtacctccaagactcagatcctgactcgttccaggactacatcaaatcctacctggaacaagcctcccgaatctggtcctggcttctgggtgccgcaatggtgggggctgtgctgactgcgctcctggccggtctggtgtccctgctctgccgtcacaaaagaaagcagctgccggaagaaaagcagcctctgctcatggaaaaggaggattaccacagcttgtaccagtcccacctg

SEQ ID NO: 20574 - DNA, 1587 bp, Artificial Sequence
  Description of Artificial Sequence: Synthetic coding sequence
atgctcctcgctgtgctgtattgtcttctctggtcattccagacttccgccggtcattttccgagagcatgcgtctcatctaaaaatctgatggaaaaggaatgctgcccaccttggtccggggacagatcaccatgcggacagctatcggggcggggcagctgccagaatatcctgctgagcaatgctccactgggcccccagtttccttttaccggggtggacgatcgtgagtcgtggccaagcgtgttctataataggacatgccagtgtagcgggaatttcatgggcttcaactgcgggaactgtaagtttggattctggggcccaaattgcacggagcggaggttgctcgtgcgccggaacatttttgatctctccgcgccagaaaaagacaagttttttgcctatctgacactagcaaaacacaccatttcatcagattacgtcatcccaatcggtacttacggacagatgaagaatggttccaccccgatgtttaacgacattaatatatacgaccttttcgtttggatgcactattatgtgagtatggacgcgttgctgggaggctccgaaatctggcgcgacattgatttcgcccacgaggctccggcctttcttccctggcatcgcctcttcttgctgcggtgggagcaggaaattcagaaactgaccggcgacgagaacttcacaattccctattgggactggagggatgctgagaagtgtgatatctgtaccgacgaatatatgggcggccaacatccaaccaacccaaatctgttaagtcccgccagtttttttagcagttggcagattgtctgcagtagattggaggagtataattcacaccagtcgctgtgtaatggtacacctgaaggaccactgcgcagaaaccccgggaaccatgacaagtcgcgaacaccacgattgcccagttccgcagatgtggaattctgcctgtctcttacacagtacgagagtgggagcatggacaaggcagccaatttctcttttcgcaataccctggaggggttcgcctcccccctcacgggtatagccgatgccagccagtcaagcatgcacaacgcactccatatttatatgaacggtacaatgtctcaagtgcagggttctgcaaatgatccgattttcctcctgcatcacgcatttgttgattcaatctttgaacagtggctgcggaggcaccggccactccaagaagtctaccctgaggctaacgcccctattggccacaacagggaaagctacatggtgccgttcattcctctctaccggaatggtgacttcttcatttcatcaaaagatctcgggtacgactacagctacctccaagactccgaccctgatagctttcaggattacattaagtcctatctggagcaggccagccgaatatggagttggctgctcggcgctgcaatggtcggcgccgtgctgaccgcccttctcgccggcctcgtgagcttactctgtagacataaacgcaagcagctgcccgaggagaagcagcccttactcatggagaaagaggactatcattccctctatcagagtcacctg

SEQ ID NO: 20575 - DNA, 1587 bp, Artificial Sequence
  Description of Artificial Sequence: Synthetic coding sequence
atgttattggcagtgctctactgcctgttgtggtccttccaaacaagcgccggccactttcctagggcatgcgtatcctccaagaatcttatggaaaaggaatgttgcccaccttggtccggcgatagatctccttgtggacagctgtctgggcggggatcctgtcagaacatcctgcttagcaatgccccactgggacctcaatttcccttcaccggagttgatgaccgggaatcatggcctagcgtgttttacaaccggacttgtcagtgctctgggaatttcatgggctttaattgcggaaattgtaaatttgggttttggggaccaaactgcacagagcgccgactcttagtccggcgcaacattttcgatctgtctgcccctgaaaaagataaattctttgcctacctcactctggcaaagcataccatctcatcggactatgtgatccccatcggaacctatggacaaatgaaaaacggctccactccaatgtttaacgatattaacatatatgacctgtttgtgtggatgcactactatgtgtcaatggatgctctgctagggggctctgagatctggcgggacatcgacttcgcccatgaagcccctgccttcctcccctggcatcgcctgttcctcctgcggtgggagcaagagatccagaaactgaccggagatgaaaactttacgatcccctattgggactggagggacgcagagaaatgcgacatttgtactgatgagtatatgggtggacaacacccgacaaaccctaatttgctgtcaccagcttctttctttagttcttggcagatagtatgctcaagattggaagaatacaattcgcatcagagcctctgcaacggtactcccgaagggccccttcgacgaaaccccggcaatcatgataagagtcgcacgccaagacttccaagctccgccgacgtcgagttctgcctgagcctgactcagtacgaatccggctcaatggataaagctgcaaacttctcttttaggaacaccttagaagggtttgccagcccacttaccggaatcgctgatgcgagccagagctccatgcacaacgccctgcacatctacatgaatggcaccatgagccaagtacagggttctgccaatgacccaattttcttgttacatcacgcctttgtggactccatctttgaacagtggctccggcggcaccgaccactccaggaagtgtacccagaggccaatgcccctattggacataacagagaatcttatatggtgcctttcatacctttgtaccgcaacggggatttctttatttcttcaaaggatctcgggtatgactatagctatctgcaagattcagacccagactcttttcaggactatataaagtcttatctggaacaggcctcaagaatctggtcttggctgcttggcgctgctatggtcggtgccgtgttgaccgcgttgctagccggcctggtaagtctcctgtgccgccacaagaggaaacagcttcccgaagagaagcagccccttttgatggagaaggaagactaccactcgctctaccagtctcactta

SEQ ID NO: 20576 - DNA, 1587 bp, Artificial Sequence
  Description of Artificial Sequence: Synthetic coding sequence
atgctgcttgccgtactgtactgcttgctgtggagcttccagacttccgccggacacttcccacgcgcatgtgtgtcctcgaaaaacctgatggagaaggaatgctgccccccttggtccggcgaccgatccccatgtggtcaattgagcggacggggatcgtgtcaaaacatccttctgtcgaacgcaccgctgggcccgcagtttccgttcaccggcgtagacgaccgagagagctggccgtccgtgttctacaataggacctgccagtgctcgggcaatttcatgggatttaactgcggcaactgtaagttcgggttttggggaccgaactgcactgagcggcggctgttggtgcgccgcaacattttcgacctgagcgcaccggagaaggacaagtttttcgcctatctcacgctggcaaagcacactatatcctcggattacgtgatcccgattggtacttatggccagatgaagaacggctcaactccgatgttcaacgacatcaatatctacgacctgttcgtgtggatgcactactacgtgtcgatggacgcccttctgggaggttccgagatctggagagacatcgatttcgctcacgaagctccggctttccttccttggcacagactgttcctgttgagatgggaacaggaaatccaaaagctgaccggggatgagaactttaccatcccgtactgggattggcgggatgcagaaaagtgcgacatttgcaccgacgaatacatggggggccaacatccgaccaatccgaatctgctgagcccagcctccttcttttcttcctggcaaattgtttgctcccgcctggaggaatacaactcgcatcagagcctgtgcaacggaactccggagggaccactccggcgcaatcccggcaatcatgataaatcaagaactccacgcctgccatcatccgcggacgtcgaattctgtctctccttgacccagtatgaatcgggcagcatggataaagcggcaaacttttcgttccggaacactctggagggattcgcttccccgcttaccggtatcgcggacgccagtcagtcgtcgatgcataacgcgctccacatctacatgaatggaaccatgagccaagtgcagggcagcgccaacgatccaatcttcctcctgcaccacgctttcgtcgattcgatctttgaacaatggctccgccggcatcggccgctccaggaagtgtaccctgaggctaacgcaccaatcggccataaccgcgaatcatacatggtgcccttcatcccgttgtataggaacggagacttctttatctcatcaaaagatctgggatacgactactcctacctccaggactctgacccagattcctttcaggattacataaagtcgtacctcgaacaagcgtcgagaatctggtcgtggctgcttggtgccgccatggtgggggccgtgctcacggcccttctcgctggcctggtttcgctgttgtgcagacacaagcgtaaacagctgcctgaggagaaacagccactgctcatggaaaaggaggactaccattccctttaccagagccacctg

SEQ ID NO: 20577 - DNA, 1587 bp, Artificial Sequence
  Description of Artificial Sequence: Synthetic coding sequence
atgctgctggccgtgctgtattgcctgctttggtccttccagacttcggcaggacactttccccgcgcctgcgtcagctcgaaaaatctcatggaaaaggagtgctgtccaccatggtccggagatcgctcgccttgcggtcagctttcgggccgcgggagctgtcagaacatcctgttgtcaaatgcgccactcggacctcagtttccattcactggggtggatgatcgggagtcatggccaagcgtgttctacaatcggacctgtcaatgttcaggcaactttatgggttttaactgtggcaactgcaagtttggattttggggcccaaactgcactgagagacgtcttttggtccgaagaaatatctttgatctttcggcacctgaaaaggacaagttttttgcgtaccttaccctcgccaagcatactatctcatcggactacgtgatccccatcggaacctacggacagatgaagaacggttccactcctatgtttaatgacattaacatatacgatcttttcgtgtggatgcattactatgtctcgatggatgcgctcctgggaggatccgaaatttggagagatatcgattttgcacatgaggcaccagctttcttgccttggcacaggctttttcttcttagatgggaacaagagattcagaagctgacgggagacgaaaacttcaccattccgtactgggattggcgggatgcggaaaaatgtgacatctgcactgatgaatacatgggtggacaacatcctaccaacccaaatctgctttccccagctagcttcttttccagctggcaaatcgtctgctcgagactggaggagtacaatagtcaccagtcgctgtgcaatggtacccccgaagggcctttgcggcgtaatccaggaaaccatgacaagtctcgcaccccgaggttgccaagctccgcggacgtcgagttttgtcttagcttgactcaatacgaatcagggagcatggacaaggctgcaaacttttcgttcagaaacaccctcgagggatttgcaagccctctgactgggattgcagatgcgtcccaaagctcgatgcacaacgcactgcatatctacatgaatggtactatgtcacaggtgcaaggttcggcaaacgatccaatctttctgcttcaccatgcattcgtggacagcatctttgaacaatggctgcgccgccacagacctcttcaagaagtgtacccagaagccaacgctcctatcggacataaccgggagtcttacatggtgccattcattcccctctaccgcaatggtgactttttcatttcctccaaggatctgggatacgattactcgtacctgcaggattcggacccggattcgtttcaagattacattaagtcctacctggaacaggcatccaggatctggtcctggttgcttggtgctgctatggttggagcagtgcttaccgctcttctcgcaggattggtatcgcttctctgtcgacacaagcggaaacaactgcctgaggagaagcaacctcttcttatggagaaggaagattatcatagtctctaccaatcccacctc

SEQ ID NO: 20578 - DNA, 1587 bp, Artificial Sequence
  Description of Artificial Sequence: Synthetic coding sequence
atgctgctggcggtcctgtactgtctcctgtggtcatttcagacgagcgccgggcacttcccaagggcctgtgtgtccagtaaaaacctcatggagaaggaatgttgcccgccttggagcggagacaggtcaccatgtggtcagctgagtggaagaggctcgtgtcaaaatatcttgctgtcaaacgcccctttgggaccacaattcccatttactggagttgatgatagggagtcctggccttccgtattctacaacagaacctgccagtgcagtggcaatttcatgggctttaactgcgggaactgcaaatttggattttggggccctaattgcacagaacggcggctgctcgtgaggagaaacatttttgacctgtccgccccggagaaggataaatttttcgcctatcttaccctagctaaacacaccattagcagcgactatgtaattcctatcggcacatacggacagatgaaaaatggttccactcctatgttcaacgacatcaacatctacgacctgtttgtgtggatgcattattacgtcagtatggatgccctgctgggcggcagcgaaatctggagggatatcgatttcgctcacgaagctcccgcgttcctcccatggcaccgtctgtttctgttgagatgggagcaggagattcagaaactgacaggggatgaaaatttcacaatcccatactgggactggcgcgatgccgagaagtgtgacatttgcaccgacgaatatatgggcggccaacaccctacaaaccccaaccttctcagtccagccagcttcttttcgtcatggcagatcgtctgttcacggctcgaagaatacaattcgcatcagtccctgtgcaatggcactccagagggaccgttaagaaggaatcccggcaatcatgacaaatccagaacacctcgcctgccctccagtgccgacgtcgaattctgtttatctctgactcagtatgaatctggatcgatggacaaggccgctaattttagttttcgaaacacccttgaagggttcgcgagcccgctgactgggattgcagatgcctcacaaagctctatgcacaacgctctgcacatctatatgaatggcactatgtcccaggtgcaaggaagcgcgaacgatcccatattcctgctccaccacgccttcgttgacagtatatttgagcaatggctgaggcgccaccgcccgctgcaagaggtttatccggaggcaaacgcccccatcggtcataaccgcgaatcttacatggtaccattcatacccctgtacaggaacggcgatttttttatcagcagtaaggatctgggatacgactattcttatctgcaggattcagaccccgattcattccaggattatatcaaaagctatttggagcaggcgtcgcgtatatggtcgtggttgttaggcgccgctatggtgggggcggtcctgaccgccctactggcaggcctggtgagtttgctctgccggcacaaaaggaagcagcttcccgaggagaaacagcctctcctcatggaaaaagaagattatcacagcctgtatcagtcccacttg

SEQ ID NO: 20579 - DNA, 1587 bp, Artificial Sequence
  Description of Artificial Sequence: Synthetic coding sequence
atgcttcttgccgtgctctattgtctgctctggagctttcagacaagcgcgggacattttcctcgcgcgtgcgtgtcatcaaagaacttgatggaaaaagagtgctgccccccgtggtctggcgacaggtccccatgcgggcaactctctggccgggggagctgtcagaacatcctactatccaatgcccccttgggcccacagttcccattcactggagtggatgatcgcgaatcttggccaagcgttttttacaaccgtacatgccaatgctcgggaaacttcatgggctttaattgcggtaactgtaagtttggattttggggcccgaactgcaccgagaggcggcttttggttcgaaggaacatctttgacctctccgctccagaaaaagacaagttttttgcctacttgaccctagctaagcacaccatctcctcggactatgtgatcccaattgggacatacggccagatgaagaatggtagtactccaatgttcaatgatattaacatctacgacctgttcgtgtggatgcactattacgtctctatggacgcactcctcggcggaagcgagatttggagagatatagatttcgcccacgaagctcccgcctttctgccatggcatcgacttttcctcctccgatgggaacaagaaatccaaaagctcaccggcgacgaaaactttaccattccttattgggactggcgtgatgccgagaaatgcgacatctgtaccgatgagtacatgggaggacagcatccaacaaaccctaacctcctgagccccgcgtctttcttttcttcttggcagatcgtgtgctcccgcttggaggaatataactcacatcagtccctgtgcaacggtacacccgagggacccttgcgacggaatcccgggaaccatgataagtctcgcaccccacgcttaccaagctccgccgatgttgaattttgcttgtctttgacacaatatgaatccggttcaatggataaggccgcaaacttcagttttagaaacacgctggagggctttgccagcccactgacaggaatcgctgatgcgtcacaatcatcaatgcataacgcactgcacatctacatgaatgggacaatgtctcaagttcagggtagcgccaacgacccaatctttttactgcatcatgccttcgtcgactcaatctttgaacagtggctgcgacgtcatcggcctttgcaggaagtgtaccctgaggctaacgcccctattgggcacaaccgcgagagttacatggtgcccttcattccattgtatcgtaatggagatttctttatctcatctaaagatctgggctatgattactcctacctccaagacagcgaccccgactcatttcaggactatataaagtcttacttagagcaggcctccaggatatggtcatggctgttgggagctgccatggtaggggccgtgctgacagccctgctcgctgggctggtatctctgctctgccggcacaagagaaagcagctacctgaagaaaagcaacccctgctaatggagaaagaagattaccacagcctgtatcaaagccattta

SEQ ID NO: 20580 - DNA, 1587 bp, Artificial Sequence
  Description of Artificial Sequence: Synthetic coding sequence
atgctcctggcggtgctctactgtctgctgtggtcgttccaaacttccgcaggacacttcccgcgggcatgtgtgtcatccaaaaatctcatggagaaagaatgctgtccgccgtggagcggcgaccgctcgccatgtggccagctttcgggccggggctcatgccagaatatcctgctgtctaacgcgccactgggaccacaattccctttcacgggcgtggatgatcgcgagtcgtggccaagcgtgttttacaaccgaacctgccagtgcagcggaaatttcatgggatttaactgcggaaattgtaagtttgggttttggggacctaactgcaccgaaagaaggttgttggtgcggaggaatatcttcgatctctccgccccagaaaaggacaagttttttgcatatctgactctggccaagcacaccatctcctcagattacgtcatcccgattggaacctatggacagatgaagaacggctcgaccccaatgttcaatgatatcaacatctacgatctgtttgtgtggatgcactactatgtgagcatggatgccctgctgggcggaagcgaaatctggcgcgatattgacttcgcacatgaagcgcctgcattcctgccgtggcatcgcctcttcctcctcaggtgggagcaagaaatccagaaactcactggagacgaaaacttcactatcccatactgggattggcgcgacgccgaaaaatgcgacatctgcaccgacgagtacatgggtggacaacacccgactaacccgaacctgctgtcgccagcatcatttttcagctcgtggcagatcgtgtgctcgcggcttgaggaatacaattctcatcagtccctctgcaacggaactccggaaggaccgctcagacggaacccgggaaatcatgacaagagtcgcactccgcggctcccatcgtccgccgacgtggaattttgcctgagcctcacccaatacgagtcgggatcgatggacaaggcggccaactttagcttcagaaatactctggaaggatttgcgtccccactgaccggaattgccgatgcgtcgcagtcatccatgcacaacgctctgcatatctacatgaatggaaccatgtcccaggtgcagggatctgccaacgatccaatcttcttgctgcaccacgccttcgtggactcaatcttcgagcagtggctgcggcgccacagacctctgcaggaggtgtacccagaagctaacgcgccaattgggcacaaccgagaatcgtacatggtccctttcatcccgctgtaccggaacggggacttcttcatttcgtccaaggacctgggatacgactacagctacctgcaagactcggaccctgattccttccaagactacatcaaatcttacctggaacaagccagtagaatctggtcgtggctcctgggcgcggccatggtcggagcagtcctgactgccctgttggcagggctcgtctcactcctgtgcaggcacaagcgcaagcagctcccagaagagaaacagccgctgctcatggagaaggaggactaccatagcctctaccaatcgcatctg

SEQ ID NO: 20581 - DNA, 1587 bp, Artificial Sequence
  Description of Artificial Sequence: Synthetic coding sequence
atgctgcttgctgtgctgtactgtctgctgtggtctttccagaccagcgctggccacttcccacgcgcctgcgtgtcaagcaagaacctgatggaaaaagagtgttgtcctccctggtccggcgatagatccccatgtggccagctttccggtcgcggaagctgtcagaacatcctgctgtctaatgctccacttggcccccaatttcctttcacaggtgtggacgaccgcgagagctggccatccgtgttttataataggacttgtcagtgctctggaaatttcatgggtttcaactgcggcaactgtaagttcggcttctggggtcccaattgcacagagaggcgtcttctggtacgcagaaatatcttcgacctgtctgctcctgaaaaagataaatttttcgcatacctgaccttggccaagcacaccatctcctctgactacgttatcccaatcggtacatatggacagatgaagaacggtagcactcccatgttcaatgatataaatatttacgatctctttgtgtggatgcactactatgtgtccatggacgcccttctgggaggttccgaaatctggcgcgatatcgacttcgctcacgaggcaccagccttcctgccttggcaccgcttgtttctgttgcgctgggaacaagaaatacagaagttgactggagatgaaaattttaccataccttactgggactggagggacgccgagaagtgtgacatctgcacagatgagtacatgggcggtcagcatccaactaacccaaacctgctcagtccagcatctttcttctccagctggcagatcgtgtgttcccgcttggaagaatacaactcacaccagagtctctgtaacggtactcctgagggtcctttgcgcagaaaccccggtaatcatgataagtcccgtacaccaaggttgccctcatcagccgacgtagagttctgtctctccctgactcagtatgaaagcggttccatggataaagccgccaatttctccttccgcaacactctggagggcttcgcttcacctcttaccggaatcgctgacgctagtcagtcttctatgcataacgcactgcatatctacatgaacggcacaatgagtcaagtccagggctccgcaaacgatccaatcttcttgctgcaccatgcttttgtcgactcaatcttcgagcagtggcttcgccgccacaggcccttgcaggaggtataccctgaagcaaatgctcctatcggtcataatcgtgaatcctacatggtgccctttatcccactgtatcgtaatggcgacttctttatcagcagcaaggatcttggctacgattacagttatctccaggattccgaccccgattccttccaggactacattaaaagctatctggagcaggcaagtaggatctggagctggctgctgggcgcagcaatggtcggtgccgtgcttacagccctcctggcaggtcttgtgtctctcctctgtagacacaagcgtaagcaactgcccgaggaaaagcagccactgctgatggagaaggaagactaccactctctgtaccagtctcacctc

SEQ ID NO: 20582 - DNA, 1587 bp, Artificial Sequence
  Description of Artificial Sequence: Synthetic coding sequence
atgctgctggcagtcctctactgtctgctctggtcgttccagaccagcgctggacacttcccacgcgcctgcgtgtcgtcgaagaatctgatggagaaggaatgctgccccccgtggagcggagataggtcgccgtgcggacagctctccggtagaggaagctgccaaaacatcctgctgtcaaacgcgccgctgggaccacagttcccattcactggcgtcgacgatagagagtcgtggccctcagtgttctacaaccggacctgccagtgctcgggaaactttatgggatttaactgtgggaattgcaaatttggcttctggggcccgaactgcaccgagcggaggctcctggtccgccgcaacatcttcgacctgtctgcgccggaaaaagacaagttcttcgcataccttaccctggccaagcataccatctcatccgattacgtcatcccgattggtacttatggccagatgaagaatggttcaaccccgatgtttaacgacatcaatatctatgatctgttcgtgtggatgcactactacgtctctatggatgctttgctgggaggttcagagatctggcgtgacattgatttcgctcacgaggccccagcattcctgccctggcatcgactcttcttgctgcggtgggaacaggaaatccaaaagctgacgggggacgagaacttcaccatcccatactgggattggcgcgatgccgagaagtgcgacatctgcactgacgaatacatgggaggacagcacccgacgaatccaaacctgctgtcaccggccagcttcttttcatcctggcagatcgtgtgcagccgcttggaagaatacaactcgcatcaatcactgtgtaatggaaccccggagggaccactcagacggaatcccggaaaccatgacaaaagccggaccccacgcctcccgtcctcggctgacgtcgaattctgtttgtcccttactcagtacgaaagcggatcgatggataaggcggccaacttcagcttccgcaacactctggaaggcttcgcctcaccactgaccggaatcgccgatgcgtcccagtcgagcatgcataatgcgctccacatttacatgaacggaacgatgtcccaggtgcaaggttcggcgaacgacccgatctttctcctgcaccacgccttcgtcgattcgatctttgaacagtggctccggcggcatcgaccattgcaggaggtgtatccagaagctaatgccccgattgggcacaacagagagtcctacatggtgccgtttatcccgctttacagaaatggagacttctttatcagctccaaagatctcggatacgattactcctaccttcaagactctgaccccgactcatttcaagattacatcaagtcgtatctggaacaggctagcagaatttggtcatggcttctgggcgcagcgatggtgggcgcagtgcttactgcgctgctggctgggctggtgtccctgctgtgccgccacaagcgtaaacagttgccggaggaaaagcagccgctccttatggagaaagaggattaccactcgctgtaccagtcccatctg

SEQ ID NO: 20583 - DNA, 1587 bp, Artificial Sequence
  Description of Artificial Sequence: Synthetic coding sequence
atgcttctcgccgtcctctactgtctgctttggtccttccaaacttcggcgggtcacttccctcgtgcctgtgtgagctcaaagaatcttatggaaaaagaatgttgccctccatggtcgggagatagatccccatgtggccaactttcgggacgggggtcctgtcagaatatccttctgtccaacgcaccacttgggccccagtttccttttactggagtggacgaccgggagtcgtggccttcagtgttttacaaccggacgtgccaatgctccggcaacttcatggggttcaattgcggaaactgtaagtttggattttggggcccaaactgtactgaacgacggctcttggtgcggaggaacatttttgacctcagcgcccctgaaaaagacaagttttttgcatacctgaccctggcgaaacataccatctcatcggattatgtgatcccaattggtacttacggacagatgaagaacggttccactccaatgtttaacgacattaacatttacgacctgtttgtctggatgcactactacgtgtcgatggacgcacttcttgggggaagcgaaatatggagagatatcgattttgctcacgaagcaccagcttttctgccgtggcatcgcctgtttcttctgcggtgggaacaagaaatccagaagctcacgggggatgagaactttaccattccatactgggactggagagatgcagaaaagtgtgatatttgcaccgatgagtacatgggaggtcaacaccctacgaaccccaatctgctgtccccagcatcctttttctcctcctggcaaattgtgtgctctcggctggaagaatacaatagccatcagtccctctgtaatgggaccccagaaggaccgctcagaagaaaccccggaaaccatgataagagccggacgcctagacttccttcatcagccgacgtggaattttgcctgtcgctcactcaatacgaatcaggatcgatggacaaggcagcgaacttctcgttcaggaacacccttgaaggattcgcatccccattgactggtattgccgatgctagccaatcaagcatgcacaacgcactgcatatctatatgaacggaactatgtcccaagtccaaggatccgcgaacgatccaatctttcttcttcatcatgcgtttgtggatagcatctttgagcagtggcttcgcaggcatcggcccctccaggaagtgtacccagaagcaaatgccccaatcggacataatagagaatcgtacatggtcccttttatcccgctttaccgcaacggagacttctttatcagtagcaaagacctgggttacgattattcgtaccttcaagactccgatcccgattcctttcaggattacattaagagctaccttgagcaggcctcgcgaatttggagctggcttctgggggcagcaatggtcggcgccgtgctgactgcactccttgcagggctcgtgagcctgctgtgcaggcataagaggaagcaactcccagaagaaaagcaaccactgctcatggaaaaggaagattaccatagcctgtaccaatcgcatctg

SEQ ID NO: 20584 - DNA, 1587 bp, Artificial Sequence
  Description of Artificial Sequence: Synthetic coding sequence
atgcttctggcagtgttgtactgtctcctttggtcgttccagactagcgcaggtcatttcccccgcgcatgcgttagcagtaagaatctcatggagaaggaatgttgtccaccatggagcggtgatcgctccccttgtggacagctgagcggtcggggatcatgtcaaaacattcttttgtccaatgcaccacttggaccgcagtttccattcaccggcgtggacgatcgcgaaagttggccgtcggttttctacaatagaacctgccaatgctcaggtaacttcatgggatttaactgcggtaattgtaagtttggattctggggtccaaattgcactgagcggcgccttcttgtgagaagaaatatctttgacctgtcggcacccgagaaggacaagttctttgcataccttaccctggcaaaacataccatctcgtccgactacgtgattcccattggtacgtacgggcaaatgaaaaacggctcgaccccgatgtttaacgatatcaacatatacgatctttttgtgtggatgcactactatgtgtccatggacgccctgcttggggggtccgaaatttggcgagatattgactttgcacacgaggcacccgcatttcttccatggcacagactgtttctgctgcgctgggagcaagaaattcagaagctcaccggtgatgaaaacttcactattccatattgggactggagggatgcggagaagtgcgatatctgcacggacgagtatatgggaggtcaacatcctactaatcccaacctgctgtcgccagcatcgtttttctcatcctggcagatcgtgtgttcgagacttgaagagtacaactcacatcagtccctgtgtaacggaacccccgaaggccctctgcggaggaaccctggaaaccatgataaatcgaggactccaaggcttccctccagcgccgatgtggaattttgcctttccctcactcaatacgaatcgggttccatggataaggcagcaaatttctcattccggaacaccctcgagggattcgcatcgccactgaccgggattgcggatgcatcgcaaagcagcatgcataacgccctccacatctacatgaacggtacgatgtctcaggttcagggtagcgcaaacgatcctattttcctcctccaccacgcctttgtggatagcatctttgaacaatggcttcgtagacatcgacctttgcaggaggtctacccagaggccaatgcccctattggtcataacagggagtcgtacatggtgccattcattcctctttacagaaacggcgatttcttcatctcgtctaaagacctcggatacgattactcctatcttcaagacagcgacccagattcctttcaagattacatcaaatcgtacctggagcaggcaagccggatctggtcgtggcttctgggagcagcaatggtgggggcagtcctcactgcccttcttgcgggcctggtgtccctgctctgcaggcataagagaaagcaacttcccgaggaaaaacaacctctcctgatggaaaaggaagattaccatagcctctaccagtcccatctg

SEQ ID NO: 20585 - DNA, 1587 bp, Artificial Sequence
  Description of Artificial Sequence: Synthetic coding sequence
atgctgctagccgttctgtattgcctcttatggtcattccagacctcggccggacatttccctcgggcttgcgtatcttccaagaacctgatggaaaaagagtgctgcccaccatggtccggcgacagatccccatgcgggcagcttagtggtcgagggtcttgtcagaacatccttctctctaatgctccgttaggacctcagttcccatttaccggggttgatgacagagagtcctggcctagcgtgttttacaaccggacttgtcagtgctccgggaatttcatggggttcaactgtggtaattgcaagtttggcttttggggccctaattgcactgagagacgcctgctggtgcggagaaatatctttgacctttccgcccccgagaaagataagttctttgcttatctgaccctggccaagcatacaatatcttcagactatgtgattcccatcggcacttatggccagatgaaaaacggttccactcccatgtttaacgatatcaatatttacgacctctttgtttggatgcactattacgtctccatggatgctcttttgggcggatccgagatctggcgcgacatcgactttgcccatgaggctccggcatttctcccctggcacagactctttttgcttaggtgggagcaagagattcagaagttaacgggggatgagaattttacaataccctattgggactggcgagacgcagaaaagtgtgacatctgtactgacgaatacatgggggggcaacaccccactaacccaaatctgttgtccccagctagcttttttagctcgtggcaaatcgtttgctcacgactggaggaatataacagtcaccaatcactgtgcaacgggactcccgaagggccactgcggcgtaaccctgggaaccatgacaagtcccgcaccccaaggcttccttcgtcagccgatgtggagttttgcctttcgctgacgcagtacgagagtggctccatggacaaggcggcgaacttctccttcagaaacaccctagagggattcgctagccctctgaccggaatagcggacgcctctcagtcttcaatgcacaacgcactccatatctacatgaacggcaccatgtcacaggtacaggggtctgctaacgacccaatatttttactgcaccatgcatttgtcgactctatcttcgagcaatggcttcgcagacacagacctctgcaggaggtttacccagaggccaatgccccgattggtcataatcgcgaatcctatatggtgcctttcatcccattgtacaggaatggagactttttcatttcttcaaaagatttggggtatgactattcttatctccaggactccgatcccgattctttccaggactacattaaaagctatctcgagcaggcttctaggatctggagctggttactgggggccgcgatggttggcgctgtcctcacagctctgctggcgggattagtgagcctgctgtgccggcacaaacgcaagcaactgcccgaggagaagcaacctctgctcatggagaaagaagactatcactctctatatcagtcacatctg

SEQ ID NO: 20586 - DNA, 1587 bp, Artificial Sequence
  Description of Artificial Sequence: Synthetic coding sequence
atgctgctcgctgtcctctactgcctgctgtggtcatttcaaacatctgctggccattttccaagggcgtgtgtgtcctcaaaaaacctgatggagaaggagtgctgtcccccatggagcggagatcggtcaccttgcggacagctgtccggaagaggcagttgccagaacatcctcctgtctaatgctcctctggggccacagtttccattcacgggcgtggacgatcgggagtcttggccctcagtgttctacaaccgcacgtgccagtgctcaggaaacttcatggggtttaattgcgggaactgcaagtttggattttggggcccaaactgcacagaacggcggctgttggtaagacgaaacatttttgacttgtcagctcccgagaaggacaaattcttcgcctacctgaccttggccaagcacaccatatcctctgattacgtcatcccaatcggcacctacggccagatgaaaaatggttctaccccgatgttcaacgacataaatatctacgaccttttcgtgtggatgcactactacgtgtccatggatgcactgttgggggggagcgagatctggcgcgacattgatttcgcccatgaggcgcctgcgttcctgccgtggcatcgactcttcctcttgcgatgggagcaagaaatccaaaaattgaccggcgacgaaaactttacaataccctattgggattggagggatgcggaaaagtgcgatatctgtaccgatgagtatatgggagggcagcacccaaccaatccaaatctgctgtcccccgcttcattcttctcatcttggcagattgtttgcagccggcttgaagagtacaattcccaccagagcctgtgtaatgggacaccggagggcccactgagacgcaaccccggcaatcacgataaatctcgaactcctcggttgcccagctccgctgacgtggagttctgcctttcactgacacagtatgaatccggctccatggataaggccgccaacttctcattcaggaacaccttggaggggtttgcctctccactcacgggcattgccgatgccagccaatcctccatgcacaatgctcttcacatctatatgaatggcaccatgtcacaggtccagggatcagccaacgaccccatttttctgctgcaccatgctttcgtagacagtatcttcgagcagtggctccggagacaccggcctctgcaagaggtgtatcccgaggcaaatgcccccatcgggcataatcgggagagttacatggtgcccttcattcccctgtataggaatggagacttttttatctcctcaaaggacctggggtacgactacagctaccttcaggattctgatcccgatagtttccaggactacattaagtcatatttggagcaagcatctcggatctggtcctggctgttgggcgctgctatggtgggggcagtactgaccgcccttctggcgggtctcgtgtctctgctttgcagacacaaaaggaagcagcttccagaggaaaagcagcccctgctgatggaaaaagaggactatcacagcctgtatcagagccacctg

SEQ ID NO: 20587 - DNA, 1587 bp, Artificial Sequence
  Description of Artificial Sequence: Synthetic coding sequence
atgctgctcgccgtgctctattgtcttctgtggagttttcagacttctgcagggcatttcccccgggcttgtgtttcatcaaagaacctgatggaaaaggaatgctgtcccccttggtctggcgaccgatccccttgtggccagctctccggacgcggatcctgtcagaacatcttactatcaaatgcccccctgggacctcagttcccttttaccggagtagatgatcgagagtcctggccttccgtgttttacaacagaacttgccagtgctctggcaatttcatggggttcaactgcggaaactgtaaattcggtttttggggtccaaattgtactgagcggcgcctactcgtgagaaggaacattttcgatcttagcgccccggagaaggataaattctttgcttacctgaccctggcgaagcacaccataagttccgactatgttatcccaattggaacgtatggtcagatgaagaatgggagcacacccatgtttaatgacatcaatatttatgacctatttgtctggatgcactactacgtctctatggacgcattgctgggggggagtgagatttggcgcgacattgacttcgcccacgaagctcctgccttcctgccctggcatagactatttctgctacgttgggagcaggaaatacagaagctgactggcgatgagaacttcacaattccctactgggattggcgggacgcagaaaagtgcgatatatgtacagatgagtatatgggcggtcagcacccgaccaaccccaaccttctgtcccctgcatcatttttctcttcttggcaaatagtgtgcagccgtctcgaggaatataattcccaccagtcactctgcaatggtacaccagagggtcctctgagacgtaatcccggcaatcacgacaagtcacgaacaccccggctgccttccagtgccgacgttgaattctgtctttctctcacccaatatgaatctggtagcatggacaaagccgccaatttttctttcaggaataccttggaggggttcgcttcccccctgactgggatcgccgacgcgtcacagtcctcaatgcataatgcgttgcacatttacatgaatgggacgatgagtcaggtacagggatcagccaacgatcccatctttctcttacaccacgctttcgtggactctattttcgaacaatggctcagacggcaccggccactgcaggaggtatatcctgaagcaaatgcccccatcggccacaatagagagagttatatggtccccttcatcccactgtaccgcaatggggacttctttatttcatcaaaagacctcggttatgactattcttatctgcaagatagcgaccctgattcgtttcaagattatatcaaatcctacttggaacaagccagccgcatttggtcatggctattgggtgctgcgatggttggagccgttttaaccgccttgctggccgggctggtcagcctgctttgtagacacaagaggaagcaacttcccgaggaaaagcagcccctcttgatggaaaaggaagactaccattctctctatcaatctcacctt

SEQ ID NO: 20588 - DNA, 1587 bp, Artificial Sequence
  Description of Artificial Sequence: Synthetic coding sequence
atgctgctcgccgtgctgtactgtctgctgtggagctttcaaacttccgctggacacttcccgcgggcttgcgtctcatcgaaaaacctgatggagaaagagtgttgccctccttggtcgggggatcgctccccctgtggtcaattgagcggacgaggctcctgccagaacatcctgctctccaacgcgcctctgggtccgcagttccctttcaccggagtggacgaccgcgaatcgtggccctccgtcttttacaaccgcacgtgccagtgctctggaaactttatggggttcaactgcgggaactgcaaattcggattctggggacctaattgcacggaacgcagattgcttgtgcggagaaacattttcgacctttccgcccctgaaaaggataagttttttgcatatctgaccctggccaagcacactatcagttcggactacgtaatcccaattggcacctacggacagatgaagaatggaagcactccaatgtttaacgatatcaatatctacgatttgttcgtgtggatgcactactacgtcagcatggatgcgcttcttggcggctccgagatctggagagatatcgacttcgctcacgaggcaccggctttcctgccgtggcaccgcctgttcctgctccgctgggagcaggaaatccagaagctgaccggagacgagaacttcactatcccatactgggactggagggatgcagaaaaatgtgatatctgcaccgacgaatacatgggaggacagcacccgaccaatcctaacctgctcagcccagcgagctttttcagctcctggcaaatcgtgtgctctcggctggaagagtataactcacatcagtcgctctgcaatggaactcctgaaggaccactgaggagaaaccctggcaaccatgacaagtcacgcacccctcggcttccgtcgtccgccgacgtggaattctgtctgagcctcacccagtacgagtcaggatccatggacaaggccgctaacttttcattccggaacactctggaagggtttgcgagccctctcaccggaatcgccgatgcctcccagagcagcatgcacaacgccttgcacatatacatgaacggtaccatgtcgcaggtgcagggatcggcgaacgatcctatctttttgctgcatcatgcttttgtggactcaatctttgagcagtggctgcgccgccaccgcccgcttcaggaagtgtacccagaagccaatgctccaatcggccataaccgagaatcatacatggtgccattcattcccttgtaccgcaacggggactttttcatcagctcgaaagatcttggatacgactactcatacctccaggatagcgatcccgattctttccaggactacatcaagagctacctcgagcaggcttcgcgtatttggtcatggctcttgggagcagcgatggtgggagcagtgcttactgccctgctggcgggattggtttcgctcctgtgcagacacaagcgcaagcagctgccagaggaaaagcagccactcctgatggaaaaggaggactatcactcactgtaccaatcccatctg

SEQ ID NO: 20589 - DNA, 1587 bp, Artificial Sequence
  Description of Artificial Sequence: Synthetic coding sequence
atgctgctcgccgtcctctattgcttgctgtggagcttccagaccagcgctggccacttcccgcgcgcttgcgtgagttcgaaaaaccttatggagaaggaatgctgtccaccctggtcgggggacagatccccctgcggacagctgtcgggccgcgggtcatgtcagaatatcctgctttctaacgccccgctgggaccccaatttccgttcactggcgtcgacgatcgggagtcctggccttctgtgttctataacagaacctgtcagtgctccggcaacttcatgggctttaactgtggaaattgcaagttcggattttgggggcccaattgcacggagcggcgtctcctggtgcgccgtaacattttcgatctgagtgccccggagaaggacaagttcttcgcttacctgaccctggccaagcataccatcagctcagattacgtgatccctatcggaacttatgggcagatgaagaatgggtcaaccccgatgtttaacgatatcaacatctacgacctgttcgtttggatgcattactacgtgagcatggacgcacttctgggaggtagcgaaatttggagagacatcgacttcgcacacgaagctccggcttttctgccgtggcacagactgtttctcctgaggtgggagcaggagatccaaaagctgactggagatgagaatttcactatcccgtactgggattggcgcgacgccgaaaagtgtgatatatgcactgacgagtacatgggcggacagcatcccactaatccgaacctgctgtcgcccgcgtcattcttcagctcatggcagatcgtgtgctccaggctggaggaatacaactcccaccagtccttgtgcaacggaacgcctgagggtccgctgaggagaaatccgggtaaccatgacaaatcaagaactccgcggctgccatcatcagctgacgtcgaattctgcctgagcctgactcaatacgagagcggatcaatggataaggccgccaacttctccttccgcaacactctggaggggtttgcctcgccgctcaccggcatcgccgacgcctcgcaatccagcatgcataacgccctgcatatctacatgaatggaacgatgtcgcaggtgcaaggatcggctaacgacccgattttcttgctgcaccacgcgtttgtcgactccatattcgaacagtggcttcggagacacagaccgctccaggaggtgtacccagaagctaatgccccaatcggacacaatcgcgagtcgtacatggtgccatttatcccattgtaccgcaacggtgatttctttatcagctccaaggatcttggatacgactactcctatctccaagattccgacccggattcctttcaagactacatcaagtcgtaccttgagcaggcaagccggatttggtcatggctgctgggtgcggccatggtcggggccgtgctcaccgctctcctggcaggattggtttctctgctctgtcgccacaaaagaaaacagctccctgaagagaaacagcctctcttgatggagaaagaggactaccattcgctctaccagtcgcatctg

SEQ ID NO: 20590 - DNA, 1587 bp, Artificial Sequence
  Description of Artificial Sequence: Synthetic coding sequence
atgcttttggcggtcctctactgcctgttgtggtccttccaaacttcggccggacacttcccgagagcctgcgtgtccagcaagaacctgatggagaaagaatgttgtccaccgtggagcggtgaccggagcccatgcgggcagctgtccggccgtggatcatgccagaatatcttgttgtcaaacgcgccgctgggacctcagtttccatttaccggagtggacgaccgggaatcctggcctagcgtgttctacaaccgcacctgccagtgttcaggaaacttcatgggattcaactgcgggaactgcaagttcggtttttggggtccaaactgcactgaaaggcgcctgctcgtgcgccgaaacatttttgatctgtcagcgcccgaaaaggacaagttcttcgcttacctgactctggctaagcacaccatctcgtccgactacgtgatcccaataggaacttacggtcagatgaaaaatggttcaactcctatgtttaacgacatcaacatctatgacctcttcgtctggatgcattactacgtttcgatggatgcactcctcgggggctctgagatttggagggatatcgatttcgcccacgaggcgccagcctttttgccgtggcacagactgtttctgctgagatgggaacaagagatccagaagttgaccggagatgagaactttaccatcccgtactgggattggcgtgacgctgaaaaatgcgatatctgcacggacgaatacatgggtggacagcatccaaccaacccgaatctgctgtcgccggctagcttcttctcctcatggcagatcgtctgttcgagactcgaagaatacaattcacaccagagcctgtgcaacggaacgccggaaggaccactgcggaggaatccgggtaatcacgataagtcacggactcctcgcctgccgtcgtccgcagacgtggaattctgcctgtcgctgactcagtacgagagcggatcgatggacaaggcagcgaatttctcattcaggaataccctcgagggatttgcctcacctctgaccggtatcgcggatgccagccaatcatccatgcacaatgccctgcacatctacatgaatggcactatgtcccaagtccaaggaagtgccaacgacccgatcttccttctgcatcatgcgttcgttgacagcatttttgaacaatggctgcggcggcataggcctctgcaggaagtgtacccggaagcaaacgcgccaattggtcataatcgggagtcctacatggtccctttcatcccgctgtaccgaaacggagacttcttcatctccagtaaagacctgggatacgactactcgtaccttcaagactcagaccctgactcgttccaagactatatcaaatcctacctggaacaggcatcccggatctggagctggttgctgggcgccgcaatggtgggcgctgtgctgacggcactgctggccggactcgtctccctcctctgtcgccacaagcgcaaacagctgccagaggaaaagcagccgctgttgatggaaaaggaagattaccattcgttgtatcaatcccatctt

SEQ ID NO: 20591 - DNA, 1587 bp, Artificial Sequence
  Description of Artificial Sequence: Synthetic coding sequence
atgttgcttgctgtgctttactgtttgctgtggtcattccagacctcagccggtcactttcctcgcgcctgtgtcagtagtaagaacctgatggaaaaagagtgttgccctccctggagcggggatcgctctccttgcggccagctcagcggtcgcggtagctgtcaaaatatcctgctatcaaacgcccccctgggtccacagttcccctttacaggtgttgatgatcgtgagtcctggccctcagtgttttacaaccggacatgccaatgtagcggcaattttatgggattcaattgtggaaactgtaaatttggattctggggccccaactgtaccgaacgccggctactggtgaggcgcaatatcttcgatctaagcgctcccgagaaagataagttctttgcttacttgacgctggccaaacacaccatttcgtctgactatgtgatcccgatcggcacttatgggcagatgaagaatggatccactccaatgtttaacgacataaatatctacgacttgttcgtctggatgcactattatgtgtctatggatgcccttcttggtggaagcgagatatggagggatatagatttcgcccacgaggcgcccgcctttttaccttggcataggttattcctgctccgctgggagcaggagatccagaagttaaccggcgacgaaaacttcaccattccttactgggactggagggatgctgaaaagtgtgacatctgcactgatgagtacatgggtggacagcacccgacgaaccccaatctcttatcccccgcctccttcttctcatcctggcagattgtgtgctcccgcctggaggaatataattctcatcagtcactttgtaatggaactcccgagggaccactcaggcggaaccctgggaatcacgacaagagtagaaccccaagactgccctcatcagctgacgttgaattctgtctttctcttacacaatacgaaagcggctctatggataaagccgccaatttctccttccgtaataccctggaagggtttgccagccctttgacggggattgcagatgcatctcagtcttcaatgcacaacgctctccacatctatatgaatggtacaatgagccaagtacagggcagtgcaaacgatcccatctttctgctacatcatgcctttgtcgatagcatattcgaacaatggctgaggaggcatcgccccctccaagaggtgtatcctgaagccaacgctccgatcgggcataatcgcgagtcttacatggtccccttcatccccctgtatcggaacggggactttttcatctctagcaaggacctcggttatgactactcttatctgcaggactccgatcccgattctttccaggactatattaagtcctacctggagcaggcatcccggatttggtcatggttgttgggtgctgcaatggtgggagctgtcttgactgccctgctcgccggacttgtgtctttgttatgccgccacaagagaaaacagctgcccgaggaaaagcagcctctcctgatggagaaggaggattatcattcgctatatcagtcccacctt

SEQ ID NO: 20592 - DNA, 1587 bp, Artificial Sequence
  Description of Artificial Sequence: Synthetic coding sequence
atgctcctggccgtgctgtactgcctgctgtggagctttcaaacttcggcaggacactttccgcgcgcttgtgtcagctctaagaacctgatggagaaagagtgctgccctccctggtcaggggacaggtcgccatgcggccagctgagcggtcggggcagttgccagaacatcctgcttagcaacgcgccacttggaccacagtttcctttcacgggagtggacgatagagaaagctggccttccgtgttttacaatcgcacctgtcagtgttcgggaaatttcatgggattcaactgcggcaattgtaagtttggattctggggcccgaattgtactgaaagacggctccttgtccggagaaacatttttgacctctccgcaccagagaaagacaagttctttgcctacttgacgctcgcaaagcataccatatcctccgattacgtgattccaattgggacctacggtcagatgaaaaatgggagcactcccatgttcaatgatatcaacatatacgacctgtttgtgtggatgcattactacgtgagcatggacgccctccttggtggtagcgagatttggcgcgatattgatttcgcacacgaagcaccagcatttctcccgtggcatagactttttctcctgaggtgggaacaagaaattcaaaagctgaccggagacgagaactttacgatcccatactgggactggcgcgacgccgaaaagtgcgatatttgtactgatgagtacatgggaggacagcatcctaccaaccccaacctgctgtcaccggcttccttcttttcatcttggcagatcgtgtgttcccggcttgaagaatacaactcccaccaatcgctttgtaacgggactcctgaggggccacttcgtcgaaatccaggaaatcatgataagtccagaacgcctcgactgccctcgtccgcagatgtggaattctgtctttccctcactcagtacgaatctggatcgatggataaagcagctaacttttcgtttagaaacaccctggaggggtttgcatccccgcttactggaatagccgatgcatctcaaagctcgatgcataacgcactgcacatttacatgaatgggactatgagccaagtccagggctcggccaatgatccgatttttcttctgcatcacgcatttgtggattcgatcttcgaacaatggcttcgtagacatcggccgctgcaggaagtgtacccagaagcaaacgcgcctattggacataaccgtgaatcgtacatggtgcccttcattccgctttaccgaaatggtgatttcttcatctcgtcgaaggatctcggatatgattactcttatctccaagactcggaccctgatagttttcaagattacatcaagtcgtacctcgagcaagcaagcagaatttggtcatggttgcttggggcggccatggtgggcgctgtgctgactgccctgttggcgggactcgtgtcgctgctctgtagacataaacgaaagcaattgccagaggaaaagcagccgttgcttatggagaaggaagattaccactccctgtatcagtcgcatctt

SEQ ID NO: 20593 - DNA, 1587 bp, Artificial Sequence
  Description of Artificial Sequence: Synthetic coding sequence
atgctgctggccgtgctatactgcctgctgtggtcatttcaaaccagtgcagggcactttccccgagcctgcgtcagcagcaaaaacttaatggagaaagagtgttgccctccttggtcaggcgatcgtagcccctgcggacagctgtccgggcgtgggagctgtcagaatatcctattgtctaacgctcccctcggcccacagttccctttcaccggcgttgatgaccgcgaatcttggccctcagtgttttataatcggacatgtcaatgcagcggaaactttatggggttcaattgtgggaattgtaagtttggcttctggggtcccaattgtactgaacggcgcctactggtccgacgcaacatttttgatctgagcgcccccgaaaaagataagttttttgcctacctgacactagctaaacacacaatcagtagcgattatgttatccccattggtacttacgggcaaatgaagaatggtagtaccccaatgttcaatgacattaatatttacgacctgtttgtgtggatgcattactacgtgtctatggacgccctgctgggagggtccgaaatctggcgcgacattgacttcgcccacgaggccccagccttcctaccttggcaccgcctgtttctgctacgatgggagcaggagattcaaaagctgactggggatgagaacttcactatcccttactgggactggcgggacgcagaaaagtgcgacatctgcaccgacgagtatatgggaggtcaacatcccactaaccccaacctgctcagccccgctagcttcttcagcagctggcaaatcgtctgcagtaggctggaagaatacaacagccaccagtccctctgtaatgggaccccagagggccccctgcggaggaatcctggcaaccacgacaaatctcgaactcctcgccttccttcttctgctgatgtggaattctgcctgagtctgacacagtacgagtccggttctatggataaggctgccaatttctctttccggaataccctggagggttttgcttctccattaaccgggatcgcagacgcatcccaatcttccatgcacaatgccctgcacatctacatgaatggcacaatgagtcaggtgcagggcagcgctaacgacccaatatttctgctacaccacgcctttgtggacagtattttcgaacaatggcttcggagacatcggccgttacaggaggtgtaccctgaggccaacgctcctattggccacaaccgcgagtcttacatggtcccttttatcccattgtataggaacggcgacttcttcattagtagcaaggacctaggctacgattacagctatctgcaggacagtgacccagactcttttcaggactacattaaatcttatctggagcaggcctctcgcatttggagttggctgcttggcgctgctatggtcggggccgtgctgaccgccctgctagccgggctggtgtccctgctgtgccgacacaaaagaaaacagctgcctgaagagaagcagcctctgttaatggaaaaagaggattatcattctctgtaccagagtcacttg

SEQ ID NO: 20594 - DNA, 1587 bp, Artificial Sequence
  Description of Artificial Sequence: Synthetic coding sequence
atgttgctcgcggtgctttactgcctgctttggtcgtttcagacttccgccggacatttccccagagcctgtgtgtcgtcgaagaatctcatggagaaggaatgttgtccaccttggtcaggtgatcggtcgccttgtggccaactgtccggaagaggaagctgccagaacatacttctgtccaacgcgcctctcggccctcaatttccatttacgggcgtggatgacagagaaagctggccaagcgtcttttacaatcgtacctgtcaatgttcgggaaacttcatgggttttaactgcggtaactgcaagttcggtttttggggccctaattgtactgaacggaggctgttggtgagaagaaatatctttgatctgtccgctccggagaaggataagttctttgcctacctcactcttgccaaacacaccatttcttccgactacgtcattcccatcggcacctatggtcagatgaagaatggcagcactccgatgttcaacgacatcaacatttacgacttgttcgtgtggatgcattactacgtgtcaatggatgccctgttgggaggatccgagatctggcgggatattgatttcgcacatgaggcacctgcatttctcccttggcatcgactgtttctcttgcggtgggaacaggagatacaaaagctgactggagatgagaactttactattccgtactgggattggcgtgatgcggagaagtgtgatatatgcaccgacgaatacatggggggtcaacacccaactaatcctaaccttctgtctccggcttcgttcttctcctcgtggcagattgtctgttcacgccttgaagaatacaactcacatcagtcgctctgtaatggaactccagagggcccactcaggcgaaaccccgggaatcatgacaagtctaggaccccaagacttccttcctcagctgacgtggaattctgcctctcactgacccaatacgaatcagggtcaatggataaggcagcaaacttttcgtttcgtaacaccttggagggatttgcctctcctctgaccggtattgcagatgcctcgcaatcgtccatgcataacgcacttcacatatacatgaacggaacgatgagccaggtgcaaggaagcgcaaacgaccctattttcctcttgcatcacgcgttcgtcgattcgatttttgaacagtggcttcgccgacacaggccgttgcaggaggtgtaccccgaagcaaacgccccaatcgggcataaccgcgaatcctatatggtgccgtttatccccctctaccgcaatggtgactttttcatatcgtcgaaagatctgggttacgattactcatatctccaagactcggacccagactcgtttcaggactacatcaaatcataccttgaacaggcttcgcgtatttggtcctggttgcttggagcagcgatggtgggggcagtccttaccgcactgctggcaggtcttgtgtcattgctgtgtaggcataaacggaaacaactgccagaagaaaaacaaccgctccttatggaaaaggaggattaccatagcctttaccaatcgcatctg

SEQ ID NO: 20595 - DNA, 1587 bp, Artificial Sequence; identical to SEQ ID NO: 20575
  Description of Artificial Sequence: Synthetic coding sequence

SEQ ID NO: 20596 - DNA, 1587 bp, Artificial Sequence
  Description of Artificial Sequence: Synthetic coding sequence
atgctgcttgccgtgttatactgcctgttgtggagtttccagacctcagccggtcacttccccagagcctgtgttagttctaaaaacctgatggaaaaggagtgttgccccccgtggagcggcgacaggagcccttgcggacagctgtcgggtcgggggtcatgccagaacatcctcctgtcaaatgcaccactcggccctcagtttccgtttacaggagtcgacgatagagagtcctggccttccgtgttctataatagaacctgtcagtgcagtgggaatttcatgggattcaactgcggaaactgcaaattcggtttctggggtccgaattgcacggagcggaggctactcgtcaggaggaatatctttgatctgtccgctcctgagaaagacaaattctttgcttacttaacgctggccaagcacaccatatccagcgattacgtgatccctatcgggacctacggacagatgaagaacggtagcacgccgatgttcaatgacatcaatatctatgacctcttcgtgtggatgcactactacgtctccatggacgctctccttggcggctctgaaatctggcgggatattgattttgcacatgaggcccctgccttcctgccgtggcataggctcttcttactgagatgggaacaggaaattcagaagcttacgggcgacgaaaatttcaccataccttattgggattggagagacgcggagaagtgcgacatttgcacagatgaatacatgggcggccagcatcccaccaatcccaacttactttcaccagcctctttcttttctagttggcagatcgtttgcagtcgactggaagagtataactcacaccagtctttgtgtaacggcacacccgagggacccctccgaaggaacccaggcaatcacgacaaatccaggactcctaggctcccatcatccgccgatgtcgagttttgtctgtccttaacccaatacgaaagtgggagcatggacaaggcagccaacttttctttcagaaacactctcgaagggtttgcctcccctttgacaggaatagccgatgcatcacagagctccatgcacaatgcattgcacatttacatgaacggtactatgagtcaagtgcagggctcggccaatgacccgatcttcctgctgcatcatgcgtttgttgattctatcttcgaacagtggttgcggagacaccgaccgcttcaggaggtttaccccgaggccaatgcgcctattggtcataatcgcgaatcatacatggtcccatttatccccctgtataggaacggcgatttctttatttcctctaaagatcttgggtacgactactcatatctgcaggactcggatccagatagcttccaggactacattaagtcttacctggagcaggctagccgtatttggagttggttgcttggagctgcaatggtcggggcagttttaacagctctacttgccggcctggtttccctactttgtaggcataaacgtaaacaattgcccgaagagaaacaaccactgctgatggagaaggaagattaccacagcctctaccaaagccatctg

SEQ ID NO: 20597 - DNA, 1587 bp, Artificial Sequence
  Description of Artificial Sequence: Synthetic coding sequence
atgctgctggctgtcctttactgtcttctctggtcatttcagaccagcgcaggccacttccctcgagcctgcgtcagctcaaaaaacctgatggagaaggaatgttgtcccccatggagcggcgataggagcccttgcggccagttgagtggacgcggcagctgtcagaacatacttttgtcaaacgctccattggggccacaattcccctttactggagtcgacgacagggagtcatggccatctgtcttttacaaccgcacttgccaatgctcaggtaatttcatgggttttaactgtggtaattgcaagttcggtttctggggaccaaactgcactgaacggaggctgctggtccgccgcaatatcttcgatctgagtgcacctgaaaaagataaattcttcgcctacctgactctcgccaagcatacaatatcatccgattatgtgattccgatcggcacctacgggcagatgaagaatggctccacccccatgttcaacgacatcaacatttacgatctgtttgtgtggatgcactactatgtgtccatggatgccttgctcggagggtcagagatatggcgggacatcgactttgctcatgaggctccagcttttctgccttggcaccggttgttcctcctcaggtgggagcaggaaatccagaagctgactggagacgagaactttaccatcccctactgggattggcgggacgctgaaaaatgtgacatttgtacagatgagtacatgggaggtcagcacccaaccaacccaaacctgctgtcacccgcatccttcttttcaagttggcaaattgtctgttctaggctggaggagtataacagccaccaaagcctgtgtaatggaacccctgagggacccctgagaagaaaccccggcaatcatgataaatcacgcactcctcgccttccgagttctgctgacgtggagttttgcttgtcactgacccagtacgaaagcgggtctatggacaaggccgcaaacttctcttttcgcaacaccctggaaggctttgcatcacccttgaccggaatcgcagacgcaagtcagagctctatgcacaacgccctgcacatctacatgaacggaaccatgagccaggtgcagggaagcgctaacgatccaatcttcctgttgcaccacgcgttcgtagactcgatctttgagcaatggctcagaaggcacagaccactccaagaagtgtaccccgaggcaaacgctccaatcggccacaatagagagtcttacatggtacccttcatccctctctacaggaatggagatttcttcatcagtagtaaggaccttggttacgattactcatacctccaagactctgatcctgactcatttcaggactacattaagagctatctggagcaagctagtcgcatctggagttggctcttaggcgccgctatggtgggagctgtcctgactgccctgttggcaggcctggtgtctctcctgtgcaggcataaacgcaaacagctgcccgaagagaagcagccactgctgatggaaaaggaagattaccattctctctaccagagccatctg

SEQ ID NO: 20598 - DNA, 1587 bp, Artificial Sequence
  Description of Artificial Sequence: Synthetic coding sequence
atgcttctggcagtgctttactgtctcctgtggtcttttcaaacttcggccggacattttcccagggcatgtgtttcatctaaaaaccttatggagaaggagtgttgtcccccttggtcaggcgaccggtcaccctgtggccaactgtccggacgtggatcgtgtcagaacatactcctttcaaacgcacctctcggacctcagtttccattcactggagtggatgacagagaaagctggccatcggtgttctacaacaggacttgtcaatgtagcgggaatttcatgggattcaactgcggaaactgtaagtttggattttggggacctaattgtaccgagcgcagacttcttgtgcggcggaacatctttgatctgtcagcacccgaaaaggataagttctttgcataccttacccttgcaaagcataccatttcgagcgattatgtcattcccatcggcacctacggtcaaatgaagaatggaagcactcccatgttcaatgatatcaatatctacgatctttttgtctggatgcattactacgtgtcgatggatgcactgttgggtggatccgaaatttggagagacatcgattttgctcatgaggcacctgcatttcttccttggcatagactgtttcttcttagatgggaacaagaaatccaaaagctgaccggagatgagaactttactattccatactgggattggcgcgacgcggaaaagtgtgatatatgcacggatgagtacatgggaggacagcatccaactaaccctaatcttttgtcaccagctagcttcttttcctcgtggcagattgtgtgtagccgtttggaagagtacaactcccatcaatctctctgtaacggcaccccagaaggacccctcagacggaaccccggtaaccatgataagtcgcgaaccccccgcctgccttcatccgcagacgtcgaattctgtctgagcctcacccagtacgagtcgggatcgatggataaagcagcaaacttcagctttcgaaatacccttgaaggattcgcatcccccctcactggaattgccgacgcctcacagtcgtcgatgcataatgcgctgcacatttacatgaacggcaccatgagccaggtgcagggcagcgctaacgatccaatattcctgctgcatcacgccttcgtggattcgatttttgaacagtggcttagacgacaccgtccgctccaagaggtgtaccccgaggcgaatgcacctattggacacaacagagaatcgtacatggtcccttttatccctctttataggaacggtgatttcttcatatcctccaaggacctgggttatgattactcgtacctccaagattcggatcctgatagctttcaggattacatcaaatcgtacctcgaacaggcgtcccgcatttggtcgtggttgcttggagcagcgatggtgggtgcagtgcttactgcactgctcgcgggtttggtttcccttctttgccgccataaacggaagcagctcccggaggaaaaacagcctttgctgatggagaaagaagattatcactccctgtatcaatcgcatctc

SEQ ID NO: 20599 - DNA, 1587 bp, Artificial Sequence
  Description of Artificial Sequence: Synthetic coding sequence
atgctgcttgccgtgctttattgtctcctgtggtccttccaaacctcagccggacattttcctagagcctgcgtttcgtccaagaacctgatggaaaaagagtgttgcccaccctggtctggtgatcggtcgccttgcggccaacttagcgggagaggcagctgtcaaaacatcttgctgtcgaatgcacctctgggaccccaattcccctttaccggagtggatgatagagagagctggccatcggtcttttacaatcgaacctgtcaatgttcgggaaactttatggggttcaattgcgggaattgtaagtttggtttttggggtcctaattgtaccgaacgacggttgttggtgcgtcgaaacatttttgatctttcggcaccagaaaaggacaagtttttcgcatatcttaccctggcaaagcacaccatcagctcggattacgtgatccccattggtacttacggtcaaatgaaaaacgggtcgactcccatgtttaatgacattaacatttacgaccttttcgtgtggatgcactactatgtgtcgatggacgccctgctcggtggttccgaaatctggagagacattgactttgcacatgaagccccggccttcctcccatggcatcgcttgtttcttcttcgatgggaacaagaaattcagaagctcaccggcgacgagaactttactattccgtattgggattggagggatgcggaaaagtgcgacatttgcaccgatgagtacatgggaggacaacacccaacgaatcctaacctgttgtcacccgcctcctttttctcgtcgtggcaaatcgtgtgttcaagacttgaggaatacaactcccaccaatcgctttgcaacggcactcctgagggccctctcagacgtaatcccgggaaccacgataaaagcagaactcctaggttgccaagctccgcagacgttgaattttgtttgtcacttacccaatacgaatcgggcagcatggataaggctgccaacttttcctttcgaaacactctggagggttttgcaagcccgcttaccggaattgcagatgcaagccagtcgtcaatgcataatgcactgcacatctacatgaacggtactatgtcgcaagtgcaaggaagcgccaatgaccctatctttcttcttcaccatgcattcgtggactcgatctttgagcagtggctgcgccggcatagacctctgcaggaagtctatcctgaagcaaatgctcctataggacataatcgagaaagctacatggtcccatttatcccgctgtacagaaacggtgactttttcatatcgtccaaagacctgggctacgattactcgtatctccaggattccgatccagattcatttcaggactacattaagtcctaccttgaacaggcctcgcggatttggtcatggcttttgggagcagcaatggtgggcgcagtgctcaccgcactcctcgcgggtcttgtgtcgcttctgtgtagacacaaaaggaagcagcttcctgaagaaaagcaacccctgctgatggagaaggaagattaccattcgctgtaccagtcgcatctg

SEQ ID NO: 20600 - DNA, 1587 bp, Artificial Sequence
  Description of Artificial Sequence: Synthetic coding sequence
atgcttctagccgtgctctactgcctcctctggtcctttcagacatcagctggacacttccctagggcatgcgtgagttctaagaatttgatggagaaggaatgttgtcccccatggtccggagatcgctctccttgtgggcaattaagtggcaggggttcgtgccagaacatcctcctgagtaacgcacctctgggccctcagttccctttcaccggcgttgatgatcgagagtcatggccgagtgtgttctacaatcggacttgccagtgcagtgggaactttatggggtttaattgtggcaattgtaaattcgggttctggggccccaactgtactgagaggaggctactagtgaggaggaacatctttgacctgagcgctccagagaaagataaatttttcgcttacctcaccctcgctaagcacactatctcgagtgattatgtgattcctatcgggacatatggtcagatgaagaacggatccacacctatgtttaacgacataaacatttatgatctcttcgtgtggatgcactattacgtctcaatggacgccttactcggaggttctgagatctggcgcgacatcgactttgcacacgaagcacctgcatttttgccatggcacaggctgttcctgcttcgatgggaacaagagattcagaagctgacaggcgacgagaatttcaccattccatactgggactggcgagatgccgagaagtgcgacatctgtactgacgagtatatgggaggacagcaccccaccaacccaaatttgctgtccccggcttccttcttttcctcttggcagatcgtctgctctcgcctcgaagagtataactctcaccagagcctatgtaatggaactcctgaggggccattgcggagaaaccctggcaatcacgacaaatctagaacgcctaggctgcctagttctgcggatgttgaattttgcctgtcgttgacccagtatgagagtggcagcatggacaaagcagctaatttctcattcaggaacacactggaaggcttcgcctctccccttactggaatcgcagatgcctctcaaagttcaatgcacaatgcactgcatatttacatgaatggcaccatgtcgcaggtccagggatcggcgaatgatcctatctttttgttacaccacgcatttgtggatagcatctttgaacagtggctccggagacacagaccgctacaggaagtgtaccccgaggcaaatgcgccaattggacacaaccgtgagtcttacatggtgcccttcattcctctgtacaggaacggcgactttttcatttcctctaaagatttaggttatgattactcatatctccaggactcggacccggattcatttcaggattacattaaaagttacctcgagcaggcttcgagaatttggtcttggctcttgggcgccgctatggtgggcgcagtcctgactgcccttcttgccggtcttgtgagcctgctgtgtcgccataagcgtaagcaactccccgaagagaagcagcccctcctgatggagaaggaagactatcatagtctttatcagtcccattta

SEQ ID NO: 20601 - DNA, 1587 bp, Artificial Sequence
  Description of Artificial Sequence: Synthetic coding sequence
atgttgttagcagtcttatattgtttattgtggtcatttcagacatctgctggtcattttccacgcgcttgcgtgagttccaagaacttaatggagaaagagtgctgtccaccgtggtcaggggatcgctcaccttgtggccaactttctggcagaggctcatgtcaaaatattttgttgagcaacgctccgctcggcccacagtttccgttcactggcgttgatgacagagagtcctggccatccgttttttataaccggacgtgccagtgttctgggaacttcatggggttcaactgcggcaattgcaagtttggcttttgggggccgaactgcacagaacgacgacttttggtgcgaagaaatatttttgatttatcagcaccggaaaaggacaaatttttcgcttatttaacactcgcgaagcatacaattagtagtgactatgtcatcccaattggaacatatggacagatgaaaaatggcagtacgccgatgtttaacgatataaatatttatgacctgtttgtctggatgcattattatgtttcaatggacgcgttgttgggaggcagcgaaatctggagagacattgattttgcacatgaagcacctgcgttcttaccgtggcaccgattgtttcttcttcgttgggaacaggaaatccaaaaactcacaggtgacgagaatttcacaatcccgtactgggactggagggacgccgagaaatgcgatatttgtacggatgaatacatgggagggcagcacccaacaaatccaaacttattgtccccggcgtcgtttttttcatcgtggcaaattgtctgctcccgactagaagaatataactctcatcagagcctctgcaacggcacgccggaaggaccgctgcgccgtaatccgggaaaccatgacaaatcgagaacacctcgtttaccgagctcagcggatgtggaattctgtttgtcattgacccagtatgaatctggctcaatggataaagcggcaaacttctcatttaggaatacgttagaggggttcgcgtcgcctcttacaggcattgccgacgcatcacagtctagcatgcacaatgcgctgcatatttatatgaacggaacaatgtcacaagtgcagggcagcgccaatgatccgattttcctgttgcatcatgccttcgtcgactcaattttcgagcaatggttgcgaagacatagaccactgcaagaggtctacccggaagccaatgcaccgatcggtcataaccgtgaaagctatatggttcctttcattccgctctatcgaaatggcgactttttcatttcaagtaaggaccttggctatgactatagctatcttcaggattctgacccggacagtttccaagattacatcaaatcttatttagagcaagcgagccgcatttggagctggctcctcggcgctgcgatggttggagcagtgttaactgcactcctggctggcttagtcagcttgctgtgtagacacaaaaggaagcaacttccggaagagaagcagcctcttttgatggaaaaagaggactaccattctttatatcaatcacacctt

SEQ ID NO: 20602 - DNA, 1587 bp, Artificial Sequence
  Description of Artificial Sequence: Synthetic coding sequence
atgttactagccgttctgtattgtttgttatggtcgtttcagacttctgcaggccattttcccagggcctgtgtgtcatccaaaaatttgatggagaaggaatgttgtcccccttggagtggggatcgcagcccatgtggccaattatcgggccgggggtcttgtcagaatattctgctctccaacgctcccctcggcccgcagttccctttcaccggcgtcgacgatcgcgagtcctggccaagtgttttttataatcggacttgccagtgtagtggaaacttcatggggttcaactgcggaaactgcaagttcggcttttggggccctaattgcacagaacgtaggttactggtgcgccgaaacatctttgatctttctgctccggaaaaggataaatttttcgcctatctgacgctcgccaaacacactattagttccgactatgtgattcccatcgggacctacggacaaatgaagaacggctccacgcccatgtttaatgatatcaatatttacgatctgtttgtctggatgcactactacgtctccatggacgcactgctagggggctctgagatctggcgcgatatagactttgcgcatgaagcacccgcattcctgccctggcatcggctgttcctgctgaggtgggagcaggagattcaaaaactgacaggtgacgaaaattttacaatcccttactgggactggagggatgccgagaagtgcgacatctgcacggacgagtacatgggagggcaacatcccaccaatcctaacttgctgagtccggcttctttttttagctcctggcagatcgtctgctctcggctcgaggaatataactcccaccaatctctctgtaatggaacaccggagggcccattgcggcgcaacccaggtaaccacgataagagtcgcaccccacgtctgccctcatccgcagatgtggagttttgtctcagtttgacacaatatgagtccggtagcatggataaggcggccaacttctcttttagaaatactttggagggcttcgcgtccccgctaaccggcatcgcagacgcaagccagagtagcatgcataacgccctacacatatacatgaacggcaccatgtcgcaggtgcagggctcagccaacgacccgatatttttattgcaccacgcatttgttgacagcatcttcgaacaatggctgcggcggcaccggccactccaagaggtttacccagaggccaatgcccccatagggcacaatagagagagctatatggtgcccttcatcccactgtataggaatggcgacttcttcattagttccaaagatctgggctacgactattcatatctgcaggacagtgacccggattcattccaagattatataaagtcttacttagagcaggcttctcggatatggtcctggctgctgggcgctgcaatggtcggtgcagtgttgaccgctctgctggcgggactggtctccctgctttgtaggcataaacggaaacaattacccgaggaaaaacagcctctactgatggagaaggaggactaccattccctttatcagagtcacctt

SEQ ID NO: 20603 - DNA, 1587 bp, Artificial Sequence
  Description of Artificial Sequence: Synthetic coding sequence
atgctccttgcggtgctgtactgccttttgtggagctttcagacgagcgcaggccatttcccgagagcctgcgtctcctcaaaaaacctgatggaaaaggaatgctgccctccttggtcgggtgatcgctccccatgtggacaactgtcgggaagaggatcctgtcaaaatatcctcctctccaacgcgcctctgggacctcagttcccgtttaccggagtggatgacagggagagctggcctagcgtcttctacaaccggacctgccaatgctcaggtaatttcatgggcttcaactgcggaaattgtaagtttgggttctggggaccgaattgcacggagagaaggctgctcgtacgccgcaacattttcgacctgtcggcgccagagaaggataaattcttcgcgtacttgacgctcgccaagcacaccatcagcagtgactacgtgatcccgatcggaacctacggtcagatgaagaacggctccaccccaatgttcaacgacatcaacatctacgacctgtttgtgtggatgcattactacgtgagcatggatgcgctgctcggcgggtccgagatctggagagatatcgacttcgcccatgaggcgccagcatttctcccgtggcataggctgttcctgttgcgatgggagcaagagattcaaaagctcactggcgatgagaacttcaccatcccatactgggattggcgcgacgcggaaaaatgcgacatttgtaccgacgagtacatgggcggacagcatccgaccaaccccaacctgctgtcgccggcatctttcttctccagctggcaaatcgtgtgctctcggctggaagaatacaattcgcaccagtctctgtgtaacgggactccggaaggcccgctccggcgcaatccgggaaaccacgacaagtcacgcaccccgaggctgccttcatcagcggacgtcgagttctgcctgtcgctgactcaatacgagagcggatccatggataaggcagccaacttctcgtttagaaacactctggaaggattcgcttccccactgaccggcatcgccgacgcgtcccaatcgtcaatgcacaatgctctccatatctacatgaacggaaccatgtcacaagtgcagggatctgcaaacgaccccatcttcctgctgcaccacgcgttcgttgattccatcttcgaacagtggttgaggcgccaccgcccgctccaggaagtgtacccggaggccaatgcgcctatcggacataacagagagtcctacatggtcccgtttatccccctctaccgaaatggagacttctttatctcatcaaaggatcttggctacgattacagctacctgcaggatagcgatccggattcgttccaggactacatcaaatcctacctcgaacaggcatcgcgcatctggtcctggctgctgggagccgcaatggtgggagccgtgctgaccgcacttctggccggactcgtgtctctgctgtgccgccacaagcgcaagcagctgccagaggaaaaacagccgcttctgatggagaaagaggattaccactcgctgtaccagagccacctg

SEQ ID NO: 20604 - DNA, 1587 bp, Artificial Sequence
  Description of Artificial Sequence: Synthetic coding sequence
atgctgctcgccgttctttattgtctcttgtggtccttccagacatcggcgggacatttcccacgcgcctgtgtcagctccaagaatcttatggagaaggaatgttgccccccatggtccggcgaccggtcgccttgcggccagctgtcagggaggggctcatgtcagaatattctgcttagcaatgctcctttgggcccacagtttcccttcactggagtggacgatagggaaagttggccatcagtgttctacaacagaacctgtcagtgctccgggaattttatgggcttcaactgcggcaattgtaagtttgggttttggggccccaattgcaccgagaggagactccttgtccgtcggaacatctttgatctgtctgccccagaaaaagataaattctttgcctacctgactttggctaaacacacaatctcctccgactacgtcatcccgatcggcacatacggtcagatgaagaatggatcaacacctatgtttaatgacataaatatctatgacctgttcgtgtggatgcattattatgtgagtatggatgccttgctgggaggctccgagatctggcgagatatcgactttgcccatgaggctcctgctttcctgccctggcaccggctcttcctactgcggtgggagcaagagattcagaagctcaccggagacgagaactttactattccttattgggactggcgcgacgcagagaagtgtgacatttgtaccgacgaatacatgggcggacaacaccctaccaatcccaatctgctctcccccgctagcttcttttcatcgtggcagattgtatgtagccgcttagaggagtacaactctcaccagagcctgtgtaatggaaccccagaaggaccactgcgccggaatcccggaaaccacgacaaatctcggaccccccgcttgccctcctctgcagacgtggagttttgcctcagtctaactcaatacgagagcggctccatggataaagccgcaaatttttcgttccggaacacactcgagggatttgcctccccccttaccggcatcgccgatgcatcccagtcttcaatgcacaatgcacttcatatctatatgaacggtacaatgtctcaggtacagggttccgcaaacgacccgatcttcctgctgcaccacgcttttgtcgactctattttcgaacaatggctgcgccgtcaccgacccttgcaggaggtgtacccagaagctaacgccccgattggacataaccgcgagagctacatggtgcctttcatccccctttatagaaacggagatttcttcatcagctccaaggatctgggctatgattactcatacttgcaggacagcgatcctgattctttccaggactatatcaagagctacctggaacaggccagccgaatatggtcatggctgctgggggcggctatggtgggcgctgtgttaaccgcgctactggcaggtctggtgtccctcttgtgcaggcataaacggaaacaactgccagaggaaaaacagcccctcctgatggaaaaggaagattaccattctttgtatcaatcacacctc

SEQ ID NO: 20605 - DNA, 1587 bp, Artificial Sequence
  Description of Artificial Sequence: Synthetic coding sequence
atgctgctggccgtcctctactgcctactatggagcttccagaccagcgctggacacttccctcgcgcttgcgtctctagtaagaacctgatggagaaagaatgttgccctccatggtcgggtgacagaagcccgtgcggacaactgtccggtcgaggtagttgccaaaacattctgctttctaacgccccgctgggaccacagttcccctttactggcgtcgacgatcgcgagagctggccttccgttttttacaaccggacgtgccagtgttctgggaacttcatgggcttcaattgtggcaactgcaagttcggattttggggcccaaattgcactgaaaggagactgctcgtaagaagaaacatattcgatctcagcgctcccgagaaggacaaatttttcgcttacttgactctcgccaaacacaccatttctagcgactacgttatcccgataggtacttacggccagatgaagaatggatccacgcctatgtttaacgacattaatatctatgatctgttcgtgtggatgcactactacgtgtccatggacgctctgctgggaggaagtgagatttggagagatatagacttcgcacacgaggcaccggcatttctgccatggcaccgcctttttcttctgcgatgggagcaagagatccagaagctgaccggagatgaaaacttcacgatcccatactgggattggcgcgacgcagagaaatgcgacatttgcacggacgaatacatgggaggacagcatccaactaaccccaacttactctccccagccagtttcttctcgagctggcagattgtatgctctcgtcttgaggagtataatagtcatcagtcgctgtgtaatggtacacccgagggacctctccgcaggaacccaggtaatcatgacaaatcgaggacccccagattaccctcatccgcggatgttgagttttgtctgtccctaacgcagtacgaatcgggctctatggacaaggccgccaattttagttttcggaatactctggagggcttcgcctcgcccttgactggcatcgccgatgcctcgcagtcgagcatgcataacgccttgcatatttatatgaatggaaccatgagccaggtgcagggctcggctaatgacccaattttcctgctacatcacgcattcgtggatagcatatttgagcagtggcttcgccggcaccgcccgctacaggaggtttatccggaggccaatgcccccattggtcacaatcgcgaatcgtatatggttccgttcatccccctctacagaaatggagatttcttcatcagcagcaaggacttgggatacgattattcctacctacaagacagcgacccggattccttccaagattacattaagtcgtatcttgaacaggcaagtcggatttggagctggctcctgggcgcagccatggttggcgcagtgctgacagccttgctggcaggactggtgtctctgctgtgccgtcacaagcggaagcagttgccagaggaaaaacagcccttgctaatggagaaggaggactaccacagcctatatcaatcacacttg

SEQ ID NO: 20606 - DNA, 1587 bp, Artificial Sequence
  Description of Artificial Sequence: Synthetic coding sequence
atgcttttagctgtattatattgtttactttggtcttttcaaacttcagctgggcattttcctagagcttgtgtttcatcaaaaaatcttatggaaaaagaatgttgtccaccatggtctggtgatagatccccttgtggacaattatcaggaagaggatcatgtcaaaacattttactttcaaatgctccattaggaccacaattcccatttactggtgttgatgatagagaatcatggccttctgtgttttataatagaacttgtcaatgttctggaaattttatgggatttaattgtggaaactgtaaatttggattttggggtccaaattgtacagaacgtagattattagttagaagaaacatttttgatttatcagctcctgaaaaagataaattttttgcatatttaacattggctaaacatactatcagtagtgattacgtcattccaattggaacatatggacaaatgaaaaatggatcaacaccaatgttcaatgatattaatatttacgatctttttgtttggatgcattattatgtttcaatggatgcattacttggtggttcagaaatatggagagatattgattttgctcatgaagcacctgcatttttaccatggcatagactttttttattaagatgggaacaagaaattcagaaactaaccggtgatgagaattttacaattccttattgggactggagagatgcagaaaaatgtgatatttgtacagacgaatatatgggtggacaacacccaactaatcctaaccttctttcaccagcaagtttcttttcatcatggcaaattgtttgttcaagattagaagaatataactctcaccaatctttgtgtaatggaacccctgaaggaccattaagacgtaaccctggaaatcacgataaatctagaacaccaagacttccttcaagtgccgatgttgaattttgtctatctcttactcaatatgaaagtggttctatggacaaagcagctaatttttcatttcgaaatactttagaagggtttgcttcaccattaactggaattgcagatgcatcacaatcttcaatgcataacgcattacatatttatatgaatggaactatgtctcaagttcaaggatcagcaaatgatccaattttccttttgcatcatgcatttgtagactctattttcgaacaatggcttagaagacatcgtccattacaagaagtttatccagaagcaaatgcaccaattggacataatcgagaatcttatatggttccatttattccattatatagaaatggagatttttttatatcatcaaaagacttaggttatgattattcgtatcttcaagatagcgatccagatagtttccaggattatattaaaagttatttagagcaagcatcaagaatttggtcttggcttttaggtgctgctatggttggtgctgttttaacagctttgttagctggattagttagtcttttatgtagacacaaacgaaaacaattgccagaagaaaagcaacctttacttatggaaaaagaagattaccatagtttgtaccaaagtcattta

SEQ ID NO: 20607 - DNA, 1587 bp, Artificial Sequence
  Description of Artificial Sequence: Synthetic coding sequence
atgttgctcgccgttctgtactgcctcctgtggtcgttccaaacatcagcgggccactttccgcgggcctgcgtgtcaagcaaaaatctcatggaaaaggagtgctgtcctccctggtccggcgatcgatccccatgtggacagctctcgggtcgcggttcttgccagaacatcctgctaagcaatgcacctctggggccccagtttcccttcaccggtgtggatgatagagagagctggcccagtgtgttttacaaccgcacatgccagtgctccggaaacttcatggggtttaattgtgggaattgtaagttcggtttttggggacccaattgcacagagagaaggctgctggtgcgaaggaacatcttcgacctaagcgcgcccgagaaagataagttctttgcatacttgaccctagccaaacacacgatctcctcagattatgtaattccaattggaacttacgggcagatgaagaatgggtcaaccccaatgttcaacgatatcaatatatacgatctctttgtgtggatgcactattatgtcagcatggacgcgctccttggcgggtcagaaatatggcgagacatcgactttgcacatgaagccccagcgttcttgccctggcaccggctcttcctgctgagatgggaacaggagattcagaaactgactggcgatgaaaattttactatcccatattgggattggagggacgcagaaaaatgcgatatctgtaccgacgagtacatgggcggacagcacccaaccaacccgaatctcctgagtcccgcatcattttttagcagttggcaaatcgtttgcagtcgacttgaggagtacaattcccaccagtcactctgtaacgggactcccgaaggacccctgaggcggaacccaggtaatcacgacaagtctcggacacctaggctcccatctagtgctgatgtcgaattttgcctgtctctcacacagtacgaatccggctccatggacaaagcggcaaacttttcttttcgaaatacactcgaagggttcgcatcacctttgaccggcatagctgacgcctcccagtcctcaatgcataacgcgctccacatctacatgaatggaactatgagtcaggtgcaggggtctgcaaacgatcctattttcctgttacaccacgcttttgtggatagtattttcgaacagtggctgcgacgccaccgccctctgcaggaggtgtatccggaggcaaatgctccaatcggacataacagagaaagctatatggtgcccttcattccactgtaccggaatggggacttttttatcagtagtaaggacttggggtacgattatagttatctccaggactcggacccagattctttccaggactatattaagagttacctcgagcaagcctcgaggatctggagctggctgctgggagccgccatggtgggcgctgtccttaccgctctgttagctggcctcgttagcctgttgtgtcgccacaagaggaagcagcttcccgaagaaaagcagcccctgctgatggagaaagaagactatcattccctatatcagagccacctc

SEQ ID NO: 20608 - DNA, 1587 bp, Artificial Sequence
  Description of Artificial Sequence: Synthetic coding sequence
atgttgctcgccgtgctctactgtctgctctggtcgttccagacgagcgcggggcactttccgcgggcgtgcgtgtcctccaagaatttgatggaaaaagagtgttgcccgccgtggtcaggcgatcgctcgccctgcggacaactctccggacggggatcgtgccagaacatcctgctgtccaacgcacctctcggcccgcagttcccgttcaccggagtggacgatcgcgaaagctggcccagcgtgttctataatcggacctgccagtgctctggaaacttcatgggattcaactgtggtaattgcaaatttggattctggggaccgaattgtaccgagcgcagactcctggtgcgaaggaacatctttgacttgtccgccccagaaaaggacaaattcttcgcgtacctgacccttgccaaacataccatctcatcggactatgtgattccgattggaacttacggccagatgaagaatggatcgactccgatgttcaacgacatcaacatctacgatctgttcgtttggatgcactattatgtgtccatggacgcgctgttgggaggatcagagatctggcgcgacatcgatttcgcacatgaggcaccggcattcttgccgtggcaccgcctgttcctgctgcgctgggaacaagagatccagaaactgacgggtgacgaaaactttaccataccatactgggactggcgcgacgcggaaaagtgtgatatctgcactgacgagtacatgggaggtcagcatcctactaacccgaaccttctctcgcctgcctcctttttctcgtcgtggcagattgtctgctccagactggaggagtacaactcgcaccagtccctgtgcaacggtaccccggaaggacctcttcgccggaacccaggcaatcacgacaagtctcgtaccccacggctgccctcgtcagcggatgtggaattttgccttagcctcacccagtacgaaagcggatctatggacaaggctgctaatttctcattcagaaacacgctcgaaggattcgcctccccgttgaccggcatcgcggacgcaagccagagctccatgcataatgccctgcacatatacatgaacggaactatgagccaggtccaggggtcggcaaacgatcctatcttcctcctccaccacgcctttgtggactcgatctttgaacaatggctgcgacggcaccggccgctccaggaagtctacccagaagccaatgcgccaattggacacaatcgcgagtcgtacatggtgccgtttatcccactgtaccggaacggtgacttctttatctcatccaaggacttggggtatgactactcctacctgcaggattccgacccggacagcttccaggactatatcaagagctacctggagcaagccagtcggatctggtcatggctgctgggagccgcaatggtaggtgcagtgttgaccgcgttgttggctgggctcgtctctcttctgtgccgccacaaaagaaagcagctcccggaagaaaagcagcctctgctgatggaaaaggaggattaccactcgctgtaccagtcccatctg

SEQ ID NO: 20609 - DNA, 1587 bp, Artificial Sequence
  Description of Artificial Sequence: Synthetic coding sequence
atgcttctggcggtgctctattgcctcctctggtcgttccaaacttctgcagggcacttccctcgggcttgtgtgtcaagcaagaacctcatggaaaaggagtgttgcccgccctggagcggggaccggtcgccttgtggccagctttccgggcgcggatcatgccagaacatcctgctctccaacgccccactgggaccgcagttcccgttcactggagtggatgatcgcgagagctggccttcagtgttctacaaccgcacctgccagtgctccggtaatttcatgggattcaattgcggaaactgtaagttcggtttctggggacccaactgcaccgaaaggcgcctgcttgtgagacgcaacatctttgacttgtccgcaccagaaaaagataaatttttcgcatacctcactttggccaagcatactatctcgagcgattacgtgatcccgattggcacttacggacaaatgaagaatggttcaaccccaatgttcaatgacatcaacatctacgacttgtttgtgtggatgcactactacgtctcgatggacgcccttctgggtggctccgagatttggcgcgacatcgacttcgcgcacgaggcgccggccttcctgccttggcaccggctgttcctcctgaggtgggaacaggaaatccagaaactcactggcgacgagaactttaccatcccatactgggattggcgggatgccgaaaagtgcgacatctgcacggatgaatacatggggggccagcatccaactaacccgaatctgctgagtcccgctagctttttctcgtcgtggcaaattgtgtgctcacggctggaagagtacaactcgcatcagtcgctgtgcaatggaaccccggagggacctctccgcagaaatcccggcaatcacgataaatcgcgcactccgaggctgccatcaagcgccgatgttgagttttgcctgtccctgacgcagtacgagtcaggatcaatggataaggccgctaatttctctttcagaaacaccttggaagggtttgcatcgcctctgaccggaatcgccgacgcatcccaaagctccatgcacaacgcgctgcatatctatatgaacggaaccatgagccaggtgcagggaagcgcaaacgatccgatcttcctcctccatcatgcgttcgtcgactcaatctttgaacaatggctgcgacggcatcggccactccaggaagtgtacccggaggcgaacgccccaatcggccacaatcgcgaatcgtacatggtcccgttcataccgctttaccggaacggcgacttctttattagctcgaaggacctgggatacgactattcctacctgcaggattctgaccctgactccttccaagactacatcaagtcgtacttggaacaggccagccgaatctggtcctggttgctgggagctgctatggtcggagccgtcctcaccgccctgctggcgggcctggtgtcgctcctttgtagacacaaaagaaagcaactcccggaagaaaagcagccgctgctgatggagaaggaggactaccactccctctaccaatcacacctg

SEQ ID NO: 20610 - DNA, 1587 bp, Artificial Sequence
  Description of Artificial Sequence: Synthetic coding sequence
atgttgctggccgtgttatattgcctgctttggagcttccagacctccgcgggtcatttcccacgggcgtgtgtgtcatccaagaacctgatggaaaaagaatgctgccctccttggtctggcgaccgttctccatgtggacagttgagtgggcgtgggtcatgccaaaacatcctcctgagtaacgcaccgctcggtcctcagtttccttttactggggtggacgacagggaaagctggccatccgtgttctacaatagaacttgccagtgttccggcaactttatggggttcaattgtggaaactgtaagttcgggttctggggccccaattgtactgaaaggagactgctcgtccgccggaacatttttgacctgtcggcgcccgagaaagataagttctttgcctacttgaccctcgccaaacacacgatctctagcgactatgtcatcccaattggaacctacggccagatgaagaatggttccacgcctatgtttaatgacattaacatctacgatctgtttgtgtggatgcattactacgtgtctatggatgccctgttgggcggctctgaaatatggagagatatcgactttgctcatgaggcccctgctttcttgccttggcacaggctttttttgctccgatgggagcaggaaatccaaaaacttactggtgatgaaaattttacgatcccatactgggactggcgggacgccgagaagtgcgacatctgtaccgacgaatatatgggtgggcaacaccccacaaacccgaacctcctgagcccagcgtccttcttcagtagctggcagatcgtgtgctctaggctcgaggagtataatagccaccaatcactgtgcaacgggactcctgaggggcctcttagacggaatcctggaaaccatgacaagtctcgcactcctcgtctcccgtcaagcgctgatgttgaattttgcctgtcgcttacccagtatgaaagcggatccatggacaaagccgccaattttagcttccgcaacaccctagaaggattcgctagccctctgaccgggatcgctgacgccagccaaagctccatgcataacgccctccatatctacatgaatggtacaatgtcgcaggtgcaggggtccgccaacgatcccatattcctgttacaccacgccttcgtggattccatattcgaacaatggctccggagacaccgccctctgcaggaagtgtatcccgaggctaacgcccccattggccacaaccgagaatcttacatggtgcctttcatccccctgtaccggaacggggacttttttatctcttccaaggatctgggatatgactattcctacttgcaggatagcgaccctgactcgttccaagactatataaagtcctatctggagcaggcatctagaatttggtcttggctgctgggcgccgctatggtgggggctgtgctgacagctcttctggcaggccttgtctcacttttgtgccgccataagcgtaagcagctccctgaagaaaaacagccattattgatggaaaaagaggactaccacagtctgtaccagtcacacctc

SEQ ID NO: 20611 - DNA, 1587 bp, Artificial Sequence
  Description of Artificial Sequence: Synthetic coding sequence
atgcttcttgcagtgctttactgtcttttgtggtcgtttcagacttccgcaggccatttcccaagagcgtgcgtgtcctcgaagaacctcatggaaaaggaatgttgtccgccctggtccggtgaccgttcgccttgcggtcagctgtcgggccggggatcgtgtcagaatatccttctctcgaatgcaccactgggcccccagttcccatttaccggagtcgacgaccgggaatcctggccctccgtgttttacaacagaacgtgccagtgtagcggtaacttcatgggattcaattgcgggaattgtaagttcggtttctggggacctaattgcactgaacgtcgtttgctcgtgcgaagaaatatcttcgatctgtcggcccccgaaaaagataagttttttgcctatcttactcttgccaagcacactatctcatccgactatgtcattcccatcggcacttacggccaaatgaaaaacggctcgaccccaatgttcaacgatatcaacatctacgacctttttgtgtggatgcactactacgtctccatggacgcacttttgggaggatcagaaatttggagggatattgatttcgcccatgaagcacctgcgtttctgccatggcaccggctttttcttctgaggtgggagcaagagatccagaagctcaccggtgatgaaaacttcaccataccttactgggattggagggatgcagagaagtgtgacatctgcactgatgaatacatgggaggacaacacccgactaatcctaaccttctgtccccagcatcgtttttctcctcatggcaaatcgtgtgttcgcgcctggaagagtacaattcgcatcagtcgctttgtaatggaacccctgagggtccactgaggcgcaaccccgggaatcatgataagagccggacccctagacttcctagcagcgcggacgtggaattctgtctgtccctgacgcaatacgagtccggctccatggataaggcagcaaatttctcatttaggaatacgctggagggttttgcttcaccacttacgggtattgcagatgcaagccagtcatccatgcataacgcactgcatatctacatgaatggtactatgtctcaagtgcaaggatctgccaacgatccgatatttcttttgcatcatgcttttgtggactccatttttgaacaatggctccggagacacagacctcttcaggaagtgtaccccgaagctaacgcgccaattggtcataatagagagtcatacatggtgccgtttatccccctctaccgaaacggagacttcttcatttcgtcgaaggacctcgggtacgattactcctacctgcaggactcggacccggactcattccaagattacatcaaatcgtatctggaacaagcgtcacgaatttggtcgtggcttcttggagcagcgatggtgggagcagtgcttaccgcgcttctcgccggtctggtcagccttctttgtcgtcataagcgcaaacaactgcctgaagaaaagcaaccactgcttatggagaaagaagattaccattccctgtaccaatcgcacttg

SEQ ID NO: 20612 - DNA, 1587 bp, Artificial Sequence
  Description of Artificial Sequence: Synthetic coding sequence
atgctgctggcagtgctctactgccttctttggtcttttcagacttcggctggacacttcccgcgggcctgtgtctcgtcgaagaacctgatggaaaaagaatgttgcccaccgtggtcgggcgatagaagcccttgcggacaacttagcggaagaggatcttgccagaacatcctgctttccaacgcgccactgggaccgcaatttccatttactggggtcgatgaccgcgagtcgtggccatccgtgttctacaaccgcacttgccagtgctcgggaaatttcatggggtttaactgtggaaattgcaagtttggattctggggacccaactgcactgagaggcggttgctcgtccggcgcaacatcttcgacctctctgctcccgagaaggataagttttttgcttacctgactctcgccaagcatacgatcagctccgactacgtcatcccgatcggtacctacggacagatgaagaacggatccaccccgatgttcaatgatatcaacatctacgatctgttcgtgtggatgcattactacgtgtcgatggacgctcttctgggaggatccgaaatctggcgcgatatcgacttcgcacacgaagccccagccttcctgccgtggcacagactgttcctgctgcgctgggagcaggaaatccagaagttgacgggagacgaaaacttcaccattccgtactgggactggagagacgccgaaaaatgtgatatctgcactgacgaatacatgggaggtcagcacccgactaatccgaaccttctctcgcctgcgagcttcttttccagctggcaaatcgtctgctccaggctcgaagaatacaattcgcatcagtccttgtgcaatgggactcctgaaggaccgttgcggcgcaatccaggcaaccatgacaagtcccgcactccgagactgccctcatcggccgacgtcgagttttgcctgagccttacccagtacgaatcaggatcaatggacaaggccgccaacttttcgtttcgcaataccctggaggggtttgcgagcccgctcaccggaatcgcagacgccagccaatcatccatgcacaacgccctgcacatctacatgaacggcactatgtcacaggtgcagggatcagcaaacgacccgattttcctgctccaccacgcgttcgtggactcaattttcgagcagtggctgcgtaggcacagaccgctgcaggaagtgtatcccgaagctaatgccccgatcggacataaccgagaatcgtacatggtgcctttcatccctctctaccgcaatggtgacttcttcatctcgtctaaggacttgggttacgactacagctacctccaggactcggacccagactcttttcaagactacatcaagtcatacctggaacaggcatcgcggatctggtcatggctgctcggcgcggcaatggtgggagccgttttgaccgctctccttgccgggctggtgagcctcctctgccgccataaacgcaagcagctgccggaagaaaagcagcccctgctgatggagaaagaggactaccactcactttaccaatcccacctc

SEQ ID NO: 20613 - DNA, 1587 bp, Artificial Sequence
  Description of Artificial Sequence: Synthetic coding sequence
atgctccttgcagtgctttactgcctgctctggagcttccaaacctcagcaggtcattttccccgtgcttgtgtgtcatcgaagaacctgatggaaaaagaatgctgtccaccttggagcggcgatcgcagcccatgcggacaactgtcaggacgaggctcgtgccagaacatcctgctgtcgaatgcccctcttggtccacagttcccttttaccggagtcgatgatagggagtcctggccatcggttttctacaatcggacttgccagtgtagcggtaatttcatgggttttaactgtggcaactgtaagttcggattttgggggcctaactgtaccgaacggagacttctggtgagaaggaacatatttgatctgtcggcaccagagaaagataagttcttcgcataccttaccctggcaaagcatactattagctcagactacgtgatacctattggtacctacggacagatgaagaacggatccaccccaatgtttaacgacattaacatctacgatctttttgtgtggatgcattactatgtcagcatggatgctcttcttggtgggagcgaaatttggcgcgacatcgattttgcccatgaagctcccgcttttcttccctggcatcgcctttttctgcttagatgggaacaggagattcaaaagctgactggagacgaaaactttactatcccttactgggattggcgagacgcagaaaaatgtgatatatgtaccgatgagtacatggggggacagcatccaactaatcctaatctccttagcccagccagctttttctcgtcatggcaaatcgtgtgttcgaggctggaagaatacaactcgcatcaatcgctctgtaacgggacgccagaggggccactgagacgaaacccaggtaaccacgacaagagcaggaccccaagattgccctccagcgcagatgttgaattttgcctctcgttgacgcaatacgagtccggatcaatggataaagcggcgaacttttcctttcgcaacaccctcgaaggattcgcttcgcctcttacggggatcgcagatgcatctcagtcctcaatgcataacgcactgcacatttacatgaacgggaccatgtcgcaggtccagggatctgcgaacgatcctattttcctcctgcaccatgcattcgtggatagcatttttgaacaatggttgaggagacacagacctcttcaagaagtgtatcctgaagcaaatgcgcccatcggccataaccgggaaagctacatggtgccgttcatcccactttaccggaatggcgactttttcatcagctcaaaggatcttggatacgattattcctaccttcaagatagcgacccagactcctttcaagactacattaagtcgtatcttgagcaggcaagccgtatttggagctggcttctgggggctgcaatggttggagccgtgttgactgcactgctcgcgggtcttgtgtcgcttctttgtcggcataaaagaaagcagttgccagaggagaagcagcctctcctgatggagaaggaggattaccattccctgtaccaatcccacctg

SEQ ID NO: 20614 - DNA, 1587 bp, Artificial Sequence
  Description of Artificial Sequence: Synthetic coding sequence
atgttgcttgcagtgttgtattgccttctgtggtcatttcaaaccagcgctggacattttcctcgcgcttgtgtctctagcaagaaccttatggaaaaagaatgttgtccaccttggagcggcgacaggtcgccctgtggtcaactttccggacggggatcctgccaaaacattctgctttcgaatgcccccctggggccgcaatttccgtttactggagtggatgacagagagagctggccgtccgtgttttacaacaggacttgccagtgttccggtaacttcatgggtttcaattgcggtaattgtaagtttggcttttggggccctaattgtacggaaagacgactccttgtgagaagaaacatctttgatctttccgctccagagaaagataagttcttcgcctacttgacccttgctaagcacaccatttcttcagactacgtcatcccaatagggacctacggtcagatgaaaaacggcagcacgcctatgtttaatgacattaacatttacgacctcttcgtgtggatgcattactacgtctctatggatgcattgcttggagggtcagagatttggagagatattgattttgcacatgaagcacctgcatttctgccatggcacagactgttccttctgcggtgggagcaagaaattcagaagttgaccggtgatgaaaactttaccatcccttactgggactggcgggatgcggaaaagtgcgacatttgcaccgatgaatacatgggtgggcaacatcctaccaacccgaaccttctctcccccgcgtcgttcttcagctcctggcaaattgtgtgcagccgcctggaagaatacaactcccatcagtcgctttgcaacggtacccccgagggaccgctcagacggaacccaggaaaccatgataagagcagaactcctagactgccctcgtccgctgatgtcgagttttgtctttcgcttactcagtacgagtcgggctcgatggacaaggcggccaacttttcattccggaacactttggagggattcgcaagccctctcactggtattgctgatgcatctcagtctagcatgcataacgcccttcatatctatatgaacggtacgatgtcgcaggtgcagggttcagcaaatgatccgatatttctgctgcatcatgccttcgtggattccatctttgaacagtggcttaggcgtcacagaccactccaggaagtgtaccctgaagcaaacgcccctattggccacaacagagagtcgtacatggtccctttcatcccactttaccgcaacggagacttctttatctcatctaaagatcttgggtacgattatagctacctgcaagatagcgacccagattcgttccaagactacattaagtcctacctcgaacaggcatccaggatctggtcgtggctcctcggagcagccatggtcggggcagttctgactgcccttttggcgggcctcgtgtccctgctgtgtcgtcacaagagaaagcaacttccagaagaaaagcaacctcttctgatggagaaggaggattaccactccctttatcaatcgcatttg

SEQ ID NO: 20615 - DNA, 1587 bp, Artificial Sequence
  Description of Artificial Sequence: Synthetic coding sequence
atgctgctcgccgtgctgtactgtcttctgtggtctttccagactagtgcgggacactttcctagggcttgcgtttcttcgaaaaatctcatggaaaaagaatgttgtcctccttggtccggagataggtcaccctgtggacagctctctgggaggggaagttgtcagaatatacttctctccaacgcaccactgggaccacagttccctttcacaggagtcgatgacagggagtcttggccctcagttttttataaccggacatgtcagtgcagtggaaacttcatggggttcaattgtggaaactgtaagttcggattctgggggccaaactgcacagaacgaagactcctagtccgcaggaacatcttcgatctgtctgcgcccgaaaaagataagttctttgcatatctcacattagcgaaacacactatctcctctgattacgtgatccctatcggaacttatgggcaaatgaagaacgggtctacacccatgtttaatgatataaacatatatgatctttttgtctggatgcattactatgtctccatggatgctctcctaggaggatctgaaatttggagggatatcgattttgctcacgaagctccagcattcctcccatggcaccgactgttcctcttgaggtgggaacaagaaatacagaaacttacaggagatgaaaatttcacaattccatattgggattggcgggatgccgaaaaatgcgatatttgcacagatgaatatatggggggacagcatcccacaaacccaaatctcctttctcctgcatccttcttctcctcctggcagatagtttgtagtagactagaagaatataactcccaccagagtttatgtaatggaacaccggaggggccactgcggcggaaccccgggaatcacgacaagtctaggacacctcgccttcctagttccgccgatgtggaattttgtctcagtctcacacagtatgaatcaggatcaatggataaagccgctaacttttccttccgcaatacacttgaaggatttgccagtcctctaacaggaattgctgatgcatcacagagttctatgcataatgccttgcacatctatatgaacgggactatgtcacaggtccaagggtctgctaatgatccaatcttcctgctgcaccacgcttttgtggatagtatctttgagcagtggctacggagacatcgtcctctacaggaagtttaccctgaggcgaatgctcccatcggacacaatcgggaatcttacatggtaccttttatcccactctataggaacggggatttttttatctcatccaaagatctggggtacgattattcctacctacaggattctgaccctgattctttccaggattacatcaaatcttatctcgaacaggcttctcgcatctggagttggctactcggggcagctatggtgggggccgtcctgactgccttgctggcaggacttgtgagtctcctgtgcaggcacaaacgaaaacagctacctgaagaaaaacagcccctacttatggagaaagaagattaccattcactctaccaatcacatctt

SEQ ID NO: 20616 - DNA, 1587 bp, Artificial Sequence
  Description of Artificial Sequence: Synthetic coding sequence
atgctgctggccgtgctttactgtctgctgtggtcgtttcaaacttcagcaggccattttcctagggcctgtgtgtcctcgaaaaaccttatggagaaggagtgttgtcctccatggtcaggtgaccggtcgccatgcgggcaacttagcggacgaggtagctgtcaaaacatccttctgtcgaacgctccccttggtcctcagttcccattcacgggagtggacgatcgagaatcgtggcctagcgtgttttacaacaggacctgtcagtgcagcggaaacttcatgggtttcaattgcggcaattgcaagttcggtttttggggtccaaattgcactgaacgtaggctgctcgtcagacgtaacatctttgatctgagcgctccggaaaaggacaagtttttcgcatacctgactctggcaaagcacaccatctcatcggactacgttatacctatagggacctacggacagatgaagaacggatccaccccaatgtttaacgatatcaacatctacgatctgttcgtgtggatgcattactacgtgtccatggatgccctcttgggaggctcggaaatttggcgcgacattgactttgctcacgaagcacctgccttcctgccatggcaccggctgtttctcctgcgttgggaacaagagattcaaaagctgactggtgatgaaaactttaccattccatactgggattggagagacgcagaaaaatgcgatatctgcactgacgaatacatgggtggacagcatccaaccaacccaaatcttctctcacccgcctccttcttttcctcctggcaaatcgtctgtagccgactcgaagagtacaattcccaccagtccctctgtaacggcactccggagggccctcttaggagaaaccctggaaaccacgacaagtccagaactccgagactgccttcctcagccgatgtggaattttgcctgtctcttacccagtacgagtccggttcgatggataaggccgcaaatttctcgttccgcaatacccttgaaggttttgcaagccctcttactggtatagcagacgcttcgcagtcctctatgcataacgcccttcatatctacatgaatggaaccatgtcgcaagtgcagggctccgcaaacgatcctatctttcttcttcatcatgccttcgtggactccatctttgaacagtggctgcgacgacacagaccccttcaggaagtctacccagaagcaaacgcacctatcggtcacaacagagagagctacatggtgccctttattcctctttacagaaacggggacttctttatctcctctaaagatcttggatacgattactcgtaccttcaggatagcgatccggattcgtttcaggactacattaagtcgtacctggaacaggcttcccggatatggtcatggctgctgggagccgcgatggtcggggcagtcctgactgcactgctcgcgggtctggtgtccctcctttgtcgtcataaaagaaagcaacttccagaggaaaagcaacccctgctgatggaaaaggaagattatcattcgctttaccagtcccacctg

SEQ ID NO: 20617 - DNA, 1587 bp, Artificial Sequence
  Description of Artificial Sequence: Synthetic coding sequence
atgcttctcgccgtgctgtattgcttgctctggtcctttcaaaccagcgccgggcacttccctagagcttgtgtttcaagcaaaaatcttatggaaaaagaatgttgccccccatggtccggtgatcgcagcccctgcggacagctctcaggacgaggcagttgtcagaatatcctgctgtccaatgcacctctgggtcctcagttccctttcaccggcgtcgacgacagggagtcatggccatcagtgttctacaatcgaacttgccaatgttccgggaatttcatgggcttcaactgtggcaactgtaagttcgggttctggggcccaaactgcaccgaaaggagacttctggtgcggcggaatatttttgacctgtctgcgcccgagaaggataagttctttgcctatctcacactcgctaagcatacaatctcatcagattacgtcatccccattggtacttacgggcagatgaagaatgggtctacacctatgttcaatgacatcaatatctatgatctgttcgtgtggatgcactattacgtgagtatggatgcactgctcggaggatctgagatctggagggacatcgacttcgctcatgaagctcccgctttcttgccatggcataggctgttcctgttgagatgggaacaggaaattcagaaactcactggcgacgagaatttcactatcccatattgggattggcgcgatgcagaaaagtgcgacatatgtacggatgaatacatgggggggcagcatcctaccaatcccaatctgctgtctcctgcttccttcttttcaagctggcagatcgtgtgctcaaggctggaggagtataatagtcatcaatccctttgcaatggcactccagaggggcccctgagacggaatccaggcaatcatgataagagccgcaccccaaggctcccaagtagcgcagatgtcgagttttgcctctcactgacccagtacgaaagtgggtcaatggacaaagcagccaatttttcatttaggaatactttggaaggatttgcctcaccattgaccggtatcgctgacgccagccagtccagcatgcataatgctttgcatatttatatgaacggaaccatgagccaagtgcagggctcagccaatgaccccatttttctgctgcaccatgccttcgtcgactctattttcgagcagtggcttcggcgacacaggccactgcaggaggtgtatccagaggccaatgctcctattgggcacaatagagaaagttacatggtgccttttatccccctctataggaacggcgactttttcatttcttctaaagacttgggatatgattattcttatctccaggactctgacccggactccttccaagactacataaaatcctatctggagcaagcaagtcgcatctggtcctggctgctcggggccgccatggtgggagctgtcctgacagcactgcttgcaggcctcgtgtcactgttgtgccgccacaagcggaagcagctgccagaggagaagcaaccattgctgatggagaaagaggattaccactctttgtaccaaagtcatctg

SEQ ID NO: 20618 - DNA, 1587 bp, Artificial Sequence
  Description of Artificial Sequence: Synthetic coding sequence
atgttgctggcggtcttgtactgcctcttgtggtccttccaaaccagcgcgggtcatttcccaagagcgtgcgtgagtagcaagaacctgatggagaaggaatgttgcccaccgtggagcggagacagatcgccatgcggccagctgtcgggacgcggttcctgccaaaacattctcctctccaatgccccgctgggaccacaattcccgtttactggggtcgatgaccgtgagtcctggccttccgtgttttacaaccggacctgtcaatgtagcggaaacttcatgggatttaactgtgggaactgcaagttcggattctggggccccaattgcactgaacggagactcttggtgcgacggaacattttcgacctgagcgcgcctgagaaggataagttcttcgcctacctcactctcgcgaagcatactatctcttcagactacgttatccccatcggcacctatggacaaatgaagaatgggtcaactcctatgtttaacgatatcaacatctatgaccttttcgtgtggatgcattactacgtgagcatggatgcgctgctgggaggaagcgagatctggcgcgacattgactttgcgcatgaagcaccggccttcctgccgtggcaccgcctgttcctgctccggtgggagcaggagatccagaagctgacgggggacgagaacttcaccatcccgtactgggattggagagacgccgaaaagtgcgatatctgcactgatgagtatatgggtggacaacatccgaccaacccgaacctcctgtccccggcgagctttttctcatcctggcagattgtctgttcgcgcctggaagagtacaactcccaccaatccctctgtaacggcactccagagggaccgctgaggcggaatcctggaaatcacgataaatccaggaccccaagactgccatcctcggcggatgtggaattctgcctgagcctcacgcaatatgaatcaggatcgatggataaagcggctaacttctcatttcggaacactcttgaaggcttcgccagcccgctgactggaatcgcagatgcgtcgcagtcctcaatgcacaacgctcttcatatctacatgaatgggaccatgtcgcaagttcaaggttcggcaaatgaccctatctttttgctgcaccatgccttcgtggactccatcttcgagcagtggctgcggcggcacaggcccctgcaggaggtgtacccggaggcgaacgctccgattggacataaccgcgagtcatacatggtgccgttcatcccactgtaccgcaacggagatttcttcatcagctcgaaggatctggggtacgattactcgtacttgcaggacagcgacccagattcgttccaggattacatcaagtcgtaccttgagcaggcctctcgcatctggtcctggctgctgggtgctgcaatggtgggcgcagtgttgaccgccctcctcgcaggactcgtgtcacttctgtgtcggcataagagaaagcaactgccggaagagaagcagccgctgctcatggaaaaggaggactaccacagcctgtaccaatctcacctc

SEQ ID NO: 20619 - DNA, 1587 bp, Artificial Sequence
  Description of Artificial Sequence: Synthetic coding sequence
atgctattagcggttctatattgtttattatggtcgtttcaaacgtcggcgggtcattttccgcgtgcgtgtgtatcgtcgaaaaatctaatggaaaaagaatgttgtccgccgtggtcgggtgatcgttcgccgtgtggtcaactatcgggtcgaggttcgtgtcaaaatatattattatcgaatgcgccgctaggtccgcaatttccgtttacgggtgttgatgatcgagaatcgtggccgtcggttttttataatcgtacgtgtcaatgttcgggtaattttatgggttttaattgtggtaattgtaaatttggtttttggggtccgaattgtacggaacgtcgtctattagtacgacgtaatatatttgatctatcggcgccggaaaaagataaattttttgcgtatttaacgctagcgaaacatacgatatcgtcggattatgttataccgataggtacgtatggtcaaatgaaaaatggttcgacgccgatgtttaatgatataaatatatatgatttatttgtatggatgcattattatgtatcgatggatgcgctattaggtggttcggaaatatggcgagatatagattttgcgcatgaagcgccggcgtttttaccgtggcatcgattatttttactacgatgggaacaagaaatacaaaaactaacgggtgatgaaaattttacgataccgtattgggattggcgagatgcggaaaaatgtgatatatgtacggatgaatatatgggtggtcaacatccgacgaatccgaatctattatcgccggcgtcgtttttttcgtcgtggcaaatagtatgttcgcgactagaagaatataattcgcatcaatcgctatgtaatggtacgccggaaggtccgctacgacgtaatccgggtaatcatgataaatcgcgtacgccgcgtttaccgtcgtcggcggatgtagaattttgtttatcgttaacgcaatatgaatcgggttcgatggataaagcggcgaatttttcgtttcgaaatacgctagaaggttttgcgtcgccgttaacgggtatagcggatgcgtcgcaatcgtcgatgcataatgcgttacatatatatatgaatggtacgatgtcgcaagtacaaggttcggcgaatgatccgatatttttactacatcatgcgtttgttgattcgatatttgaacaatggctacgtcgacatcgaccgttacaagaagtatatccggaagcgaatgcgccgataggtcataatcgtgaatcgtatatggtaccgtttataccgctatatcgtaatggtgatttttttatatcgtcgaaagatttaggttatgattattcgtatttacaagattcggatccggattcgtttcaagattatataaaatcgtatctagaacaagcgtcgcgtatatggtcgtggctactaggtgcggcgatggttggtgcggtactaacggcgttattagcgggtttagtttcgctattatgtcgacataaacgtaaacaactaccggaagaaaaacaaccgttattaatggaaaaagaagattatcattcgctatatcaatcgcatcta

SEQ ID NO: 20620 - DNA, 1362 bp, Artificial Sequence
  Description of Artificial Sequence: Synthetic coding sequence
atggatccctatatgatccaaatgtcatctaaagggaacctcccctctatcctagatgtacacgtgaacgtcgggggacggtcaagcgttcctggcaaaatgaaaggtcggaaggcacgctggtcagtccgaccaagcgacatggccaaaaagacgtttaacccaatcagagccatcgttgacaacatgaaggtgaaaccaaatcccaacaaaacgatgatctcactatccatcggtgacccgaccgttttcgggaacttgcccacggacccagaagtgacccaagccatgaaagatgctctagactctgggaaatataacgggtatgctccgtccattggcttcctgagctcaagagaggaaattgccagttattaccattgtccagaggctcccctggaggccaaggatgtcatcctgacatcgggatgttctcaggcaatcgatctgtgcctagccgtgctggccaacccagggcagaacatcctagttccaaggcccggcttcagtctttacaagaccctggcggaaagcatgggtattgaggttaagctgtacaacctgctgcccgagaaaagctgggaaatcgacctgaagcagctggaatatctgattgacgaaaaaacagcttgcctcattgtcaacaatccttccaatccttgcggcagtgttttcagcaaacgccatctgcaaaagatcctggccgtagccgctaggcagtgcgtgcctattctcgctgatgagatttacggagatatggtgttctcggactgcaaatacgagccactggccacactgagcacagatgtcccaattctatcctgcggcgggctggccaaaaggtggctagtccccggttggcggttggggtggatattgatacatgataggcgcgatatttttggcaatgagatcagagacggattagtcaaactatcccaaagaatcctcggcccgtgtacaattgtgcagggggccctgaagtccatcttgtgcaggactcccggcgaattctatcacaacacacttagctttctgaaatcaaacgcagatttatgttatggcgccttggcagcgattcctgggctgcgtccagtgaggccatctggtgcaatgtacctcatggttggaatagagatggagcattttccagagtttgagaatgacgtagaattcactgagagactcgtcgctgagcagagtgtacactgcttgccagccacgtgttttgaatatccaaatttcattcgcgtggttataacagtgcccgaggtgatgatgttggaagcttgttcccgtattcaggaattttgtgaacagcactaccattgtgcagaggggagccaagaggagtgcgacaag

SEQ ID NO: 20621 - DNA, 1362 bp, Artificial Sequence
  Description of Artificial Sequence: Synthetic coding sequence
atggatccatacatgattcaaatgagcagtaaaggcaatctgcccagcattcttgacgtgcatgtcaatgtggggggccgctcctccgtgccaggcaagatgaaaggccggaaggcccggtggtctgtgagaccctctgatatggcgaagaaaacgtttaaccctatacgggccatcgtggataatatgaaagtgaagccaaacccaaataagacaatgattagcttaagcattggcgatcctactgtctttggtaacctccccaccgaccccgaggttacccaggccatgaaggatgcattggactccggtaagtataacggatacgctcctagcatcggcttcctgtcgtctagggaggagatcgcctcttactatcactgtcctgaagcacccctggaagctaaggacgtcatcttaacctctggttgtagtcaagcgattgatctgtgtttagcagtgctggccaacccagggcagaatattcttgtccctagaccaggattttcactctacaagactctggctgaaagtatgggaattgaggtaaagctgtacaacctgttgcctgaaaaaagttgggagattgacttgaagcaactggagtacctcatcgacgaaaagacggcatgcttaatagtcaacaatcccagtaacccttgcggctccgtgttctccaagagacacctgcagaaaatccttgcggtggctgcgagacagtgcgttcccattctggccgacgaaatttacggcgacatggtgttcagcgattgtaagtatgagcccctggccacactgagcacggacgtgcccatattgtcttgtggcggccttgcgaaacggtggctggttccgggttggaggctagggtggatcctgatccacgataggcgagatattttcgggaacgagattagagatggtctggtaaagttgagccagcggatcctcggaccttgcacgattgtgcagggcgctctgaaatcaatcctgtgtcgaacacctggggagttttatcacaacacactgtctttcctgaaatccaacgccgacttgtgctatggtgccctggccgctatccctgggctgcggcccgtgcgaccaagtggagctatgtacctgatggtggggatcgaaatggaacacttcccggagttcgagaatgatgtcgagtttacagagagactggtggcagaacagagcgttcactgcctgccagccacctgtttcgagtaccctaactttattagggtggtgataactgtaccggaggtaatgatgcttgaagcctgttccagaatccaggaattctgcgaacaacactatcactgcgccgagggttcccaggaagaatgcgataaa

SEQ ID NO: 20622 - DNA, 1362 bp, Artificial Sequence
  Description of Artificial Sequence: Synthetic coding sequence
atggacccttacatgatccaaatgtcctctaaaggaaaccttcctagtatcctggacgtccatgtaaacgtgggtggacgatcctcagtgccgggcaagatgaagggtcggaaagcgcgttggagcgtgcgcccttcggatatggcaaagaaaacttttaatcctattcgagctatcgtggacaatatgaaggtgaaacctaatcctaataaaactatgatttctcttagcatcggggatccgactgtcttcggaaatttaccaacagatccggaggtgactcaagccatgaaggatgccttagacagcgggaaatacaacggctacgccccctccatcgggtttttatcgtcacgcgaggaaattgcctcatactatcactgtccagaagctccgttagaagccaaagatgtaatccttacatccgggtgttcccaggctatcgacctgtgcctggccgtccttgccaacccaggccagaatatattggtgccgcgtcccgggttttccctgtataagaccctagctgagagcatgggcatcgaggtgaaactctacaacttgctccctgaaaaatcttgggaaatcgatctgaagcagcttgaatacctgattgacgagaagactgcatgccttatcgtgaataacccgtcaaatccctgcggaagtgtcttctccaaaagacatctacaaaaaattctggccgtggccgctcgacagtgcgtcccaattctcgctgatgagatatacggcgatatggttttcagcgattgcaaatacgagccattggctaccctgtccacagacgtcccaatcctttcatgtggcggactcgccaaacgctggctggttcccggctggcggcttggttggattctgatacacgaccgccgggacatatttggaaatgaaatcagagatggccttgtgaagttgtcccagaggatattgggtccatgtactattgtccaaggtgctttgaagagcattttgtgccggacgcccggagagttttatcacaatactctgtcattccttaaaagtaatgccgatctatgttacggagccctggccgccatccctgggctgagacctgtcaggcctagcggggccatgtatctgatggttggcatagagatggaacatttcccagagttcgaaaatgacgtcgagttcactgagcgactggtagccgaacaatccgtccactgtctgcccgcaacctgctttgagtatcccaattttatcagggttgtgatcaccgtccctgaagtgatgatgctcgaagcctgcagccggatacaggaattctgtgaacagcactaccattgcgccgaaggttcccaagaagaatgtgacaag

SEQ ID NO: 20623 - DNA, 1362 bp, Artificial Sequence
  Description of Artificial Sequence: Synthetic coding sequence
atggacccgtacatgatccagatgagctccaagggcaatctgccatcgatcctcgacgtgcatgtcaacgtgggaggacggtccagcgtcccaggcaagatgaagggccggaaggcacgctggagcgtgaggccttcggatatggcaaaaaagacgttcaatcctatccgcgccatcgtggacaacatgaaggtgaaacctaacccgaacaaaaccatgatttccctgtccattggcgaccccaccgtctttggaaacctgccaactgatccagaagtgacccaggctatgaaggacgccctggattcgggaaagtataacggatacgccccgagcatcggattcctgtcatcgcgggaagagatcgcatcgtactaccactgcccagaagcgccgttggaagcaaaggacgtaatactcacctcaggatgctcccaggccatcgacctgtgcctggcggtgctcgcaaaccccggacaaaacatccttgtgccgcgccctggtttctccctgtacaaaaccctcgccgaaagcatgggaatcgaggtgaagctctacaatctgctgccagaaaagtcatgggaaatcgacctcaagcagctggaatacctgatcgacgaaaagacggcgtgccttatcgtgaataatccaagcaacccatgcggctccgtgttttcaaaacgccatctgcagaagatcttggccgtggcagccagacaatgcgtccctatcctcgcagatgagatctacggcgacatggtcttttcggactgcaagtacgagccactggcaactctgtccaccgacgtgccaatcttgtcgtgtggcggcctcgctaaacggtggctggtgccgggatggcgactcgggtggatccttatccacgatcgcagagacatcttcggcaacgagatccgggatggactcgtgaagctgtcgcagcggatcctgggaccttgtactatcgtgcagggagccctcaagtcaatcctttgcaggactccaggagaattctatcataacaccctcagcttcctcaagagcaacgccgacctgtgttacggagccctcgctgccatccctggattgcggccagtccgcccatcaggggcgatgtacctgatggtaggcattgaaatggaacactttccagagtttgagaatgacgtggaattcacggaacggctggttgccgagcaatcagtccattgcctgccggctacctgtttcgagtacccgaacttcatccgcgtggtcatcaccgtgccagaagtgatgatgctggaggcttgctcgagaatccaggagttctgtgagcaacactaccactgcgctgaaggatctcaggaggagtgtgacaag

SEQ ID NO: 20624 - DNA, 1362 bp, Artificial Sequence
  Description of Artificial Sequence: Synthetic coding sequence
atggatccatatatgatccaaatgtcatcgaagggaaatctgccatcaatcctggacgtccatgttaacgtgggcggccggtcgagcgtgccaggaaagatgaaaggacgcaaggctcgctggagcgtgcgcccttcggacatggccaaaaagacctttaacccgatccgcgccatcgtggacaatatgaaggtgaagccgaatccgaacaagactatgatctccttgagcatcggtgacccgaccgttttcgggaacctcccgacggacccggaagtaacccaagccatgaaggacgcgctggattctggaaaatacaatggatacgccccgtcgatcggattcctgtcgtcgcgggaagaaatcgcgagctactaccactgccccgaagctccgctcgaggccaaggacgtgatcctcaccagcggctgttcccaggcaatcgacctctgcctggcagtgttggccaatcccggacagaacatcctggtcccacgccccggtttcagcctgtacaagactttggccgagtcaatgggaatcgaggtgaaactgtacaaccttttgccagagaaatcctgggaaatcgatctgaagcagcttgaatacctcattgacgaaaagactgcttgtctgatcgtcaataatccgtcaaacccgtgcggcagcgtgttctccaaacgccatttgcagaagatcctggcggtggcagcaagacagtgtgtgccaattctggcagacgagatttatggcgacatggtgttctcggattgcaaatacgagccgctggccaccctgtccaccgacgtgccgatcctctcctgcggtggcctggccaaacgctggctggtcccaggctggagactcgggtggattctcatccacgaccggcgcgacatcttcggaaacgaaatccgggacggcttggtgaaactttcccaacggatcctcggaccgtgtaccatcgtgcaaggggcgttgaaaagcatcctgtgtcggactcctggtgaattctaccataacactctgtcattcctcaaatcaaacgcagacctgtgctacggagccctcgcagccatcccgggacttagacctgtgcggccttccggagccatgtacctgatggtgggaatcgagatggagcacttcccagagttcgaaaacgatgttgaattcaccgagcgactggttgcggagcagtccgtccattgtctcccggctacctgcttcgagtatccgaacttcatcagggtggtaatcaccgtgcccgaagtgatgatgcttgaggcatgctcgcggatccaggagttctgcgaacagcactaccactgcgctgaaggcagccaggaggaatgcgacaaa

SEQ ID NO: 20625 - DNA, 1362 bp, Artificial Sequence
  Description of Artificial Sequence: Synthetic coding sequence
atggacccctatatgatacagatgagttcaaaggggaatctcccatcaatcctggacgtgcacgtgaatgtcggcgggagatctagcgtgccgggcaaaatgaaaggaagaaaagcccgctggtccgtgcgacctagcgatatggctaaaaagacgttcaatccaataagggctattgtcgataatatgaaggttaaacccaatcccaataagactatgatatcgttgtctatcggtgatccgaccgtctttggcaacttaccaactgatccagaggtgacccaggctatgaaagatgcacttgacagtgggaagtacaatggatatgcacccagtatcggctttctttcatccagagaagagatcgccagctactaccactgccccgaagcgcctctggaggcaaaggacgtcattctgacgtcgggatgttctcaggctatcgatctttgcctggcggtgctggccaaccctggtcagaatattctagttccccgtccagggttctccctgtataagaccctcgcagaatccatgggcattgaagttaagttatacaatcttctacccgaaaagtcttgggaaattgacctgaagcaattggaatacctcatcgatgaaaagacagcctgcctaatcgtgaacaaccccagcaacccctgtggctccgtcttttccaagcgccacctccagaagattctcgccgtcgcggcgcgtcagtgtgtgccaatattagctgacgagatttacggcgacatggtttttagcgactgtaagtacgagccactcgccacactcagcacggacgtgccaatcctgagttgtgggggacttgcaaaacggtggttggttcccgggtggcgtttaggatggatcttgattcacgatcgtcgcgacatcttcgggaatgagatcagggacgggctggtgaaactttcccagcgcattctcgggccctgcaccattgtccagggcgctctgaagagcattctgtgtcggaccccaggtgagttctatcataatacccttagctttctcaagagcaacgccgatctgtgctacggagctttggccgctatacccggtcttagaccagttagaccatccggggccatgtatcttatggtcggaattgaaatggagcatttcccggaatttgagaatgatgtggagtttaccgaaaggctggtggccgaacagtctgtgcactgcttgcccgcaacatgcttcgagtacccaaattttatccgtgtggtcatcacggtccctgaggtcatgatgctggaggcatgctcacggatccaagagttctgcgagcaacactaccactgtgccgagggaagccaggaggaatgtgacaag

SEQ ID NO: 20626 - DNA, 1362 bp, Artificial Sequence
  Description of Artificial Sequence: Synthetic coding sequence
atggacccatacatgatacagatgtcgtcaaaggggaacctgccctccattctggacgttcacgtgaacgtcgggggaagatcctcggtccccggtaaaatgaaagggaggaaagcccgatggtcagtccggccgagtgatatggcgaaaaaaaccttcaatccaatccgtgcaatcgttgataatatgaaagtcaagcctaaccccaacaagaccatgatttcactgtctatcggggaccctacagtgttcggaaatcttcccacagaccccgaggtgacccaggccatgaaggacgcccttgacagtgggaaatacaacgggtatgcgccttctattggctttctatctagccgggaagagatagcttcctattaccactgccccgaggcccccctggaagcaaaggacgtgatactgacaagcggttgctcacaggccattgacctgtgtctggctgtgctggcaaaccctgggcagaatatcctggtaccgcggcctggattctccttgtataaaactcttgcagaatccatggggatcgaggtaaagttatacaacctgctccccgagaagtcctgggagattgacctcaaacaactggaatacctcatcgatgagaagacagcctgccttatcgtgaataacccctctaacccttgcggaagcgtattctcaaagcggcacttacagaaaatcctcgcagtagctgctagacagtgtgtacccattctggccgacgaaatctacggagacatggtattctcagactgcaaatacgaacccttagccaccttgtccaccgatgttcctatattaagctgtggggggttggccaagcgctggctagtgcctggttggcggctcggctggatacttatccacgacagacgcgacatctttggaaatgaaattcgagacggcctagttaagctcagccagcgaattctcggaccctgcaccatcgtgcagggagccttaaaaagtatcctctgtcgaacccctggggagttttaccacaataccttgtctttccttaaaagtaatgctgatttatgctacggggcactcgccgcaattcccgggctccgccctgtcaggccatccggagctatgtatctcatggtaggcatcgagatggaacacttcccagagttcgagaacgatgttgagtttacagaacgtctagttgccgagcagagcgtgcactgcctccccgctacctgcttcgaatatcctaacttcatacgagtggtgataaccgtacccgaggtaatgatgttggaagcttgctcccggattcaggagttctgcgaacagcattatcattgcgccgagggttcccaagaggaatgtgataag

SEQ ID NO: 20627 - DNA, 1362 bp, Artificial Sequence
  Description of Artificial Sequence: Synthetic coding sequence
atggatccctacatgattcagatgtcctctaagggaaatctgccttcaatactcgatgtgcatgtcaacgtgggggggagatcatcagtgcctgggaaaatgaaaggacgcaaggcacgctggtcagttagaccctctgatatggccaagaaaacttttaaccctataagagcaatcgtcgataacatgaaagttaaaccaaacccaaacaaaacgatgatctctctgagtattggggatcccactgtgttcgggaacctacctacagatccagaagtaacgcaggcaatgaaggatgcactggattctgggaagtacaatggatatgcccctagtattgggtttctctcctcaagagaagaaatcgcgagttattatcactgtcccgaggcaccactggaagcaaaagatgtcattcttacatctgggtgttctcaggctatcgatctctgccttgccgtactagccaaccctggacagaacatcctcgtgccaaggcccggattcagtctttacaaaactttagcagaatctatggggatcgaagttaaattatataacctcctccctgagaagagttgggaaattgatctcaaacaactagaatatttaatagatgaaaagacagcttgtctgattgtaaataacccttctaatccctgcggatcagtgttctccaaaaggcatctacagaaaatactagcagtcgctgcacggcagtgcgtgcccattctggcagatgagatatacggagatatggtcttttctgattgtaagtacgaacccctcgccactctgtctactgatgtgcccatactctcttgtgggggactggctaaacgatggcttgtgcctggatggagacttgggtggatcctcatccatgatcggcgagacatatttgggaacgaaatcagagatggacttgtgaaattatcccagagaatacttggaccgtgtactatagtgcagggggctctaaagtccatcctctgtaggacgccaggggagttttaccacaatacactcagttttttaaaaagtaatgcagatctgtgttatggggcacttgccgctatacctgggctccggccagtgagaccctcaggggctatgtatctaatggtgggaatagaaatggaacacttcccggaattcgaaaacgatgtcgaatttacagaacggcttgtggccgagcagtcagtacattgcctcccagcaacatgctttgaatatcctaattttatacgggtggttataactgttcccgaggtcatgatgttggaagcctgctctaggattcaggaattttgcgaacagcactaccactgtgctgaaggatcccaggaagaatgcgacaaa

SEQ ID NO: 20628 - DNA, 1362 bp, Artificial Sequence
  Description of Artificial Sequence: Synthetic coding sequence
atggacccttatatgattcagatgtcgtccaaaggtaatcttccctccatactcgatgtccacgtcaacgttggcggccgctcttcggtgccaggtaagatgaaaggaagaaaggcacggtggtccgtgcggccttcagatatggcaaagaaaactttcaacccaattagagcgattgtggacaacatgaaggtgaagcctaaccctaataagactatgatttcgctctccattggggatccgaccgtgtttggtaaccttccaacggatccagaagtcacccaggctatgaaggatgccttggactcggggaaatacaatggttacgcgccgagcatcggcttcctcagctcgcgggaagagattgccagctactaccattgcccagaggcccctcttgaggccaaggatgtgattcttacttccggctgctcccaagctatcgacctgtgcctggcagtcctcgcaaaccctggtcagaatatccttgtcccgcgtccaggcttttccctgtataagaccctcgcagaaagcatggggattgaagtgaaactttacaatctcctccccgagaagtcttgggaaattgatttgaaacaactggagtacctgatagacgaaaagaccgcttgtttgatcgtcaacaacccatccaatccttgtggtagcgtgtttagcaaacggcacctccagaagatcctggcagtggcggcacgacaatgtgtgccgattttggcggacgagatctacggagacatggtgtttagcgattgcaagtacgaaccactggccaccctgtcgactgatgtccctatactgtcgtgtgggggccttgcgaagagatggctcgttccaggatggaggctcggatggatccttattcatgatcgtcgcgacatatttgggaacgagatccgggatggccttgtgaaactttcgcagaggatcttgggcccttgtactatcgtgcagggtgccctcaagtctattctgtgcagaacgcccggagaattctatcataacaccttgtcattcctgaagtctaacgccgatctttgctacggtgcactggcagccatcccaggactgaggccagtgcgacctagcggagcaatgtacctgatggtgggtattgaaatggaacattttccggagtttgagaacgatgttgaattcactgaaagactggtcgcggagcagtcagtgcattgtttgcccgccacttgtttcgaataccccaatttcatccgtgtggtgattaccgtccccgaagtcatgatgcttgaggcttgttcaagaatacaggaattctgcgaacaacattaccattgtgcagaggggtcgcaagaagaatgtgacaag

SEQ ID NO: 20629 - DNA, 1362 bp, Artificial Sequence
  Description of Artificial Sequence: Synthetic coding sequence
atggatccctacatgatccagatgagttcgaaggggaacctgccatctatcctagacgtccatgtcaacgtgggtgggagatccagtgtgccgggcaaaatgaaagggcgcaaggcgcgctggagcgtccgcccgtccgatatggctaagaaaaccttcaacccgattagagcgatcgtggataacatgaaggtgaagcccaatccgaacaaaaccatgatcagtctaagcattggcgaccccactgtcttcggcaacctgcccactgatcccgaggtcacccaggctatgaaagacgccttggattccggcaaatacaatggatacgccccttctattggcttccttagctcacgcgaggaaattgcttcttactatcattgccccgaggcgcccttggaggcgaaggatgtcattctgacctccggctgttcgcaggcgatcgacctttgtctggccgttctcgccaatcccggccagaacatcctcgttcccagacccgggttctcattgtacaagactctcgcggaatctatgggtatcgaggtcaagctgtacaacctgctcccggaaaagtcttgggagatcgatctgaagcagctggagtacctaattgacgaaaagactgcctgtttgatcgtcaataatccctctaacccctgcggctccgtctttagtaagcgacacctgcaaaagattctggcagtcgcggctcggcagtgcgtgcccatactggcggatgagatatacggtgacatggttttctccgattgcaaatacgaacccctggccacactgtccaccgatgtgcccattctgtcgtgcggaggcttggctaagcgctggcttgtccctggctggcgcctaggatggatcctgatccacgatagacgcgacatcttcggaaacgagatccgtgacggtctggttaagttgtcgcaaagaatcctcggaccctgtacaattgttcagggtgctctgaagtcgattctctgccgcacgccgggtgagttctatcataacaccttgagcttcttgaagtcgaacgccgatctgtgttatggcgctctcgctgccattcccggtctccgccctgtacgtcctagcggcgctatgtaccttatggttggtatcgaaatggaacacttccccgagttcgagaacgacgtcgagtttactgagcggttggttgctgagcagagtgtgcattgcctacctgccacgtgtttcgagtaccccaactttattcgcgtcgtgattacggtacccgaggtcatgatgctagaagcatgcagccgcatccaggagttctgcgagcagcactatcactgcgccgagggctcgcaggaggagtgcgacaag

SEQ ID NO: 20630 - DNA, 1362 bp, Artificial Sequence
  Description of Artificial Sequence: Synthetic coding sequence
atggacccctatatgatccaaatgagcagcaagggtaaccttccttctatccttgatgtgcatgttaacgtgggtggcagatcctctgtgccagggaaaatgaagggaagaaaagctaggtggtcagtaaggccatctgacatggctaagaaaacctttaatccaatccgcgcaatcgtggacaacatgaaggtgaagcccaacccaaacaagacaatgatctcgctctcaatcggcgatcctaccgtctttggtaacctgcctaccgacccagaagttacccaagccatgaaggatgctctcgattccggaaaatacaatggctatgctcccagcatcgggtttcttagctcacgggaagaaatagcctcttactaccactgccctgaggcgcctcttgaagccaaagatgtgattttaacatctgggtgtagtcaggccatcgacctctgcctcgcagtgcttgccaacccgggacaaaacatcctggtgcctcgcccaggctttagcctatacaaaacactcgctgagagtatgggaatcgaggtgaaactgtacaatctgctgcctgaaaagtcttgggagattgacctaaagcaactcgagtatctgatcgacgagaaaacagcttgcctgatcgtgaacaacccgtcaaacccgtgtggatccgtgtttagcaagagacatctgcagaagatactggcagtagccgcgcgccagtgcgttccaatcctggccgacgagatctacggagatatggtgttctccgattgcaagtatgagcctctggcaactctatcaactgatgtccccatccttagttgcgggggactggcaaaacgatggcttgttccaggatggagactgggatggatcctgatccatgacagaagagatatcttcggcaatgaaataagggacggcctggtcaagctttcccagcggatccttggtccttgcaccatcgttcaaggggctctcaagtccatcctgtgccgcaccccaggagaattctaccataacacactgtccttcctgaaatcaaatgctgacttgtgctacggagctctggccgccatccctggcctgcgccctgtaagaccctctggagctatgtatttaatggttggcatcgaaatggaacacttccctgaatttgagaatgacgtggagttcactgaaagactggttgcagagcagtctgtccactgcctccccgctacttgttttgaatacccgaactttatccgcgtggtcatcactgtgcctgaagttatgatgctggaagcatgtagccgcatccaggaattttgtgagcagcactaccactgcgcagaggggagccaggaagagtgtgacaag

SEQ ID NO: 20631 - DNA, 1362 bp, Artificial Sequence
  Description of Artificial Sequence: Synthetic coding sequence
atggacccctacatgatccagatgtcatccaaagggaatcttccctccattctggatgttcacgtgaatgtggggggacggagttccgtccctggcaagatgaagggaagaaaggcacgctggtcagtgcgcccctccgacatggccaagaaaactttcaatcccatcagggctatcgtagacaatatgaaagtaaaaccaaatccaaataaaaccatgatttctctatccatcggagatccaacggtgtttgggaacctgcccacagatccggaggtgacccaggccatgaaggacgctctggatagcggtaaatataatggctatgctcccagcatcggcttcctgtccagccgggaggaaattgcctcttactaccactgtccggaggccccactagaggctaaagacgtgatcctcaccagcggttgcagccaggcaatcgatctgtgtctggccgtcctcgccaaccctggtcagaatatcctagtgccccgacctggattctccctttacaagacattggccgaatcaatggggatcgaggtgaagctatacaacttgttacctgagaagagctgggagattgatctgaagcaactggagtatcttattgacgagaagacagcgtgtctgatcgtcaacaatccctcaaatccctgcggatctgttttttcaaagcgccatctgcaaaagatcctggctgtggccgcaaggcagtgcgtgcctatcctagccgacgagatctacggtgacatggtcttttcagattgcaaatatgagccactggctacgctgtccactgatgtgcccattcttagctgtgggggcctggctaagcggtggcttgtccccggttggaggctggggtggatactaatccacgatcggcgggacattttcggtaacgaaatccgggacgggctggttaagttaagccaacggatattgggcccttgcacgatcgtgcagggagccctcaaatctatactgtgtcgaactccaggggagttctaccacaacaccctgagttttctcaaaagcaacgcggatctatgttacggtgcactggcagcaattcccgggctcaggcccgttaggccctctggggcgatgtatctgatggtgggtatcgagatggaacactttcctgaattcgagaatgacgttgaatttaccgagcggctcgtggctgaacagtccgtacattgtctccccgctacttgtttcgagtacccaaactttataagggtggtgatcactgtccccgaggtgatgatgctggaagcgtgctcccggatacaggagttctgcgagcaacactaccattgcgcggaagggtctcaagaggaatgtgacaag

SEQ ID NO: 20632 - DNA, 1362 bp, Artificial Sequence
  Description of Artificial Sequence: Synthetic coding sequence
atggacccatacatgatacagatgagctctaaaggcaatctgccctcaatccttgacgtgcatgttaatgtcgggggcaggagttctgttccagggaagatgaaaggtcggaaagcccgctggagtgttcggcctagtgacatggcgaaaaagacctttaatcctattagggctattgtcgataacatgaaagtgaaacccaaccctaacaagactatgatctccctgtctatcggagaccctaccgtattcggcaacctccccaccgatcccgaggtgacacaggccatgaaggatgccttagattcgggaaagtacaatggttatgccccctctattggattcctgtcgtcaagggaggagatagcctcctattaccattgtcccgaggccccattggaggccaaggacgtgatcttaactagtggttgctctcaggctatcgatctctgcctcgcagtgcttgctaatcctgggcaaaatatcctggtgcctagaccaggcttcagcctctacaagacccttgccgaaagtatgggaattgaagttaagctgtacaatcttctgccagaaaagtcctgggagatagacctgaaacagcttgagtacctgatcgacgaaaagactgcctgtttaattgtcaacaacccctccaacccctgcggctcagtgttttccaagcgccatcttcagaaaatcttggcggtcgctgcccgccagtgtgtcccaattctagctgacgaaatttatggagacatggttttctccgactgcaaatacgagccactggcgaccctttcaaccgatgtgcctatcctgagctgcggcgggctcgctaagcgctggctggtcccaggatggcgactgggatggatactgattcacgatcgacgtgacatttttggtaatgaaataagggacggcctggtcaagctctctcagcggatcctggggccctgtacgattgtgcagggagccctcaagtctatcctgtgtcggactcctggggagttttatcacaatacactgtccttcttaaagagcaatgcagacctatgttacggcgcactcgcggctatacccggtctccgccctgtgaggccgtccggcgcgatgtatctgatggtcggaatagaaatggagcactttccagagtttgaaaacgatgtggaatttacggagaggctcgtcgctgagcaaagcgttcactgcctcccggcaacctgctttgagtacccaaactttattcgtgtggtgatcaccgtgcccgaggtgatgatgctggaggcctgttcgcgaatccaagagttttgcgagcagcattaccattgcgcagagggatcccaagaggagtgcgataaa

SEQ ID NO: 20633 - DNA, 1362 bp, Artificial Sequence
  Description of Artificial Sequence: Synthetic coding sequence
atggacccatacatgatccagatgtcctcgaagggtaacctgccgagcatccttgatgtgcatgtcaacgtggggggacggagctctgtgcccggaaaaatgaagggccgtaaggcgagatggtctgtgcgaccatcggacatggcgaagaaaactttcaacccgatcagggccattgtggacaatatgaaggtcaagcctaacccgaacaaaaccatgatctcactgtcgattggcgatcctactgtgttcggaaacttgcctactgacccagaagtgacccaagcaatgaaggatgcacttgattcaggcaaatacaatggctacgccccctccattggcttcctgtcaagccgggaagaaatcgcatcctactaccactgcccggaggcgcctctcgaagcaaaggatgttattctgactagtggatgcagccaagcgatcgatctctgcttggccgtccttgccaacccgggacagaatatcctcgtgccacggccaggattctcactctataagaccctcgcggagtcgatgggaatcgaagtcaagttgtataacctgctgccggagaagtcatgggaaatcgatctcaagcagctcgagtacctcatagacgagaaaactgcttgtttgatcgtgaacaacccaagcaacccatgcggatcagtgttctccaaacggcatctgcaaaagatcttggcagtggctgctcggcagtgcgtgccgatcctggcagatgagatttatggggatatggtgttctcggactgcaagtacgaaccactggcgaccctctcaacggatgtgcccatccttagctgcgggggcctcgcaaagagatggcttgtgccgggatggcgcttgggctggattctgatccatgaccgccgcgacatcttcggcaatgaaatcagggacggcctggtgaagctctcccaacgcatcctcggaccctgcaccatcgtccaaggagctttgaagtcgattctttgccgcactccgggggagttttaccataataccctgtccttcttgaagtcaaatgcagacctctgctacggagctttggccgcgatccccggactcaggcctgtgcgcccgtcgggggccatgtacctgatggtgggaatcgaaatggaacattttccggaattcgagaatgacgtggaattcactgaacgcctggtggcggaacaatcggtgcactgtctccccgctacctgcttcgaatacccaaactttatcagggttgttattaccgtgccggaagtcatgatgctggaagcgtgctcccgcattcaagaattttgcgagcagcactaccattgcgcggagggatcgcaggaagagtgcgataag

SEQ ID NO: 20634 - DNA, 1362 bp, Artificial Sequence
  Description of Artificial Sequence: Synthetic coding sequence
atggatccgtacatgattcaaatgtcatcaaaaggaaaccttccttcgattcttgacgtgcatgtcaacgtcggcggccgctcctcggtcccgggtaagatgaaaggtagaaaggcccgctggtccgtgcggccgtcagacatggcgaagaagacctttaatcctattcgcgccatcgtggacaacatgaaggtgaaaccaaacccaaataagactatgatctccctgagtatcggcgaccctaccgtgttcggtaacctgcccacggacccagaagtgacgcaagctatgaaggacgccctcgattcaggcaagtacaacggatacgcgccgtcgatcggattcctgagcagccgcgaagaaatcgcctcctattaccattgtccggaggccccactggaagctaaggacgtgattctcactagcggatgctcacaagcgatcgatctgtgcctcgccgtcctcgcgaatccaggacaaaacatcctggtgccgcggccaggcttctcactctacaaaactctggcagagagcatgggaatcgaggtgaagttgtacaacctgctcccagaaaaatcttgggaaatcgacctgaagcaactggagtacctgatcgacgagaagactgcatgtctcatcgtgaataaccctagcaacccgtgcggatctgtcttctccaaacgccacctccagaagatcctggctgtagcagcgaggcaatgtgtgccgatcttggccgatgagatatacggggacatggtcttctccgactgcaagtacgaaccactcgctactctgtcaactgacgtcccgatcctgtcgtgtggagggctcgctaaaagatggctggtccctggatggcggctgggctggatcctgatccacgaccgccgggacatctttggcaacgaaatcagggatggactcgtgaagttgtctcagaggatcctgggcccttgtaccatcgtgcagggggcactgaagagcatcctgtgcaggactcctggagagttctaccacaacactctgagctttctcaagtccaacgccgacttgtgttacggagcactcgcggccatccctggactccggccggtgcggccctcgggggccatgtacctgatggtgggcatcgagatggaacacttcccagaattcgaaaacgacgtggagttcactgaaaggctggtggctgaacaatcagtgcactgtctgccggccacttgcttcgaataccctaatttcattcgggttgttatcactgtgccggaagtgatgatgttggaagcctgctcgcgcattcaggagttttgcgaacagcattatcattgcgccgaggggtcccaggaggaatgtgacaaa

SEQ ID NO: 20635 - DNA, 1362 bp, Artificial Sequence
  Description of Artificial Sequence: Synthetic coding sequence
atggatccttacatgatacagatgtcctcgaagggtaacctgccttcaattcttgacgtgcatgtgaacgtgggcggtaggagctcggtgccaggaaagatgaaaggaagaaaggcaaggtggtcggtgcgaccatctgacatggcgaagaaaacttttaacccaattcgcgcaatcgtggataacatgaaggtcaaacctaaccctaataagacgatgatatctctgagcattggagatccaaccgtctttggcaaccttcctactgaccctgaggtgacccaagcaatgaaggacgcactggattcgggtaagtacaacggttacgcaccatcgataggttttctttcctcacgggaagaaattgcatcatactaccattgtccggaagcaccacttgaagcaaaggacgtcatccttactagcggttgtagccaagctattgatctgtgtctggcagtgcttgcaaatcctggtcagaacattctggtgccaaggccgggtttctcgctctacaagacccttgcagaatccatgggaattgaggtgaagttgtacaatcttcttccggagaagtcctgggaaattgacttgaagcaacttgaataccttattgatgaaaagactgcctgtctcatcgtgaacaacccttccaatccatgtggttccgtcttttcgaagcggcacctgcaaaagatcctggccgtggcagcacgccaatgtgtaccaatcttggcagatgagatatatggggatatggtgttctccgattgtaagtacgagccacttgccaccctgagcaccgacgtccccatcctgagctgcggaggccttgccaagcgatggctggtgcctggatggcgactgggatggattctcattcatgatcgcagggatatctttgggaatgaaattcgagatggcctcgtgaagctctcacagaggattcttggaccttgcactatcgtgcagggggcattgaaatcgatcctgtgtcgaacccctggggagttctaccacaacacgctgagctttctgaaatcgaacgcagatctgtgttacggagcccttgctgctattccaggacttagacctgtccggcccagcggtgccatgtacttgatggtcggtattgaaatggaacatttcccagagtttgaaaacgatgtcgaattcaccgagagacttgtggcagaacaatcagttcactgtctgcctgcaacctgtttcgaatatcctaactttatcagagtcgtgatcactgttcctgaggtgatgatgttggaggcatgttcgaggatccaggaattttgcgagcagcactaccactgcgccgaaggttcgcaagaagaatgcgataag

SEQ ID NO: 20636 - DNA, 1362 bp, Artificial Sequence
  Description of Artificial Sequence: Synthetic coding sequence
atggatccgtacatgatacagatgtcttcaaaaggcaatttgccttcaatcttggatgttcatgtgaatgtgggagggcgtagctctgtgcctggcaaaatgaaaggcagaaaggccagatggtcagtaagacctagcgacatggctaagaaaacatttaacccgataagggcaatcgtcgacaacatgaaagtgaagccaaatcccaacaagacgatgatctccttatcaatcggcgaccctaccgtctttgggaacctcccgacagaccctgaggtgactcaggcgatgaaagatgcactcgattcaggcaaatataacggctatgccccctccatcgggttcctttccagcagagaagaaatcgcatcatactaccattgtccagaagctcccctggaggctaaagacgtgattcttacctccgggtgctcacaggccattgatctgtgcttagctgttttggccaaccccggccagaacatcctggtgccacggccgggattctctctgtataagacactggcagaaagtatgggcattgaggttaaactgtataatctgctccctgaaaagtcatgggagatagatctgaaacagctggagtatttgattgatgagaagacagcttgcttgattgtaaacaatccgagcaacccttgcggtagtgtgttcagcaaaaggcatttacaaaaaattcttgccgtagcagcccggcagtgcgtccccattcttgcagatgagatatatggtgatatggtcttcagtgactgcaaatacgagcccctggcgactttaagtactgatgtgccgatcctgtcctgtggtggtttagccaagcgatggctggttcccggctggaggctggggtggatactgattcatgaccgtagagacatctttggaaacgagatccgggacggtctggtcaagctctcccagaggatcctaggtccttgcaccattgtgcagggtgcgttgaaatctatcttgtgccggacccctggagagttctaccacaatactctgtcattcctcaagtctaacgcagacctttgctacggcgccttggctgccattcctggacttagacctgtacgcccctcaggagcgatgtatttgatggtggggatagagatggaacatttccctgaattcgaaaacgacgtggaattcaccgagcggctcgtggccgagcagtccgtccactgcctgccagccacctgtttcgagtatccaaactttatccgcgtggtgatcacagtccccgaggttatgatgctcgaggcctgttctcgaatccaagaattctgcgagcaacactatcactgtgccgaaggcagtcaggaggaatgtgataag

SEQ ID NO: 20637 - DNA, 1362 bp, Artificial Sequence
  Description of Artificial Sequence: Synthetic coding sequence
atggatccctatatgatccagatgtcgtcgaagggcaacttgccgtcaatcctggatgtgcatgtcaacgtgggcggccgctcatcggtgccaggtaaaatgaagggacgcaaggcccgctggagcgtgaggccatccgatatggcgaaaaagactttcaacccgatcagagctatcgtcgacaatatgaaggtgaaaccgaacccgaacaaaactatgatctcactgtccatcggagatcccaccgtgttcgggaacctgcccactgacccggaggtcacccaggccatgaaagatgctttggatagcgggaagtacaacggctacgcgccatccatcggcttcctcagcagccgggaagaaatcgcctcgtactaccactgccctgaagcaccgctggaagcgaaagacgtgattctgacctcgggttgttcccaggccatcgatctctgcctggccgttctggcaaatccggggcagaacatcctcgtgccgcgaccaggatttagcctctacaaaaccctggcggaatcgatgggcatcgaagtgaagctgtacaacctgttgccagaaaagtcgtgggagatcgacctgaagcagctggagtacctgattgacgaaaagacggcctgcctcatcgtgaacaacccgtcgaacccatgtggaagcgtgttcagcaagcggcatctgcagaagattttggccgtggcggcccggcagtgcgtgccgattctggctgacgaaatctacggagatatggtcttttcggattgcaagtacgagcccctggccactttgtccactgacgtgcctatcctctcatgtggcgggctcgcgaaaagatggctggttccgggatggaggttgggctggattctcatccacgatcggcgggacatctttggtaatgaaatcagagacggactcgtgaagctctcgcagagaatcctgggaccatgtactatcgtccagggcgccctcaaatccatcctctgcagaaccccaggcgagttctaccacaacactctgtccttcctgaagtcaaacgcagacctctgttacggggcactggcagcgatcccgggcctgcggccagtccgcccgtcgggggccatgtacctgatggtgggcattgagatggagcattttcctgaattcgagaatgatgttgaattcaccgaacggctcgtggccgagcaaagcgtgcactgcctcccagctacctgcttcgaataccccaatttcatccgcgtggtgatcactgtgccggaagtgatgatgctggaagcctgtagcaggatccaggagttttgcgaacagcactaccactgcgccgagggcagccaggaggagtgtgacaaa

SEQ ID NO: 20638 - DNA, 1362 bp, Artificial Sequence
  Description of Artificial Sequence: Synthetic coding sequence
atggatccatacatgatccagatgtcctcgaaaggaaatctgcccagcatcctcgacgtgcacgtgaacgtgggaggtagaagctccgtgccgggcaagatgaaaggccgcaaggcgcgctggtctgtcaggccatcagatatggctaagaaaaccttcaaccccatcagagcgattgtggacaacatgaaggtcaagccgaaccccaacaaaactatgatctctctgtctatcggggatccaactgtctttggcaacttgccgaccgatccagaggtgacccaggccatgaaggacgcgttggactcgggcaagtacaacgggtacgccccgtcaataggcttcctgtcctcacgcgaagaaatcgcatcgtactaccactgtccggaggccccgctcgaagcaaaggatgtgatactgacctcaggatgtagccaagccatcgatctgtgcctcgctgtgctggcaaatccgggccagaatatcctggtgccaagaccaggcttctccctttacaagactctggccgaatcgatggggatcgaggttaagctgtacaatctgctgccggagaagtcgtgggagatcgacctgaagcagttggagtacctgatcgatgagaaaactgcctgtcttattgtcaacaatccaagcaatccgtgcggctcggtgttttccaagcggcaccttcagaaaattctggccgtcgccgcgcggcagtgcgtgccgatcctcgctgacgaaatctatggagacatggtgttctccgactgcaagtacgaaccgctcgctaccctctccaccgatgttcctattttgtcatgcggaggtttggccaagcgatggctggtgccgggatggagactgggatggatccttatccatgacaggcgcgacattttcggaaacgaaatccgcgatggactggttaagctcagccagagaatcctgggcccctgcactatcgtgcagggagctctcaagtcaatcctgtgccggactccgggtgaattctaccacaataccctgtcatttctgaagtcaaacgcagacctctgctacggagccctcgcggccatcccggggctgcgtcctgtccggccctccggagcaatgtacctcatggtcggtatcgaaatggaacatttccctgaattcgaaaacgacgtcgaattcaccgagcgacttgtggccgaacaatcagtgcactgccttcctgctacgtgctttgagtaccccaacttcatccgggtggtgatcactgtgcccgaagttatgatgcttgaggcgtgttcgcggatccaagaattctgtgagcaacattatcactgcgcggaagggtcccaagaagaatgcgacaaa

SEQ ID NO: 20639 - DNA, 1362 bp, Artificial Sequence
  Description of Artificial Sequence: Synthetic coding sequence
atggatccgtatatgatccaaatgtcctcaaaaggaaaccttccgagtatactggatgttcacgtgaatgtaggcggccgctcatccgttccaggaaaaatgaaaggccggaaagccaggtggagtgttcggccaagtgatatggccaaaaaaacttttaacccaattcgtgccatcgtagataacatgaaggtgaagccaaaccctaacaagacaatgattagtctctccattggcgatccaactgtgttcggcaacctgcccaccgaccccgaggtaacccaggctatgaaagacgcactggatagcggaaagtacaacgggtacgccccatccattggatttctgtcctctcgcgaagagatcgcctcgtattaccactgtccagaggctccactggaagccaaagatgtcattctcacttccgggtgcagccaagctattgacctttgccttgcagtcttggcgaatcctggccaaaacatccttgtgcctcggcccggcttcagtttgtacaagaccctggccgagtcgatgggaatagaagtcaaactctataatttgttgcctgagaagtcgtgggaaattgatctgaaacaactggaatatctgattgatgaaaagaccgcttgtctgatcgttaataacccatctaatccgtgtggcagcgtattttcgaagcggcacctgcagaagatcttggccgtggcggctcgacagtgtgtacccatccttgcagacgaaatctacggtgacatggtcttttcagattgcaagtatgaacctctcgctacactaagcaccgatgtaccaatactgagctgcgggggtcttgccaaaagatggttggtacccggctggcgcttagggtggatcctgatccacgacagaagagatattttcggaaatgagatccgcgacggcctcgtgaaactgtcccaacgcatactgggtccatgtaccattgtccagggcgcgctgaagtctatattgtgccgaacccccggggagttctaccataacaccttgtcttttctgaagtcaaatgcagatctatgttatggagcactggctgccatccccggactccggcctgtccgcccctccggcgccatgtatcttatggttgggatagagatggaacactttcctgagtttgagaacgacgttgagttcaccgaacgtttggtggccgagcagagcgtgcactgtctgccagccacctgttttgagtacccgaacttcattagggtcgttatcaccgtgccggaagttatgatgctggaggcctgttccagaattcaggagttctgtgagcagcactatcattgtgccgagggttcccaagaagaatgtgataag

SEQ ID NO: 20640 - DNA, 1362 bp, Artificial Sequence
  Description of Artificial Sequence: Synthetic coding sequence
atggatccttacatgattcaaatgtcctctaaaggcaatctcccatctatcctcgatgtgcacgttaatgtgggtggccggtcttctgtaccaggaaaaatgaaggggcgtaaagcaaggtggagcgtgagaccatccgacatggccaagaagacatttaacccgattcgcgcaatagtggacaacatgaaggtgaagccaaaccctaacaagacaatgatttccctgtcaataggggatcccacggtcttcggaaatctgccgacagatccagaggtgacacaggctatgaaggacgccctcgacagcggcaagtataatggctacgctccgtctattggatttttgtcgtcccgcgaggagatagcctcgtactatcattgcccggaggccccactggaggcaaaggacgttattctgaccagcgggtgctcgcaggccatagacctgtgtctggctgtgttggctaatccaggccagaatatcctcgtccctagacctgggttctccctgtataagaccctggccgagtccatgggcatcgaggttaagctgtacaacctgctgccagagaagagctgggagatcgacttgaagcagctggaatacctgattgacgagaaaaccgcttgcctaattgtgaataatcctagcaacccatgcggctccgtgttctctaagaggcatcttcaaaagatcctcgctgtggctgcgcggcagtgtgtgcctatcctggctgatgagatctacggcgatatggttttctcagactgtaagtacgagcccttagcaaccctgtctacagacgtccctattctctcttgtggcgggctcgccaagagatggctggtcccaggatggagactcgggtggatactgatccacgacagaagggacatctttggcaacgagatccgagatggcctggtcaagctatctcagagaattctgggcccgtgcacaatagtccagggcgcacttaagtccatcttgtgcagaacacctggagaattttaccataacactcttagtttcctcaagtccaacgccgatctgtgctatggagccctggccgccattccgggcctcaggcccgtgcgaccttccggagccatgtatctgatggtggggatagagatggagcacttccctgagttcgaaaacgacgttgaattcacggaaaggctggttgcggagcaaagcgtgcactgtctgcccgctacatgcttcgaataccctaacttcattcgtgtggtgatcaccgtccctgaggtgatgatgcttgaggcttgttctaggatccaggagttctgcgagcaacactaccactgtgccgaaggttctcaggaggaatgcgataag

SEQ ID NO: 20641 - DNA, 1362 bp, Artificial Sequence
  Description of Artificial Sequence: Synthetic coding sequence
atggatccttacatgatccagatgtccagcaagggcaaccttcctagcattctagatgtgcatgtgaacgtggggggacgcagctctgtgcctgggaagatgaagggtaggaaagcacgttggagcgtgcggccttcagacatggccaagaagaccttcaatcccattcgcgccattgtcgataatatgaaggtgaaacctaacccaaacaagactatgatttcccttagtattggcgaccctacagtgttcggcaatctgccaactgatcctgaagtgacgcaggcaatgaaggatgctctggacagcggaaagtataacggctacgcaccttctatcggattcctctcttcccgagaagagattgcctcgtattaccattgcccggaagctcccctggaagccaaggacgttatactgaccagcgggtgctctcaggccatagacctgtgcctcgccgtgctggcaaacccaggccaaaacatcctagtgccaagaccaggcttttcactttacaagacactagctgaatcaatggggatcgaagtcaaactgtataaccttctccctgagaagtcctgggaaatcgatctgaagcagctagagtacctcatcgatgaaaagacagcttgcctgattgtgaacaatccctcaaacccgtgtgggtctgtgtttagtaaacgacatttacaaaagatcctagccgtggccgcgcgacagtgcgtgcctatcttggccgatgaaatctacggcgacatggtgttcagcgactgtaaatacgagccactggccacgctctcgaccgacgttcccatcctatcctgtggcggactggctaaaaggtggctggtgccaggctggcggctgggttggattttaatccacgatagaagagatatcttcgggaatgagatccgagatggtctcgtgaagctgtctcagaggatcttgggcccgtgtacgatagtacagggcgcactgaagtccatactgtgtcggactcccggagagttctaccataacacgctgagctttttgaagagcaatgcggacttatgctatggcgctctggcagctatcccagggctccgccctgtgcgtccgagtggtgctatgtatctcatggtgggcattgagatggagcactttccagagttcgagaacgacgtggagtttaccgaacgcctggtagccgaacagtccgtgcactgcctccctgctacatgctttgagtaccctaatttcatccgggtcgtgatcactgttccagaggtgatgatgctggaagcgtgcagccgcatccaagaattctgtgagcaacactaccattgcgcggaaggatcgcaagaagaatgtgataag

SEQ ID NO: 20642 - DNA, 1362 bp, Artificial Sequence; identical to SEQ ID NO: 20622
  Description of Artificial Sequence: Synthetic coding sequence

SEQ ID NO: 20643 - DNA, 1362 bp, Artificial Sequence
  Description of Artificial Sequence: Synthetic coding sequence
atggatccgtatatgatacaaatgtcgtcgaaaggtaatctaccgtcgatattagatgttcatgttaatgtaggtggtcgttcgtcggtaccgggtaaaatgaaaggtcgtaaagcgcgttggtcggttcgtccgtcggatatggcgaaaaaaacgtttaatccgatacgtgcgatagtagataatatgaaagtaaaaccgaatccgaataaaacgatgatatcgctatcgataggtgatccgacggtatttggtaatttaccgacggatccggaagtaacgcaagcgatgaaagatgcgctagattcgggtaaatataatggttatgcgccgtcgataggttttctatcgtcgcgtgaagaaatagcgtcgtattatcattgtccggaagcgccgttagaagcgaaagatgtaatactaacgtcgggttgttcgcaagcgatagatctatgtctagcggtattagcgaatccgggtcaaaatatattagtaccgcgtccgggtttttcgctatataaaacgttagcggaatcgatgggtatagaagtaaaactatataatttattaccggaaaaatcgtgggaaatagatctaaaacaattagaatatttaatagatgaaaaaacggcgtgtttaatagttaataatccgtcgaatccgtgtggttcggtattttcgaaacgacatctacaaaaaatactagcggtagcggcgcgacaatgtgttccgatactagcggatgaaatatatggtgatatggttttttcggattgtaaatatgaaccgttagcgacgctatcgacggatgtaccgatactatcgtgtggtggtctagcgaaacgttggttagtaccgggttggcgtttaggttggatactaatacatgatcgtcgtgatatatttggtaatgaaatacgagatggtttagtaaaattatcgcaacgtatattaggtccgtgtacgatagtacaaggtgcgttaaaatcgatattatgtcgaacgccgggtgaattttatcataatacgttatcgtttttaaaatcgaatgcggatctatgttatggtgcgctagcggcgataccgggtctacgtccggtacgaccgtcgggtgcgatgtatttaatggttggtatagaaatggaacattttccggaatttgaaaatgatgtagaatttacggaacgactagttgcggaacaatcggttcattgtctaccggcgacgtgttttgaatatccgaattttatacgtgttgttataacggttccggaagttatgatgttagaagcgtgttcgcgtatacaagaattttgtgaacaacattatcattgtgcggaaggttcgcaagaagaatgtgataaa

SEQ ID NO: 20644 - DNA, 1362 bp, Artificial Sequence
  Description of Artificial Sequence: Synthetic coding sequence
atggacccctacatgatccagatgagctccaagggtaacctgccgtcgatcctggatgtgcacgtgaacgtgggagggcgttcttcagtgccagggaagatgaagggacggaaagcccggtggagcgtgaggccctcagacatggccaaaaagaccttcaaccctatcagggctatcgtcgataacatgaaggtgaagccgaacccaaacaagaccatgatctcactgtcaatcggcgatccgaccgtattcggaaacctccccacggacccagaagtcacccaagccatgaaagatgcgctcgatagcgggaagtataatggatatgcaccgtccatcggctttctttcatcgagagaggaaattgcgagctactaccactgtccagaagcccctctggaagcaaaggacgtgatcctcacttccggatgctcacaggccatcgatctgtgcctcgcggtgcttgcgaacccgggacagaacattctggtgccgcggccgggattctcgctctacaagactctcgccgaatcaatgggcatcgaggtgaagctgtacaatctcctgccagagaagtcctgggaaatcgacctgaagcagcttgagtacctgatcgacgaaaagaccgcttgcctcatcgtgaataacccctccaatccgtgcggatcagtgtttagcaaacggcaccttcagaaaatcctcgccgtggctgccagacagtgcgtgccgatcctggcagacgaaatctacggagatatggttttctccgactgcaagtacgaacccctggctaccctttccacggacgtgccaatcctcagctgtggaggcctcgcgaaaagatggctggtccctggctggcgacttgggtggatcctgatccacgatcgccgcgatatcttcggcaacgagattagagacggcctggtgaaactgtcccaacgaattctcggaccatgcaccatagtgcagggtgccctgaagtcgatcctctgccgcacgccgggggagttttaccataataccctgagctttctcaagtccaacgcagacctgtgctacggggcactggccgcgattccgggactccggccggtgcgcccaagcggagccatgtacctgatggtcggaatcgaaatggaacacttcccagagttcgaaaacgacgtggaattcaccgaaaggttggtggctgaacaatccgtgcattgcctgccggctacctgctttgaatacccgaatttcatccgggtggtgatcaccgttcctgaggtcatgatgctggaagcatgctcccggatccaggaattttgtgaacagcattatcattgtgcggaaggatcccaagaggaatgcgacaag

SEQ ID NO: 20645 - DNA, 1362 bp, Artificial Sequence
  Description of Artificial Sequence: Synthetic coding sequence
atggatccctacatgattcagatgagctcgaagggaaacctccccagtatcctggacgtccacgtgaacgtgggcggaaggtcttccgtcccgggcaagatgaagggccgtaaggccaggtggtccgtccggccctccgatatggccaagaagacctttaaccctatccgtgctattgtggacaatatgaaggttaaacccaatcccaacaagaccatgatttcattgtccatcggcgatcctaccgtgtttgggaacctgccaacagatcccgaggtgacacaggctatgaaggacgcgttagactccggtaagtataatggctatgccccttcaattggattcctctcgtctagggaggagattgcttcctattaccattgtcctgaggcccccctagaggccaaagacgtgatactcacaagcggatgcagccaggcgatcgacctctgcttggccgtcctagccaatcccggccagaacattctggtcccacggcccggattcagcctctataaaactctcgccgaatcaatggggatcgaggtgaaactatacaatctgctgcccgagaagtcttgggaaattgatttgaaacagctggagtacctgatcgatgagaagacggcttgtctgatcgttaataacccgtcaaacccatgtgggtcggtattcagcaaacgccacctccagaaaattttagcggtcgcagcccgtcagtgtgtgcccattctggcggatgagatctatggcgacatggtgttcagcgattgcaagtacgagccactggctacactgagtaccgatgttcccatactctcttgcggaggtcttgccaaacgatggctagtccccggctggagattaggctggatcttaattcacgatcgcagagacatcttcggcaacgagattcgagacggcctagtgaaactcagtcagcggatacttggcccatgtaccatcgttcaaggggcattaaagagtatcctctgtcgcactcctggggagttttatcacaataccctgagctttctgaaaagcaacgccgatctctgttatggggctttagcagcaattcctggtttgaggcctgtcaggcctagcggagccatgtatctgatggtaggcatcgaaatggagcatttcccagaattcgaaaacgatgttgagtttaccgagcgccttgtcgcagagcagtccgtgcactgtctgcccgctacctgttttgagtacccaaacttcattcgggtagtgattacagtgcccgaggttatgatgctggaagcgtgcagcagaatccaggagttctgcgagcagcattaccactgtgccgaggggagccaggaggagtgtgataag

SEQ ID NO: 20646 - DNA, 1362 bp, Artificial Sequence
  Description of Artificial Sequence: Synthetic coding sequence
atggacccgtacatgatacaaatgtctagtaaaggtaatcttccaagcatcctggacgtccatgtcaacgtgggtggcagaagcagcgtgccaggcaagatgaagggccgcaaggcccggtggagcgtgcgcccatcagatatggccaagaagaccttcaacccgatacgagccattgtagataacatgaaggtgaagcccaaccccaacaagactatgatcagcctcagcatcggagatcctacagtgttcggcaatctgccaactgatccagaagtgacccaggcaatgaaggacgctttagatagcggcaagtacaacggctacgcgccatcaatcggcttcctatcatcgagggaggaaatagcatcttactatcattgtcctgaggcgcccctcgaagctaaggacgtcatcctcaccagcggatgcagccaggccattgacttgtgccttgctgttcttgcaaacccaggccagaatatccttgtaccgaggcccggcttcagcctgtataagactttggcagagtccatgggcatcgaggtcaagctctataacctgctgcccgagaaatcctgggagattgaccttaagcaactggaatacttgatagatgaaaaaaccgcatgcctgatcgtgaacaatcctagcaacccttgcggaagtgtgttctctaaacgtcacctgcagaagattttggccgtggccgctcggcaatgtgtccctatcttggccgacgagatttatggagatatggtctttagcgactgtaagtacgagcccctggctactctttcaactgacgtgcctatcctcagctgtggtggcctcgctaaacgctggctggtacctggatggaggctggggtggattttgatccatgacaggagggatatttttgggaacgaaatccgcgatggcctggtcaaactcagccagcggatcctggggccatgcacaattgtccaaggggcgcttaaatcaatcttgtgcaggactccaggtgagttttaccataacaccctgagttttttgaagtctaacgcggacttgtgctatggagcacttgccgctatccctggcctgcggcctgtgcgtccgtccggtgccatgtatcttatggtgggcattgaaatggagcattttcctgagttcgagaatgacgtggagttcaccgaacgcctcgtcgcagagcagagcgtgcattgtctgcctgcaacatgctttgagtatcccaactttattagggtggtgattactgtgcctgaggtgatgatgctggaagcttgcagtcgtatccaggagttttgtgaacagcattaccactgcgccgaaggaagccaagaggaatgtgacaaa

SEQ ID NO: 20647 - DNA, 1362 bp, Artificial Sequence
  Description of Artificial Sequence: Synthetic coding sequence
atggatccctacatgattcaaatgtcgagcaagggtaacctcccgtccatactagacgtgcacgttaatgtgggtggtaggtccagtgttcccggcaagatgaaaggtcggaaggcccggtggtcggtgcgtccttcggacatggccaagaaaacgtttaatcccattcgcgccatagtcgataacatgaaggtgaaaccgaatccgaacaagaccatgatatcgctgagtatcggtgatccgaccgtgttcggcaacctgccgaccgatcccgaggtgacgcaggccatgaaggatgccctagactccggcaagtacaatggatacgcgccctcgatcggattcctgtcatcgcgagaagaaatcgcctcatactaccactgccctgaggcccccttggaggcgaaagatgttatcctgacctcgggttgctcccaagccatcgacctctgtctcgccgtgctcgcgaatcccggacaaaatattctcgtgccacgcccaggcttcagcctctataaaacgttggcggagtctatgggcattgaggtcaagttgtacaatctgctgcccgaaaagtcctgggaaattgacctaaagcaattggagtatctgattgacgagaagaccgcttgcctgattgtcaacaatccatcgaatccttgcggatcggtgttcagtaagcgacatttgcaaaagatccttgccgtcgcagcccgacaatgcgtgccaattttagcggacgagatctatggtgacatggtgttctcggactgcaaatacgaacccctggccacactatccacggacgtgcctatcctgtcctgcggtggcctggcaaagcgttggttagtcccaggctggcggcttggttggatcttaattcacgaccgcagggatatcttcggcaatgagattcgggatggtctcgtgaaattgtcgcagaggattctagggccatgcacaattgtgcagggagccctgaagagtattctttgccggacccccggagagttctaccacaatactctgtccttcctgaagtccaatgcggacctgtgctatggcgcgctggcagccattccgggccttaggccggtaagaccgtcgggggctatgtatctgatggtcggtatagaaatggagcactttcccgagtttgaaaatgacgtggaattcaccgaaaggctggtggctgaacagagcgttcattgcctccctgccacgtgtttcgagtaccctaatttcattcgcgttgtcatcacagttccagaggtgatgatgctggaggcctgctcgagaattcaggagttttgcgagcagcattaccactgcgcagaaggcagtcaggaagagtgcgataag

SEQ ID NO: 20648 - DNA, 1362 bp, Artificial Sequence
  Description of Artificial Sequence: Synthetic coding sequence
atggatccctacatgattcagatgtcgtccaagggcaatttgccttcaatactggatgtgcatgtcaatgtgggtggaaggtcctcggtgccaggcaaaatgaagggaagaaaagctcgctggtccgtgaggccttcagatatggcaaagaaaacctttaaccctatacgagccatagtggataacatgaaggtgaagccaaaccctaacaagaccatgatcagcttgagcatcggagatccaactgttttcggaaacctgccaactgatcctgaagtgacccaggcaatgaaagatgcacttgattccggtaagtacaatggatacgcaccctcgattggtttcctctcctcacgcgaggaaatcgcaagctactaccattgcccagaagcgcctctggaagctaaggatgtgatccttaccagtggttgttcacaagctattgacctttgtctggctgtccttgcaaaccctggacaaaacatactggtgcctcggcccgggtttagcttgtacaagaccctggcggaatcgatgggaattgaagtcaagctctacaatcttctcccagagaagagctgggaaatcgatcttaaacaattggaataccttattgacgaaaagacggcttgcctgatcgtgaacaacccatcgaatccttgtggatctgtgttcagcaagcgccatctgcagaagattctggccgtggcagcaagacaatgcgtgcctattctggcggacgagatttacggagatatggtgttctccgattgtaagtacgaacctctggcaactttgtcaactgatgtgcctattctttcatgcggcggtcttgcgaaacgttggcttgtcccaggttggagactcggttggattcttatccatgaccggcgcgacattttcgggaacgaaattagagatggactggttaaactgtcgcaacgcattcttggaccttgcactattgtgcaaggagccctgaagagcattctgtgtcggactccaggtgaattctaccataacactctttccttcctgaagtcaaacgcagacctctgttacggggcacttgcagcaatccctggcttgcgtcctgttcgccccagcggggcgatgtacctcatggtgggcatcgagatggagcattttcccgaatttgaaaatgatgtggaatttactgaacgcctggtcgcggaacagtccgtgcactgcctgcccgcaacctgttttgaatacccgaatttcattagagtggtgataactgtccctgaggtcatgatgctggaggcctgctcacgcattcaggaattctgtgaacagcattatcattgtgctgaaggtagtcaagaagaatgtgataag

SEQ ID NO: 20649 - DNA, 1362 bp, Artificial Sequence
  Description of Artificial Sequence: Synthetic coding sequence
atggacccctatatgatacagatgtcttccaagggcaacctcccatcaattctggacgtacatgtgaacgttggtggccgctcaagtgtgccaggtaaaatgaagggcaggaaagctagatggtctgtaagaccgtctgatatggcaaagaagaccttcaatccgattagagctatcgtggataacatgaaggtaaaacctaatcccaacaagacaatgatctcactctctatcggagaccccacagtgttcggcaatctcccaactgatcctgaagtaacacaggctatgaaggatgcattggactctggcaagtataacggctatgcaccttccataggttttctgtcctcacgcgaggaaatcgcatcttactaccattgccccgaggccccccttgaagccaaagacgttattctgacgtccggatgttcccaagccatagatctttgcctggctgtcctcgccaacccgggccagaacatcctggtgccccgccccggctttagtctctataaaacattggctgagtctatgggtatagaggtcaaactttacaatctgcttcccgagaaatcttgggaaatcgatttgaaacaactcgaatatctgattgatgagaaaactgcctgcctgatcgtgaataacccatcaaacccatgcggctccgtcttcagcaagagacacctgcaaaagatcttggccgtggccgcacgccaatgcgtgcctattcttgccgacgagatctacggtgacatggtattctccgactgtaagtacgaaccgctggctactctctccactgatgtgcctatcttgagctgcggaggactggcaaaaaggtggttggtgccaggctggagacttggctggattctgattcatgaccgcagggacatcttcggcaacgaaatcagagatggtctggtgaagctgtcccagagaatcctgggcccctgcacaatagtacagggagctctcaagtccattctgtgcaggaccccaggagaattctaccataatactctgtcattcctgaaatctaacgctgatctttgctatggtgcgctcgccgccatcccgggccttaggcccgttcgcccgagtggagccatgtatctcatggtcggcattgagatggagcatttcccagagttcgagaacgacgtggagttcaccgagaggctcgtggctgaacaatccgtgcattgtctccctgctacatgcttcgagtatcctaactttattcgcgtggtgattactgtgcctgaggttatgatgctggaggcctgctcacgcattcaggagttctgcgagcagcactaccattgtgccgagggctcacaggaagaatgcgacaaa

SEQ ID NO: 20650 - DNA, 1362 bp, Artificial Sequence
  Description of Artificial Sequence: Synthetic coding sequence
atggacccatacatgatacagatgtcatcaaagggcaaccttccgtctatcctggatgtgcacgtgaacgtcggcgggagatcgtccgtccctggcaaaatgaagggaagaaaagctcgctggagcgtcaggccctctgatatggccaagaagaccttcaatcccatcagggcaattgtggataacatgaaggtgaaacctaacccaaacaaaaccatgatatcattgagcattggcgatcccaccgtctttggcaacctacctactgatcccgaggtgacacaggccatgaaagacgctctggatagtggcaagtacaacgggtacgctcccagtatcgggttccttagtagccgcgaggaaattgcatcttattaccattgccccgaggctcctctggaagcaaaagacgtgattctgacctctggatgctcccaggccattgatctgtgcttggccgtcctggcaaacccaggacagaacatactagttcccaggccaggctttagcctgtacaaaaccctcgccgaatcaatggggatcgaggtgaagctttataatcttctgccagaaaagagctgggaaattgatctgaagcagctggagtatcttattgatgagaaaactgcctgcctgattgtgaataatccgtcaaacccttgtgggtccgtcttctctaaaagacatttgcagaagatactggccgtagcagcccgccaatgcgtgccgattttggctgatgagatttacggggatatggtgttctccgactgtaagtacgaacccctggctaccctgtccacagacgttcccatcctgagttgcggaggacttgccaaacggtggctggttcctggctggcggttggggtggatcttgatacacgataggcgcgatatcttcggaaatgagattcgagacggcttggttaagttgtcgcagagaatcctcggcccttgtactatcgtgcagggcgctctcaaaagcatattatgtcgcacacccggggaattttaccacaacactctgagtttcctgaagtctaacgccgatctatgttacggagccctggccgcaattcctgggcttcggccagtacgcccgtcgggggctatgtacctgatggtcgggattgagatggagcactttccagagttcgaaaacgatgttgagttcaccgaacgcctggtcgcagagcagtcagtccactgtctacccgcaacttgtttcgagtatcccaattttattcgggtggtgattacagtccccgaagtcatgatgctggaagcttgctctagaatccaggagttttgtgagcaacattaccattgtgccgaggggtcccaagaggagtgcgacaag

SEQ ID NO: 20651 - DNA, 1362 bp, Artificial Sequence
  Description of Artificial Sequence: Synthetic coding sequence
atggatccttacatgatccaaatgtcctcaaaggggaatcttccttccatacttgatgtccatgtgaacgtgggaggtcgctcgtcggtccccggaaagatgaaaggccgaaaggcacgctggtctgtgaggccgtccgacatggcaaagaaaacgttcaatcctattcgggccatcgtggataacatgaaggtcaagcctaatcctaacaagaccatgatttcgttgtcgatcggagatcctactgtgtttggcaatcttcctactgatcccgaagtgactcaggcgatgaaggatgcccttgattctggtaagtacaatggctacgcaccttcgataggctttctcagcagccgtgaagagattgcgtcatactaccactgtcctgaagctccccttgaggccaaagatgtgattctgacttcaggttgtagccaagcaattgatttgtgtcttgcagtcttggcgaatcctgggcagaacatactggtgccaagaccaggtttctcgctgtacaagactctggcagaatccatgggaatcgaagtgaaattgtacaacttgctgcctgaaaagtcatgggaaatcgacctcaagcaactggagtaccttattgatgaaaaaaccgcatgtctcatagtgaacaacccatcaaacccatgtggatcagtgttttccaaaagacacctgcaaaagattcttgccgtcgcggcacgacagtgtgtgcccattctggcggacgagatttacggggacatggttttcagcgactgtaagtatgaaccccttgcaaccctttccaccgatgtaccaatactttcctgcggaggtctggctaaaaggtggcttgtccctggttggaggctgggctggattctcatacacgacagaagagatatcttcggcaacgagatacgagacggactggtcaagctgtcgcagcgcattttgggtccctgtactatagtgcagggtgcactcaagtccattctttgcagaactccaggcgaattctaccacaacaccttgtcctttcttaagtcgaatgcggatctttgctacggcgcattggccgccatacccgggctccgtccggtcagacccagcggagcaatgtacctcatggtcggtattgaaatggaacactttcctgaattcgaaaatgatgttgagttcactgaacgactggtggccgagcagtctgtccactgtctgccagcaacttgcttcgagtatccaaacttcattcgggtggtgattacggtcccagaagtcatgatgctcgaggcatgctcgagaatccaggaattttgtgaacagcattaccattgtgctgaaggtagccaagaggaatgtgataag

SEQ ID NO: 20652 - DNA, 1362 bp, Artificial Sequence
  Description of Artificial Sequence: Synthetic coding sequence
atggacccctacatgatccaaatgtcctctaaaggtaacctgccgtccatattggacgtgcacgttaatgtgggtggacgatcaagtgtgcctggaaaaatgaagggccgtaaggccagatggtcagtgcggccctccgacatggctaaaaagacttttaaccctattcgagccattgtagataatatgaaagtgaaaccgaacccaaataaaacaatgatctcgctgagcatcggcgaccccactgtttttggtaatcttccaaccgaccctgaggtgacacaggctatgaaggatgctttagactcggggaagtacaacggatatgctccaagcatcggatttctttcaagtagagaggagattgcatcttattaccattgcccagaggctcccctggaggccaaggacgtgatactgacctccgggtgctcacaggctatcgatctgtgcctcgccgttctagctaaccctggccagaatatccttgtgcctagaccaggatttagtctgtacaagactctggcagaatccatgggcatcgaggtcaagctctacaacctgctgcctgagaagtcatgggaaatcgacttgaaacagcttgaataccttatcgacgagaagactgcatgtcttattgtcaacaatccttctaacccttgcggcagcgtgttctccaagcgtcacctgcagaagatactggccgtggccgcccgacagtgtgtgcccatcctcgctgacgaaatttacggcgacatggttttcagtgattgtaaatacgaacctctggctacccttagtacagacgtccctatcttgagttgcggggggctagccaaaaggtggctcgtccccggctggcgtctaggatggattcttatccacgaccgcagagatattttcggaaatgagataagggatggcctggtgaagctcagccagcggatactgggaccttgtacaatcgtccagggggcgttgaagtccattctgtgcaggacccctggggagttctatcacaacacattgtcttttctgaaatcgaatgcagatttgtgctacggagcattagccgccattcctggattgcggcctgtcaggcctagcggagccatgtatttaatggtgggaatagagatggagcactttccagaatttgaaaacgacgtcgagttcacggaaaggctggtggccgaacagtcagtgcactgcctacccgctacctgcttcgagtatcctaattttattagagttgtgataacagtgcctgaggtgatgatgctggaagcttgttctaggatccaagagttttgcgagcagcactaccactgcgcagagggtagccaggaggagtgtgacaag

SEQ ID NO: 20653 - DNA, 1362 bp, Artificial Sequence
  Description of Artificial Sequence: Synthetic coding sequence
atggatccctacatgatacagatgtcatcaaagggcaacttgccatccatcctcgacgtccacgttaatgtaggcggtcggtctagcgtgccaggcaagatgaagggcagaaaagccagatggagcgtgaggccctctgacatggctaagaaaacatttaacccaatccgtgctatcgtcgacaatatgaaggttaagccaaatcccaacaaaactatgattagtcttagcatcggcgaccccacagtgttcggaaaccttcctaccgaccccgaagtgacgcaggctatgaaggatgccctcgattctggtaaatataacggctatgcgccatctatcggcttcttgtcttcaagagaggaaattgcgagttattaccattgccctgaggcaccactggaagccaaggatgttattctcacatctggctgttcacaggcaatcgacctgtgcctagctgtgctggccaaccctgggcagaatatcctggtgcccaggccgggcttttccctttacaaaacgctcgcggagagtatgggaattgaagtgaagctatataacctcctgcctgagaagtcatgggagatagatttgaaacagcttgaatacctgatcgatgagaagaccgcatgcctgatagtcaacaatccatccaacccctgcgggagcgtgtttagtaaacggcacttgcagaagatcctggcagtggcagcacggcagtgtgtacctattctggccgacgagatctacggagatatggttttctctgattgtaaatacgagccccttgcaacccttagtaccgatgttcccattctgtcctgtggcgggctggctaagcgctggctggtccctggttggagactgggttggatcctgattcacgatcgcagggacattttcggcaacgaaatacgggacggactcgttaagttatctcagcggattctgggcccctgtactatcgtccagggagcactgaagtcaattctctgtagaactcccggggagttctaccacaatacactgagctttttgaaaagtaatgccgacctttgctatggcgcgctggctgcgatccccggcctgcggccagtgagacccagcggagcaatgtacctcatggtcggaatcgagatggagcattttcctgagtttgaaaatgacgttgaatttacagagagacttgtggcagaacagagcgtccattgcctccccgccacttgctttgaatacccaaattttatacgagtggtgattacagtgcccgaggtaatgatgctggaagcctgttcgagaatccaggagttttgcgaacagcactatcattgtgcagaaggatcccaagaggaatgtgacaaa

SEQ ID NO: 20654 - DNA, 1362 bp, Artificial Sequence
  Description of Artificial Sequence: Synthetic coding sequence
atggatccttatatgatacagatgagctcaaaaggtaacctgcccagtatcctggacgtgcacgtgaacgtaggggggcggtcaagcgtgcccggcaaaatgaagggtcggaaggcacgatggtccgtccggccttcagatatggctaaaaagacttttaaccctatccgtgccatcgtggataatatgaaggttaagccgaacccgaataagacaatgataagtttgtcgattggagatcccacagtgtttggaaatcttccaactgatccagaagtaacccaggcaatgaaggacgcattggactctgggaagtataatgggtacgcaccctccataggctttctgtcttcaagagaggagatcgcgagctactatcattgccctgaggccccccttgaggccaaggatgtcatactcacctcggggtgtagccaggccatcgacctatgcctggctgtgctcgccaaccctggtcaaaacattcttgtgccgaggccaggcttcagtctttacaagaccttagccgaaagtatgggtattgaagttaagttgtataacctcctcccagaaaaaagttgggagatagaccttaagcaactggagtatctgatagatgagaaaacggcctgtttgatcgttaacaacccatccaatccatgtggatccgtctttagcaagcgccatctccaaaagatcctggcagtcgcagcgcggcagtgcgtgccgattcttgcagacgagatttatggcgacatggtatttagcgattgcaagtatgagccattggcaaccctcagcacggacgtgcctatcctcagctgcgggggactggcaaagcgctggctggtgcccggctggcggctgggctggatcctgattcacgatagacgggatatcttcgggaatgagattcgcgacggactagttaaactatcccaaaggattttgggcccctgcacgattgtccagggtgccttgaagtccatactgtgtaggacacctggagaattttaccacaacactctgagtttccttaagtctaacgccgacctttgctacggagcattggccgcaatccctggcctgagaccggtgcgcccaagtggtgccatgtatttgatggttgggattgagatggagcatttccctgagtttgagaatgatgtcgagttcacagaacgactagtcgccgagcagtcagtccactgtctccctgctacttgcttcgaatatcccaattttatccgagttgtaatcacggtacccgaagtaatgatgcttgaagcctgttctaggatccaggagttctgcgagcagcactaccactgcgcggaggggtcccaagaagagtgcgacaag

SEQ ID NO: 20655 - DNA, 1362 bp, Artificial Sequence
  Description of Artificial Sequence: Synthetic coding sequence
atggatccgtatatgatccagatgtcctccaaaggaaacctgcccagcatccttgatgtgcatgtgaacgtcggaggacggtctagtgtgccgggaaagatgaagggacggaaggcccggtggagtgtgcggccgtccgacatggctaagaaaaccttcaatcccatcagggccattgtggacaacatgaaagtcaagccgaacccaaataagaccatgatctcactgtcgatcggagatccgaccgttttcggtaacttgccgaccgacccggaagtgactcaggcgatgaaggatgccctcgacagcggaaagtacaacggatacgcaccatccatcggattcctgagctcgcgtgaagagatcgcctcctactaccactgcccggaggccccactcgaagccaaggacgtgatcctgacgagcggatgctcccaagcaattgacctgtgccttgccgtgctcgcaaacccaggccagaacatcctcgtgccgcgccccggattctccctgtacaagactctggccgaaagcatgggaatcgaagtgaagttgtacaatctgctgccagagaagtcgtgggagatcgatcttaagcaactggagtacctgatcgacgaaaagaccgcatgtctgatcgtgaataatccttcgaacccatgcggatcggttttttctaagcgccacctccaaaagatcctggctgtcgcagcgcgacaatgtgtcccgatcctggcggacgagatctacggagatatggtgttttctgactgcaaatacgaacctctcgcgactctttcaactgacgtgcctatcctgtcatgtggtggattggcaaagaggtggctcgtgccgggctggcggctggggtggatcctcattcacgacagaagagatatcttcggcaatgagatcagagatggacttgtgaaactgtcgcaacggattcttggcccgtgtactatcgtccagggtgcgcttaagtccatcctctgccgcaccccgggcgagttctaccataacactctgagcttcctgaaaagcaacgcggatctgtgttacggggctctggccgcgattccgggtctgcgcccggtgcggccatcgggagcgatgtacttgatggtgggcatcgagatggaacacttcccggagtttgaaaacgacgtcgaattcaccgagcggctcgtcgcggagcaatccgtgcactgtctgcctgcaacctgcttcgagtacccgaacttcatccgcgtggtgattactgtcccggaagtcatgatgctggaagcatgcagcaggatccaggaattctgcgaacagcactaccactgtgcagaaggatcccaggaggagtgtgacaaa

SEQ ID NO: 20656 - DNA, 1362 bp, Artificial Sequence
  Description of Artificial Sequence: Synthetic coding sequence
atggacccttacatgatccagatgtcgtccaagggaaatctgcctagcatactcgatgtgcacgtgaacgtgggtggtcgaagctcggtgccagggaaaatgaagggcagaaaagctcgctggagtgttcgcccgtcggatatggcaaagaaaactttcaatccgatcagggccattgtcgacaacatgaaagtaaagccgaacccaaacaagactatgatctcgctgtctattggcgacccaactgtgttcggaaacctcccaaccgacccagaggtgacccaagctatgaaagatgccctggatagcgggaagtacaacggttacgctccatccatcggtttcctctcgagccgggaagaaattgcctcatattaccattgcccagaagcgccgctggaagccaaagatgttattctcactagcggatgctcgcaggcgatcgacctgtgcctcgcggtgttggctaatccaggacagaacattctcgtcccgaggcccggcttctccctctacaagaccctggcggagtccatggggattgaggtgaaactgtataacttgctccccgaaaagtcttgggagatcgatttgaagcagctggagtatctcatcgacgagaaaaccgcgtgcctgatcgtgaataatccttctaatccgtgcggatcggttttctcgaagcgccatcttcagaaaatcctggcggtggcagcccggcaatgcgtgccgattttggctgatgaaatctacggcgacatggtgtttagcgattgtaagtacgagcctctggcaacgctgtcaaccgatgtgccgatcctcagctgtggaggtctggcgaagagatggcttgtgccagggtggcggctggggtggatccttatccacgatcgccgcgacatcttcggaaacgaaatcagagacggcctcgtcaagctgagccagcgcatccttggcccgtgtactatagtgcaaggtgcactcaagtccatcctctgtcggaccccgggagagttctaccataataccctctccttcctgaaatcaaacgccgatctttgctacggcgccctggctgccatcccagggctccggcctgtccgccccagcggcgctatgtacctgatggtcggaattgaaatggaacacttccccgagttcgaaaacgatgtggaattcaccgagagactcgtggccgaacaaagcgtgcactgcctcccagccacctgtttcgaatacccgaatttcatccgcgtggtgattaccgtgccggaggtcatgatgttggaggcctgtagccggatccaggaattctgcgaacaacactaccattgtgccgaaggatcacaggaagagtgcgacaag

SEQ ID NO: 20657 - DNA, 1362 bp, Artificial Sequence
  Description of Artificial Sequence: Synthetic coding sequence
atggatccttacatgattcagatgagcagcaaaggtaacctgccatctatactggatgtgcacgtgaatgtaggtggtaggtcttctgtgcctggcaaaatgaaggggcgcaaggcgaggtggtcagtgcgacccagtgacatggctaaaaaaaccttcaaccccattagggcgatcgtggacaacatgaaggtgaaacctaaccctaataagaccatgatttcactgtccatcggcgatcctaccgtattcggcaatctcccaactgacccagaagtgacccaggcaatgaaagatgccttggactctggcaagtacaatgggtacgctcctagcatcggcttcctgtcctcaagggaggagattgcttcttattatcactgccctgaggccccccttgaagctaaggatgttattctcacgagtgggtgctctcaagccattgacctctgcctcgctgtgctggcgaaccccgggcagaatatcttggtgcctaggcccggtttcagtttgtacaaaacactggcagagagcatgggcatagaggttaagctgtacaatctcctgcccgagaagtcctgggaaatcgatctgaagcagctggaatacctgattgatgagaagactgcctgcctgattgtgaataatccgtccaatccctgcgggtctgtattttcaaagagacacctccaaaagatcctcgccgttgccgctcggcagtgcgttcccattcttgctgatgagatctacggggacatggtgttcagcgattgcaaatacgaaccattggctacactttccaccgatgtgccaatcctgagctgcgggggtttggctaagcgatggctggtgcctgggtggaggcttgggtggatccttattcacgatcgcagggatatctttgggaacgagatcagggatggtcttgttaagctgagccaacgcatcctgggaccatgtacaattgtgcagggtgcacttaagagcatcctgtgcagaacccccggcgagttttatcacaataccctgtcttttctcaagtccaacgcagatctgtgctatggggcccttgccgctattcccggcctccggcctgtccggccatctggcgccatgtacctcatggttggtatcgaaatggagcacttccctgaatttgaaaacgatgtggaattcaccgagagactcgtggcagagcagtccgtgcactgcctgcccgccacatgttttgaataccccaacttcatcagagttgtgataactgttccagaagtgatgatgctggaagcctgctcacggatccaagaattctgtgaacagcattatcactgtgccgagggcagccaggaagagtgcgataag

SEQ ID NO: 20658 - DNA, 1362 bp, Artificial Sequence
  Description of Artificial Sequence: Synthetic coding sequence
atggatccgtatatgatacaaatgtcatccaagggcaacctgccttctatcctggatgttcatgtcaacgtgggcggtaggagcagcgtgcctggcaaaatgaagggacgcaaggcccgctggtccgtgcgaccctcagacatggctaaaaagaccttcaatcctattcgggccatcgttgacaacatgaaggttaaaccaaaccccaataaaaccatgatttctttgtccataggcgaccccacagtgttcggtaatctgcccactgaccccgaagttacccaggccatgaaggatgccctcgactcagggaagtataacggatatgctccaagtatcggattcctgtcaagccgagaggagattgcatcttactatcattgccccgaggccccactggaagcaaaggatgttatcctcacaagtggatgttcacaggctatagatctgtgtcttgctgtcctggccaacccaggccagaatatactggtgcctagacccggcttttccctgtataaaaccctcgcagagtcaatgggtattgaggtgaagctttacaatctgctcccagagaagagctgggagatcgacttgaaacagctcgagtatcttatcgatgagaagaccgcttgccttattgtgaataatccgtcaaatccctgcggctcagttttttctaagcggcatttgcagaaaatcctggcagtcgctgccagacaatgtgtaccgatcctggcagacgaaatctacggagacatggtcttcagcgattgtaaatacgaacctctcgctacgctctccacagatgtgcctattctgagctgcggtggactggcgaagcgatggttggtcccggggtggcgcctggggtggatacttatccacgatcggagagacattttcggcaacgaaattagggacgggctggttaagctgagccagcggatcctgggaccatgcacaatcgttcagggcgcactcaaatcaatcctttgccgcacaccaggtgagttctatcataacacactctctttcctcaagtccaatgctgatctctgttacggggctctggcggctatacctggactgcgccccgtccgcccctcaggagcaatgtatctgatggtgggcattgagatggaacacttccctgagttcgaaaacgacgtggagtttaccgaacggctggtcgcagaacagagcgtacactgtctgccagccacttgcttcgagtaccctaattttattcgggtggtgattacagtgcccgaggtgatgatgctcgaggcatgcagtaggatccaggagttttgcgagcagcattatcattgtgctgagggctcccaggaggagtgtgataaa

SEQ ID NO: 20659 - DNA, 1362 bp, Artificial Sequence
  Description of Artificial Sequence: Synthetic coding sequence
atggacccttacatgatccagatgtcgtcaaaggggaacctcccctccatcctggacgtccatgtcaacgtgggcggacggtcctccgtgccaggaaagatgaaaggcaggaaggcgcggtggagcgtgcggccctcggacatggcgaagaaaaccttcaatccaatccgcgccattgtggataacatgaaggtcaaacccaacccaaataagaccatgatttccctgtcaatcggagatcccactgtctttgggaacctgccgaccgatcccgaggtgacccaggcaatgaaggatgccctggattccggcaagtacaacgggtacgcaccatccatcggattcctctcgtcgcgggaggaaattgcatcatactaccactgtccggaagcgccgctggaagccaaggatgtcatcctgacctctggctgctcgcaggccattgacctgtgtctcgcagtgttggcaaacccgggacagaacatcctcgtgccgcgcccgggattttcgctgtacaagaccctggccgagtcgatgggaattgaagtgaagttgtacaacctgttgccggaaaaatcttgggagatcgatctgaaacagctggaataccttatcgacgaaaagaccgcctgtctgattgtgaataacccttctaacccttgcggaagcgtgttttcaaagagacacctgcaaaagatcttggcggtggcggcacgccagtgtgtgccgatcctcgcggatgaaatctacggcgatatggtgtttagcgattgtaaatacgaaccactggccactctgtcaactgacgtcccaatcctgtcatgcggaggcttggctaaaaggtggctggtgccgggctggcgtctgggatggatcctcatccatgacaggcgcgacatcttcggtaacgaaatccgggacggactggtcaagctctcgcagagaatcctcggtccgtgcaccatcgtgcaaggagccctcaagtcgattctctgccggaccccgggcgaattctaccataacactctgtcattcttgaagagcaacgcagatctctgctacggggcgcttgccgctatcccaggactccgcccagtcaggccgtcaggcgctatgtacctgatggtgggcatcgagatggagcactttccggagtttgagaatgacgtcgagttcaccgagcgcctggtggcggagcagtcggtccattgcctgccggccacctgcttcgaatacccgaatttcattagggtggtgatcaccgtcccagaagtcatgatgctggaggcgtgttcgcggatccaggaattctgtgaacagcattaccactgcgctgaaggtagccaagaggaatgcgacaag

SEQ ID NO: 20660 - DNA, 1362 bp, Artificial Sequence
  Description of Artificial Sequence: Synthetic coding sequence
atggatccttacatgattcaaatgtcgtcaaagggcaacttgccatccattctcgacgtgcatgtcaatgtcggaggacggtcgtcggtgcctggcaaaatgaaaggacgcaaagccagatggagcgtgaggccatcggatatggcgaaaaagacttttaaccccatccgcgcaatcgtggataacatgaaggttaagcccaatccgaataagactatgatctccctttcaattggagatcccacggtctttggtaacctcccaaccgaccctgaggtcactcaagcaatgaaggatgccctggattcaggaaagtacaatggctacgccccctcaattggctttctgtcctcgagggaggaaatcgcatcctactaccactgtccagaagctcctctggaagccaaggatgtcattcttacttccggctgctctcaggcgattgacttgtgccttgctgtgctggcaaacccaggccagaatatactggtccctagaccaggcttttccctctacaaaactctggcagaatctatgggaattgaggtgaaactttacaacctcttgcctgaaaagtcatgggagatcgatcttaagcaacttgagtaccttatcgatgagaaaactgcatgtttgatagttaacaaccccagcaatccttgcggtagcgtgttctccaagagacatctgcaaaagattcttgccgtggccgcacggcagtgtgtgccaatcttggctgacgaaatctacggagatatggtctttagcgattgcaagtacgaaccacttgcaacgctgtcaaccgatgtgcccatcctctcctgtggtggtctggcaaagcgttggctggtgcctggatggcgacttggctggattcttatccatgacaggagggacatattcgggaacgagattagagatgggctcgttaagctctcgcaacggattctggggccctgtacgattgtgcagggggcccttaagtccattctgtgtcggacccctggagaattctaccataacacgctcagcttcctcaagtcgaatgccgatctgtgttacggtgcacttgccgcgattccaggacttcgtcccgtgcgccctagcggtgcaatgtatttgatggtgggaattgaaatggaacacttcccagaatttgaaaacgatgtggaattcacggaacgcctggtcgccgagcaatcagtgcattgtctcccggccacttgtttcgaataccccaactttatccgagtggtgattaccgtccctgaagtcatgatgctcgaggcctgttccagaatacaggaattttgcgaacaacattaccattgcgcagagggatcacaggaagaatgcgacaag

SEQ ID NO: 20661 - DNA, 1362 bp, Artificial Sequence
  Description of Artificial Sequence: Synthetic coding sequence
atggacccttatatgatacagatgtctagcaaaggaaacctaccgagtatcttagatgttcatgtcaatgtgggagggcgcagtagcgtccccggaaagatgaagggccgtaaggctaggtggagcgtgaggccctcagatatggcgaagaaaacgtttaatcccatcagggcaatcgtcgacaatatgaaagtgaagcctaaccccaacaaaaccatgatctctctctccatcggagatcctaccgtgtttggtaacctgcctacggaccctgaggtgacccaagccatgaaggacgccctggactccggcaagtataatggctatgccccctctattgggttcttgtcctcccgcgaagagatcgccagctattaccattgtcccgaggctcctctggaagccaaggacgttattctgacatcgggttgcagccaggccatcgacctgtgcttagcagtgctagccaaccccggccagaatattttggttccccgaccaggattcagcctgtataagacacttgcggagagcatgggtatagaggtgaaactgtacaacctgctgcctgagaaatcatgggagatcgacctgaagcagctggaatacctcatcgacgagaagacagcctgtcttatcgtgaacaatcccagtaacccctgtgggagcgtgttttccaagcgacacctgcaaaagatcctcgcggtggcagccaggcagtgtgtgcccatcctggctgacgaaatctacggggacatggtgttctctgactgtaagtacgagcccctcgcaacactgagcaccgatgtgcccatcctttcatgtggaggcttggctaaaaggtggctggtaccgggatggagactgggctggattctaatccatgacaggagggatatattcggaaatgagatacgcgacggcctagtcaaactgtctcagcggatactcggtccctgtactatcgttcagggggcactcaagagtatcctgtgtaggactcctggcgagttttaccacaatacactgagtttcctgaagtccaacgccgacctctgttacggtgcacttgccgccatccccggcctgaggccagtgaggccaagcggtgcaatgtacttgatggtggggattgaaatggaacattttcccgagtttgaaaatgacgttgagttcactgagcggttggtggcggagcaatcagtgcactgcttgccggccacatgttttgaatacccgaattttatccgcgtcgttatcacagtccccgaagtaatgatgctcgaggcctgttctcggattcaggagttctgcgagcagcactatcactgtgccgaaggaagccaggaagaatgtgataaa

SEQ ID NO: 20662 - DNA, 1362 bp, Artificial Sequence
  Description of Artificial Sequence: Synthetic coding sequence
atggacccttacatgatccaaatgtctagcaagggcaatctcccctctatcttggacgtccatgttaacgtgggcggcaggagttccgtgccaggtaagatgaaggggcgcaaggcccggtggtccgttcgaccaagtgacatggccaagaagacctttaatcccataagggcaattgtggataacatgaaggtgaaacccaatcccaacaaaactatgatcagtctgtccatcggagatcctactgtgttcggtaatcttccaaccgacccggaggtgactcaggccatgaaagacgcgttggactccgggaagtacaacggctatgcaccatcaatcggcttcctgagctctagagaagagattgcatcatattatcactgcccagaggccccattggaggccaaggacgtaatcctgaccagcggctgctcccaggcaattgacctctgtctggcagtcctggcgaaccccggtcagaatatcctagtgccccgtcctgggttttctctgtataagacattggccgagagtatgggtatcgaggttaagctgtacaaccttctgcccgagaagtcttgggaaatcgatcttaagcagctggagtacctgattgacgaaaaaactgcttgtctgattgtcaataatcccagtaacccatgcggtagtgtcttcagtaagcgccacctgcagaaaatcctcgcagttgccgcccggcagtgcgtgccgattctggcggatgagatatacggcgacatggtgttttctgattgtaaatacgagccgctggcgacgctgtcaaccgacgttcctatcctgtcctgtggcggccttgccaagcgttggttggtcccaggatggagactcggatggatactcatacacgaccgccgtgatattttcggaaacgaaatccgggatggcctcgtgaaactgagccagaggatcttagggccctgtaccatcgtacaaggcgccctgaagtctattctctgccgcactcccggagagttttatcacaatactctctctttcctcaaaagtaacgccgatctgtgctatggagcgttggctgctattcccgggcttaggcccgtgcggccatcaggcgcgatgtacttgatggtcggcattgagatggagcattttcctgaattcgaaaatgacgttgagttcaccgaaagactcgtggccgagcagtccgtacactgtctcccagccacctgtttcgagtatcccaacttcatccgtgtggtgataacagtccctgaggtgatgatgctggaggcttgctctcgcatccaagagttttgtgaacagcactaccactgcgcagagggttcacaggaggagtgcgataaa

SEQ ID NO: 20663 - DNA, 1362 bp, Artificial Sequence
  Description of Artificial Sequence: Synthetic coding sequence
atggatccatatatgatccagatgtcttccaaggggaatctgccttccatactggacgtgcatgttaatgtgggtggtagaagttctgtccccggtaagatgaaaggcaggaaggccagatggtctgtaaggccgtctgacatggccaagaagactttcaacccgatacgcgccatagtggataacatgaaagtgaagccaaaccccaataagacaatgatttctttgtcaataggcgacccaacagtgttcggcaatctccctacagatcctgaggtcacgcaggctatgaaggatgccctcgattcaggcaaatataacggatacgctccgagcatcggatttctgagcagccgagaggagattgcttcctactaccactgccccgaggcacccctggaagcaaaagacgtaatcctcacctctgggtgcagccaagccatcgacctttgtctggccgtactggccaatccaggacagaacatcctggtgccccgcccaggattttctctctataagactctggcagaaagcatgggcatagaggtgaaattgtacaacctgttgcccgaaaaatcatgggaaatcgacctgaagcagctggagtacctgattgacgagaaaaccgcgtgcctcattgtgaataatcctagcaacccctgcggctcagtgttcagcaagcgccacttgcaaaagatacttgccgtggccgcccgccagtgtgtcccaattctggcggatgagatctatggagacatggtgttctcagactgcaaatacgagccgctggcaactctgtccactgacgtgcccatactgagctgcggcgggctcgccaagcgatggctcgtccccggttggagactgggctggattctcattcacgatcggagggatatcttcggaaacgagatccgggatggtctggttaagctttcacaaaggattctggggccctgcaccatcgtgcagggcgctctcaaatcaatcctgtgtcgcaccccgggagaattctaccacaacacactgtcatttcttaaaagcaatgctgatctgtgctacggagcgctggctgcaatccctggattgcggcccgtcagaccctcaggagccatgtatcttatggtcggcatcgagatggaacacttcccggagttcgaaaacgacgttgagtttactgagcgactcgttgccgagcaatctgtccactgcctccccgcgacatgcttcgaatacccaaatttcatccgagttgtgatcaccgtgcctgaggtgatgatgctcgaggcgtgcagcaggatacaggagttttgcgaacagcactaccactgtgcagagggcagtcaggaggagtgtgacaag

SEQ ID NO: 20664 - DNA, 1362 bp, Artificial Sequence
  Description of Artificial Sequence: Synthetic coding sequence
atggacccatacatgattcaaatgtcctccaagggcaacctacctagcatacttgacgtacacgttaatgtaggaggtagatctagcgtccccggcaaaatgaaggggcgtaaagcgcgctggtctgtgaggccttctgatatggccaagaagacatttaacccgatccgagctattgtagataacatgaaagtgaagccgaatcctaacaaaactatgatcagtttaagcataggagatcctaccgttttcgggaacctgccgaccgaccctgaagtaacacaagccatgaaagatgccctcgatagcgggaagtacaatggttatgcccccagtatcgggtttctgtcatctagagaagagatcgcctcgtattaccactgtccagaggctcctctcgaagccaaggacgtgatcttgactagcggctgttctcaggcaatcgacctgtgcctggccgtgctggcgaatccgggccagaacattttagttcctcgtcccggcttctcgctgtacaaaaccctggcagaatctatgggcattgaggttaagctatacaatttactgccggaaaagtcatgggaaatcgacctgaagcaacttgagtaccttatcgacgaaaagactgcatgcctgatcgtgaacaaccccagtaatccctgcggctctgtgttctctaaaagacatttacaaaaaatcttggccgttgccgctcgtcaatgtgtgccaattctggctgacgaaatctacggtgatatggtgttctccgattgcaagtacgagccactggccaccttgtccactgacgttcctatcttatcctgcggcgggctggccaagcgctggctcgtcccagggtggaggctcggatggatcctgatacacgaccggagggacatcttcggcaatgagatccgcgacggcttggtaaaactgtctcagaggatcctcggcccctgtaccatcgtccaaggtgctctgaagtcaattctgtgtcgaacccctggggagttctatcacaatactcttagctttctaaagtccaatgcagacctgtgttacggagctctggccgccatcccagggctacgacccgtgaggccttctggcgcaatgtatttgatggtcggtatagaaatggagcacttccctgagttcgagaacgatgtggagtttacagagcgcctagtagctgagcagtcagtgcactgcttacctgctacctgcttcgaatacccgaattttatccgggtggtcatcacagttccagaagttatgatgctcgaggcctgtagccgcattcaggagttttgtgagcagcattatcattgtgccgaagggagccaggaggagtgtgataaa

SEQ ID NO: 20665 - DNA, 1362 bp, Artificial Sequence
  Description of Artificial Sequence: Synthetic coding sequence
atggatccctacatgattcagatgtcctccaaaggaaatttaccctccatactcgacgtccacgtgaatgtggggggtcggagctccgtgccagggaaaatgaaggggaggaaagcccgttggagcgtgaggccatctgacatggcgaagaagacttttaatcctattcgagcaatcgtggataacatgaaggtgaaaccaaaccctaataagacgatgatttctctttctatcggggacccgaccgtctttgggaacctgcctaccgatcccgaggttactcaggctatgaaggacgctttagactctggcaaatacaatggctacgcaccaagtatagggtttctctcctctagagaggagatcgccagctattatcattgtccagaagcacccctggaggcaaaggacgtaattctgacatcaggctgtagtcaggcaatagatctatgtctggcagtgcttgccaacccaggccagaatatcctggtgcctaggcctgggtttagcctctacaagaccctggccgagtccatgggaatagaagttaagctgtacaatctgctccctgagaaatcctgggagattgatttgaagcagctcgaatacttgatcgatgaaaagaccgcgtgcctcattgtgaacaacccatcaaacccttgcgggagtgtcttttctaagagacacttacaaaagatactggcggtggcggcacgacaatgtgttcccatcctggcagatgagatctacggcgatatggtcttttcagactgcaagtatgaacctctggctactctgtcaaccgacgttccaattctctcttgcgggggcctcgcaaaaagatggctggtgccaggttggagactcggctggattttgattcacgacagaagagacatcttcggaaatgaaataagggacggactcgtaaaattgtcccagcgtattctgggtccctgtacaatagtgcagggcgctttgaagtccatcctgtgtagaaccccaggggagttctaccataataccctgtccttcctgaaatcaaacgctgacctatgttacggggcactggcggcaatcccaggtctgcgccccgtccgacctagtggggcgatgtatctgatggtgggaattgaaatggagcacttcccggaattcgaaaacgatgtggaatttaccgagaggctggtcgccgagcagagcgttcattgtttacctgcaacttgtttcgagtatccgaactttattcgagtggtcatcaccgtacccgaggtcatgatgttggaagcttgctccaggattcaggagttttgcgaacagcactatcattgcgccgaagggtctcaggaagaatgtgataag

SEQ ID NO: 20666 - DNA, 1362 bp, Artificial Sequence
  Description of Artificial Sequence: Synthetic coding sequence
atggatccttacatgatccagatgtcctccaagggtaatttgccgtcaatactcgacgtgcatgtgaatgtggggggtcggagttctgtgccaggaaagatgaagggaagaaaagctcgatggtcggtcagacctagcgatatggccaaaaagactttcaacccgatccgcgcgatcgtcgataacatgaaggtgaagcccaatccaaacaaaaccatgatttccctctcgatcggggaccccaccgtgttcggtaaccttccgactgatcctgaggtcactcaggcgatgaaggacgccctcgactcagggaagtacaacgggtacgccccgtcgatcggcttcttgagctcacgggaagaaattgcgtcctactatcactgcccagaggctccgctcgaagcgaaggatgtcatcctgacctccgggtgctctcaggctatcgatctgtgcctcgccgttctggccaatccaggacagaacatcctggtgccacggccgggattctctctgtacaaaactcttgcggaatcaatgggaatcgaggtcaagctctacaacctgctcccggaaaaaagctgggaaattgatctgaagcaactggaatacttgatcgatgagaaaaccgcctgcttgatcgtcaacaatccgtcgaatccgtgcggaagcgttttctcgaagcgccacctccagaagatcctcgctgtggctgcccgccaatgcgtgcctatcctggcggacgagatctacggagatatggtgttttccgactgcaagtatgagccactggccactctttccactgacgtgcccattctttcgtgcgggggtttggcaaagcggtggttggtgcccggatggcgccttggttggatcctgattcacgatcgccgggacatttttggtaacgaaatcagagatggactggtgaaactctcgcagcgcatcctcggaccatgtaccatcgtccaaggcgcgctcaaatctatcctctgtcggactcctggagagttctaccataataccctgtccttcctgaagtcgaacgccgacctgtgctacggcgccctcgccgcgatcccgggtttgcgcccagtgcgcccgagcggcgccatgtacctcatggttgggatcgagatggaacacttcccggagttcgagaacgacgtcgagtttactgagcggctcgtggccgagcaatccgtccactgcctgccggcaacttgtttcgagtaccctaactttatccgcgtggtcatcacggtgcccgaggttatgatgctcgaggcgtgctcgcggatccaggaattctgcgaacagcactaccattgtgctgagggatcccaggaagagtgcgacaag

SEQ ID NO: 20667 - DNA, 1362 bp, Artificial Sequence
  Description of Artificial Sequence: Synthetic coding sequence
atggatccatacatgatccagatgagcagtaaaggcaacctcccctcgattctggacgtgcacgtgaacgtgggcggacgcagttccgtcccaggtaaaatgaaggggcggaaggctaggtggagtgttcgcccatccgacatggcgaaaaaaacgtttaatcctatccgggccatcgtggataatatgaaagtcaagcccaacccaaacaagaccatgattagccttagcattggtgacccaacggttttcggcaatcttcccacagatccagaagtgactcaggccatgaaagatgctctggacagcggcaagtataatggatatgcaccctccattggattcctatcatcgcgcgaggagattgcttcatactatcattgccccgaggctccactggaggctaaagatgtcatcctgacatcaggatgttcccaggccatcgatctgtgtctagccgtcttagcaaaccccggtcaaaacatccttgttccccgacccgggttttctctgtataaaacacttgccgagtcaatgggcatcgaagtcaagctctacaatttactacctgagaagtcctgggaaattgacctgaagcagctcgagtacctgatcgatgagaagacagcctgtctgattgtgaataacccttctaatccctgcggtagcgtattcagtaaacgacatctgcagaagattttggcggtcgctgcacggcagtgcgtcccaatcctggccgacgagatttatggtgatatggtgttttctgactgtaagtacgagccactggctaccctctctacagacgttcccattttgtcctgcggaggcctcgccaagagatggcttgtacccggatggaggctcggctggatcctgatccacgacagacgagatatattcggaaatgaaattagagacggtctggtcaagctgtctcagcgaatcctagggccctgcaccatcgtgcagggggcattgaagtcaatcttatgtaggacacctggagagttctaccacaacacactttcatttctgaaatctaatgctgatttgtgctacggagcccttgcagcgattcctggactaaggccagtaagaccgagcggcgctatgtatctaatggtgggcatcgaaatggaacactttccagagttcgagaacgacgtggagttcaccgagcgtctagtggcagaacagtcggtgcactgcctgccggctacgtgcttcgagtacccaaactttataagagttgtgattacggttcccgaagtgatgatgcttgaggcctgtagccgcattcaggaattttgtgagcagcattatcactgcgccgagggctcacaagaggaatgtgataaa

SEQ ID NO: 20668 - DNA, 1362 bp, Artificial Sequence
  Description of Artificial Sequence: Synthetic coding sequence
atggatccgtacatgatacaaatgtcctcgaagggcaatttgccatcaattctggatgtccatgtcaacgtcggaggacgttcatcagtgccggggaaaatgaaaggtagaaaggccagatggagcgtgcggccttcggatatggcgaagaaaacttttaacccaatccgcgcaatagtagacaatatgaaggtcaagccaaaccccaacaaaaccatgatatccctctcaatcggtgatcctaccgtgttcggtaacctgcctaccgacccagaagtgacccaggccatgaaggatgcactggattccggtaagtacaacggttacgccccctcaatcggatttctgtcatcgagggaggaaattgcatcctactaccattgcccagaggcacctcttgaggccaaggatgtcattctcacctcagggtgttcacaagctattgacctgtgtcttgccgtcctcgcaaatcctggacagaatattcttgtgcctagacctggattttcgctctacaaaaccctcgccgagtcaatggggattgaagtgaagctgtacaatctcctgcctgaaaagagctgggaaatagatttgaagcaactggagtacctcattgacgagaaaaccgcgtgtctgattgtcaataacccatccaatccttgtgggtcggtgttttcgaagcgccatcttcaaaagattcttgccgtggcggcgaggcagtgcgtccctatcctcgcagatgagatttatggggacatggtgttcagcgattgcaagtatgagccccttgcaacgctctcaacggacgtgccaatcctctcatgcggaggacttgcaaaacgttggctggtgcccggatggcgtcttggttggatcctcatccacgacaggcgcgacattttcgggaacgaaatcagagacggacttgtcaagctcagccaacggattctcggcccatgtactatcgtgcaaggagcactgaaatccatcctctgtaggaccccaggtgaattctaccacaacactctttcgttcctcaagtcgaacgcagatctttgttacggagcactggcggccattcctggactgcgccctgtgcgcccatcgggagcaatgtaccttatggtcggcattgaaatggaacacttcccagaatttgagaatgatgtggaattcactgaacgcctcgtggcggaacaatccgtgcattgtctgccagccacctgttttgagtacccaaactttattcgggtggttattaccgtccccgaagtgatgatgcttgaagcatgttcccggatccaggagttctgtgaacaacactaccattgcgccgagggctcccaagaggaatgtgataag

SEQ ID NO: 20669 - DNA, 1362 bp, Artificial Sequence
  Description of Artificial Sequence: Synthetic coding sequence
atggatccgtacatgattcagatgagttccaagggaaatttaccctccattctcgatgttcatgttaatgtcggcggacggagctctgtccccggaaaaatgaaagggcgtaaggcgcggtggtctgttcggcctagcgatatggcgaaaaagacatttaatcctatcagagcgattgtggacaatatgaaagttaaaccgaatccaaataagactatgatatccctctcaattggcgatccaacggtatttggcaaccttccaacagatccggaagttacccaggcgatgaaagatgcactcgattctggaaaatataatggatacgcgcctagcatcggatttttgtcctcacgagaagaaatagcgtcgtactaccactgccctgaagcaccgctagaggcaaaagacgtaattttgacatcaggatgcagccaagcgattgatctttgtttggccgtgttggccaatccaggtcaaaatatccttgtgccgcggccgggtttctctctctataaaacgcttgcggagagcatgggaatcgaggttaagttatacaatttgctcccggaaaaaagctgggaaatcgacctcaaacaactcgaatatttgatagatgagaaaacggcatgtttgattgtaaataatccgagtaatccgtgcggaagtgtgttctctaaaaggcatctgcaaaaaattcttgcagtcgcagcgagacaatgcgtgccgattttagctgacgagatctatggggacatggtgttttcagattgcaaatacgaaccgttagccacactgtctacggacgtccctatattgagctgtggcggcctagcgaaacgctggttagtgccgggctggagacttggatggatactcattcatgatcgcagagatatttttggtaatgaaatacgcgatggtctggtcaagttgtcccaaagaatccttggaccgtgcactattgtccaaggagcactcaaatctattttatgccgcactcctggcgaattttaccataatacattgtcttttctaaagtctaatgctgatctgtgctacggcgcgcttgcagccatcccggggctgagaccggtccgcccttctggcgcaatgtatctgatggtagggattgaaatggaacactttccagagttcgaaaatgacgtggaatttaccgagcggttagtagcagagcagtcggtgcattgtcttcctgcaacctgtttcgagtaccccaattttattagggtcgttattacagtaccggaggtcatgatgttggaagcttgctcccgcattcaagaattttgcgaacagcactatcattgtgcggaagggagtcaagaagaatgtgataaa

SEQ ID NO: 20670 - DNA, 1362 bp, Artificial Sequence
  Description of Artificial Sequence: Synthetic coding sequence
atggatccctacatgattcagatgagtagcaagggcaatttaccttcaatcctagatgtccacgttaatgtgggaggtagatcatccgtgccaggaaagatgaaaggccgcaaggcccgctggtctgtgcgcccgtccgatatggccaagaagacctttaacccaatccgcgccatcgtggacaatatgaaggttaagccaaacccaaataaaacaatgatttcgctatctattggcgatcctacagtgttcggaaacctgccaaccgatcctgaggtgacccaggccatgaaagatgcgctcgactctggaaaatacaacggatacgctccctccatcggcttcctgtccagccgggaggaaatcgcctcttattatcactgcccagaggccccgcttgaagctaaagatgtcatactaacttcaggctgttcacaggccatcgacttgtgtctggctgttctggcaaacccagggcagaatattctcgttcccaggcccggattttctttatataagacccttgccgagtccatgggtattgaggtgaaactttacaatttgctgcctgagaaatcgtgggagattgatctgaaacagctggagtatttaatagacgaaaagactgcctgtctgatagtcaataatccctctaacccctgtggctccgttttcagcaaacgacatctgcagaaaattctggcggttgcagcgcgacaatgtgtgcccattctcgccgacgaaatatacggtgacatggtcttttcggactgcaagtacgaacccctggctactctctccaccgatgtccccattcttagttgtgggggtctggccaaacggtggctggtgcccggctggcggttgggatggatattgattcacgatcgaagggacatctttgggaacgagatacgggacggactcgtgaaactgagtcaacggatactgggaccctgcacgatcgtgcaaggcgcccttaagtcaatactttgtaggacccctggagagttctaccacaacacattgtccttcctcaagtcaaacgcggacctatgttatggcgcccttgccgcaattcccggcctgcggcctgtgcggccctccggggctatgtatctaatggtgggcattgagatggagcatttcccggagttcgagaacgacgtggagttcaccgaacgtttagtggctgagcaatccgttcattgtcttcctgctacctgtttcgagtatcctaactttattcgggttgtgattacagtgcccgaggtcatgatgctcgaggcttgttcacgtatacaggagttttgcgagcagcattatcattgcgcagaggggtctcaggaggagtgtgacaag

SEQ ID NO: 20671 - DNA, 1362 bp, Artificial Sequence
  Description of Artificial Sequence: Synthetic coding sequence
atggatccatacatgatccaaatgtcctcgaaaggcaacctgcctagcattctggatgtccacgtgaatgtgggtggtcggtcatccgtccctggaaagatgaagggacgcaaggcacggtggtccgtgaggccgtccgatatggcaaagaaaacgttcaacccgatccgcgctatcgtggacaacatgaaggtcaaaccgaaccccaataagaccatgatatctctcagcatcggcgaccctacggtatttggaaacctgccaactgaccccgaagtgacccaggcgatgaaggatgctctggattcaggaaagtacaacgggtacgcgccgagcatcggctttttgagctcgcgcgaggagatcgcctcctactaccattgcccggaagcacccctcgaagcgaaagacgtgatcctgacttcgggatgttcccaagccatcgacctttgtttggccgtgctcgcgaatcctggacagaatatcctggtgccaaggccagggttttcgttgtacaagacccttgcagagtcaatgggaatcgaggtcaagctctacaacctcctgccggagaaatcgtgggaaatcgatctgaagcagctggagtacctgatcgacgaaaagaccgcctgccttatagtgaacaatccgtcgaatccgtgcgggtccgttttctcaaaacggcacctgcaaaagatccttgccgtcgctgcacgccagtgcgttcctatcctggcggatgagatctacggggacatggtgttcagcgactgcaagtatgagccactggctactctgtcaacggacgtcccgatcttgtcctgcggtggcctggctaagagatggctggtgcctggatggcggctgggatggatcctgatccacgaccgccgggacatatttggtaacgaaatccgggacggactcgtgaagctcagccaaaggattctcgggccctgtaccatcgtgcagggggccctgaagtcgattctctgccgcaccccgggcgagttttaccacaacaccctttcattccttaaatccaatgccgatctgtgctacggtgcgctcgcggccattcccggcctgaggccggtccgaccatcaggagccatgtaccttatggtcggtattgaaatggagcatttcccggaattcgaaaacgacgtggaattcactgagaggcttgtggctgagcaaagcgtgcattgcctgccggcgacttgcttcgagtaccctaacttcattcgcgtggtgatcactgtcccggaagtgatgatgcttgaagcctgttcgcgcatacaggaattttgcgagcagcactatcattgcgcggaaggatcgcaggaggaatgtgataaa

SEQ ID NO: 20672 - DNA, 1362 bp, Artificial Sequence
  Description of Artificial Sequence: Synthetic coding sequence
atggacccgtacatgatccaaatgtcgtcgaaaggaaatctcccatccatcttggacgtacatgtgaacgtcggcggtcggtcctccgtcccgggaaagatgaaaggacggaaggctcgttggtcggtccgcccgtcggatatggcgaaaaagactttcaatccaattcgggccatagtggataacatgaaagtgaaaccgaacccgaacaagaccatgatctccctctcgatcggggatcccaccgtctttggcaacttgccgaccgatcccgaggtcactcaggcgatgaaagacgcgctggattcgggtaagtataacggctacgccccttctatcggttttctgtcgtcccgggaggaaatcgcatcgtactaccattgcccggaggcaccactggaagcgaaggacgtcatactcacttctgggtgctcacaagccatcgatctgtgcttggccgtcctggctaatcctggacagaatatcctggtgcctagaccgggtttctcgctgtacaagactctggccgaatcaatggggatcgaagtcaagctgtacaacctgctcccggagaagtcgtgggagattgacctgaaacagctcgagtatctgatcgatgaaaaaactgcatgtctgatcgtgaacaacccgtccaacccatgtggctcggtgttcagcaagaggcacctccagaagatcctggctgtggcggcgaggcagtgcgtgcctatcctggccgacgaaatctacggtgacatggtgttctcggactgcaaatacgaaccgctggcgacgctgtccaccgatgtcccgatcctgagctgcggaggacttgccaagaggtggctcgtcccaggctggcggctggggtggatcctcatccacgaccgccgggacatctttggaaatgagatccgggatggcctggtgaagctgtcacagcgcattctgggaccatgcaccatcgtgcagggagccctgaagtcaatcctgtgtcggactccaggagagttctaccataatactctgtcatttttgaagtccaacgcggacctctgttacggagccctggctgctatccctgggcttcgcccggtccgcccctccggagccatgtacctgatggtgggaattgaaatggaacacttcccggaattcgaaaacgacgtcgaattcactgaacggctggtggccgagcagagtgtccattgcctccctgcaacttgtttcgagtacccgaatttcatcagggtggtgattactgtgcccgaggtgatgatgctggaagcatgctcccgtatccaggaattctgcgaacagcactaccactgcgcggagggcagccaagaggagtgcgataag

SEQ ID NO: 20673 - DNA, 1362 bp, Artificial Sequence
  Description of Artificial Sequence: Synthetic coding sequence
atggacccatatatgatccaaatgagctcgaaagggaatctgccctcaattctggatgttcacgtgaatgtgggcggaaggagctcagtccctggcaagatgaaaggtcggaaggcacgctggtcagttagacctagcgatatggccaagaaaacctttaatcctatcagagcgatcgtggataacatgaaggtgaaaccgaacccaaataagactatgatctccctttcgattggtgatcctactgtctttggaaacctgccaaccgatccagaggtgactcaagcaatgaaggacgcacttgactccgggaaatacaacggctacgcccctagcataggatttcttagcagcagagaagagatcgcatcctactaccattgtcctgaggcaccactcgaagcgaaggatgtcattctcacgtctggatgctcccaggccatcgacctttgtctcgcagtcctcgcaaatccgggacaaaacattctcgtgccgcggcccggatttagcctctacaagactctcgcagagtccatgggaattgaagtgaaactgtacaaccttctgccagaaaagagctgggaaattgatttgaagcaattggaatacctgattgatgaaaagaccgcatgcctcattgtgaacaacccttcaaacccatgcggctcagtgttttcgaaacgccatcttcagaaaatactcgcagttgccgctcgacaatgcgtgcctatcctggcagatgagatttacggcgatatggttttctcggactgcaagtacgaacctcttgccaccctttcgactgatgtgccaattctgagctgcgggggccttgcgaagcgctggctggtgccaggatggcgactcggttggatcctgattcatgaccgtcgcgacatttttggtaatgaaatcagagatggcctggtgaagctgtcacaacggattctcggcccctgcacgattgtgcagggagctctgaagtcaattctgtgtagaactcccggagaattctaccataacactctgtcgtttctgaaatccaacgcagacctgtgctacggagcgcttgccgcaataccagggctgcgcccggtccgcccttcgggcgccatgtacctcatggtgggcattgagatggagcacttcccggaattcgaaaatgacgtggagtttactgagagacttgtggccgaacaaagcgtgcactgcctccccgcaacctgtttcgagtacccaaactttatccgcgtagtgattactgtgccagaagtcatgatgcttgaagcatgtagccgaattcaagagttttgtgaacagcattaccattgtgccgaaggatcccaggaagagtgcgataaa

SEQ ID NO: 20674 - DNA, 1362 bp, Artificial Sequence
  Description of Artificial Sequence: Synthetic coding sequence
atggacccctatatgatccaaatgtcatctaagggaaatcttccttcaatcctcgatgtgcatgtgaatgtcggagggcgtagctcagtgcccggtaagatgaagggccggaaggcccggtggtcggtaagaccgagcgatatggcaaagaaaactttcaacccaattcgcgccattgtggacaacatgaaagtgaaacctaatccaaacaagactatgattagcctgtcgatcggggatcccaccgtgtttggaaatcttcccactgacccagaagtgacgcaggcaatgaaggacgcactggactcgggaaagtataacggctacgcacccagcatcggtttcctttcgtcgcgcgaggagattgcaagttactaccattgtccagaagcgcctctggaagccaaggatgtcattctcacctccggatgttcgcaagcaatagatctgtgtttggccgtgctggctaaccccggccagaatatacttgtccctaggcctgggtttagcctgtacaaaaccctggccgagtccatgggaattgaagtgaaactttacaatcttctcccagagaaaagctgggagatcgacctcaagcagctggaataccttattgacgaaaaaacggcgtgcttgatagtcaataacccatccaatccttgtggaagcgtgttttcgaagcgccaccttcaaaagattctggcagttgcagctaggcaatgcgtgcccattctggcagatgaaatctacggggatatggtcttttcagactgtaaatacgaaccactggcaaccctttcgaccgatgtgccaattcttagctgtggtggactcgcaaagagatggttggtgcctggatggagactggggtggatccttattcatgatcggagagacattttcggaaacgaaattcgggatggtctggtaaaacttagccaacggatcctgggaccatgtaccatcgtgcaaggtgccctgaagtccatactgtgccgcactccgggggagttttaccataacactctctcatttctgaagtcgaatgcagacctttgctacggggctttggctgcaatccccggactgaggccggttagaccctcgggtgctatgtacctcatggtcgggattgagatggaacactttccagaattcgagaatgatgtggagtttaccgaacgactggtcgcagagcagtcagtgcattgtctgccagccacttgcttcgagtaccctaacttcattagggtggtgatcacggtgccagaggtgatgatgcttgaagcatgctcaagaatacaagaattttgtgaacagcactaccactgcgcggagggcagtcaggaagaatgtgataag

SEQ ID NO: 20675 - DNA, 1362 bp, Artificial Sequence
  Description of Artificial Sequence: Synthetic coding sequence
atggacccttacatgatccagatgtcctccaagggaaatttgccctccattctggacgtgcatgtgaacgtcggaggccgaagtagtgtcccgggtaagatgaaaggtcgcaaagcgcgttggtctgtgcggccttccgatatggcgaagaaaacattcaatcccattcgcgccattgtagacaatatgaaggtaaagccaaaccccaacaagactatgatcagtttgtcaattggcgaccccaccgtgtttgggaatctgcctaccgatcccgaggtaacacaagccatgaaggacgctctggactcaggaaaatacaacggctacgccccatccattggatttctatcatcgcgagaagagatagcatcttattatcactgtcccgaggcccccctcgaggccaaagacgttatcctgaccagtggatgttctcaggccattgacctgtgtttggctgttttagccaatcccgggcagaacattctcgttccgaggcccggattcagcctgtataagacccttgccgagagcatggggattgaagttaaactctataacctcttgccggagaagtcttgggagattgatctgaagcagctggaatacctgatcgatgagaagaccgcctgcctcattgtgaacaatccaagtaatccttgtggaagcgtgttcagtaaacggcacttacagaaaatcttggcagtggcggctcgacaatgtgtgcccatccttgcagatgagatctacggggatatggtgtttagtgactgcaagtatgagccccttgccaccctatctacagatgttccgattttgtcatgtggagggctggctaagaggtggcttgttcccggttggaggctaggctggatcctaattcatgacagacgggatatctttgggaatgaaattcgagacgggcttgtcaaattatcacagcgtattctgggaccctgcaccattgtccagggggcactgaaaagcatactttgccggacccccggtgagttttaccacaatacgctctccttcctgaagtctaacgcagacctctgctacggcgccctggcggccatccccggcctgcggccagtgaggccatcgggcgctatgtacctcatggtggggatagaaatggagcattttcccgagtttgagaatgatgtggagtttaccgaacgcctggtggcagagcagagtgtgcactgtctgcctgccacctgctttgagtatcccaatttcatccgagtcgtcattaccgtcccagaggtgatgatgctggaggcatgctccaggattcaggagttttgtgagcagcactatcactgcgctgagggcagccaggaggagtgtgataag

SEQ ID NO: 20676 - DNA, 1362 bp, Artificial Sequence
  Description of Artificial Sequence: Synthetic coding sequence
atggatccatacatgatacagatgtcttcaaagggaaatctgccctccatcctcgatgtccatgtcaacgtgggaggtaggagtagcgtcccaggtaagatgaagggcaggaaggcccgctggagtgtccgtcccagtgacatggccaagaaaacttttaatcctattagagccattgtagacaacatgaaagtgaagcctaacccaaataagaccatgatcagcctgtctatcggcgatccaacagtgtttggaaatttgcccacagatcctgaggttacacaggccatgaaagatgctcttgactcaggtaagtataatggatacgcccctagcattggatttctctcctctcgtgaagaaattgcatcctattatcattgtcccgaggctcccctggaggccaaagacgtcatcttgacttctggttgcagccaagcaatcgatctttgcctcgctgtcttggctaatcctggccaaaacatcctggtgcccaggcctggcttcagcctctacaagactctcgccgagtctatgggaatcgaggtaaaattgtacaatctgctgcctgagaagagttgggagatcgacctgaaacagctggaatacctgatcgatgagaaaaccgcatgcctgattgtgaacaatcccagtaatccatgtggctctgtattctcaaaacgccacctgcagaagattctggcagtcgctgcccgtcagtgtgtcccaatcctggccgacgagatatatggagatatggtgttctccgattgcaaatacgaaccactggctactctgtctactgacgtgcccatcttgagttgtggaggtctggctaagaggtggctggtcccaggttggcgtctcggctggatcctgattcacgaccgccgcgacatctttggcaacgaaattcgcgacggccttgtgaagctttctcaacgtatcctcggaccctgcaccattgttcagggagccctgaaaagcattctctgcaggacacctggtgaattctatcacaatactctttctttcctgaagtcaaatgctgatctgtgctatggcgctttggctgccattcccggacttcgccctgtaagaccctctggagctatgtacctgatggtcggtatagagatggagcatttccctgagttcgagaacgatgtggagtttaccgagcgcctggttgctgaacagagcgtgcattgtctgcccgcaacatgctttgagtaccccaacttcattcgcgttgtgatcactgttcccgaagttatgatgctggaagcatgttccaggattcaggaattttgcgaacagcactaccattgcgctgagggttctcaggaggagtgcgataaa

SEQ ID NO: 20677 - DNA, 1362 bp, Artificial Sequence
  Description of Artificial Sequence: Synthetic coding sequence
atggatccgtacatgatccagatgtcatctaaggggaatttgccaagcatcctcgatgttcacgtcaacgtggggggccggtcgtcggtgcccgggaagatgaaaggccgcaaagcaagatggtcggtgcgcccttcggatatggctaagaaaactttcaatccaatcagagcgatcgtagacaacatgaaggtgaagccgaatccgaacaagacgatgattagcctctccatcggtgatcctaccgtttttggaaacctgcctaccgacccggaggtgactcaggcaatgaaggatgcactggactctggaaagtacaacggatacgccccttcgattggattcctgagctcgagagaggagatcgcttcgtactatcactgcccggaggctcccttggaagcaaaggacgtcattctgactagcggatgttcccaagctatcgacctctgcctggccgtgctcgcgaatcccggccaaaacatcctcgttccgcggcctggcttctcgctgtataagactctcgcggagtcaatgggaatcgaagtgaagctgtacaatctgctccctgaaaaaagctgggaaattgaccttaagcaactggagtacctgatcgatgagaaaaccgcgtgtctgatcgtgaataacccatcaaatccgtgcggatcggtgttttccaagcggcaccttcagaagatcctggcagtggccgcgcgtcagtgtgtgcccatcctggctgacgagatctacggagacatggtgttttcagactgcaagtacgaacccttggcgactctctccaccgacgtgccgatccttagctgcgggggactggctaaacgctggcttgtccctggttggagactgggatggatcctcatccacgaccgcagagacatctttggcaacgaaataagggatggcctggtgaaactgtcgcagcgcattctcggaccgtgtactattgttcagggagcgctcaaaagcattctttgccgaaccccaggagaattctaccacaacactctctccttcctgaagagcaacgcggatttgtgctacggagccctggccgctatcccggggctgaggccagtgcggccatctggcgctatgtacctgatggttggcattgaaatggaacacttcccggaattcgaaaacgatgtcgagttcacggagagactcgttgctgaacagtccgtccattgcctcccggccacctgcttcgaatacccaaacttcatccgagtcgtgatcaccgtcccggaagtgatgatgcttgaggcttgctccagaatacaggaattttgcgagcaacattaccattgtgctgagggatcccaagaagaatgcgataag

SEQ ID NO: 20678 - DNA, 1362 bp, Artificial Sequence
  Description of Artificial Sequence: Synthetic coding sequence
atggatccatatatgattcaaatgtcaagtaaaggtaacttaccaagtattttagatgttcatgttaatgtaggaggaaggtcatctgtaccaggtaaaatgaagggaagaaaggccagatggtcagttagaccatcagatatggctaaaaaaacatttaatcctattagagctattgtagataatatgaaagttaaacctaatccaaataagactatgataagtttatctattggtgatccaacagtttttgggaatcttcctactgatccagaagtaacacaggctatgaaggatgcattagatagtggtaaatataatggttatgcaccatcaataggttttctaagttctagagaagaaattgcatcatattatcattgtccagaagctccacttgaagctaaagatgtaattttaacaagtggttgttctcaagctattgatttatgtttagctgttttagctaatcctggtcaaaatatattagttccaagaccagggttcagtttatataagacattagcagaatctatgggtattgaagttaaattatataaccttcttccagaaaagagttgggaaattgacttaaagcaattggaatatcttattgatgaaaagacagcatgtttaatagttaataatccatccaatccatgtgggtcagttttttctaaaagacatcttcaaaaaatattagctgttgctgctagacaatgtgttccaattttagcagatgaaatttacggagacatggttttttcagactgtaaatatgagccattggctactttgtcaactgacgttccaattctttcttgtggaggtttagctaaaagatggcttgtaccaggatggagacttggatggatattaattcatgatagaagagatatttttggaaatgaaattagagatggattagttaaattatcacaaagaatacttggaccatgtactattgttcaaggagctttaaaatcaatattatgtcgtactccaggagaattctatcataatactttatccttcttaaaatcaaatgcagatttatgttatggtgcacttgctgctattccaggattacgaccagttagaccatcaggagctatgtatcttatggttggtatagagatggaacacttccctgaatttgaaaatgatgttgaatttacagaaagacttgttgcagaacaatcagtacattgtttaccagcaacttgtttcgaatatcctaattttattcgtgttgttattactgttcctgaagttatgatgttagaagcttgttcacgtatacaagaattttgtgaacaacattatcattgtgcagaaggatctcaagaagaatgtgacaaa

SEQ ID NO: 20679 - DNA, 1362 bp, Artificial Sequence
  Description of Artificial Sequence: Synthetic coding sequence
atggacccatacatgatccagatgtcctcaaaagggaatctgccctccatcctggatgtgcacgtgaacgtgggagggcgcagtagcgtgcccggcaagatgaagggacggaaggcccggtggagcgtaaggcccagcgacatggcaaagaagacatttaacccaatcagagccattgtggataatatgaaagtaaaaccaaaccccaacaaaactatgatttcactctctataggggaccccaccgtgtttggaaatctcccaacagatccagaagtgactcaagctatgaaggatgccttagattccggcaagtataacggttatgccccttcaattggcttcctcagcagtcgcgaagaaattgcctcatactatcactgtccagaagctccgctagaggcaaaagacgtgattctgacttcaggatgctcacaggcaatcgacctctgcctcgcggtcctcgccaatcccgggcagaatatcctagtacccagaccgggtttcagtctgtacaaaactctggcagaatccatgggaattgaagttaaactttataatctcttgcctgagaagagttgggagatagatctgaagcagctcgagtatctcattgacgagaaaaccgcatgtctgatagtcaacaatccctccaatccttgcggctcggtgttcagtaaacgccaccttcagaaaatactcgccgtcgcagcacggcagtgcgtgcctattcttgctgacgagatctatggggacatggtcttttcagattgtaagtacgaacccctggccaccctttctaccgacgtcccaatactgtcatgcggtggcctcgctaagcgctggcttgtccctggctggcgtctgggctggatactgattcacgatagacgggatatctttgggaatgagatccgggacgggctggtgaaactctcacaacgcattctgggcccttgtaccatagtgcagggcgctctcaagtctatcttgtgccgcacccctggcgagttctaccataatacactatcctttctcaagagcaacgccgatctctgctatggggcccttgcagcgattccagggctgagacctgtgcgaccgtctggcgccatgtacctcatggtgggcattgagatggagcacttcccggagttcgaaaatgatgtcgaattcacagagcgtcttgtagctgagcagtcggtccactgtctgccggcaacctgttttgagtatcccaatttcatacgcgtcgttatcactgtgccagaggtgatgatgctcgaggcatgcagtcgaattcaggaattctgcgagcagcattatcactgcgccgaaggaagtcaggaagagtgtgataaa

SEQ ID NO: 20680 - DNA, 1362 bp, Artificial Sequence
  Description of Artificial Sequence: Synthetic coding sequence
atggatccgtacatgatccaaatgtcgtccaagggtaatctgccttctatcctcgacgtccacgtgaacgtgggaggacgctcctcagtgcctggaaaaatgaagggccggaaggcacgctggagcgtgcgcccttcggatatggcgaagaaaacctttaacccgatcagagccatcgtggataatatgaaggtcaagccaaaccccaacaagactatgatctcgctctccatcggagatccgaccgtgtttggaaatctgccaactgatccagaagttacccaagcaatgaaggacgcgcttgactcgggaaaatacaacggatacgctccatctatcggtttcctgtcatcgcgggaagaaatcgctagttactaccactgccctgaagctccccttgaagcgaaggacgtgatcctcacctcgggatgcagccaggccatcgacctgtgcctggcggtgttggcaaacccgggacagaacattctggtgccgcggccaggcttcagcctgtacaaaactttggccgagagcatggggatcgaggtcaaactgtacaaccttttgccggagaaatcctgggaaattgacctcaagcaactggagtatctcattgatgaaaagacggcgtgcctgattgtgaacaatccgagcaatccctgtggcagcgtgttcagcaagcggcacctgcagaaaatcctggccgtcgcggcccgccaatgcgtgccgatccttgccgatgagatctacggagacatggtgttctccgattgcaagtacgagcctctcgccactctgtcgaccgacgttccaattctgtcatgcggcgggctggctaagagatggttggtgccggggtggcgcctcggatggatcctgatccatgatcggagggacatcttcggaaacgagatccgagacggactggtgaagctctcccagagaatcctgggtccgtgtaccatcgtccagggagcactgaaatcgatcctctgccgcactcctggcgagttttaccacaataccttgtcgtttctgaagtcaaatgctgacctctgttatggcgccctcgcggccatccctgggctgcgtccggtacgcccgtcaggggcaatgtacctcatggtcggtatcgagatggagcatttccccgaattcgaaaacgacgtcgaattcaccgagagactggtcgccgaacaatcagtgcattgcctcccagccacttgtttcgagtacccaaacttcataagggtggtcattacggtgccggaagtgatgatgctggaggcatgctcccggatccaggaattctgcgaacagcattaccactgtgccgaaggctcccaggaagagtgcgacaag

SEQ ID NO: 20681 - DNA, 1362 bp, Artificial Sequence
  Description of Artificial Sequence: Synthetic coding sequence
atggatccctacatgatccaaatgagcagcaaaggcaacctgccctcaattcttgacgtacacgtgaacgtgggcggacggtcatcagtcccagggaaaatgaagggaagaaaagctaggtggtctgtgagacctagtgacatggcaaaaaaaactttcaatcctatcagagctatagttgataatatgaaggtgaagccaaatccgaataagacaatgatcagtttgtcaataggcgaccccactgtcttcggaaatttgcccaccgaccccgaagtgacacaagccatgaaggacgcgttggacagcggtaaatacaatgggtacgcccccagcattgggtttttgtcatctagggaggaaatcgcgtcatattatcattgtccagaggctcccctggaggccaaagatgtgattctaacttcaggctgctcgcaggccatagatctgtgtctggctgtgcttgctaatcctggccagaacatcttggtgccccgacccggcttttcattgtataaaaccttagccgagtctatgggtattgaggtgaagctctacaatctactgccggagaaatcatgggaaattgatctgaagcaactggagtatctgattgacgagaagaccgcatgcctcatcgtaaataatccttccaacccgtgtggcagtgttttttctaaaagacaccttcagaaaatcctagctgtcgccgcccggcagtgtgtgccaattttggcggacgaaatctatggggatatggtgttctctgactgcaaatacgaaccgttggcaactctgtctaccgatgtgcccatattatcttgtggcggactggccaagagatggctggtcccgggctggagactaggttggattttgatccacgacaggagggacattttcggtaatgagattcgagacggactcgtaaaattatctcagagaatacttgggccatgtactattgttcagggtgccctaaaatcgattctgtgtcgtactccaggggaattttatcacaatactctgtcttttctgaagagcaacgctgatctttgctacggcgccttggccgccattcccggtctacgaccagtgcggccgtcaggtgcaatgtatctgatggtcgggatagagatggaacattttccagagttcgaaaacgacgtggagttcactgaaagactcgtagccgagcagtctgtgcattgtctccccgctacttgcttcgaataccccaattttattcgcgttgtgataacagtgcccgaggtgatgatgcttgaggcctgcagccgcatacaggagttctgcgagcagcattatcactgcgctgaggggagccaggaggaatgcgacaaa

SEQ ID NO: 20682 - DNA, 1362 bp, Artificial Sequence
  Description of Artificial Sequence: Synthetic coding sequence
atggacccttacatgatacagatgagcagcaagggaaatctgcctagcatccttgacgtgcatgtcaacgtcggaggacgttcgagcgtgccaggaaaaatgaagggtcgcaaggccaggtggtccgtcagaccttcagacatggcaaagaaaaccttcaaccctatccgcgcgatcgtggacaacatgaaggtgaagcccaatccgaataagaccatgatcagcctgtccatcggcgacccgactgtgttcggcaacctgccgaccgacccggaagtgacccaagcaatgaaggatgccctggactctggcaagtataatggatacgcgccgagcatcggcttcctttcctcacgcgaggagattgcttcgtactaccactgcccagaagccccattggaagccaaggatgtgattctcacctccgggtgctcacaggccattgacttgtgcctggcggtcctcgccaacccaggacagaacatcctggttccgcggccggggtttagtctgtacaagaccctcgcggaatcgatgggaatcgaagtcaaactgtacaacctgctgcccgagaagtcctgggaaatcgatctgaagcagctggagtacctcatcgacgagaaaactgcatgcctcattgtcaataacccgtcgaacccatgcggatccgtgttctcaaagaggcatctccagaagatcctggccgtggcggcacggcaatgtgttccaatcctggctgacgaaatctatggagacatggtgttctctgattgcaaatacgaaccgctggcgactctgtcgactgatgtgcccatcctgtcgtgtggtgggctggccaaaagatggttggtgcccggctggagacttgggtggatactgattcacgacaggcgcgacatcttcggaaacgagatccgtgatggtcttgttaaacttagccaaagaatcttggggccgtgtactattgtgcagggtgcccttaagtctatcctctgccggactccgggggaattctaccacaatacgctgagcttccttaagtcaaatgcagatctgtgctacggagccctggcagcgattccgggactccggccagtaagaccgagcggagcgatgtacttgatggtgggtatcgaaatggagcattttcctgaatttgagaacgacgtcgagtttaccgaacggcttgtggctgagcaatccgtccactgcctgcccgctacgtgcttcgagtaccccaactttatcagagtcgtgatcaccgtgccagaggtaatgatgctggaagcctgctcgcgaatccaagaattctgcgaacagcactaccattgtgccgaaggcagtcaggaggagtgtgataag

SEQ ID NO: 20683 - DNA, 1362 bp, Artificial Sequence
  Description of Artificial Sequence: Synthetic coding sequence
atggatccatacatgattcagatgtcctcaaagggaaacctgccttcaattctcgatgtccacgtgaatgtgggtggtagaagctccgtccctggaaaaatgaaaggacgcaaggctaggtggtccgttcgcccgtccgatatggcaaaaaagaccttcaaccccatcagagcgattgtggataacatgaaagtgaagcctaatcccaacaagaccatgatttccctttcaattggggatcctaccgtctttggtaacctccccactgacccagaagtcactcaggcgatgaaagacgcactggactcgggcaagtataatgggtacgcaccttcgattggatttctctcttcaagagaggagatcgcttcctactaccattgtcctgaagctcctctggaagcaaaggacgttattctcacttcaggatgttcccaagcaattgatctctgtttggccgtgctcgcaaacccaggtcaaaacattcttgtgcccagacccggcttttctctgtacaaaacgctcgcagaaagcatgggcatagaagtcaagctgtacaacctcttgccagagaaatcgtgggagatcgatctgaagcagctggaatacctgattgatgaaaagacggcatgtctgatcgtgaacaacccgtccaatccatgcggttcagtgtttagcaaaagacatctgcagaaaatccttgcggtggcggcccgtcagtgcgtccctattttggcggacgagatttacggagatatggtctttagcgattgcaaatacgagccccttgccactctgtcgactgatgtgccgattctgtcatgtggtggactggcaaagcgctggctggtgccagggtggcgccttggttggattcttattcatgaccggcgcgatatctttggaaacgaaatcagagatggtctggtgaaactttcccaacgcatcctgggaccatgtaccattgtgcaaggggcactgaagagcatcctgtgcagaactccaggcgaattctatcataacaccctgtcctttcttaagtccaatgctgacctttgttacggggcccttgcagcaatccctggcctgcgtcctgtgcggccatcaggtgcaatgtaccttatggtgggaatcgagatggaacatttccctgaattcgagaacgatgtcgaatttacggaacgtctggtggctgagcagtcggtgcactgccttcctgccacttgttttgaataccccaacttcataagggtcgtgatcactgtgcctgaggtgatgatgcttgaagcctgctcgcggatacaggaattttgtgaacaacactaccactgtgcagagggaagccaggaagagtgtgataag

SEQ ID NO: 20684 - DNA, 1362 bp, Artificial Sequence
  Description of Artificial Sequence: Synthetic coding sequence
atggatccgtatatgatccagatgagcagcaagggaaatctgcccagtatcctggacgttcatgtcaatgtaggggggcgaagtagtgtgcccgggaaaatgaagggacgaaaagctcggtggtccgtacgaccgtccgacatggccaagaagacctttaacccgatcagagccattgtggataatatgaaagtcaagcctaaccctaataagacgatgatcagccttagcattggagatcccacagtgtttggaaatctgcccaccgatccagaagtgacccaggctatgaaggatgccctggacagcggaaaatacaatgggtacgctccatcaatcggctttctctcatcccgcgaggaaatagcttcttattaccactgtccagaggcacccctagaggccaaggacgtcatattgacctcaggatgttcccaggctatcgacctttgtctggccgtgctcgccaacccggggcaaaacatcctggtaccccgaccagggtttagcctgtacaagacactggccgagagcatggggatagaagttaagctctacaatctgctgccagagaaaagctgggagatcgacctcaagcagttggagtacctgattgatgagaagactgcctgcctcattgtcaacaacccttcaaacccatgcggaagtgtgttttcgaaacggcaccttcagaaaattttggccgtggcggcgcgtcaatgcgtgccaatcctagccgatgaaatctatggagatatggtgttttctgattgtaaatacgagcccttggctactctgtctacagatgtgcccattctcagctgcggcggactggcaaaacgctggctcgtgccgggctggcggcttggttggattttgatccatgaccgccgagacatttttggaaatgaaattcgggatggtttggtgaagttgtcccagcgaatcctgggcccatgcaccatcgtgcagggcgcgttgaagtccatattgtgcaggactccgggggagttttaccataacaccctgtcctttctaaagtcaaacgcggacctgtgttacggagccttagccgccatccccgggttgcgccccgtacggcctagcggtgctatgtatctgatggtcggaattgaaatggagcacttcccggagttcgagaatgacgtggagttcacagagaggttggttgctgagcagagtgtgcactgcctgcccgctacatgcttcgagtatccgaattttatccgcgtagtcatcaccgtgccagaggtgatgatgctggaggcttgcagtcgcatccaggagttctgcgagcaacactaccattgtgccgaaggctctcaagaggagtgcgacaag

SEQ ID NO: 20685 - DNA, 1362 bp, Artificial Sequence
  Description of Artificial Sequence: Synthetic coding sequence
atggacccatatatgattcaaatgtcaagcaagggcaatctgccttccatcttggatgttcacgttaatgttgggggtcggagttccgtgcctggtaaaatgaagggaagaaaggccaggtggagcgtgagaccttcagatatggcaaaaaagaccttcaatcctattagggcaattgtggacaatatgaaggttaagccaaatcccaacaagaccatgatttccttgagcataggcgatcctactgtattcggcaacttgccaacagacccagaggttacgcaagcaatgaaggatgcactggattcaggtaagtacaacgggtacgctccatctattggatttttgtcctccagggaagaaatcgctagttactaccattgtcccgaggctcctctcgaggctaaagatgttattttgacatccgggtgttctcaggccatcgatctctgcctggctgttctggctaacccgggtcaaaacatcttggtccctagaccaggcttttcgctctataaaacgcttgcggagagtatgggaatcgaggttaagttgtacaatttattaccagagaagtcgtgggagattgatctgaaacagcttgagtacttaatcgacgaaaagactgcctgtttaatcgtgaacaacccatccaatccatgcggctcagtgttctctaagaggcacctccagaagatcctggcagtggctgcgagacagtgcgttccaatcttggccgatgagatttacggtgatatggtcttctcggactgtaaatatgaacctttggctacattatcaactgatgttcctattctttcctgcggcggacttgcgaagcgatggttggttccaggatggagactcgggtggatccttatccatgataggcgtgatatctttgggaatgaaatccgtgacgggcttgtcaagctgagccaaaggattctggggccttgcaccatagttcagggtgctcttaagagcatcttgtgcagaacccctggtgaattttaccataacacattatcttttttaaaatcaaatgcagatctttgctacggagctcttgccgccattccgggacttcgtcccgtcagaccttctggtgccatgtatcttatggtaggaattgagatggaacactttccagagttcgagaatgatgttgaatttactgaaaggttggtcgccgagcagtcagttcactgtcttcctgcaacgtgttttgagtaccctaattttattcgggtagtcattacagtccctgaggtgatgatgcttgaagcttgctcccgcattcaggaattttgcgagcagcattaccattgcgccgaggggtcgcaggaggaatgtgacaag

SEQ ID NO: 20686 - DNA, 1362 bp, Artificial Sequence
  Description of Artificial Sequence: Synthetic coding sequence
atggatccctacatgatccagatgagctccaaaggcaatctcccaagcatcctggacgtgcacgtaaatgtcgggggccgctcctctgtgcccggtaagatgaaaggaaggaaagcccgatggagtgtccggcccagcgacatggcgaagaaaactttcaatccaattcgggctatcgtcgataacatgaaagttaaacctaatcctaataaaaccatgatcagccttagtattggcgatcccaccgtgtttgggaacctgcctaccgatcccgaagtcacccaggcgatgaaagacgcactggattctgggaagtataatggctacgcgcctagcattggttttctgtcatcccgcgaagagattgcaagttattatcactgccccgaagctcctctcgaagcgaaagacgtcatattgacttcaggctgttcacaagccatcgatttgtgtttagccgtgctggccaatcctgggcagaacattctagtgccccggcctggcttctccttgtacaagacccttgccgaatctatgggaattgaggtgaagctgtacaacctccttcccgagaaaagctgggagattgatctgaagcagctggaatacttgatcgacgaaaagactgcctgtcttatagtcaacaacccctcaaacccatgcggtagcgtcttctctaagcgtcacctacaaaagatcctggcagtggcagcccgtcagtgtgttccgatcctggcagacgaaatatacggtgatatggtctttagtgactgcaagtacgagccacttgccacgctgagcacagacgtgcccattctgtcctgcggaggactggcaaagagatggttggtgcccggctggaggctgggctggattctcatccacgatcgacgcgacatttttggcaacgaaattagggacggccttgtgaaactgtctcaaaggattctcggcccctgtacgattgtgcaaggtgccttaaagagcattctctgtcggacacctggagagttttaccacaacactctttcctttctgaagtccaatgcagatctctgctacggagcccttgcagccatacccggattgaggccggtgcgaccaagtggcgctatgtatttaatggtgggaatagagatggaacatttcccggaatttgagaacgacgtggagtttaccgaacgacttgtagcagaacagagtgtacactgtcttccagccacctgtttcgagtatcctaatttcatccgggtggtaatcacagtacctgaggtgatgatgttggaagcctgcagccgcatccaggagttctgtgagcaacactatcactgcgcggaaggcagtcaggaagagtgcgataag

SEQ ID NO: 20687 - DNA, 1362 bp, Artificial Sequence
  Description of Artificial Sequence: Synthetic coding sequence
atggatccctacatgattcagatgtcctcgaagggaaatcttccttccatactggatgtccatgtcaacgtgggaggcagaagctcggtgcctgggaagatgaagggcagaaaggcgcgctggtcggtgcgcccatcggatatggcaaaaaagactttcaatccgatacgcgcaattgtggacaatatgaaggtgaagccaaatccgaacaaaacgatgatttcgctgtcgatcggagatccaacggtgtttggaaacctccccacggaccccgaggtcactcaagcaatgaaggacgcgctggatagtggtaagtacaacggttacgcgcccagcatcggatttctctcctcgcgtgaggaaatcgcttcctactaccattgcccagaagcacctctggaagccaaagacgtgattctcacctccgggtgttcgcaggcgatcgacctgtgccttgctgtgcttgctaatccaggccaaaacatacttgtcccacgtcctggattctccctttacaagactctggcagaatccatgggtatagaagtcaagttgtacaaccttctcccagaaaagtcatgggagatcgaccttaaacagctcgaataccttatcgatgaaaagaccgcctgtcttattgtgaacaatccctccaatccttgtggttcagtgttctcgaagcgccaccttcagaaaatactggccgtcgccgcccggcaatgtgtccctattctcgcagacgagatttacggagatatggtcttttcggattgtaagtacgagccccttgcaaccctgtccacggatgtccctattttgtcatgcggtggcctcgcaaaacgttggcttgtgcctggttggagactcggttggattctgatccacgatagacgagacatatttgggaatgagattagagatggattggtgaagttgtcacaacggattctcggcccctgtacgattgtccagggggcactgaagagcatcctctgtcgaactcctggcgaattctaccacaacactctttcatttctcaagtcgaatgcagatctctgttacggggcactggcagccatccctggtcttaggccagtgcgaccttctggggcaatgtacctgatggtgggcatcgaaatggagcactttccagagtttgagaacgacgttgaatttaccgaacgccttgtcgcagagcaaagcgtccactgcctcccagcaacctgttttgagtacccaaactttatccgagtcgtcataaccgtgcccgaagtgatgatgctggaagcctgttcaagaatccaggaattttgcgaacagcattaccactgcgccgaaggctcgcaggaagagtgcgataaa

SEQ ID NO: 20688 - DNA, 1362 bp, Artificial Sequence
  Description of Artificial Sequence: Synthetic coding sequence
atggatccgtatatgattcaaatgtcttcgaagggcaatctgccaagcattctcgacgtgcacgtcaatgtgggtggccgctcaagcgtgcctggtaaaatgaaggggcgtaaggcacggtggagcgtgagaccatccgatatggcaaaaaaaacttttaatcctatacgcgctattgttgataacatgaaggtcaaacctaatcctaataaaactatgatatctctctccatcggtgacccgacggtgtttgggaatctacctaccgatccagaggtcacccaggcaatgaaggacgcgttggatagcggtaagtacaatggttacgcgcctagcattggttttctgtccagccgagaggagatcgcgagctattatcattgccctgaggctcctctggaggcaaaggatgtaattttgactagtggttgtagccaagcgatcgatctgtgcctggcagtgctggcgaacccaggccagaatattctggtgccccgcccagggttttcattatacaagaccttggcggagtcgatgggaatcgaggttaagctatacaatctgctgccggagaaatcctgggagatcgacctgaaacagctggagtaccttatcgatgaaaagaccgcctgcctgattgtcaataacccatccaatccatgcggtagcgtgttttccaaacgccacctccaaaaaatcctggctgttgcagcgcgccaatgcgtaccaatcctagcagacgaaatttacggtgatatggtctttagcgattgcaagtatgaacctctcgctaccctgtcgactgacgtgccgattctgtcctgtgggggcctggcaaaacggtggctggtaccgggttggcgtcttggctggatcctgatccatgacaggcgggacatatttggaaatgagatccgcgacggtttggtgaagctgtcccaacgcattttggggccatgcaccatcgtgcagggcgcgctgaagagcatcctttgtcgcaccccaggtgagttttaccacaatactctgagcttcttgaagtcaaatgcagacctgtgctatggcgctctggccgcgattcctggtttgcgcccagttcgaccaagcggcgcgatgtatctgatggttggtattgagatggaacactttccagagtttgagaatgacgtcgaatttaccgagcgcttggtggctgaacagagcgtccactgtttgccagctacttgcttcgagtatccaaacttcatccgcgtggtcattacggtgccagaggttatgatgctggaggcatgtagtcgaatccaagaattttgcgagcagcactatcactgcgcggagggaagccaggaagaatgtgacaag

SEQ ID NO: 20689 - DNA, 1362 bp, Artificial Sequence
  Description of Artificial Sequence: Synthetic coding sequence
atggacccatatatgatccagatgagttctaaagggaaccttccttctatccttgatgtgcacgttaacgtaggagggcggagtagtgtgcccgggaaaatgaaagggaggaaagctcgatggtccgttaggccctccgatatggcaaagaaaacttttaatccaatcagagctatcgtagataacatgaaagtgaaacccaatcccaataaaactatgatatcactttccatcggagatcctacagtgttcgggaatctccctacagatcctgaagtcactcaggcaatgaaagatgctctcgattcagggaaatacaacgggtatgcaccctccataggattcctatcatcacgggaagagatcgccagttattaccattgcccggaagctcccctagaagccaaagatgtgatcttaacttctggatgctctcaggccattgatctgtgtttagctgtgcttgccaaccccggacagaacattcttgtgccccggcctgggttttctctttataagacacttgctgagtcgatgggaatcgaagttaaactctataacttgctacccgaaaagtcgtgggagatcgatcttaagcagctggagtatttaatcgacgagaaaactgcttgtctgattgtgaataatccatccaacccttgtggatctgtgtttagtaagcgccacctccagaaaatccttgccgtagctgcacggcaatgtgtgcccatcctagctgatgaaatttatggggatatggtcttctcagattgtaaatatgaacctctggctactctgtccactgacgtccccatcctttcctgtggagggctagccaaaagatggcttgtccctgggtggcggttaggatggatactaattcacgatcgccgagatatatttggaaatgaaatccgggatgggttggttaaactgtcacagagaatattaggaccctgtacaatcgtacagggagcactgaaatccattctatgcagaacacccggagagttctaccataatacactctcgtttctaaagtccaatgcagatctgtgttatggagcccttgccgcaatccctggactgcggcctgtgcggccatctggggccatgtacttgatggtcggaatcgaaatggaacacttccccgaatttgaaaacgatgtggagtttactgaacgactggtcgctgaacagagtgtgcattgtctccctgcgacatgctttgagtacccgaacttcataagggttgtcattacagtccctgaagtcatgatgctcgaagcatgttctcgcatacaggaattttgtgaacagcactatcactgtgcggaagggtcacaagaagaatgtgataaa

SEQ ID NO: 20690 - DNA, 1362 bp, Artificial Sequence
  Description of Artificial Sequence: Synthetic coding sequence
atggatccgtacatgatccagatgtcgtcaaaggggaacctgccatcgattcttgacgtgcatgtgaatgtgggaggccgatcctccgtcccaggaaaaatgaaaggcagaaaggcacgttggagcgtgcggccttccgatatggcaaagaaaacttttaaccctattagagccattgtggacaatatgaaagtgaaacctaatcctaataagactatgatatcgctgtccattggagatccaactgtgtttgggaacttgcctaccgacccagaggtcacgcaagcaatgaaggatgcactcgattcgggtaaatacaacggctacgctccatccattggcttcctgtccagccgcgaggagattgcgagctactaccactgtccagaggcacctcttgaagcgaaagacgtcattcttacctcgggatgttcccaagcaatcgacctttgcctggcggtgcttgccaaccccggccagaatatactggtccctcggccaggattctcactctacaagactttggctgaaagcatggggattgaggtgaagctgtacaaccttctgcctgaaaagtcgtgggaaattgaccttaagcaactggaatacctgatcgatgagaaaactgcatgccttatagtgaataacccaagcaacccctgtggatccgtgttttcgaagcggcaccttcaaaagatcctggcagtggcggcacgccaatgtgttccaatattggccgatgagatatacggcgacatggtgttttcagattgcaaatacgagccactggccaccctgtcaactgatgtgcccattctgtcctgcggaggtcttgcaaagaggtggctcgtgccgggctggagactgggctggatccttattcacgatcgtcgggacatattcggcaatgaaatcagagacggcttggtcaagttgtcgcaacggattctgggcccctgcaccatcgtgcagggtgcacttaagtcgatactttgcagaacccccggggaattctaccataacacgctgagctttctgaagtcgaatgcggatctctgctacggcgcattggcggcgatcccaggtcttagacctgtcaggccctcaggagcaatgtaccttatggtcgggattgaaatggaacatttcccagaattcgagaacgacgtggaatttactgaaagacttgtggcagagcagtcggtgcattgtctccctgcaacttgttttgagtatcctaatttcattagggtggtaattacggtgcctgaagtgatgatgcttgaagcatgcagtcgtatccaagaattttgtgaacaacattaccattgtgcagaagggagccaagaagaatgtgataaa

SEQ ID NO: 20691 - DNA, 1362 bp, Artificial Sequence
  Description of Artificial Sequence: Synthetic coding sequence
atggacccttacatgatccaaatgtcctctaagggcaatctgccaagcatcctggatgttcacgtaaatgtgggggggcgctcgtcagttcctggcaaaatgaagggacgcaaagcgaggtggtccgtgcggccatctgatatggctaagaagacattcaatccaataagagccatagtagacaacatgaaagtgaagccaaaccctaacaaaacaatgataagcctctccatcggtgatcctacggtcttcgggaatctcccaactgatcctgaggtgacacaagcaatgaaagatgctctggatagcggaaagtataacgggtacgcgccatccatcggatttctgagctcacgtgaagagatcgccagctactatcactgtcccgaagcacctctcgaggcaaaagatgtgatcttgacgtctgggtgttcccaagccattgatctgtgtctggccgtactggccaatcccggacagaacatactggtgcctaggccaggctttagtctgtacaagactcttgccgagtccatggggattgaagtaaaactgtataatctgctgccagagaaaagctgggagatcgatttgaaacagttagaatatctgatcgacgagaagactgcttgtcttatagtgaacaaccctagcaacccatgcggctctgtctttagcaagcgtcacctccaaaagattctggcggtggccgccagacagtgcgtgcccattttggctgacgagatttacggagacatggtgttctccgactgcaagtacgagccactcgccactctctctaccgacgtgcctatcctgtcctgtgggggtttggcaaaaaggtggctggtgccggggtggcggctcggatggattctaatacatgatcgtagggacatcttcggaaacgaaattcgggacgggttagtgaagcttagccagcggatactgggcccttgcaccattgtccagggggctctcaaatctattctctgccgcacacctggggagttctaccacaacacactcagcttcctgaagtcaaacgccgacttgtgttatggcgctctggccgccatccctggccttagacccgtgaggccctccggcgcaatgtatttgatggtcggaatcgagatggaacactttccagaattcgaaaacgacgtggagttcacggagagactggtggcagagcagtctgtacactgtctacctgctacatgctttgagtacccaaactttatcagggttgtcatcacggtgccagaggtgatgatgttggaggcctgcagcaggattcaggaattctgcgagcagcactaccactgcgcagaagggagtcaggaggagtgtgataaa

SEQ ID NO: 20692 - DNA, 1362 bp, Artificial Sequence
  Description of Artificial Sequence: Synthetic coding sequence
atggatccttatatgatccagatgtcgagcaagggaaacctcccatccattctcgatgtgcatgtgaacgtgggtgggcgatcctcggtcccaggaaaaatgaaaggacgcaaagcgaggtggagcgttcggccctcggatatggctaaaaagacgttcaatcctatccgagcaatcgttgacaatatgaaggtgaagcctaaccctaataagactatgatcagcctcagcatcggcgatcccactgtattcggcaatctcccgaccgaccctgaagtcacgcaagccatgaaggatgctctcgactccggaaagtacaacggctacgctccgagtattggctttttgtcctcaagggaggaaattgcgtcgtactaccactgccccgaagcgccattggaggccaaggacgtgatcctgactagcgggtgctcgcaagccatcgacttgtgcctggctgtgttggccaaccctggacagaacattctcgtgccgcgcccgggattttcgttgtacaagactctcgccgaatcaatgggtatcgaggtgaagctgtacaacctgctgccggaaaaatcatgggagatcgacctgaagcagctcgagtatttgatcgatgaaaagactgcctgcctgattgtgaataatccgtccaacccttgtggatcggtgttttcgaagcgccaccttcagaaaattctggcggtcgcggcaagacagtgcgtgcccatcctggccgacgaaatctacggcgacatggtgttctcagactgcaagtacgagcctctggccaccctcagcacggatgtcccaatcctgtcgtgcggaggcctggctaagcgctggctggttccgggatggcgcttgggatggatactgattcatgacaggagggatatcttcgggaacgagatccgcgacggtctggtgaaactgtctcagcgcatactcggaccatgcaccatcgtccaaggcgcgttgaagagcatcctctgccggaccccaggagaattctaccacaacactctgtccttcctcaagtcgaatgcggatctctgttacggcgcactggctgcaatccctggtctgcggccggtgaggccttcgggagccatgtacctgatggtcggcatcgagatggaacatttcccagaattcgaaaatgacgtcgagttcaccgaacggcttgtcgcagaacagagcgtgcactgtctccccgcaacctgtttcgaatatcccaactttatccgagtcgtgatcaccgtgccggaggtgatgatgctggaagcatgctcgagaatacaagagttctgcgaacaacactaccactgcgccgaggggtcgcaggaggagtgtgacaaa

SEQ ID NO: 20693 - DNA, 1362 bp, Artificial Sequence
  Description of Artificial Sequence: Synthetic coding sequence
atggatccctatatgatccagatgtcttccaagggtaaccttccaagtattctggatgtgcacgttaacgtcggtggccgaagttccgtgcctggaaaaatgaagggaagaaaagcacgatggtccgtgcgtccatctgacatggctaaaaagacttttaatcctattagagcaatcgtagacaatatgaaagtcaaaccaaacccgaacaagaccatgattagtttatctattggagatccaactgttttcgggaatctgccaacagatcctgaagttactcaggccatgaaagatgcacttgattctggtaagtacaacggatacgcccctagtattggatttctctcctcccgtgaagagatcgcatcatactatcactgtccggaagcacctcttgaagccaaggatgtgattcttacgtcaggatgctcacaggccattgatctatgcttggccgtcttggctaaccctggacagaacattctggtgccacggccaggattttcattgtacaaaactttggcagaatcaatgggtatcgaagtaaaactgtataacctgctcccagaaaaatcctgggaaattgatcttaaacaactcgagtatcttattgatgagaaaacagcatgtctcatcgtaaataacccatccaatccatgtggatcggtgttttctaaaagacaccttcagaagattcttgcagtcgcagcgcggcagtgcgttccgatcttggcagatgaaatctacggcgatatggttttttctgattgtaaatatgaaccattggcgacattgtcaacagatgtccctattttgtcctgcggaggactcgcaaaaagatggcttgtgccaggctggcgactcggatggatactcattcatgatagacgagatatttttggcaacgaaataagagacggattggttaaattgagtcaaaggatactgggaccgtgtactattgtacagggagccttaaaaagtattttgtgtcgcacaccgggagaattttatcataatacactttctttcttgaaatcaaatgcagacctctgttacggggctctagcagcaattcctggcttgcgaccagttcgtccgtccggtgccatgtatctcatggtcggtattgaaatggaacattttccagagtttgaaaatgacgtcgaatttacagagagactagtagcagagcaatccgtgcattgcttgccagctacgtgctttgagtatcctaatttcatacgtgtcgtgatcacagttcctgaggttatgatgctcgaagcttgcagccgtatacaggagttttgtgagcaacattaccattgtgcagaaggaagtcaagaagaatgtgataag

SEQ ID NO: 20694 - DNA, 1362 bp, Artificial Sequence
  Description of Artificial Sequence: Synthetic coding sequence
atggatccctatatgatccagatgtcaagcaagggcaacctgccatcaattctcgacgtccatgttaatgtcgggggtaggtcgtcagtgcccgggaagatgaaggggagaaaggcccgctggagtgtgcgaccgtcagatatggcaaagaaaacgtttaatccaattagagcaattgtagataacatgaaggtcaagcccaatccaaataagaccatgatttccctctcgataggtgaccctactgtttttggaaacctgcctaccgatcctgaagtaactcaagccatgaaggatgcacttgatagcggtaagtacaatggatacgccccctccatcggatttctgagttctcgtgaggaaatcgcatcctactatcactgcccagaagcaccgttggaggccaaggacgtgattctgacttcagggtgctcccaggccatcgacctttgcctcgcggtgctggcaaaccctgggcaaaacattctggtgccacggcctgggttctcactttacaaaacccttgcggaaagcatgggtattgaggtgaaattgtacaacctgcttcctgaaaaatcgtgggagattgatctgaaacaactggaataccttatcgatgaaaagaccgcatgtctcattgtgaacaacccttcgaatccttgcggctcggtgttctcgaaaagacatcttcagaagatcctggcagtcgcagctagacagtgtgtgcctatactcgcagatgagatatacggagacatggttttttcggattgtaagtacgagcctcttgctactctgtcgaccgacgtgccaatcctctcctgtggtggactggctaagcggtggcttgtgccaggatggcgtctcggatggattttgatccatgacagacgagatatctttggaaatgaaattcgagatggacttgtcaaactttcgcagaggatcttgggtccttgcactattgtgcagggtgcacttaaatctattttgtgtagaaccccaggtgaattctaccacaatacgctgtccttccttaagtcaaacgccgacctttgttacggagccctcgcagcaatacctggcctgcggcctgtgcggccaagcggtgcaatgtacctcatggtcggaatcgaaatggagcattttcctgaatttgaaaacgacgtggagttcaccgaacggctggtggcggagcaatccgtgcactgtctcccggcaacttgtttcgagtaccctaacttcattagggtggtgattacggtcccggaagtcatgatgctcgaggcatgttctcgtattcaagaattctgcgaacagcattaccactgtgcagagggatctcaggaagagtgtgataag

SEQ ID NO: 20695 - DNA, 1362 bp, Artificial Sequence
  Description of Artificial Sequence: Synthetic coding sequence
atggatccttacatgatccaaatgtcgtcgaagggtaaccttccatcgatcctggatgtgcatgtgaacgtcggtggcagatcctcggtccccggcaagatgaaggggcgtaaggcacggtggagcgtgcgtccatcagacatggcaaagaaaacttttaaccctattagggcaatcgtcgacaacatgaaagtcaagccgaaccctaacaaaactatgatttcactttcaattggcgaccctactgtctttggtaatctcccaaccgatccagaggtcacccaggccatgaaggacgcacttgattcgggtaagtacaatggttacgctccctcgatcggttttctgagcagcagagaggaaattgccagctactaccattgccccgaggcgccactggaagcaaaagacgtgatacttactagcggttgttcccaagcaattgacctttgcctggccgtgcttgcaaatcctggacaaaacattcttgtccctagaccaggcttttcactctacaagaccctggcagaatcaatgggaattgaagtgaagttgtacaatctgctgcccgagaagtcgtgggaaatcgatttgaaacaactcgagtacctcattgatgagaaaactgcatgtctcattgtgaacaatccctcgaatccctgtggatccgtgttctcaaagcgccacctccaaaagattcttgcagtggctgcgcgccagtgtgtcccaatactggcagatgaaatctacggggacatggtcttttccgattgcaagtacgagcctctggccaccctttccaccgacgtgcctatacttagctgcgggggattggcaaagaggtggctggtgccaggatggagactgggatggattttgattcatgatagacgtgacatttttgggaacgagatccgcgatggtcttgtgaagctgtcccaaaggattctgggaccttgtactattgtgcaaggtgccctcaagagcatactgtgccgcaccccgggggagttctaccataacaccctgtcattcctgaaatccaacgcggacctttgctacggtgccctcgccgcgattcctggactcagaccggtccgcccttcaggtgcaatgtacctgatggtcggcatagaaatggaacattttccagagtttgagaacgatgtcgagtttactgaacgcttggtcgccgagcaatccgttcattgccttcctgccacctgcttcgagtacccaaacttcatccgggtggtgatcacggtgccagaagtgatgatgctggaagcctgctcacggatacaagagttctgtgaacagcattaccactgtgcagaagggagccaggaagaatgtgataag

SEQ ID NO: 20696 - DNA, 1362 bp, Artificial Sequence
  Description of Artificial Sequence: Synthetic coding sequence
atggatccctacatgatccaaatgtcatcaaaaggaaatctgccttccattcttgacgtccacgtgaatgtgggaggaagatcctcagtgccgggaaagatgaagggacgcaaagcacggtggtccgtccggccttcggatatggcaaagaaaactttcaacccaattagagccattgtggataacatgaaagttaagcctaacccaaacaagactatgatcagcttgtcgattggggatcccacggtctttggtaacctccctaccgatcctgaagtgacccaggctatgaaagatgcgctggattcgggcaagtacaacggctatgcgccatcaataggctttctctcatcgcgagaggaaattgcatcctactaccattgcccagaggcaccactcgaggcaaaggatgtgatccttacttccggatgctcgcaagcgattgatctgtgtctggcggtgctcgcaaacccaggccaaaacatccttgtccctcgccctggattttcgctttacaagacccttgcagagagcatgggaatcgaggtgaagctgtacaacctgcttccggagaaaagctgggaaatcgatcttaagcaactggagtacctgatagatgaaaagacggcttgtctgattgtcaataacccaagcaacccatgcggatccgtgttctcgaagcgtcaccttcaaaagattctggctgtcgctgcacgacagtgtgtgccgatcctggcagacgagatttacggagatatggtgttttcggactgcaagtacgaacctttggcaactctgagcaccgatgtgcccatcctgagctgtggagggctggcaaagagatggctggttcctggatggcggcttggatggattctcattcacgataggcgtgacattttcggcaacgaaattcgcgacggcctggttaagttgtctcagaggattctgggtccatgtacgatcgtgcaaggagcgctcaagtccattctctgccgcaccccaggggaattctaccataatacgttgtcatttcttaaaagcaatgcagatttgtgttacggcgcacttgccgccatccctggtctgcggccagtgcgcccgtccggtgccatgtatctgatggtgggaattgagatggaacatttcccggagtttgagaacgatgtggaattcaccgaaagacttgtggctgaacagtcggtgcattgtctgcccgcaacctgtttcgagtaccctaatttcataagagtggtgattaccgtgcccgaagtgatgatgctggaagcatgttcacggatccaagagttttgtgagcagcattaccactgcgcagagggttcgcaagaggaatgcgacaaa

SEQ ID NO: 20697 - DNA, 1362 bp, Artificial Sequence
  Description of Artificial Sequence: Synthetic coding sequence
atggatccatacatgatacagatgagcagtaagggtaacctgcccagcatactagatgtgcacgtcaatgtcggtgggcgatcctcagtgcctggcaaaatgaagggcaggaaagcccggtggagtgttcggcccagcgatatggctaagaagaccttcaatcccatacgtgctatagtggataacatgaaagtgaagccaaatccaaataagaccatgatctctctgagcattggcgaccccaccgtgtttggcaatttaccaactgaccccgaagtgacacaggccatgaaagatgccctggactctggcaagtacaacgggtacgccccttctatcgggtttctatcttcccgggaagaaatcgcttcctattaccactgtcctgaggccccactggaagcaaaagacgtgattctgacaagtggatgtagccaggctatagatttgtgcctggctgttctggctaatcctgggcagaacatcctggtgcctagacccgggttcagtctgtacaagactcttgccgagagtatgggaattgaagtgaagctttacaacctgctgcccgagaaaagctgggaaatagatctcaagcagctggaatatctgattgatgagaagactgcatgcctgattgtgaacaatccttccaatccctgtggaagcgtcttttccaaacggcacctgcagaaaatacttgccgtggcagcccgacagtgcgtgccaatactagccgacgaaatttatggcgacatggttttttctgactgtaagtacgagcccctcgccaccctgtctacagacgtccccatcctgtcttgcggcgggctggccaaacggtggctggttcctgggtggcgtctaggttggattctcattcacgatcgccgggacatttttggaaacgagatacgcgacggcttagtgaaattatcccagaggattttaggaccttgtaccatagttcaaggcgctctgaagtctatactgtgccggacaccaggggaattttaccacaataccctgtcttttctgaaatcaaatgccgatctctgctatggcgccctcgccgctatcccagggcttcgaccagttagaccttcaggcgccatgtacttaatggtgggcattgaaatggagcattttcccgagtttgagaacgatgtggagtttactgaacggctggtggccgagcagagcgtgcattgcctgcccgcaacatgtttcgagtacccaaactttatacgcgtggtgatcaccgtgcccgaggtgatgatgctggaggcctgttctcgcatccaagagttttgcgaacagcactaccactgcgcagagggcagtcaagaggaatgcgataaa

SEQ ID NO: 20698 - DNA, 1362 bp, Artificial Sequence
  Description of Artificial Sequence: Synthetic coding sequence
atggatccttacatgattcaaatgtcctcgaagggcaacctaccctccatcctggatgttcacgtcaacgttgggggtcgaagttccgtcccagggaagatgaaagggagaaaggcacgttggagcgtacgcccttccgacatggcaaagaagaccttcaatcctatacgggcaatagttgataatatgaaggttaagccgaatccaaataaaactatgatttcactctcaatcggtgacccaacggtattcggcaatctcccgaccgaccccgaagtcacccaggcgatgaaagatgcgctggactctggtaaatataatggttatgctcctagcataggctttctgagcagtcgtgaggaaattgctagctactaccactgtcccgaagccccgctggaggccaaggatgttatcttaacctcaggctgttcccaggcaatagacctgtgcctagccgtccttgcaaaccctggacagaacattcttgtccccaggccaggattctcactctacaagacacttgcagaatcaatgggcattgaagtaaaactctataatcttttgcctgaaaagtcatgggaaatcgaccttaagcaactggagtatctgatagacgaaaaaacggcgtgcctcatagttaacaacccctccaatccctgcggttcggtcttttctaagcgacacctgcagaagatactggcagttgcagctcgtcaatgcgtgcctatccttgctgatgaaatatatggtgacatggtattttcagattgtaagtatgaaccacttgccacactttctactgacgtaccgattctctcttgcggcggtttggccaagaggtggctcgtgcccggttggcggttgggttggatcctaattcacgaccgaagggatatcttcggcaacgagatacgagacggcctggttaagctgagccagcggattctaggaccctgcacgattgtccagggcgctctcaagtcgattctctgccgaactcctggggaattttaccacaacaccctgagtttcctaaagagcaatgcggacctgtgctatggagccttggctgctatacccggtcttcgccctgtgcggcccagcggcgccatgtacctgatggtggggattgagatggagcattttcccgaatttgaaaatgacgttgaattcacggagcgccttgtggccgaacaatcagtccactgcttgccagctacctgctttgagtaccctaacttcatccgcgttgtgattacggttcctgaagttatgatgttggaagcctgttcccggattcaagaattttgtgagcagcactatcactgtgcagagggatctcaggaagaatgcgataaa

SEQ ID NO: 20699 - DNA, 1362 bp, Artificial Sequence
  Description of Artificial Sequence: Synthetic coding sequence
atggatccatacatgattcaaatgtcctcaaaggggaacctgccttccatccttgacgtgcatgtgaatgtggggggacggtcatcggtcccgggcaagatgaaaggccgcaaagcccgctggtcagtgcgccctagcgacatggcgaagaaaactttcaacccaatccgcgcgatcgtcgacaacatgaaggtcaagccaaacccgaacaagaccatgatttcactgtccattggcgatccgactgtgttcgggaaccttccgaccgacccggaggtcacgcaggcaatgaaggacgccctggattccggcaagtataacggatacgccccatccatcggtttcctgtcatcgcgcgaagaaatcgcgagctactaccactgcccagaggctccactggaggccaaggacgtgatcctgacctcgggctgttctcaggcaattgacctgtgcctcgcggtcctggccaatcccggacaaaacatcctggtgccaagacctggattctccctgtacaagaccttggcggaatcgatggggatcgaggtgaagctctacaatctgctgcccgaaaaatcgtgggaaatcgacctcaagcaactcgaatacctgatcgacgaaaagaccgcctgtctcattgtgaataaccccagcaacccgtgcggatctgtcttttccaagcgtcacctccagaagatcctcgctgtcgctgcacgccagtgtgttccaatcttggccgacgagatttacggagatatggtgttttcggactgcaaatacgagcctctggctaccctgtctaccgacgtgcccatcctgagctgcggcggactcgctaagcggtggctggtcccgggatggagactgggctggatcctgatccatgaccgccgggacatctttggcaacgagatccgggatggtctggtgaagttgtcgcaacggatcttgggaccgtgtactatcgtacagggggcgctgaaatccatcctttgtcgcactccgggggagttctaccataacaccctgtccttcctcaagtcaaacgctgacctgtgctacggcgcgctggcagctatcccggggctccgcccggtgcgcccctcgggcgccatgtaccttatggtgggtatcgaaatggaacattttcccgaattcgaaaatgatgtggaatttactgagcggctggtggcggaacagtcagtgcactgcctgccggcaacctgcttcgagtacccgaatttcatcagagtcgtcatcactgtgcccgaggtgatgatgctcgaggcttgttcgcggatccaggagttctgcgaacagcattaccactgtgctgaaggatcccaggaggaatgtgataag

SEQ ID NO: 20700 - DNA, 1362 bp, Artificial Sequence
  Description of Artificial Sequence: Synthetic coding sequence
atggatccatacatgatccagatgtcctccaaagggaatctaccctctatcctggacgtgcacgttaacgtgggcggtcgcagctccgttccaggcaagatgaaagggcggaaagctaggtggtccgtacggcctagcgatatggccaagaaaaccttcaatccaattcgcgcgatcgtggataacatgaaggtcaaacccaacccgaacaagacaatgatttcactctctattggtgatcctaccgttttcgggaacctcccaacagaccctgaggtcactcaggcaatgaaggatgccctcgacagcggcaaatataatggctacgcaccaagcattggcttcctgtcctctcgagaagaaattgccagttattaccattgcccggaagcaccgctggaggcaaaagacgtgatactgacctctggctgttctcaggctatcgatctctgcctcgcggtgctggctaatcccggccaaaacatactggttcctcggcccggtttttctctgtacaaaacactagctgagagcatggggatcgaggtgaaactgtacaacttactccctgaaaagagttgggagattgatctgaagcagctagaatacctaatcgacgaaaagacagcctgtttaattgtcaacaatccgtcgaacccatgtggatccgtgttctccaaaagacacctacagaagatcctagcagtagccgctcgtcagtgcgtgccaatcctcgccgacgagatttacggtgacatggtgttcagtgactgcaaatacgaacctctggcgacgctttcaacggacgttccaatcctatcatgtggagggctcgcaaaacgctggttagtgcccgggtggaggctaggatggatcctgattcatgacaggagagacatctttggaaacgaaatccgcgatgggcttgtgaaactctcacagagaatactcggcccctgtacaatcgttcagggcgcgttaaagagcatcctgtgtcgtacacccggggaattctaccataatactctgagttttctgaagtcaaacgccgatctctgctatggagccctggctgctatccctggattaaggccagtacgcccgagcggtgccatgtacctgatggtgggcattgagatggaacactttccagaatttgagaacgacgtggaattcacagagagactggttgcagagcagagtgtacactgtctgcctgccacttgttttgaataccccaattttatacgagtggtgattaccgtgcccgaagtgatgatgctcgaggcatgcagccggatccaggagttctgcgaacagcactatcactgtgcggagggaagccaggaggagtgcgacaaa

SEQ ID NO: 20701 - DNA, 1362 bp, Artificial Sequence
  Description of Artificial Sequence: Synthetic coding sequence
atggatccatatatgattcagatgtccagtaaggggaatctaccgtcgatactggacgtacatgtcaatgttggcggaaggagcagtgtgcccggaaagatgaaggggcggaaggctcgctggagcgtacgaccaagcgacatggcaaagaagactttcaatcccataagggcgatcgtggataacatgaaagtgaaaccaaatccaaacaagacaatgatctctttgagtataggagaccccacggtctttgggaacctgcctaccgatccggaagtgacccaggcgatgaaagatgctcttgactctggcaagtacaatggatatgcaccatccatcgggttcctgagctctcgcgaggagattgcctcatactaccactgtcctgaggctccactggaggctaaggacgtcatactcacctctggctgttctcaggccatagatctctgcctggccgtgctcgctaacccgggccagaatattctcgtcccccggcctggcttttcactttacaagactcttgcagaaagcatgggtattgaggtcaaactgtataatcttcttccggaaaaatcttgggaaatcgacctcaaacaactggagtacttaatagacgagaaaactgcgtgtcttattgtaaataatccaagcaatccttgcggctccgtcttctctaagcggcacctgcagaaaatccttgctgttgccgcccgccagtgtgtcccaatcttggctgacgagatatatggtgatatggtgtttagcgactgcaagtacgagcctctggccaccctctcaactgatgtgcctatcctgtcttgtggcggcttggccaagaggtggctcgtaccaggatggagactgggctggattctgatccacgaccgcagagacatttttggtaacgagattagggacgggttggtgaagctgtcacagcggatcctggggccgtgcactattgtgcaaggggctttaaagtctattctgtgccgcacacccggggaattctatcataatactctgtcctttcttaaaagcaacgccgacctctgttacggcgcgctggccgccattccagggttacggcccgtgaggccgtcaggcgctatgtatctgatggtgggcatagaaatggagcacttccccgagttcgaaaatgacgtggagtttactgagagattggtggccgagcagagtgtgcattgcctccctgccacctgctttgagtaccctaattttatcagggtggtgatcactgtgcctgaggttatgatgctcgaggcgtgcagccgaattcaggagttctgtgagcaacattatcattgcgcggaggggtcccaggaggagtgcgacaaa

SEQ ID NO: 20702 - DNA, 1362 bp, Artificial Sequence
  Description of Artificial Sequence: Synthetic coding sequence
atggatccttacatgatccagatgtcgagcaagggaaaccttccatcaatccttgatgtgcatgtgaatgtcggcggacggtcctccgtcccaggaaaaatgaagggccggaaagccagatggagcgttagacccagcgacatggctaagaaaactttcaaccctatccgcgcaatcgtagataacatgaaggtgaaaccaaatcccaacaaaaccatgataagcctctccataggtgatcctactgtgttcgggaatctgccgacggaccctgaggttacccaagccatgaaagatgcgctcgatagcggtaagtataacggatacgcacctagcattggttttctcagcagccgggaagagattgcatcctactaccactgtcctgaggccccacttgaagccaaggatgtcatactgacctcaggatgttcccaagcaattgatctgtgcctggcagtccttgcgaaccctggtcagaacatactggtgcctcggccagggttttcgctttacaagactcttgcagagtccatgggaattgaagtcaagttgtacaaccttcttccagagaaatcgtgggagattgatctgaagcagctggaatacctgattgatgaaaagactgcttgtcttattgtgaacaacccttcgaacccatgtggatctgtgttctcgaagcgccatctccaaaagattctggcggtggcggcgcgccagtgtgttcccattctggcagatgaaatctatggagacatggtgttttctgattgtaagtacgagcctctggcaactctttccaccgatgtgcctattctttcctgcgggggccttgcgaaacgctggttggtgcccggatggcgactcggatggattctcattcatgaccgtcgagacatttttggaaatgaaatccgtgatggtctggtcaaactttcacaacgcattctcgggccgtgtactattgttcaaggagcgttgaagtcaattctctgtagaacccctggagaattctaccataacactctctcgtttctgaagtcgaacgccgatctttgttacggagccttggcagcgatccctggcctgcgtccggtaagaccatcaggtgccatgtaccttatggtgggaatcgagatggaacattttcccgaatttgagaacgacgtggagtttaccgagaggctggtggcagagcaatcagtgcattgtttgcctgccacgtgctttgagtaccctaatttcattagggtcgtgattaccgtgccagaagtcatgatgcttgaagcatgtagccgtattcaggagttctgtgagcaacactaccactgtgcagaggggtcacaagaagaatgcgataaa

SEQ ID NO: 20703 - DNA, 1362 bp, Artificial Sequence
  Description of Artificial Sequence: Synthetic coding sequence
atggatccctatatgatccagatgagctccaagggaaacctgccaagtattctggacgtgcatgtgaacgtcggtggacgatcgagcgttcctggaaaaatgaagggacgaaaagcacggtggtcggtgaggccctcagatatggccaagaaaaccttcaacccaattagggccatcgtggacaacatgaaagtgaagcctaaccctaacaagacgatgattagcctgtccattggagatccaactgtgtttggcaacttgcctaccgatcccgaggtgacccaagctatgaaagacgcactcgactccggtaagtacaatggatacgcaccctccatcggatttcttagctcgcgggaagaaatcgcaagctactaccattgtccagaagctccactggaggcaaaagatgtcatcctgacctcgggatgttcacaagcgattgatctttgccttgcagtgcttgcaaaccctggacagaatatcctggtgccccgccctggctttagcctgtacaagactcttgccgaatccatgggtatagaggtcaagttgtacaacctgctgcctgagaaaagctgggagatagatcttaagcagcttgagtatcttatcgacgaaaagactgcctgtcttattgtcaacaacccttcgaacccctgcggtagcgtattctcaaaaagacatcttcaaaagattcttgccgtggcagcgagacaatgtgtcccaatcctggctgacgagatctacggagacatggtcttttccgattgtaagtacgagccacttgcaactctgtcaactgacgtcccaattctgagctgtggaggactggcgaagcgatggctcgttccaggctggaggttgggatggattcttatccatgaccgccgggacatttttgggaatgagattcgtgatggactggtgaagctctcccaacggattctgggtccctgtactattgttcagggagcattgaagtcaatcctgtgccgtactcctggcgagttttaccataacacgctttcctttcttaagtcaaacgccgatctgtgctacggcgcactggcggcgattcctggactgaggcctgtcagaccctcgggtgccatgtacctcatggtggggatcgagatggagcatttcccagaattcgagaatgatgtggaattcaccgaacgccttgtggccgaacaaagcgtgcattgcctcccggcaacctgttttgagtacccgaacttcatcagagttgtcattaccgtcccggaagtgatgatgctggaagcatgtagcagaatccaggaattctgtgaacaacactaccattgtgcagagggcagccaggaggaatgcgataag

SEQ ID NO: 20704 - DNA, 1362 bp, Artificial Sequence
  Description of Artificial Sequence: Synthetic coding sequence
atggacccttatatgatccaaatgtcctccaagggaaaccttcccagcattcttgatgtccatgtcaacgtgggcgggagatcgtcagtccccggtaagatgaaggggagaaaggcacgctggtccgtccggccttcggacatggcaaaaaagactttcaatccaatacgagcgattgtggataacatgaaggtcaagccaaaccccaacaaaaccatgatctcactgtcgattggtgaccctaccgtttttggaaacctgcccaccgatcctgaagtcactcaggcaatgaaggacgccctggatagtggaaagtacaatggatacgccccatccattggatttctcagttcacgggaagagattgcttcgtactaccattgtccagaagcacctctcgaggcaaaagacgtcattctgactagcggctgcagccaagcaatagatctttgtcttgcagttttggcaaatcctggccagaacattctcgtgccccgtccgggcttctcactttacaaaaccctcgcggagtcaatgggtattgaggtgaaactgtacaacctccttcctgaaaagtcctgggaaattgacctcaagcaactcgaatatcttattgatgaaaaaaccgcgtgtctgatcgtgaataacccaagcaatccctgcgggtccgtgttcagcaagaggcatcttcagaagatcctcgcagtcgcagcaagacaatgcgtgcctattttggcagacgaaatctatggtgacatggtgttttcagattgcaagtacgaacctcttgccaccttgtcgaccgacgtgcctattctgtcatgcggaggccttgcaaaacgttggctcgtgccaggttggagacttggatggatccttattcatgatcgacgcgatatcttcggaaacgaaatacgagatggactggtgaagctctcacagcgtatcctcgggccctgcaccattgtgcaaggtgcccttaagtcgattctttgcagaactccaggagagttctatcacaacaccctttcctttctgaagtcgaatgctgacttgtgttacggagcgctcgcagcaatccctggactgcggcccgtaagaccctccggagccatgtacctgatggtgggaattgagatggagcattttccagaatttgaaaatgacgttgagtttaccgagcggctcgtggcagaacagtcggtccactgccttcccgcgacctgctttgaatacccaaacttcattcgcgtggtcatcactgtgccagaggtgatgatgcttgaggcatgttcgcgcatacaggaattctgtgagcaacattaccattgcgcagaaggttcccaggaagaatgtgataag

SEQ ID NO: 20705 - DNA, 1362 bp, Artificial Sequence
  Description of Artificial Sequence: Synthetic coding sequence
atggacccctacatgatacaaatgagtagcaaaggaaacctaccttcaatcttggacgtgcatgtaaatgtggggggcaggtcaagcgtgccagggaagatgaagggcaggaaagcccgttggtccgtgagaccttcagacatggcgaaaaagacttttaaccccatacgcgccatcgtagacaatatgaaggtgaagcctaatccaaacaagaccatgatctcactgtcaatcggggaccccactgtatttggaaatctgcctacagatccagaagtgacacaagccatgaaggacgccctggactcaggaaagtacaacggctatgcacccagtatcgggttcctgagttcccgggaggaaatcgcttcctattatcactgtcccgaagcccctctcgaggcaaaagatgtgatcttaacttctggatgctctcaagccattgacctttgcctggccgtgctcgcaaaccccggccagaacattttggtgcccagaccgggtttcagtctctataagacgctggcagagagcatgggaatcgaggtgaaactctataatttactcccggagaagagctgggagatcgacctaaaacagcttgagtacttgattgacgagaaaactgcttgtctgatcgtaaacaatccctccaacccctgcgggtcggtgttcagcaaaagacaccttcagaagatactcgctgtagcagccagacagtgcgttccaatacttgcagacgagatttacggggatatggttttctcggactgtaagtatgagcccctggccacgttatcaacagacgtgcctatattgtcttgtggcggactcgctaagcgctggctggtgcctggctggaggctggggtggattctgatccatgatcggcgagatattttcggcaatgagatcagggacgggctcgtgaagctttcccagcgaatactaggcccatgtactatcgtgcagggagccctgaagtccatcctttgtcgaacccccggtgagttctatcacaatactctcagctttctgaagtctaacgccgatctgtgttacggggctctcgcagccatacccggcttaagaccggtgcggccatcaggggcgatgtatttgatggttgggattgagatggaacatttccctgaattcgaaaacgacgtggaatttacggagagacttgtggccgagcaatctgttcattgcctgcctgcaacatgtttcgagtaccccaattttatccgggttgtgattaccgtgcctgaagtgatgatgctggaggcctgcagtcgcatccaggaattctgcgaacagcactaccattgtgccgaagggagccaggaagaatgtgacaag

SEQ ID NO: 20706 - DNA, 1362 bp, Artificial Sequence
  Description of Artificial Sequence: Synthetic coding sequence
atggatccgtacatgatccaaatgtcgtctaaaggaaatctgccatcaatcctggacgtccatgtgaacgtgggcggaagaagctcggtcccggggaagatgaagggacgcaaagctagatggagcgtgcgcccaagcgatatggcgaagaaaacgtttaaccctatcagagcgatagtcgacaatatgaaagtgaagccgaatccaaataagactatgatctcgttgtccataggagatcccaccgtctttggcaaccttccgactgaccctgaggtcacgcaggcgatgaaagacgcactcgactcaggcaagtacaacggctacgcgccgtcgatcggattcctcagctcgagagaggaaatcgcttcgtactaccactgtcctgaagcacccttggaagccaaggacgtgatcctgacctcgggatgctcacaagccatcgatctctgcctggcggtcctggcaaaccctggacagaacatccttgtgccacggccgggcttctcgctctacaagaccctcgcggaaagcatgggaatcgaagtgaagctgtacaacctgctcccggagaagtcatgggaaattgatctcaaacagctcgagtatctgatcgacgaaaagactgcttgcctgatcgtcaataacccatccaatccgtgcgggtccgtgttttctaaaagacatctgcaaaagatcctcgctgtcgcagccaggcagtgcgtgcctatcctcgcggacgagatatacggagacatggtgttctcggactgcaagtacgaacccctggccaccctgtccactgacgtcccgatcctgtcctgtggcggcctcgccaaacggtggttggtccccggatggcggctgggatggatcctgatccatgatcgccgggacattttcggaaacgaaattcgggatggactcgttaagctgtcgcaacggatcctggggccgtgcactatcgtccagggagcgctgaagtccatcctgtgccggactccaggggaattctaccacaacaccttgagcttcctcaagtcgaacgccgatctgtgctacggcgccttggctgccatcccaggacttcgacccgtgcggccgtcgggagcgatgtaccttatggtgggcattgagatggagcacttcccggaatttgagaatgacgtggaatttacggagcggctggtcgccgaacagagcgtgcactgcctgcccgccacctgtttcgagtatcctaacttcatcagggtggtcatcacggtgccggaggtgatgatgctggaagcatgttcgcgcattcaggagttctgtgaacagcattaccactgcgccgaaggatcccaagaggaatgcgacaag

SEQ ID NO: 20707 - DNA, 1362 bp, Artificial Sequence
  Description of Artificial Sequence: Synthetic coding sequence
atggacccctacatgatccaaatgagctccaagggtaaccttccctcaatcctcgatgtgcacgtgaacgtaggcggacgatctagcgtccccggcaagatgaagggccggaaagcacgttggtctgtccgtcccagcgatatggctaagaagacgttcaatcctatacgagcaatagtggacaatatgaaagtgaagccaaacccaaataagaccatgatcagcctgagcatcggtgatcccactgtcttcgggaacttacccaccgaccctgaggtgacacaggcgatgaaggacgcgcttgattcgggcaagtataacgggtacgctccttcaatcggctttctgtcgtcccgggaagaaattgcttcatattaccattgcccagaggctcccctggaggccaaagatgtgatcctgacttccgggtgcagtcaggctattgatctgtgcctggccgtgctcgccaacccagggcaaaatattctcgtgcctcggccaggattttccttgtacaagacacttgccgagagcatgggcattgaggtcaaattgtacaacctgctccctgaaaaaagctgggaaatagacttgaagcagctggagtacctaattgacgagaaaacagcatgtttgatagtgaacaacccatcaaacccctgtgggtctgttttcagcaaaaggcacttgcaaaagatcctcgcagtggccgctaggcaatgtgtccccatactcgctgacgaaatatacggcgacatggtattttccgattgtaagtatgagcccctcgccaccctgagcacagacgttccaatcctaagctgcggggggctggccaaaaggtggctggttcccggatggaggttggggtggattcttatacatgaccgccgggatatttttggaaatgaaatccgcgacggtttggttaagctgagccagcgaatcctgggtccatgtactattgtccagggtgctctgaagtccatcttgtgtaggacacctggagagttttaccacaacacactgtccttcttgaagtcaaacgcagacttatgctacggggcgctagcagccattcctggcctccgcccagttaggcctagtggcgctatgtatctcatggtgggaattgaaatggagcactttccagagttcgaaaacgatgtcgagttcaccgaaagacttgttgctgagcaaagtgtacattgccttcctgcaacatgctttgagtatcctaacttcataagagttgtgataacagtgccagaggtaatgatgctggaagcttgcagccggatccaggagttttgcgagcagcactaccactgcgccgaggggtcccaggaggagtgtgataaa

SEQ ID NO: 20708 - DNA, 1362 bp, Artificial Sequence
  Description of Artificial Sequence: Synthetic coding sequence
atggacccctacatgatccaaatgtcatccaagggcaaccttccctccattctcgacgtccacgttaacgtgggaggccgatcttccgtgccaggcaagatgaagggccggaaagcgagatggagtgtcaggccttctgacatggccaagaaaacattcaatccaatcagagctatagttgacaatatgaaggttaagccaaaccccaataaaacaatgatctctctgtccatcggagatcctactgttttcggtaacctccctacggaccctgaagttactcaggccatgaaggatgctcttgactctgggaagtataatggttacgcgccttcaattggttttcttagtagccgcgaggagatagctagctactaccactgtccggaggctccccttgaggctaaggacgtgatcttgacgagcggctgtagccaggctatagacctctgtctggcagtcctcgcaaatcccggacaaaatatcttggttcctagaccaggattctccctgtacaagacactggcagagtccatggggattgaggtgaagctttacaatctgttgccagagaagtcttgggaaattgacttgaaacagctggaatacctgatcgacgagaagacagcctgcctcattgtgaacaacccaagcaacccttgcggttctgttttttctaagaggcacctccagaagattctcgctgtcgccgccaggcaatgcgtgccaatcctggctgatgaaatctacggggacatggttttttcagactgtaagtatgaaccacttgcaacactctccactgacgtccctatcctttcatgtggcggtcttgctaaaagatggctggtgccaggctggaggttgggctggattcttatccatgatcgccgagacattttcggaaatgagatacgagacgggcttgtgaaactcagccagcgcatcctggggccgtgtacaatcgttcagggtgctctcaaaagcattctgtgtcgcacacccggcgagttctatcataacactctgtccttcttgaaatccaatgcggatctgtgttatggtgctctcgcagctatccccggattgagacctgtacggcccagtggtgccatgtacctgatggtcggtattgagatggagcattttccggaattcgagaacgacgttgaatttaccgagagattggtagctgaacaatctgtgcattgccttccggccacatgttttgagtatcctaactttatccgagttgtgatcaccgttccagaggtgatgatgctggaggcctgctcccgcatacaggagttttgcgagcagcattatcattgcgcagaagggagccaggaggaatgtgataag

SEQ ID NO: 20709 - DNA, 1362 bp, Artificial Sequence
  Description of Artificial Sequence: Synthetic coding sequence
atggacccatatatgatccaaatgtcatctaagggaaacctgccctcaatcctcgatgtgcacgtgaacgtgggtggtcgctcttccgtgccaggcaagatgaaaggtcgtaaggccagatggagcgtgaggccttctgatatggccaagaagacatttaaccccattcgtgccatcgttgacaacatgaaggtaaagccaaacccaaacaaaacaatgatctccctgtctattggcgaccccaccgttttcggcaatttgcctacagaccctgaagtgactcaggctatgaaggatgcactcgacagtggtaagtacaatggatacgctccttccattggattcctgagctcacgcgaggaaatcgcctcctactaccactgtcccgaagcccctttggaggccaaagatgtcattctgacatccggatgctcacaagccattgacctttgccttgctgtcctggccaaccccggacagaatatactcgtccctcgtcccggtttttccttgtacaagactctggcagagtctatgggaatcgaagtcaagctctacaatttgttgcccgagaaatcttgggaaatcgaccttaagcaattggaatacttgatcgatgagaagactgcttgcctcatcgtcaataatcctagtaatccttgcggatccgtgttctctaaacgccacctgcagaagatactggccgtcgctgcccgtcagtgcgtgcccatactcgctgacgaaatctatggtgacatggttttctcagactgtaaatacgagccattggctacactgtcaactgacgtgcccatcctcagttgcggaggcctcgccaagaggtggctggtcccaggttggagactgggatggattctgattcacgaccgcagggacattttcggtaacgaaattagggacggcctggtgaagctttcccagaggattctcggtccctgcaccatagtgcaaggcgctctgaaatccatcctgtgtcgcacaccaggcgaattttatcataatacattgagtttcctcaaaagcaacgctgacctttgctacggcgccctggcagctatccccggtctgaggccagtccgtcctagcggagctatgtatcttatggttggtattgagatggaacattttcctgagttcgagaatgatgttgagttcaccgagcgcctcgtggccgagcagtcagtgcattgtcttcccgccacctgcttcgagtaccctaactttattcgtgtagttattacagtgccagaggttatgatgctggaggcatgtagccgcattcaggagttctgcgaacagcattaccactgcgccgaaggctctcaggaagagtgcgacaag

SEQ ID NO: 20710 - DNA, 1362 bp, Artificial Sequence
  Description of Artificial Sequence: Synthetic coding sequence
atggacccttacatgatccagatgtcgagtaagggaaacctgccaagtatattggacgttcacgtcaacgttggcggacgaagttccgtgccaggaaaaatgaagggccgtaaggcgcggtggtcagtgcgcccatccgatatggcgaagaagacattcaatcccattcgtgcaattgtggataatatgaaagtcaagccaaaccccaataagacgatgatttcgctgtctattggcgatccaacggtatttggtaatctgccgacggaccccgaggtaacacaagccatgaaggatgcgctcgactccggaaagtacaacggctacgctccgtcgatcggcttcctctcctcccgagaggagatcgcttcctactaccactgcccagaggcccccctggaggccaaggacgtgatcctgacctccggttgctcccaggcaatagatctgtgcctagcagtgttggcgaaccctggtcagaatattctggtgcctaggcccgggttctctctatataagacgctcgccgagtctatgggcattgaggtgaagttatataacctattgccagaaaagtcgtgggagattgatcttaagcaactggagtatctcattgacgagaagaccgcctgcttgatcgtgaacaatccgagcaacccgtgcggctcagtgttcagtaagcggcacctgcaaaaaattctggctgtggctgcccgccaatgtgtgcccattctggccgacgagatatacggagacatggtgttcagtgactgtaagtatgagccgttggcaaccctctcgactgacgtgcctattctgagctgcggtggcctggcgaagcgatggctcgtaccgggttggcgcctgggttggatcctcatccatgatcgccgagatatcttcggcaatgagatcagagacggactggtgaagctgtcgcagcgcatccttggtccctgcactatcgtccagggcgcgttaaagtcgattctgtgtagaaccccaggggagttctaccacaacaccctgtcgttcctcaagagtaatgccgacctctgctatggtgccttggccgccattccgggcctgcgacccgttaggccttcgggcgctatgtacctgatggtgggtatcgaaatggagcattttccggaatttgaaaacgacgttgagttcacggagcgactcgtggccgagcagagtgtccattgtctaccagctacctgcttcgagtaccccaactttatacgagtcgtgattactgtgccagaggtgatgatgctggaggcctgcagtcgcattcaggagttctgtgaacagcattatcactgcgctgagggcagccaggaggagtgcgataaa

SEQ ID NO: 20711 - DNA, 1362 bp, Artificial Sequence
  Description of Artificial Sequence: Synthetic coding sequence
atggatccatacatgatccaaatgtcttcaaagggaaacctgccatccattctggacgtgcacgtgaacgtgggcggtcgctcctcagttcctgggaagatgaaaggacgcaaggctaggtggtctgtgaggccttcagatatggctaaaaagaccttcaatcccatccgcgccattgtggataatatgaaggtcaaaccaaaccctaataaaacaatgatttccctgagcattggggacccaaccgtgtttggcaaccttcccacagacccggaggtcactcaggctatgaaagacgcactagactctggtaaatataacggttacgcgccctccataggattcttgagttcgcgagaagagatcgcgagttactatcactgtccggaggcacctcttgaggcaaaggatgttatcctaacttcagggtgttcacaggccatcgatttgtgtctggccgttcttgctaatcctggccagaatatcttggtaccacgccctggttttagtctgtacaagacattggcagaaagtatgggcatagaagtgaaactttataatttgttacccgagaaaagttgggagattgatctgaaacagctcgaatacttaattgatgagaagacggcatgtctcattgtgaataatccgtctaatccttgtgggtccgttttttccaagaggcatctacaaaaaatcttggcggtggctgctcggcagtgcgtaccaattctggccgatgagatatatggagatatggtcttcagcgattgcaaatacgaacctctggccacactttcaaccgacgtccccatattatcttgtggcggtctggctaagcggtggctggtgccagggtggaggctcggctggatactgatacacgatcggagagatatcttcgggaatgagattcgcgacggactcgtgaagctttcccagcgcatcctggggccttgtactatcgtgcaaggcgcgctgaagtccatcctgtgtcggacacctggggaattttaccacaatactctgtccttcctgaaatccaatgcagatctgtgctatggggcactggcagcaatccccgggttgcggccagtccgcccatcaggagccatgtatttgatggtgggaattgaaatggaacacttccccgagttcgagaacgacgtggagttcaccgagagactcgtcgctgagcagagtgtgcattgcctgccggctacttgcttcgagtacccgaattttatccgcgttgtgattacagtgcctgaggttatgatgctcgaagcgtgcagccgaatccaggaattttgcgaacagcattaccactgcgcggaaggcagccaggaggaatgcgataaa

SEQ ID NO: 20712 - DNA, 1362 bp, Artificial Sequence
  Description of Artificial Sequence: Synthetic coding sequence
atggacccctatatgatccagatgtcttcaaaaggaaatctgccttcaatcctcgatgttcacgttaacgtggggggtcgcagctctgtgcccggtaaaatgaaagggcgtaaagcgaggtggtctgttcgaccttccgacatggccaaaaaaaccttcaacccaattcgggctattgtggacaacatgaaggtcaagcctaaccccaataagacaatgatcagtctctcaatcggcgaccccacagttttcggaaacctccctaccgaccccgaggttacgcaagcaatgaaagatgctctggattccggaaagtacaatggctacgcaccatctattggtttcctctcttctagggaggagatcgcatcttactatcattgccctgaagcccccctggaggccaaagacgtgatcctgacttcgggatgttctcaggctatcgacctgtgtcttgcagtgcttgccaatcctgggcagaacatcctcgtccccagaccggggttcagcttgtacaaaaccttagctgaatctatgggcattgaggtgaaactttataaccttttacctgagaagagttgggaaattgacctcaagcagctggagtatcttattgacgagaaaaccgcctgcctgatcgtcaacaacccatcaaatccttgcgggtccgtcttctctaaaaggcaccttcaaaagattcttgccgtcgccgcccgccaatgcgtgcctatcctcgcagatgaaatatacggagacatggtattttccgactgcaagtacgagcctttagccactctttcgactgacgtccccatcctgtcctgcggaggtcttgcaaaacggtggctggtgcccggctggcgcttggggtggatcctgatccacgaccgaagggacatctttggaaatgaaatacgtgatgggctagttaaactgtcacagagaatactgggtccttgtacaatcgtccaaggggcactgaaatccatcctgtgccgtactcccggtgagttttatcataacacccttagcttcttgaagagcaacgccgacttgtgctatggagcgctcgcagctattcccgggctccgtcctgtgaggcccagtggcgccatgtacctgatggtcggcatcgaaatggaacattttcccgaattcgaaaatgatgtcgagtttactgagcgcctggttgccgagcaaagtgtgcattgcctgccagccacctgcttcgaatacccaaattttattagggttgtgatcaccgtcccagaggtgatgatgctagaggcctgcagtaggatccaagagttctgtgagcaacactaccactgtgcagaggggtctcaggaggaatgtgacaaa

SEQ ID NO: 20713 - DNA, 1362 bp, Artificial Sequence
  Description of Artificial Sequence: Synthetic coding sequence
atggacccttacatgatacaaatgtcctcgaaaggaaatctgccgagcatcctcgatgtgcatgtaaacgtgggtggccgcagcagcgtccccggcaagatgaaaggccgcaaggcgcgatggtccgtgagacccagcgatatggctaagaaaaccttcaaccccatcagagccattgttgacaacatgaaggtaaagcccaacccaaataaaactatgatcagcctcagcattggggacccaactgtgttcgggaatctgccaaccgaccccgaggtgacccaagcaatgaaggacgctctagacagtggtaagtacaacggttacgcgccctctatcggatttctgagcagtcgggaggagattgcaagttactaccactgccccgaagcacctcttgaggccaaggacgttattcttacctcaggatgtagccaagccatcgacctttgcttggccgttctcgcaaatcctggtcagaatatacttgtgcccaggccagggtttagcctgtataaaacactggctgagagtatgggcatcgaagtgaagctgtataatttgcttccagaaaagtcgtgggaaattgacttgaagcagctggaataccttattgatgagaaaactgcatgcctaattgtaaataatccgagtaatccgtgtggaagtgtgttctcaaaacggcacctgcagaaaatcctggccgtggcggcccggcagtgtgttccgatcctggctgacgagatctatggagacatggtgttttccgattgcaagtacgaacccctcgccactctgtcaactgatgtaccgattctgtcatgcggaggactcgctaaaaggtggctcgtgcccgggtggcgcctaggatggatacttatccatgatagaagagacatattcgggaacgagattagggatgggctcgtgaaattgtctcagaggatcctgggcccttgcaccatcgtgcaaggggcactcaaatcgatcctgtgccgcactccaggggaattttaccataacaccctgagttttctgaagtcaaatgcggatctatgctacggtgctctggccgcaatccccggtcttcgccccgtgcgtccttccggcgctatgtatttaatggtgggcatcgagatggaacacttccccgaattcgagaacgatgttgaatttactgaacgactggtggcagagcagtcggtgcactgccttcccgctacctgcttcgagtacccaaacttcattcgcgtggtgatcactgtgccggaagtgatgatgctagaggcctgtagccggatccaggaattttgtgaacagcactatcactgtgcagaaggcagccaagaggagtgtgacaag

SEQ ID NO: 20714 - DNA, 1362 bp, Artificial Sequence
  Description of Artificial Sequence: Synthetic coding sequence
atggacccctacatgatacaaatgagtagcaaggggaatctccccagtatcttggatgtgcacgtaaatgttgggggtaggagttccgtacccgggaaaatgaaaggccggaaagctagatggagcgtgcgtccctcagacatggccaaaaagacctttaaccccattcgggcaattgttgacaatatgaaggtcaaacccaacccaaacaaaaccatgatctctctgtccattggagatcctaccgtattcggcaaccttcctacggatcccgaggtgacccaagccatgaaagatgctttagacagtggtaagtataacgggtatgctccttccatcggctttctgagttcacgggaggagatcgcttcgtactatcattgcccagaggcacctctggaagccaaagacgtgatcttgacctccggatgctcccaggccatcgacttgtgccttgccgtgctggcaaatccagggcaaaatatactggtgccccggcctggcttcagcctttacaaaaccctggccgaaagcatgggcatagaagtgaagctctacaaccttctgccagaaaagtcttgggaaatagatttgaagcagctggagtatctcattgacgagaagacagcttgtttgatagtcaacaatccatctaatccgtgcggatctgtgttctcaaagcggcatctgcagaagatcctggcagtggcagcaaggcagtgcgtgcccattctggctgatgagatttatggggatatggttttctctgattgcaaatatgaacccctcgccacgctgagcacagatgtgcccattctctcatgtgggggactggcgaagcgctggttggtgcccggatggcgtttggggtggatacttatccatgatcggcgagacatcttcggcaatgagatccgtgatgggctcgtcaagctgagccagcggattctaggaccctgcactattgtgcaaggcgctctgaaatcaatcctgtgtcgcactcctggagaattttaccacaacacactctcattcctgaaaagtaatgcggatctgtgctacggggccttagcagccatccccggactccgcccagtccggccaagcggggcaatgtatttgatggttggaatagagatggagcactttcccgaatttgaaaatgacgtcgagtttacggagcggctggtcgccgaacaatctgtgcactgtttgccggccacgtgcttcgaatatcccaattttatcagagtggtgattactgtgcccgaggtgatgatgctggaggcgtgtagccggatccaggagttttgtgaacagcactatcactgtgcagaggggagccaggaagaatgcgacaag

SEQ ID NO: 20715 - DNA, 1362 bp, Artificial Sequence
  Description of Artificial Sequence: Synthetic coding sequence
atggatccttacatgattcaaatgtcttcaaagggaaacctgccatctatcttagacgtgcatgtcaatgtcggaggacggagtagcgtgcctggcaagatgaaaggtaggaaggcacgctggtcggtgaggccatccgacatggcgaagaagactttcaacccaatccgagcgatcgttgataacatgaaagtgaaacctaaccctaacaaaaccatgatctccctatccatcggagaccctactgtgttcgggaatctgcctaccgaccctgaggttacacaggcaatgaaagatgcactagactctggcaaatacaatggctatgctcctagtatcggtttcctgtcttctagagaagaaatcgcaagctactaccactgtccggaggctcccctcgaggcaaaagatgtgatcctgacaagcgggtgcagtcaggcaatcgatctgtgtctggccgtgctggcaaacccagggcagaacatactcgtgccacgcccaggcttcagtctgtataagaccttggcggaatctatgggcatcgaggtgaaattgtataatctgctgcctgagaagagttgggagatcgatctgaaacagttggagtatctcatcgatgagaagacagcatgcctgatagttaataatccatctaacccttgtggcagcgtgttctccaaacggcacctgcagaagatcctggccgtcgcagcgagacagtgcgtacctatcctggccgacgagatttatggcgatatggtgttcagcgattgcaaatatgaacccttagccacactgagtacagacgtgccgatcctgtcatgcggggggctcgcaaagcgttggctggtgcccggttggcgcctggggtggattcttatccacgaccggcgggacatattcggtaatgagataagagacggtctggttaagctcagccagcgcatcctgggtccctgcacaattgtacaaggcgccctcaagtccattctgtgcaggacaccaggagagttctaccacaacactctaagcttcctaaaatcaaatgccgatctttgctacggcgctctagctgcgatacccggactgcgcccagtcagacctagcggcgctatgtatctcatggtcggaatagaaatggagcacttcccagaatttgaaaacgacgtcgaatttacggagagactcgtcgccgagcagtcagtgcattgcctgcctgccacctgtttcgaatacccgaatttcattagggtcgtgattacagtaccagaagtcatgatgctcgaagcctgctcccgcatccaggagttttgcgaacagcactatcattgcgctgaaggttcacaggaggagtgcgacaag

SEQ ID NO: 20716 - DNA, 1362 bp, Artificial Sequence
  Description of Artificial Sequence: Synthetic coding sequence
atggacccatatatgatccaaatgtcaagcaaagggaatcttccgtctattctcgatgtgcacgtaaatgtcgggggcaggtcgagcgtgcctggcaagatgaaaggacgcaaggctagatggtccgtgcggccctcagatatggcgaagaagacctttaatcccatcagggcgattgtggacaatatgaaagtgaaacctaatccaaacaagactatgatttccctctcgattggagatccaaccgtgttcgggaacctgccaactgaccccgaggtaactcaggcaatgaaggacgccctggatagtgggaagtacaatggctacgccccctccattgggtttctttcctccagagaagagatcgcttcctattaccactgccctgaggcccctctggaagctaaggatgtaattctaacatccggctgttcccaggccattgacctgtgcctcgctgtgttagccaaccctggtcagaatatactcgtgcccaggccagggttctccctctacaaaaccctggccgagtctatgggtatagaggtcaagctttacaacttactaccagaaaaatcttgggagattgatctgaagcagctagagtacttgatagatgagaagaccgcctgcttgatcgtaaacaaccccagcaatccctgtggatctgttttcagcaagcgccacctgcagaagattttggctgttgctgcacggcagtgtgtgcctatactggctgatgagatttatggcgatatggtgttcagcgattgcaagtatgagcccttagctactttaagtacggatgtaccgatcctctcatgcggcggcctcgccaagagatggcttgtgcctgggtggcggttgggttggatactcattcatgaccgcagagacatcttcggcaatgaaattcgggacggtttagttaagctctctcagcggatcttgggaccttgtaccatcgtccagggggccctgaagagtatcctgtgccgcacacccggtgagttctatcacaacactctttccttcctcaaatctaatgctgatctttgttacggggctctggccgctattccgggccttcggccagttcgaccgagcggtgccatgtatctaatggtcggaatcgagatggagcactttcctgaatttgaaaacgatgtcgaattcactgagaggctcgtcgccgaacagagtgttcattgtttgcctgcaacctgtttcgagtaccccaacttcatcagggtggtgatcaccgttcccgaagtcatgatgcttgaggcctgctcgcgtattcaggaattctgcgagcagcactaccactgtgccgagggtagtcaggaagagtgcgataag

SEQ ID NO: 20717 - DNA, 1362 bp, Artificial Sequence
  Description of Artificial Sequence: Synthetic coding sequence
atggatccatatatgattcagatgagttccaaggggaatctaccttctatcctggacgttcatgtgaacgtcggcgggagaagtagtgttccaggaaagatgaagggccgcaaagcccggtggtcggtaaggcccagcgatatggctaagaagacattcaacccgattcgtgccattgtcgacaacatgaaggtgaagcccaaccccaacaagacaatgatctccctgtctataggtgatccaaccgtttttggtaacctacccactgatcctgaggtgactcaggccatgaaggacgctctggactcaggaaaatacaacggatacgccccctctatcgggtttctgtcgagtagggaggaaatagcctcatactatcactgtcccgaagcccccctggaagccaaagacgtgatcctcacttctgggtgcagtcaggcaattgacctgtgcctggcagtgctggccaatcccggacagaacatcctggtgcctcgtccagggttcagcctttataagacacttgccgaaagtatgggaatagaagttaagctctacaacttgctgcctgagaaaagctgggagatcgacctgaaacagctcgagtaccttatcgacgagaagactgcctgccttatcgttaacaacccatctaacccatgcgggtctgtgttcagcaagagacacctccagaagatcctcgccgttgctgctcgccagtgtgttcctatcctcgccgatgagatctacggggacatggtttttagcgactgtaagtatgagcccctcgccactttatccacagatgtcccaatactgagctgcggcggattggctaagcggtggctggtccctggatggcgactcgggtggatcctgattcatgaccgcagggatatattcggtaacgagattagggacggtctggtcaaattgtcacagcggatccttgggccctgtacgatcgttcagggggctcttaaatccatactctgcagaacacctggagagttctatcataacaccttatcgttcctcaagtcaaatgccgacctatgctatggtgcgctggcagccatcccgggactcaggccggttcggccctctggagcaatgtatctcatggtcgggatcgagatggagcatttcccagagtttgaaaatgacgtggaatttaccgagcggctggtggccgagcagtcagtccactgcttgcctgccacttgttttgagtaccctaatttcatcagagtggtgatcactgtacctgaggtgatgatgctcgaagcctgctcccgcattcaggaattctgtgagcagcactatcactgtgccgagggtagccaagaagaatgcgataaa

SEQ ID NO: 20718 - DNA, 1362 bp, Artificial Sequence
  Description of Artificial Sequence: Synthetic coding sequence
atggacccctacatgatacagatgagctccaaaggaaatctgccatcaatcctggatgtgcacgtgaacgtaggcggacggtccagcgtgccagggaaaatgaaaggcaggaaggcaaggtggagcgtccgcccgtccgatatggctaagaaaacgtttaacccaataagagctattgtggataacatgaaagtcaagcccaatccaaacaagacaatgatatccctgtccatcggggaccccactgttttcggcaacctacctactgaccctgaagtgacacaggctatgaaagacgcccttgactcaggcaagtataacggttacgcccctagtatcggcttcctctcgagtcgagaggagatcgcttcctattaccactgcccagaagcccctctggaggctaaggatgtgattttaacgtccggctgctcgcaggcaattgacctgtgcctcgcagtgttggcgaacccgggacagaacattctggtaccaaggcctggcttttcattatacaagactctcgccgaatcaatgggaatagaagtgaagctgtacaacctccttcccgagaagtcctgggagatcgacctgaaacagctggagtacctgatcgatgagaagacggcttgccttattgttaataacccctccaacccctgtggttctgtgttctccaagcgacatctgcagaagatcctggccgtggcggccaggcagtgtgtgccaatccttgctgacgagatctacggggacatggtgttctccgactgcaagtacgagcccctggcgaccctttccacggacgtccccattctttcctgtggcggcctcgccaaaagatggctcgtacccggctggcggctgggatggattctcatacacgatcgaagagacattttcggaaatgaaatcagagacggcttagtgaaactcagtcagcgtatcctcggtccctgcacgatcgttcagggtgctctcaagagcatactgtgccgcacacccggtgaattctaccacaatacactatccttcttgaaaagcaacgcagatctgtgctacggagccctagccgccattcccggccttcgacctgtgagacctagcggcgccatgtatcttatggtcggaatagagatggagcatttccccgaatttgaaaatgacgtcgagtttacagagcggctcgtggctgagcagtcagtgcactgcctgccggcgacatgctttgagtatcccaatttcatcagagtcgtgattaccgtacctgaggtcatgatgctggaagcttgttcgcgcattcaagagttttgtgaacagcactatcactgtgccgaaggatcccaggaagaatgtgacaaa

SEQ ID NO: 20719 - DNA, 1362 bp, Artificial Sequence
  Description of Artificial Sequence: Synthetic coding sequence
atggatccctacatgattcagatgagcagtaagggaaatcttccctctatcctggatgtgcatgtcaacgtgggcgggcggtcctctgtccccggaaagatgaagggtcgcaaggctaggtggagcgtgcgcccatctgatatggccaaaaagacgttcaatcctattagagcaatcgtggataacatgaaagttaaaccaaatccaaataagacaatgatctccttatcgattggagatccgacggtttttggcaacctgcccaccgatcctgaggtcacccaggcgatgaaagacgctttggacagcggaaagtataacggatacgcgccctctatcggattcctaagcagtcgggaggagatagcctcctactatcactgccctgaagcgccactcgaggcaaaggacgtgatcttgacatctggatgctcccaggcgattgacctgtgcctcgccgtattagccaatcccggacagaacatcctggtgccacggcctggtttctctctgtataagactcttgcagaaagtatggggatagaggtaaaactctacaaccttttacccgagaaatcatgggaaattgatctcaagcagcttgagtacttgatagacgagaagacggcatgcctgatagtgaacaatccttctaacccctgcgggtcggtgttcagtaaacgccaccttcaaaaaattctggccgtggcagctaggcagtgtgtgcctatattggctgacgaaatctatggggacatggttttctctgactgcaaatatgaacctctagctacactgagcacagacgtccctattttaagttgtggcggcctggccaagcgctggctagttcctggatggcgcctaggctggatcctcatacacgataggagggatatttttggcaacgagattcgggacggtctggtgaagctttcccagcgtatcctgggcccttgtacaatagtgcagggagccttgaaaagcattctgtgtaggaccccaggagagttttatcataatacactgagcttcctcaagtccaacgcagatctctgttacggagcacttgcggccatcccaggactccgaccagttaggccaagtggcgcaatgtaccttatggtaggcatcgaaatggagcattttcccgagttcgagaatgatgtggaatttaccgagcggctcgttgccgagcaaagcgtgcactgtttgccagcaacatgctttgagtacccaaattttatccgcgtggtcattacagtgcctgaagtgatgatgctcgaggcttgttctagaatccaggaattttgcgagcagcactaccattgtgccgagggttcccaggaagaatgtgacaag

SEQ ID NO: 20720 - DNA, 1362 bp, Artificial Sequence
  Description of Artificial Sequence: Synthetic coding sequence
atggacccctatatgatccagatgtcttcgaaggggaatttaccgtctatcttggacgtgcacgttaatgttggtgggaggtcgtccgtgccagggaagatgaaaggtcgcaaagccaggtggtccgtgcgcccttctgatatggcgaagaaaacctttaaccctataagggcgatcgtcgataatatgaaggtaaagcccaatcccaataagactatgatcagcctgagtatcggagacccgactgttttcgggaacttacctaccgatcccgaggtgactcaggccatgaaggatgcgctcgacagcgggaagtacaatgggtacgcccccagtattggcttccttagtagccgtgaggagatagcgagctactatcattgtcctgaagcccccttggaagccaaggatgtcattctgacgagtgggtgttctcaggctatagacctgtgccttgcggtccttgccaaccccgggcaaaatattcttgtgcctcgcccaggtttctccctgtataagacacttgcagaatccatgggcattgaggttaagctgtacaatctgttgcctgaaaaatcttgggagatcgatctgaaacagctggaatatcttattgacgaaaagacggcatgcctcatcgtgaataatccatccaacccttgtggcagtgtgtttagtaagcgtcacctgcagaagattctcgcagtggcagctcgccaatgcgtgcccattctggccgacgaaatctatggtgatatggttttttccgattgtaaatatgagccacttgcgacactttccacagatgtgcccatcctatcctgcggcggacttgccaagcggtggctggtacccggatggcgtctgggctggattttgattcatgacaggcgggacatattcggcaatgagatacgtgacggcctcgtgaagctttctcagagaatcctgggtccctgtacaattgtgcaaggggcccttaagagtatcctttgccggacgcccggtgagttttaccataacaccttatcttttttaaaatccaacgctgacctatgctacggcgcattggccgcaatcccaggcttgcgccctgttaggccatccggggcaatgtacttaatggtcggtatcgagatggagcatttccccgagttcgagaatgacgtggagtttacagaacgtctggtagcagagcagagtgtccattgtcttccggctacttgcttcgaatacccgaatttcatccgagttgtcataacagtgccagaggtcatgatgctggaggcctgcagtcggattcaggaattctgtgagcagcattaccactgtgcagaaggcagtcaggaagaatgcgacaaa

SEQ ID NO: 20721 - DNA, 1362 bp, Artificial Sequence
  Description of Artificial Sequence: Synthetic coding sequence
atggatccttatatgatccagatgtctagtaaagggaacttaccaagcatactggatgtccacgttaacgtagggggccggtctagcgtgcccgggaagatgaaaggcagaaaggcccgctggtctgtgcggccaagtgacatggccaagaagacattcaacccaatcagggccatcgtggataatatgaaagtcaagcctaaccctaacaagactatgatatctctctctatcggggaccctaccgtgttcggcaacctacctaccgatcctgaagtgactcaggcaatgaaggacgccctggacagcggtaagtacaatggctatgcaccctcaattggattcctatctagtagagaggagatagcatcctactaccactgccctgaagccccactagaggctaaggacgtgatcctcacttctggctgttcccaggctattgacctgtgcttagccgtccttgccaaccccggacagaacatactggttcccagacctggattctctctttacaagaccctggctgagtctatggggatagaggtgaagttgtacaatctgctgcctgagaagtcatgggaaatagatttaaagcaactagagtacctaattgatgagaaaaccgcatgtctgattgtgaacaatccttcaaacccttgtggctccgtcttttctaaacggcacctccagaagatcctcgccgttgcagctcggcagtgcgtgccaattctggcagacgagatttacggtgatatggtgttttctgactgcaagtatgaacctcttgctaccctgagcacagatgtccccattctgtcctgtggcgggctcgcaaagaggtggcttgtgcctggttggcgactgggctggatcctcatccacgacaggcgggatatctttggaaacgagattcgggatgggttagtgaagctctcccaaagaatcctaggcccatgcactatagttcagggcgccctgaaaagtattttatgtcgcactcctggcgagttctatcacaatactctaagtttcctgaagagcaatgctgatctctgctacggagccttggctgccattccagggctcagacccgtccgcccttctggagctatgtatctgatggtcgggatcgaaatggaacactttcccgagtttgagaacgacgtggagtttacagaaaggctggtggccgagcagagtgttcattgcttgcctgctacctgcttcgaatatccaaatttcatacgtgtggtcattacagtgccagaggtgatgatgctggaagcatgctctcgcattcaagagttctgtgaacagcactaccactgcgctgaagggtctcaagaggaatgtgacaag

SEQ ID NO: 20722 - DNA, 1362 bp, Artificial Sequence
  Description of Artificial Sequence: Synthetic coding sequence
atggatccatacatgatccagatgtcttctaagggcaaccttccctccatcctcgacgtgcatgttaatgtgggaggccggagctcagtcccagggaaaatgaagggccgcaaggcccggtggtctgtcagacctagcgatatggctaaaaagaccttcaatccgatacgcgccattgtcgacaatatgaaggtgaagcccaacccaaacaaaactatgatcagtctgagcatcggcgacccaaccgtgttcggcaacttgccaacggatcctgaagtgacccaagccatgaaagacgctctggactctgggaaatacaacgggtacgctccatcaatcggcttcctttcatcccgagaggaaatagccagttactatcactgccccgaggcacccctggaggcaaaggatgtcatcctcacatctgggtgtagccaggctattgatctctgcttggccgttttggccaacccggggcagaacattctggtgccacgtcccgggttttcactatacaagaccttggccgagagcatggggattgaggttaaactctataacctgctccctgagaagtcttgggagattgatttgaaacagctggagtacctgatagatgagaaaactgcttgcctcatcgtgaacaatccatccaacccttgtggcagtgtgttttcaaaacggcatcttcaaaagatcctggccgtcgccgcccggcaatgcgtgcctatcctggctgacgagatatatggagatatggtgttcagcgactgcaagtacgagcccctagccaccctttccaccgatgtgccaattctcagttgcggaggtctcgccaagcggtggctggtgcccgggtggcggctgggctggattctgatacatgatagacgggacatcttcgggaacgagattcgcgacggcctggtcaaactgtcccagcgaatccttgggccatgcactatcgtacagggagccctcaaatccatactgtgtaggacccctggcgagttctaccataataccctgtccttccttaaatccaacgccgacttgtgctatggagccttggccgcaatacctggcctcaggccagttcgacccagtggcgctatgtatctcatggtgggcatcgagatggagcatttcccggagtttgaaaatgatgtggaattcacagagaggctcgtggccgagcagtctgtgcattgcctacccgcgacttgctttgagtatcctaactttatcagagtcgtgataaccgtgcccgaggtaatgatgctggaggcttgttctagaattcaggaattctgcgaacagcactatcattgtgccgagggcagtcaagaagaatgcgataag

SEQ ID NO: 20723 - DNA, 1362 bp, Artificial Sequence
  Description of Artificial Sequence: Synthetic coding sequence
atggacccgtacatgatccaaatgagctcgaagggcaatctcccaagtatcttggatgttcatgtgaacgtaggcggcagatcctccgtgccgggcaaaatgaaggggcggaaggcacggtggagtgtgcgcccgagcgacatggcaaagaaaactttcaatccaatcagagccatcgtggataacatgaaggtgaaacctaacccaaataaaacaatgattagtttaagtatcggggatcctacagtcttcgggaatctgccgaccgatcctgaagtgacccaagccatgaaagatgcactcgactcaggcaaatacaatggctatgccccctcaataggttttctcagcagcagggaggagatcgccagctattaccattgcccggaggctcctctggaagccaaagacgtgattctgacatctggctgttcacaagcaatcgacctgtgcttggcggttctggcaaacccaggccagaacattttggtgcccaggccgggcttttcactctataagacattggccgagagtatgggtatcgaggtcaaactttacaatctgcttcctgaaaaaagttgggagatcgacctcaagcagctcgagtacctgattgacgaaaaaactgcctgccttattgttaataacccatccaatccatgcggctcagtgttctcgaagagacacctccaaaagattttagcggttgcagctcgccagtgcgtaccaatcttagcagacgaaatctatggcgacatggtgttttccgactgtaagtatgagccactagcaacccttagtactgatgtgccaattctgagctgtggtggattggctaagcgctggctcgtgcctggttggcgtctggggtggatcctcatccacgacaggcgtgatattttcggaaatgagattcgcgatggcctggtgaaactgagtcagaggatcctcggcccttgtaccatagtgcagggagctctgaagtcgatactctgtagaacaccaggcgagttctaccataatacgctatcatttttgaaaagcaatgcagatctgtgttatggtgcgttggcggcgattcccggtctaagacccgtccggccatccggggccatgtatctcatggtggggattgagatggagcatttccctgaattcgaaaatgacgtcgagtttacagagcggctcgtggctgaacaatccgttcattgtttacccgcgacctgttttgagtatcccaattttatccgagtagtgattactgtgcctgaagttatgatgctggaagcttgcagtcggatacaggagttctgcgagcagcactatcactgtgcagagggttcacaggaagaatgcgataag

SEQ ID NO: 20724 - DNA, 1362 bp, Artificial Sequence
  Description of Artificial Sequence: Synthetic coding sequence
atggatccttatatgatccagatgtcctccaaaggaaatttgccttccatactcgatgtgcatgtgaacgtgggggggaggtctagtgtgcccgggaaaatgaagggacgaaaagccaggtggagtgtgagaccttctgacatggctaaaaaaacattcaatcccatacgcgcaattgtcgataacatgaaagtgaaacctaaccctaataaaactatgatttcactctcaataggggatccgactgtattcggaaaccttcccacagatccagaagtaacacaggctatgaaagatgccctggattcagggaaatataatggatatgcgccctctataggattcctcagttcacgcgaggagatcgccagttactatcattgtcctgaggctccactggaagccaaagatgtgatactcacatccggatgttctcaggccattgatctgtgcctagccgtccttgccaacccagggcagaatatactggtccctcgcccaggattctccctctataaaacactggccgaatctatgggaatcgaagtcaaactctacaacctgttacctgagaaatcttgggaaatcgatctaaaacagctggaatacttgatcgatgaaaaaacagcctgccttatagtgaataacccctcaaatccatgtgggtctgttttctcaaagagacacctgcagaaaatactcgctgtggctgctaggcagtgtgtccctatattggctgacgaaatatacggggatatggtgttttccgattgtaaatatgaacccctcgcaacgctctctacagatgtccctattttatcctgtgggggattagccaaacggtggcttgtgcccggatggaggcttggatggatcttaatacatgatcggcgggatatctttggaaacgaaattcgagatgggctcgtgaaactgtcacagcggattctcggaccatgcacaatcgtgcaaggggccctcaagagtatcctttgtaggacaccaggagaattctatcacaacactttgtcctttctaaaatctaacgctgatctttgctatggagcactcgctgccatacctgggttacggccagtgaggccaagtggagctatgtatctcatggttgggatcgaaatggaacactttcccgaatttgaaaatgacgtggaattcactgaacgattagtagccgaacagtcagtgcattgtttacccgcaacttgctttgaataccctaactttattagggtggtgatcactgtccctgaagtaatgatgctcgaagcatgctctaggatacaggagttttgtgagcagcactatcattgtgctgaagggtcacaggaggaatgtgataaa

SEQ ID NO: 20725 - DNA, 1362 bp, Artificial Sequence
  Description of Artificial Sequence: Synthetic coding sequence
atggatccatacatgattcagatgagctcaaagggcaacttaccatcaattctcgacgttcacgtaaatgtgggcggtcgaagttccgtgcccggaaaaatgaaagggaggaaagcgcgctggtccgttcgcccctcagacatggctaaaaagactttcaaccccatacgcgcaattgtagataacatgaaggtgaagcctaatccaaacaagactatgatctccttgtcaataggcgatcctactgtgtttgggaatctgcctaccgatccagaggtaactcaagccatgaaggatgcccttgactccggaaaatacaacggctacgcacctagcattggattcttgtcgtcccgggaggaaattgccagctactaccattgccccgaagcaccactggaggccaaagacgtgattctcacctctggatgttcccaggccatcgatctgtgtctcgccgtgctggctaatcctggccagaacatcctggtgccgcgcccggggtttagtctctataaaacacttgcggaaagcatgggaattgaggtcaagctctacaatctcctccctgagaagtcctgggagattgacttgaaacagttggagtacttgattgatgaaaagaccgcgtgcttgatcgtgaacaacccaagcaatccttgtggcagcgtattttcaaaaaggcacctccagaaaattctggcggtcgcagctcgacagtgcgtgccaatcttagcagacgagatctacggcgacatggtgtttagcgattgtaaatatgagcctctggcgaccctgagtaccgacgttccgattctgtcctgcggcggcctggccaagcgctggctggtccctgggtggagacttggctggatcctgattcacgaccgcagggatattttcgggaacgagatccgtgatggtcttgtgaaactatctcagcggatcttgggcccctgcacaattgtacagggcgcactaaagagcatcctctgccggaccccaggtgagttttatcacaataccctgtccttccttaaatcgaacgctgatctgtgttacggcgcccttgccgccattcccggactgaggcccgttcggccctccggcgccatgtatctcatggtcggaatcgagatggaacacttcccagagttcgaaaacgacgtggaatttaccgaaaggctggtcgccgagcagtccgtgcactgcctgcctgcgacttgcttcgaatatcctaactttatacgagttgtgatcaccgtgccagaggtgatgatgttagaggcctgctcaaggattcaggagttttgcgaacagcattatcattgcgcagagggcagtcaggaggaatgtgacaaa

SEQ ID NO: 20726 - DNA, 1362 bp, Artificial Sequence
  Description of Artificial Sequence: Synthetic coding sequence
atggatccgtatatgattcagatgtcgtccaaggggaatcttcctagcattctggatgtgcatgttaatgtcggcggacgatccagcgtgccgggcaagatgaaggggcgtaaggcccggtggtccgtccgacctagtgacatggccaagaagacattcaatcccatccgagcgattgttgataacatgaaggttaagccaaacccgaacaagacgatgattagcctcagcataggggatccaaccgtcttcgggaacctccccacagaccccgaggtcacacaagctatgaaagatgcacttgactccgggaagtacaatgggtatgctccgtcgatcggcttcctcagttctcgcgaggagattgctagttactatcattgcccagaagcgcctctcgaagccaaggatgttatcttgacctctggatgcagtcaagctattgatctttgcttggcagtcctcgccaacccaggtcaaaatattctcgtcccacgtcctggttttagcctctacaagaccctagcggaatcaatgggaatagaggtgaagctttataatttgctccccgaaaagtcctgggagatcgaccttaaacagttggagtatcttatagacgagaaaaccgcatgtctaattgtgaacaacccgtctaacccgtgcgggtcagttttctcgaagcgccatctgcagaagatcctggctgtcgctgctagacagtgtgtgcccatcttagccgacgagatatatggtgacatggtcttctctgactgcaaatacgaaccactcgctaccctttccacagacgtccccattttgtcttgtggtggtcttgccaagcgttggcttgtccccggttggcgtcttggttggatcctcatccatgaccgcagggatatattcggtaacgagattcgtgatggcctcgtaaagctctctcagcgtatcctcggcccgtgcacaatagttcaaggagctctaaagtctatcctgtgtaggaccccaggagaattctaccacaacacattgtctttcctgaagtccaatgctgatttatgctatggggctctcgccgcgatccctggactcaggcccgtcaggcctagcggtgctatgtatctaatggttggtattgaaatggagcattttccggagttcgagaatgatgttgaattcacggaacgtctcgtggccgagcagtccgtgcattgcctccccgctacttgctttgaatatccgaactttatccgtgttgttatcacagtcccagaggtcatgatgctggaggcgtgctcaagaatccaggagttttgtgagcagcactaccactgtgcggagggttctcaagaggagtgtgacaag

SEQ ID NO: 20727 - DNA, 1362 bp, Artificial Sequence
  Description of Artificial Sequence: Synthetic coding sequence
atggatccctatatgatccaaatgtcttctaaggggaatctcccatcaatcttggacgttcacgtgaatgttggtgggcgctccagcgtccccggaaagatgaaaggacgtaaggccagatggagcgtgcgtcccagtgatatggcaaagaaaacatttaaccctattagagcaatcgtggataatatgaaagtgaagccaaatcctaacaaaaccatgatatccttatcaatcggcgaccccacggtgttcggcaatctccctaccgatcccgaagtcacgcaagctatgaaggatgcccttgactctggtaaatacaacggatacgctcctagtattggcttcctttcatctcgtgaggaaatcgcgagttactatcattgcccagaggctcctctggaagccaaagacgtgatcctgacgtctggttgcagtcaagctattgatctgtgcctggccgtactggccaaccccggccagaatatcctggtaccccgacctggcttttccctgtataagacattagccgagtctatgggaatcgaagtgaaattgtacaaccttctgcctgaaaagagttgggaaatcgaccttaagcagttagagtatctgatcgatgagaaaactgcatgtcttatcgtcaataatccatctaacccgtgcgggtcagttttctccaagcgccatctccagaagattctggcagtggctgccaggcagtgcgtgcctattctggctgatgaaatttatggagatatggttttttcagattgcaaatatgaaccccttgccacactgagtaccgacgtccccattctgtcgtgcggaggcttagcaaagaggtggctggtcccaggttggcgtctagggtggatcctgattcacgatcggcgtgacatcttcgggaatgaaataagggatgggctcgtcaagcttagtcagcggatcttggggccttgcaccatcgtgcagggggccctgaaaagtattctctgcaggacgccaggcgagttctaccacaatacgctctctttcctcaagagcaatgccgacctgtgctacggcgccttggcagccatccctggcctcagacccgtacggccctctggggcaatgtatctgatggtgggcatcgagatggagcatttcccggagtttgaaaatgacgtggagttcactgaacggctggttgctgagcagagcgtgcattgcttgccagcaacatgcttcgaatacccgaactttatcagggtagtgatcacagtgccagaggtcatgatgctggaggcgtgctcccgaattcaggagttttgtgagcagcactatcactgtgccgaggggtcccaagaggagtgtgataaa

SEQ ID NO: 20728 - DNA, 1362 bp, Artificial Sequence
  Description of Artificial Sequence: Synthetic coding sequence
atggatccttatatgatccagatgagtagtaaagggaacctgccgtctatactggatgttcatgttaatgttggcgggagatcaagtgtcccaggcaaaatgaagggccgaaaagcaaggtggtcagttcgaccctccgacatggccaagaagacttttaaccctataagagccattgtcgacaacatgaaggtgaagccaaaccctaacaagaccatgatctctctgtctatcggtgaccctacagtctttgggaacctacccactgacccggaagtgacgcaggctatgaaggatgccctggactctgggaagtacaatggctacgctcccagtataggtttcctgtcgtccagggaagaaatcgcctcttattaccactgtcccgaagcccctctggaggcaaaagacgtgatcctgacttctggctgttcccaggccattgatctgtgtctggccgtcctggccaaccctggacagaatatccttgtgcctagacccggattctccttgtacaaaacattagccgagtccatggggatcgaagttaaactttataacctcctgcccgagaagagctgggaaattgatctcaagcagctggagtatcttatagacgagaagaccgcgtgccttatcgttaacaatccctcaaacccttgtggatcggtattctctaaacgccatttgcagaaaattctggctgtggccgctcgccagtgcgtgcccattctagcagacgagatttatggcgatatggttttctccgactgtaagtacgaacccctcgctacattgtcgactgacgtgcccatactgtcctgtggcgggttagctaaaaggtggctggtgcccgggtggaggctgggatggatacttatccacgataggcgcgatatttttggcaatgagattcgagacgggctcgtaaagttgtcccagaggatcctcggtccatgcaccatcgtccagggtgccctcaagagtatactctgtagaactcccggcgaattctaccacaacaccctctcgtttctcaaaagcaacgcggacctttgttatggggccttagcagctatccctggcctgagaccagttagacctagcggagctatgtatttgatggtgggcatcgagatggagcacttccccgaattcgaaaacgacgtggagtttacggaaagacttgtggccgagcagtctgtccactgtctccccgccacttgctttgagtatcctaatttcatcagagtcgttattacggtcccagaggtgatgatgctggaagcctgtagcaggattcaagaattttgcgagcagcattaccattgcgccgaaggaagccaggaagagtgcgataag

SEQ ID NO: 20729 - DNA, 1362 bp, Artificial Sequence
  Description of Artificial Sequence: Synthetic coding sequence
atggacccctatatgatccaaatgtctagcaaaggcaatctgccgtcaatccttgacgtgcatgtcaatgttgggggtcgttcctcagtcccgggtaagatgaaggggagaaaggctcgttggtctgtgcggccgagcgacatggcgaaaaaaactttcaatccgattcgagcaattgtggacaatatgaaagttaagccaaatcctaataaaacaatgatttccctaagtattggcgatccgacagtatttggtaatctgccgacggatcctgaagtcacgcaagcgatgaaagatgcattggactcgggaaaatacaatggatatgccccgtctataggttttttatcttctcgtgaggaaatcgcctcatattatcactgcccggaagctcctcttgaggcgaaggatgtcatacttactagcggttgttctcaagcaatagacctgtgcttggcggtcttagccaacccggggcagaacattttagtcccgcgccctggtttttctttatataaaactcttgcggaatccatgggaattgaagtaaaactatacaatttattgcctgagaaaagctgggaaatcgatcttaaacaattggaatatctgattgacgagaagactgcttgcctcattgtaaacaaccctagtaatccgtgcggctcggtgttttctaagagacacttacaaaaaattttagctgtcgcagctagacaatgcgtgcctatcctggctgacgagatctatggagatatggtgttttccgattgcaaatatgaacctttggcgactctctcaacggatgtgccaattctaagctgtggaggccttgctaaacgatggctcgttccgggctggcgcctgggctggattctcattcatgatagaagagatattttcgggaacgaaatccgagatggcttggtgaagctttcacaaagaattcttggcccgtgtaccatagtacagggagcgctgaaatctatcctatgtcgcacgcctggagaattttaccataatacattatcctttctgaaaagcaatgcagatctttgctatggagctttagcagcaatccctggtttacgccctgttagaccctccggggcgatgtacttgatggtgggaattgagatggaacactttcccgaatttgagaatgatgttgaattcacggaacgcttagtggcggagcagtcagtgcattgcttaccggctacatgctttgagtatcctaattttatacgtgtcgttatcacggttccggaagtcatgatgttagaggcatgctcgcgtatccaagagttttgtgagcagcattatcattgtgcagagggctcacaggaagagtgcgacaag

SEQ ID NO: 20730 - DNA, 1362 bp, Artificial Sequence
  Description of Artificial Sequence: Synthetic coding sequence
atggatccatatatgatccagatgtcctccaaggggaaccttcccagcatcctggatgtgcacgtaaatgtgggagggaggtctagcgtccccggcaagatgaagggccgtaaggcacggtggtctgtgagaccttccgacatggcgaagaaaacgttcaaccctatccgagccatcgttgataatatgaaagtaaagcctaatcctaacaagacaatgatttctctctccatcggagatccaacagtattcggaaatctgcctacggaccctgaagttactcaggcaatgaaggacgcactggattcaggcaagtataacgggtatgccccctctatcggattccttagctctcgcgaagaaatcgcctcctattaccattgtcctgaggcacccctggaggcaaaagatgtaatacttacatctggatgttcgcaggctatcgatttgtgcttggccgtccttgccaaccccggtcaaaatatcctggtgccccgtccagggttttcactgtataagactttggccgagagtatgggcatcgaggtgaaactgtacaatcttctgccggaaaaatcgtgggaaattgatttgaaacagctggagtacctcattgacgaaaagacagcgtgtctgatagtcaacaatcccagcaacccctgtgggtctgtgttttctaaaaggcacctgcagaagattcttgccgttgccgcccgtcaatgcgtccccatcctggccgacgagatttacggggacatggttttttctgactgcaaatatgaacctttagctacactcagcaccgatgtgccgattctatcctgtggcggcttagccaagcgctggctggtccctggctggcggctcggatggattctgatccatgacagacgggatatattcgggaatgaaataagagatggcctcgttaagctgagccagcgcatcctgggcccatgtaccatcgtgcagggcgccctgaaatcaattctgtgtaggacacctggggagttctatcacaacaccctgagtttcctgaagtctaatgcagacctgtgctacggcgctctggcggcaattccaggactgagacccgtgcggcccagcggtgccatgtaccttatggtcggcattgaaatggagcactttcccgagttcgagaatgacgtggaattcaccgaaagactggtggccgaacaatccgtgcactgcttgcccgctacatgttttgaatatcctaattttattagagtggtcattacagtgcccgaggtgatgatgctggaagcttgttccaggatccaagagttttgcgaacaacactatcactgtgccgaaggctcccaggaagaatgcgacaaa

SEQ ID NO: 20731 - DNA, 1362 bp, Artificial Sequence
  Description of Artificial Sequence: Synthetic coding sequence
atggatccatatatgatccaaatgtccagcaagggcaatctgccctccatcctggacgtacacgttaacgtcggcggccgttcttcggtgccggggaaaatgaagggacggaaggccaggtggtccgtgcgcccttctgatatggccaagaagacttttaatcctattcgtgccatcgtggataatatgaaggtgaagcctaatccaaataagactatgatttccctatcaattggcgaccccaccgtcttcggtaacctgcctacagatcccgaagtgacccaggcgatgaaggacgccctcgatagcggcaagtacaacggctacgctcccagtattggctttctgagttcgagagaagagattgcttcttactaccattgcccggaggctcctcttgaggcaaaagacgtgatccttacctctgggtgctcacaggctattgacttgtgtctggctgtgctggccaatccagggcaaaacattttagtgccccgacccgggttttccctttataaaactctagctgaatcaatgggcattgaagtgaagctttataacctgctgcccgagaagagctgggagattgacctgaagcagttggagtacctgatagatgaaaaaacggcttgcctcatcgtcaacaatccctccaacccatgcgggtccgtcttcagcaaaagacacttacaaaagatcctggctgtggctgcgcgtcaatgcgtccctatccttgcagacgagatctacggcgatatggtttttagtgactgcaagtatgaaccactcgctaccctgtccacagatgtacccatcctcagctgcggagggctggcgaaaagatggttggttcctggatggaggcttggctggatcctcatccatgacagacgcgatattttcggtaacgaaatcagggacgggctcgtcaagctttctcagagaattctgggcccttgtaccatagtgcaaggggctttgaaaagtattttatgcaggacacccggcgaattctaccacaacactctgtcgtttttaaaatcgaacgcggatctttgttatggcgccctcgccgctatccccggccttcgcccagtgaggccatcaggagccatgtacctaatggtaggtattgaaatggagcacttcccagagttcgagaatgatgtggagttcaccgaaaggctggtggcggaacaaagcgtgcattgcctgcctgcgacatgtttcgaatatcctaatttcatccgggtggtaataacggtgccagaggtaatgatgttagaggcgtgctctcgcatccaggagttctgcgaacagcactatcactgtgcagagggttcccaggaggaatgtgacaaa

SEQ ID NO: 20732 - DNA, 1362 bp, Artificial Sequence
  Description of Artificial Sequence: Synthetic coding sequence
atggatccttatatgattcagatgtcatctaagggcaacttgccaagcatcctggatgtccacgtcaatgtcggtggccgcagcagcgtgcccggcaagatgaagggccgcaaggctaggtggtctgtgaggccttctgacatggcaaaaaaaactttcaaccccatcagagcaatcgtagataatatgaaagtgaagcctaatcctaacaagacgatgatctctctgagtattggcgaccccactgtgttcggaaacctgccgactgatcctgaggtcacccaggccatgaaggatgccctcgactccggcaaatataacggatacgcaccctctatcggatttcttagctccagagaggagatagcatcttactaccattgtcctgaggcccctttggaggccaaagacgtcattctgacatccggctgttcccaggcgatcgacctgtgtctcgctgtgctcgctaatcccggtcagaatatcctggtccctagacccggcttcagtctgtataagaccctcgcagagtctatgggcattgaggtaaaactctataacctgctgcctgaaaagagttgggagattgatctcaagcagttggagtacctgatcgacgaaaagaccgcgtgcctcatcgttaataaccccagtaatccatgtggctccgtcttcagcaaaagacacctccagaagatacttgctgtcgctgccagacagtgtgtccctatcctggcggacgagatatacggcgacatggtgttcagcgactgcaagtacgaaccactggccacgctgagtactgatgtacccatcctttcctgcggtggcctcgccaagagatggttggtgcccggctggagactcggctggatcctcattcacgaccgccgcgatatttttggcaatgagatcagagacggccttgttaagctgtcacagaggattctcggtccttgtacaatagttcaaggagccttgaaaagcatactttgccgcacgcctggagagttctaccacaacaccctgtctttcttgaaatctaacgctgacctctgttacggagcactcgccgcaattccaggcctgaggccagtgaggccatctggcgcaatgtacttgatggttggtatcgaaatggagcattttccagagtttgagaacgatgttgaatttaccgaaaggctcgtcgccgaacaatccgtgcactgtctgccagccacttgtttcgaataccctaacttcatccgcgtcgtgatcacggtgccagaggtcatgatgcttgaagcttgctcccgcatccaggagttctgtgaacagcattaccactgtgctgaaggttcccaagaagagtgcgataaa

SEQ ID NO: 20733 - DNA, 1362 bp, Artificial Sequence
  Description of Artificial Sequence: Synthetic coding sequence
atggacccatacatgatccagatgtcctccaaaggaaacctgccaagcatacttgacgtacacgtcaacgtcggaggccggtcctccgtgccaggcaagatgaagggccggaaagcccgttggtccgtgcggccttccgatatggcaaaaaagactttcaatccaattagggcaatcgtggacaatatgaaagtgaaacccaaccccaataagacgatgatttcccttagcataggcgatcccaccgtgtttgggaatctcccgaccgatcctgaagttactcaggccatgaaggatgcactggatagtggaaaatataacggttacgccccctctattggcttcctgtcctcgagagaagagatagcatcttactaccactgccccgaggctcccctggaagccaaggacgtgatcctgacttccggttgttcgcaggccatagatttatgtctcgctgtgctggcaaaccctgggcagaacattctggttccgaggccggggttttccctatataaaacactggcagagtccatggggatagaagtcaaactatacaatctgctacctgagaaatcatgggaaatcgacttgaagcaacttgaatatctgatcgacgaaaagaccgcatgtctgattgtgaacaatccatcaaatccttgtggctcagtcttcagcaagcgccacttacagaaaatcctggccgtggcagcgcgccagtgtgtgcctatattggctgatgaaatctacggtgacatggtcttttcagactgtaaatacgagcccctggccacactctctactgatgtgcctatcctgtcctgcggtgggcttgcgaaacggtggctggtaccgggatggaggctcgggtggatactgattcatgatcggcgggatatcttcggcaatgaaatccgagacgggctggtgaaactctcccagcggatcctgggcccttgtacaatagtgcaaggggctttgaaaagtatcctgtgccggaccccgggagaattttatcacaacactctgagctttcttaagtctaatgccgacttgtgctacggagcgttggcagccatcccggggctccggcctgtgcgcccatcgggggcaatgtacttaatggtggggatcgagatggaacattttccagagttcgagaatgatgtggaatttaccgaaaggctggtggccgaacagagcgtccactgtctgccagccacttgcttcgagtacccaaatttcatccgagttgtaatcaccgttcctgaagttatgatgctcgaggcctgttcgcggatccaagagttttgcgagcaacactaccattgcgccgagggttcccaggaggagtgtgacaag

SEQ ID NO: 20734 - DNA, 1362 bp, Artificial Sequence
  Description of Artificial Sequence: Synthetic coding sequence
atggatccctacatgattcaaatgagttcgaaggggaacctgcccagtatcttggatgtccacgtgaacgtgggcggccgctcgtcagtgccgggaaaaatgaagggaaggaaggctcgttggagcgtgcgcccaagcgatatggcgaagaagactttcaaccccatccgtgccatcgttgacaatatgaaggtcaaacccaacccaaacaagaccatgatttccctgtcaattggggatcccaccgtgtttggtaacttgcctacggatcccgaggtgactcaggcaatgaaggacgccctggacagcggcaagtataatggatatgcacccagcataggatttttgtcctcccgagaggagatcgcgagctactaccactgccccgaggcccccctggaagccaaagacgtgatcttgactagcggctgcagccaggctatcgacttatgcctggcagtgctggccaatccgggccaaaatatcctggtgccaaggcctgggttcagtctctacaagacactggcggaatctatgggcatcgaggtcaaactgtacaacctgctccctgagaagtcctgggaaatagacttgaaacagctcgaatacctgatagatgagaagacagcctgtttgattgttaataaccctagcaatccttgtggcagcgtgttctcaaagcgacacctccagaagattctcgccgtagcggcaaggcaatgcgtgccaattctcgccgatgagatctacggcgatatggtgttttcagattgcaaatacgagcccctagccactttaagtacagatgtgccaatcctgtcatgcgggggactggccaagagatggctggtgccaggctggcgcttgggttggatcctgattcatgaccggagggacatcttcggaaacgaaatcagagatggccttgttaagctgtctcagaggattctgggtccctgtactattgtccagggtgcactgaaaagcattctgtgcagaactccaggagaattctatcacaatacgctgtctttcctgaaatctaacgccgatttatgttacggtgctctagccgccattccaggcctgaggccagtcaggcccagtggcgctatgtatctgatggtgggcatagagatggaacatttccccgaattcgaaaacgatgtggagttcacagaacggcttgtggccgagcagtcagtccactgcctcccagctacctgtttcgagtaccccaattttatccgggtcgtaatcacagtgcccgaggtgatgatgcttgaggcttgctccagaatacaggagttttgcgagcagcactaccattgtgccgaagggagtcaggaagagtgtgataag

SEQ ID NO: 20735 - DNA, 1362 bp, Artificial Sequence
  Description of Artificial Sequence: Synthetic coding sequence
atggacccctatatgatccagatgtcctccaagggaaatctgccatcaatcttagacgttcacgtgaatgttgggggccgcagctctgttccagggaagatgaaggggcggaaggcccggtggagcgtccgcccttcagacatggccaagaaaacattcaaccctatacgagcgatcgttgacaatatgaaggtcaaaccgaaccctaacaaaactatgatcagtctgtcaattggagacccgactgtcttcggcaacctgccaacagatcccgaggtaacacaggccatgaaagacgcgctggattctgggaaatataacggctatgctccgtccattgggttcttgagttctagagaggaaattgcgtcatactatcattgtcccgaagcacccctggaggcaaaggatgttatccttacctcagggtgctcccaggctattgacttgtgtctggctgtgctggccaatccgggacaaaacatcctggtccccaggcccggcttttcactctataagactctggcagagtccatggggatagaggttaaactttataatctgctgcccgaaaagtcttgggaaatcgatctcaaacagcttgagtacttgatcgatgaaaagacagcttgcttaatcgtaaacaatccctctaacccctgtggctcagtcttctccaaacggcatttacagaaaatccttgccgtagcagccaggcaatgtgttcccatcctggcagatgagatatatggagatatggtcttctcagactgcaagtacgaaccactagcaaccctaagcactgacgtaccaatactgtcctgcggcggcctggccaaaagatggttggtgcccgggtggagactgggctggatattgatccatgatcgacgcgacatctttggcaacgaaattagggacggactggtgaagctgtctcagcggatactgggaccctgtacaatagtgcagggcgctttgaaaagtatcctgtgccggacgccaggcgaattttaccataatacgctcagttttctgaagtcgaacgcagatctttgttatggtgctctcgccgctatccctggactgcgccctgtacggccatccggggccatgtacctgatggtgggaatcgagatggagcactttcctgagttcgaaaacgacgtggagttcacagaacgcctggtggcagagcagtctgtgcattgtctgcctgctacctgcttcgaatacccaaacttcatccgggtggtaattactgtcccggaggtcatgatgctagaagcatgctccaggattcaggaattttgcgagcagcactaccattgtgctgagggatcacaggaggagtgcgacaag

SEQ ID NO: 20736 - DNA, 1362 bp, Artificial Sequence
  Description of Artificial Sequence: Synthetic coding sequence
atggatccttatatgattcagatgtccagtaaaggtaaccttcccagcattctcgatgtgcatgtaaacgtgggaggtcgttcaagtgtccctggcaagatgaagggcagaaaagccagatggagtgtgaggccctcagacatggctaagaagaccttcaatcctatcagggccatcgtcgacaacatgaaagtcaaaccgaaccctaacaaaaccatgatctccctatcaatcggggacccgaccgtgtttggcaacctccccaccgacccagaagttacacaggccatgaaagatgcccttgactcgggcaagtacaatggctacgctccttcaatcggcttcctgagtagccgcgaggagatagcctcatactaccattgcccagaggctcccctcgaagccaaggatgtgattcttacctctggctgtagccaagccatcgacctctgcctagccgtactcgctaacccagggcagaatatcttagtgcctcgtccggggttctccctgtataagacactggccgagagtatgggaattgaggttaagttgtacaatctgctccctgaaaagtcgtgggaaatcgacttaaagcaactggaatacttgattgacgaaaagacagcttgcctgatcgtgaacaaccctagcaacccgtgcggctccgtgttcagcaaacgccacctgcagaagatactggctgtagcggcccggcagtgtgttccaatcctggctgacgagatctacggcgatatggtcttctctgattgcaagtacgaaccgctcgcaactctgagtacagacgtgcctatcctgagctgcggagggctggcaaaacggtggttggttcccggctggcggcttggatggatcctgatccacgacagacgggacatttttggtaatgagatccgggatggcctcgtcaaactgtcccagaggattctcggcccctgtactattgtacagggcgccctgaagtctattctgtgtcgcactccaggcgaattttaccataacacactgtcgtttctcaaatctaacgcagacctttgttacggagctttagctgcgatccctggattgcggcctgtaagaccttctggggcaatgtacctgatggtgggaatcgaaatggagcacttccccgaatttgagaacgacgtggagtttacagagcggctcgttgccgaacagtctgtgcactgcctgcccgcaacttgctttgagtatcctaattttattcgagttgtgattactgtgcctgaagtgatgatgctcgaggcatgctccagaatacaggagttttgtgagcagcactaccattgtgccgaaggtagccaggaggagtgcgacaaa

SEQ ID NO: 20737 - DNA, 1362 bp, Artificial Sequence; identical to SEQ ID NO: 20713
  Description of Artificial Sequence: Synthetic coding sequence

SEQ ID NO: 20738 - DNA, 1362 bp, Artificial Sequence
  Description of Artificial Sequence: Synthetic coding sequence
atggatccgtacatgattcaaatgtcgtcaaaaggaaatttgccgtcgatccttgatgtgcatgttaatgttggaggaaggtcctcggtgccgggaaaaatgaaaggccgaaaagcacgttggagcgtacgtccgagtgatatggcgaaaaaaactttcaatcccatacgggctattgttgataacatgaaagttaagcccaacccaaacaagacaatgatttcacttagtattggagatccaacagtgttcggaaatttgccgacggatccggaagtgactcaggctatgaaagatgctctggattcgggtaagtacaacggttatgcaccttcaataggattcttgtcatcacgcgaagaaattgcttcctattatcattgtcctgaggctccactggaagcgaaagacgtcatactcacttctggatgctcacaagcaatagacctttgtctcgccgtcctcgccaatccaggacagaatattttggtcccaaggccaggattttcgctttacaagacactcgctgaaagtatgggaatcgaggtcaaattgtataatttactcccagaaaagtcatgggaaattgacctaaaacagctggagtatcttattgatgaaaagaccgcttgtcttatagtcaataaccctagcaacccatgtgggtcagtatttagtaaacgtcatctacaaaaaatccttgcggtagctgccagacagtgtgtacccatccttgcagatgaaatttatggtgatatggtgttttctgattgcaagtacgagccactggcaaccctcagcaccgacgtgccaattctttcttgtggtggactagctaaacgatggcttgtgccgggatggcgtcttgggtggatcttgattcacgatagacgagatatttttggcaacgaaatacgagatggactcgttaagctttcacaaagaatcttgggaccttgtactattgtacagggagctttaaagtcaattctttgcagaacccctggagagttttaccataatacattatcattcttaaagtcaaacgccgatttgtgttatggagctctcgcggcaatcccaggcttaaggccggtacgaccgagcggagcgatgtacttgatggtcggtattgagatggaacatttcccagagtttgaaaacgatgtggaatttactgagagacttgtggctgagcagtcagtccactgtcttccagctacgtgttttgaatatccaaatttcatacgagttgttatcacagttcctgaagttatgatgctagaggcatgctcaagaatacaagagttttgcgagcaacactaccattgtgctgagggttcgcaagaagagtgtgataaa

SEQ ID NO: 20739 - DNA, 1362 bp, Artificial Sequence
  Description of Artificial Sequence: Synthetic coding sequence
atggatccctacatgatccaaatgtcatccaaagggaatctcccatcaattttggacgttcacgtaaacgtgggggggcgaagttctgtgcccggaaagatgaagggccgaaaagcgcgctggtcagttcggcccagcgatatggctaagaaaacttttaacccaataagggccatcgtcgacaacatgaaagtcaagccgaatcccaataaaacgatgatctcactgagtataggagatccaaccgtctttggcaacctccccacggacccagaggttactcaggccatgaaagatgcgttggactctgggaaatacaacggctacgctccgagtattggattcctctcttcacgggaagaaatagcatcatactaccactgccccgaggccccactggaggcaaaggacgtcatactgacttccggatgcagtcaggcgatcgacttgtgcctcgccgtgctcgccaacccaggacagaacattctggtacccaggcctggtttttctctgtataagacattagctgaatccatgggcatcgaagtgaaactgtacaatcttctgcctgagaaaagctgggaaatagacctgaaacaactcgaataccttatagacgaaaaaacagcatgcctgatcgtgaataatccatcaaacccctgcggaagtgttttctctaagcgccaccttcagaaaatcttggccgtggcggccagacaatgtgtaccaattctcgccgacgagatctacggagacatggtgttttcagactgtaagtacgaacccctggccactcttagtactgacgtaccgatcttaagctgcggcgggctggcgaaacggtggttggtcccaggatggaggctcgggtggatcctcattcatgatagaagagacatttttggaaacgagattcgggatgggctcgtcaagctctcccaacggatcttgggcccttgcacaatcgtccagggggccctgaagtccattctctgtaggacgccaggtgagttctaccacaatactttgagttttctgaaaagtaacgccgacctatgttatggcgcactggccgccatccctggtctgaggcctgttaggcccagcggcgctatgtatctgatggtgggtatcgagatggagcatttcccggagtttgaaaatgatgtggaattcacagagcgcctggtggccgaacagtctgtccattgtctgccagccacttgttttgaatatcctaatttcataagggtagtcatcacggttcctgaagtcatgatgttggaggcctgcagtcgcattcaagagttctgcgagcagcattaccactgtgcagagggatcccaagaagaatgtgataag

SEQ ID NO: 20740 - DNA, 1362 bp, Artificial Sequence
  Description of Artificial Sequence: Synthetic coding sequence
atggatccgtatatgatacaaatgtcgtcgaaaggtaatctaccgtcgatactagatgtacatgttaatgtaggtggtcgttcgtcggttccgggtaaaatgaaaggtcgtaaagcgcgttggtcggtacgtccgtcggatatggcgaaaaaaacgtttaatccgatacgtgcgatagttgataatatgaaagtaaaaccgaatccgaataaaacgatgatatcgttatcgataggtgatccgacggtttttggtaatttaccgacggatccggaagttacgcaagcgatgaaagatgcgctagattcgggtaaatataatggttatgcgccgtcgataggttttttatcgtcgcgtgaagaaatagcgtcgtattatcattgtccggaagcgccgttagaagcgaaagatgtaatattaacgtcgggttgttcgcaagcgatagatttatgtctagcggtattagcgaatccgggtcaaaatatattagtaccgcgaccgggtttttcgttatataaaacgctagcggaatcgatgggtatagaagtaaaattatataatctattaccggaaaaatcgtgggaaatagatttaaaacaactagaatatttaatagatgaaaaaacggcgtgtttaatagtaaataatccgtcgaatccgtgtggttcggttttttcgaaacgtcatctacaaaaaatactagcggttgcggcgcgtcaatgtgttccgatattagcggatgaaatatatggtgatatggttttttcggattgtaaatatgaaccgctagcgacgttatcgacggatgtaccgatactatcgtgtggtggtctagcgaaacgttggttagtaccgggttggcgtttaggttggatactaatacatgatcgtcgagatatatttggtaatgaaatacgtgatggtttagtaaaattatcgcaacgtatattaggtccgtgtacgatagttcaaggtgcgctaaaatcgatattatgtcgtacgccgggtgaattttatcataatacgttatcgtttctaaaatcgaatgcggatctatgttatggtgcgctagcggcgataccgggtttacgaccggttcgaccgtcgggtgcgatgtatttaatggttggtatagaaatggaacattttccggaatttgaaaatgatgtagaatttacggaacgtctagttgcggaacaatcggttcattgtctaccggcgacgtgttttgaatatccgaattttatacgagtagtaataacggttccggaagtaatgatgttagaagcgtgttcgcgtatacaagaattttgtgaacaacattatcattgtgcggaaggttcgcaagaagaatgtgataaa

SEQ ID NO: 20741 - DNA, 1362 bp, Artificial Sequence
  Description of Artificial Sequence: Synthetic coding sequence
atggacccgtacatgattcagatgagctctaaaggcaatctgcccagcatcctggacgtgcatgtgaacgttggcggacgaagtagtgtaccagggaagatgaaaggccgcaaagccaggtggagcgttcgcccgtccgatatggcaaaaaagacctttaatccaattcgtgcgatcgttgataacatgaaggtcaaacccaacccgaacaaaacaatgattagccttagcattggggaccccacagtcttcgggaacctgccgacagatcccgaggtcacacaggcgatgaaagacgctcttgatagtggcaagtataacggctacgcgccgtccattggatttctgtcctcccgcgaggaaatcgcctcatactaccactgcccagaggcacccttggaggcaaaagacgtgatcttgaccagcggctgctcacaggcaatcgatctttgtcttgccgttctggcaaaccccggtcaaaacattctggtccctagacctggattttcgttgtataagactttggccgagtctatgggcattgaggtcaaactctacaacctgttgcctgaaaagagctgggagattgatctgaagcaattggagtacctgatcgatgaaaaaacagcgtgccttatcgttaacaacccaagtaacccctgcggcagcgtcttcagcaagcgccaccttcagaagatcctggccgtggctgcccgccagtgtgtgccaatccttgcagacgagatctacggtgatatggtgttctctgactgtaagtacgaacccctagctacattgtctaccgatgtccccatcctctcatgtggtgggttggctaagagatggttggtgcccggatggcgcctcggatggatactgattcacgatcggagggatatctttggaaacgagatccgcgacggactggtgaagttgtcacagagaattctcgggccatgcacaatcgttcaaggagctctcaaaagtatcctgtgccgaacgcccggagaattttaccataacaccttatccttcttaaagagcaacgcagatttgtgctatggggccctcgcagctatcccgggcctgcgcccagtaaggcctagtggagctatgtatctcatggtggggatcgagatggagcactttccggagttcgagaacgatgtggaatttactgagagactagtggccgagcagtctgttcactgtctgccagctacctgctttgaatacccaaactttatcagagttgtgatcacagtcccagaagtgatgatgctcgaggcttgctctcgtatccaggagttttgtgagcagcactatcattgcgcagaaggcagtcaggaagaatgcgacaag

SEQ ID NO: 20742 - DNA, 1362 bp, Artificial Sequence
  Description of Artificial Sequence: Synthetic coding sequence
atggacccctacatgattcagatgagtagcaaagggaacctcccaagcatattggatgtgcacgtaaacgtgggcggacggtcttccgtccccgggaaaatgaaagggagaaaagcccgatggtcagtccgcccctccgacatggctaaaaagaccttcaacccgattagagccattgtggacaatatgaaggtaaagccaaacccgaataagaccatgatctccctgagcattggcgatcctaccgtgtttgggaacctccctacagaccccgaggtgacgcaagccatgaaggatgccttggattctggcaaatataatggatatgccccctcaataggcttcctgtcctcccgcgaagagattgctagctactatcactgccccgaagctcccctggaggccaaagacgtgatcctgacaagtggatgttcccaggcgatcgatctctgcctggcagtgctggcgaaccccgggcagaatattctggtgccgagacctggcttctcactgtacaaaaccctggcagagtccatgggcatcgaagtgaagctgtataacctgctgccagagaagtcttgggagatagacctgaagcagctggagtatttgatcgacgagaagaccgcatgcctcatagtgaataatccatctaatccttgtggatcagtcttctccaaaagacacttgcagaagattctggcggtagccgcaaggcagtgtgtacccattttggctgacgagatctacggcgatatggtcttctcagactgcaagtacgagccccttgctacacttagtacagacgtcccgatcctgagctgtgggggactggccaagagatggctggtgcccggatggcgcctgggttggatactgatacatgatcggcgcgacattttcggaaatgagattagggacgggctggtgaagctgtcccagcgcatcctcgggccatgtacgattgtccagggtgccctgaagtccatcttgtgtcgaactcccggggagttctaccataacactctttcctttttgaaaagcaacgcggacctttgctatggcgcgctggcagccattcctggcttgcggcctgtacgccccagtggcgctatgtacctcatggttggcattgagatggaacactttccggaatttgagaatgacgtggagttcacagaaaggctggtggccgagcaatctgtccactgcctgccagccacctgcttcgagtatcccaattttatcagagttgtgatcacagtgccagaggttatgatgctcgaggcctgctccagaattcaggaattctgtgaacagcattaccactgtgccgaaggcagtcaagaggaatgtgataag

SEQ ID NO: 20743 - DNA, 1362 bp, Artificial Sequence
  Description of Artificial Sequence: Synthetic coding sequence
atggacccttatatgatacaaatgtcgtctaagggcaatcttccatcgattctcgacgttcatgttaacgttgggggacggagctccgtgcctggtaaaatgaaaggtaggaaggctagatggagcgttcgccctagcgatatggcaaaaaagacatttaatccaatacgtgcaattgtagataacatgaaggtgaagcctaatccaaataaaacaatgatttcgctttcgattggtgaccctaccgtctttggcaacctacctactgacccagaagttactcaagccatgaaagatgctctcgactccggaaaatacaacggatatgctcctagtatcggtttcctttcaagccgggaggaaatagcttcatactaccattgcccggaggcacctctggaggcaaaggatgtgattttgaccagtggatgcagccaagctatcgatctttgccttgctgtccttgctaatcctggtcaaaacatactggtaccccgacctggattttctctttataagacccttgctgaaagcatgggaattgaagttaaactgtacaacttactcccagagaagagttgggagatcgatttgaaacaactagagtatttaattgacgagaagactgcgtgcttgattgtgaacaacccatctaacccatgtggaagcgtctttagtaagcgtcatctgcagaagatcctcgctgtggccgctagacagtgtgtcccaatcctggccgatgagatctatggtgatatggtgttttctgactgcaagtatgaacctttagctaccctgagcactgatgttcctatcttgagctgtggtggattagctaagaggtggttagttcccggttggcgcctcggatggatccttattcacgatcgtcgggatattttcgggaatgagattagggatggtctggttaagttgtcccaacgtattctggggccatgtacgattgttcagggggctctgaagtctatattatgtagaactcctggcgagttttaccataatactctttccttcttgaagtctaacgcagacctctgttacggcgctttggccgctattccagggctcaggccagttagaccaagtggggctatgtatcttatggtgggaatcgaaatggaacactttcctgaatttgagaatgatgtggaattcaccgagcgacttgtagctgaacaatcagttcattgtttgcctgctacttgtttcgagtacccaaatttcatccgtgtagtgattactgttcctgaagtcatgatgttggaggcctgttcgcggattcaggaattctgtgagcagcactatcactgcgctgaagggtcacaagaggagtgtgataag

SEQ ID NO: 20744 - DNA, 1362 bp, Artificial Sequence
  Description of Artificial Sequence: Synthetic coding sequence
atggacccttacatgatccagatgtcctccaagggcaacctgccctccatcctcgacgttcatgtcaacgttggagggaggtcttcggtccccggcaagatgaaaggaaggaaggctagatggagcgttcggccaagcgatatggctaagaaaacatttaaccctatcagagctatcgtggataacatgaaagtaaaacccaacccaaataaaactatgatctctctttcaataggtgacccgacagtatttgggaacctccctactgaccctgaagtcacccaagccatgaaggatgcactggattccggcaaatacaacgggtacgccccatccataggtttcctgagttccagggaagaaatcgccagttactaccactgtcctgaggcccctctggaggctaaggatgtgattctgacgtcaggctgcagtcaagcgatcgacttgtgcttggctgttcttgctaatcccggccaaaacatcctggtccctcggcccggttttagcttgtataagaccttggcagaaagcatggggatcgaggtgaagctgtacaatctcctgcctgagaagagttgggagattgatctgaaacagctggaatacttgatcgatgagaagacagcatgtttaatcgtcaataacccctcaaacccttgcgggtctgtgtttagcaaaaggcaccttcagaagattcttgccgtggctgctaggcagtgcgtgcctatcttggcagatgaaatttacggagacatggttttttctgattgtaaatacgaaccactggcaacgctctccacagatgtgccaatactcagctgcggagggttagcaaagcgttggcttgtacctggatggagacttggctggatacttatccacgataggagagatattttcggcaatgaaattagagacggacttgtgaaactgtcacaaagaatcctgggcccctgtactatagtccagggagctctgaaaagtattctctgccgcacacctggggaattctatcataatacattgagtttcttgaaatcaaatgccgatctttgttatggtgccttggccgccatccccgggctgaggcctgtgagaccttcaggagctatgtacttgatggtgggaatcgaaatggaacactttccagagttcgagaacgacgttgagtttaccgaaaggctcgtcgcagagcaaagcgtccactgcttgccagcaacttgctttgaataccctaacttcatcagagtcgtgataaccgtccctgaagttatgatgctggaggcgtgttcaaggattcaggagttctgtgagcagcattaccactgcgctgaggggagccaggaagagtgcgataaa

SEQ ID NO: 20745 - DNA, 1362 bp, Artificial Sequence
  Description of Artificial Sequence: Synthetic coding sequence
atggacccctacatgattcagatgtcatccaaaggaaacctgccctcaattctcgatgtccatgtgaatgtgggcggcaggtcctctgttcctggtaagatgaagggaagaaaggcccggtggtctgttagaccgtccgacatggctaaaaaaacattcaatcctatcagagccatcgtcgataacatgaaagtgaaaccgaacccgaacaagaccatgatttccttgagcatcggtgatccaacagttttcgggaacctccctactgacccggaggtcacgcaggcaatgaaggacgccttggactctggtaagtacaatggatacgccccctctattggcttcctgtcaagccgcgaggagatcgcttcttactaccactgccccgaagctcccctggaagctaaggacgtcatcctgacttctggctgctctcaggctatcgatctgtgcctcgccgtactggccaacccaggacagaatatcctcgtgccaaggcctggattttctctgtataagaccctggctgagagcatggggatcgaagtgaagctgtacaatctgttgcccgagaaatcttgggagatcgatctcaaacaactggagtatttgattgacgaaaagacagcatgcctgattgtaaataatccgtctaatccctgcggaagtgtcttttctaagaggcatctgcaaaaaatacttgcggtcgccgcacggcagtgcgtgcctatactggcggatgagatttatggcgatatggtcttttccgattgtaagtatgagccattggctaccctgtccactgacgttccaatattgagttgcggaggcctggccaaaagatggctggtgccagggtggcgcctgggctggattctgattcatgacaggagggacatcttcgggaatgagattagagatgggctggtcaaactgtcccagcgcatattgggaccctgcacgatagtccaaggtgcactgaaatctatactgtgtcgcaccccgggagagttctaccacaatactctgagcttccttaagtctaacgctgatctgtgttacggagcacttgccgcaatcccaggtctccggcccgtgaggccctctggtgctatgtacctcatggtagggatcgagatggagcatttcccagaattcgagaacgacgtggagtttactgaaagacttgttgcggaacagtcagttcactgtcttcccgccacctgtttcgaataccccaacttcatccgggtcgtgatcactgtgcctgaagtcatgatgctggaagcctgcagcaggatccaggagttctgtgagcagcattatcattgtgccgagggtagccaggaagaatgtgataag

SEQ ID NO: 20746 - DNA, 1362 bp, Artificial Sequence
  Description of Artificial Sequence: Synthetic coding sequence
atggacccttacatgattcagatgtcctccaagggtaacctgccgtctatcctggacgtccacgtcaacgtcggcggtcggtcatctgtgcctggcaaaatgaagggtcgcaaagcacgctggagcgtccgcccaagcgacatggccaaaaaaacgttcaatcctataagggcgattgtcgataacatgaaggtgaaaccgaatccaaacaaaactatgattagcctgtcgatcggcgacccaactgtcttcggtaacctgcctacggaccctgaggttacgcaagccatgaaggatgctctggatagtggaaaatacaatggatatgccccaagtatcggattcttgagctcccgcgaggagatcgcctcctactatcactgcccagaggctccactggaggcgaaagacgtcatactcacctctggatgcagccaagcaatagatctgtgtctggcagtgctcgctaatccaggtcagaacatcctggttcctcgcccggggttttccctgtacaaaacgctggcggaatcgatggggattgaggtgaagctgtataatctcctgcctgagaaatcttgggaaatagaccttaaacagctcgagtatttgatcgatgaaaaaaccgcgtgcctaatcgtgaacaatccatcgaatccttgtggaagtgtttttagcaaaagacatctgcaaaagatcctggctgtggcggcacgccagtgcgtccctatcctggcggacgagatctacggcgacatggtcttttcggattgtaaatatgagccgctggcaacgttgtcaaccgacgttcccattctgagctgcggtggtctggccaagaggtggttggtgcccggatggcgattgggttggatcctgattcacgatagacgcgatatattcgggaatgagattcgcgatggcctcgtcaaactgagtcagcgtattctgggcccgtgcaccatagtccaaggtgcactgaaatcaattctgtgcagaaccccaggcgaattttaccacaataccttgtcttttctgaagagcaacgccgatctgtgttatggagcgctggccgcaatcccaggtctgcgtccggttaggccatcgggagctatgtatttgatggtcggcatagagatggagcactttcccgaatttgagaacgacgtcgaatttaccgagagattggtggcggaacagtctgtgcattgtctgccagctacttgctttgagtatcctaatttcataagagtggtcatcactgtccccgaagttatgatgctagaagcctgcagccgaattcaagagttttgcgagcagcattaccattgcgccgagggcagccaggaggagtgtgacaaa

SEQ ID NO: 20747 - DNA, 1362 bp, Artificial Sequence
  Description of Artificial Sequence: Synthetic coding sequence
atggatccttatatgattcagatgtcttctaaagggaacttgccatctatactcgacgttcatgttaatgtgggagggagatcctcagtgccagggaaaatgaaagggcgcaaagcacgctggtctgtgcgcccttccgatatggcaaaaaagactttcaaccctattcgcgccatagtggataatatgaaagtaaaacctaacccgaacaaaacaatgatctctctcagtataggggatcccactgttttcggaaacctccctacggatcccgaggtgactcaggccatgaaagatgccttagattcaggaaaatataatggatacgcaccatctattggatttctttcaagtcgggaagaaatcgcaagttattaccattgcccagaagctcccctggaagccaaagacgttatacttacatccgggtgctcccaagcaatcgatttatgtctcgccgttcttgcaaaccccgggcagaacatactagtgccccggcctggattctccctttataaaactctcgccgaatccatggggatagaagtgaaactctataatctcctacctgaaaaatcctgggaaatagatctgaagcagctcgaatatttaatagatgaaaaaactgcttgcctcatagtgaacaacccttcgaacccatgtggaagtgtgtttagtaagagacacctgcagaaaatcttagccgtcgcagcccggcagtgtgtgcccatcctggccgacgagatttatggagacatggtgttctcagactgtaaatatgagcctctggcaacactgtctacagacgtgcccatcctctcctgtggaggactcgctaagcgttggttagttcccggatggcggttaggatggatcctcatccacgatagaagagatatattcgggaacgaaattcgggatgggttggtgaaactatcccagcggatacttgggccttgcacaatcgttcagggggccctcaaatcaatactctgccgcactcccggagaattttatcataatactctctcattcctaaaaagtaacgcagatctgtgctacggggccttagctgctattccaggactgaggcccgtgcggccatcaggggctatgtacctcatggtgggaatcgaaatggaacattttccagagttcgaaaacgatgtagaatttacagaaaggctggtcgccgaacagtctgtgcactgcctccctgccacttgttttgaatatcccaattttatacgggttgtgataacagtacccgaggttatgatgctcgaagcctgctcgaggattcaggaattctgtgaacagcactatcactgcgccgaggggtcccaggaggagtgcgacaaa

SEQ ID NO: 20748 - DNA, 1362 bp, Artificial Sequence
  Description of Artificial Sequence: Synthetic coding sequence
atggatccgtacatgattcagatgtcctcaaagggcaatcttccttccattctagacgtgcatgtgaacgtcggaggtaggtcaagtgtgcccggtaagatgaaaggacgtaaggctaggtggtctgtgcggccaagtgatatggcgaagaagaccttcaaccccattcgtgcaatcgtcgataacatgaaagtcaaacctaacccgaataaaacgatgattagtctgagtataggggaccctactgtctttggtaatcttccaacagatccggaggtgactcaggctatgaaagacgcactcgatagcggcaagtacaacggatacgccccctccataggcttcctctcctctcgtgaagagatcgcgagctattatcattgtccagaggccccactggaggcaaaggacgttatcctgacatctggctgtagccaggctatcgacctttgtctggcggttctggctaatcccgggcagaatatccttgttccccgacccggtttcagtctctataaaacattggcagagtctatgggcatcgaggtcaaactgtataacctgctgcccgagaagtcttgggagatcgatctgaaacagctggagtacttgatagacgagaaaaccgcgtgtcttatcgtgaataatcctagcaatccctgtggtagcgtgtttagtaagcggcacttgcaaaagatacttgcggtggccgcgaggcaatgtgtgccaatcctcgccgatgaaatatacggagacatggtcttctcagattgtaagtacgagcctctggcaactctgagcactgatgttcccatcctttcttgtggagggctcgctaaacgctggctggtccctgggtggcggctgggttggatcctcatccatgatagaagggacattttcggcaacgaaatcagagatggcttagttaagctgagtcagaggattctgggaccttgcacgatcgtgcagggagctttgaagagcattttatgtagaaccccgggggaattttaccacaacaccctgagctttctgaagtctaacgctgatttgtgttacggcgctcttgcggcaattccgggactacgtccggtcagaccatccggtgccatgtacctgatggttgggattgagatggaacattttccagagtttgaaaacgacgtcgaatttacagagcgcctggtagccgagcaatcagtgcactgcctgcctgcaacctgcttcgaataccctaatttcattagggtagttataactgtgcctgaagtgatgatgttggaggcctgttctcggattcaggagttctgcgagcagcactatcactgcgcggagggcagccaggaagagtgcgataag

SEQ ID NO: 20749 - DNA, 1362 bp, Artificial Sequence
  Description of Artificial Sequence: Synthetic coding sequence
atggatccatacatgatacaaatgagctccaagggaaatctgccctccattctagacgtgcatgtgaacgtaggtggtagatctagtgttcccggaaagatgaaggggcgaaaggccagatggagcgttagaccaagtgacatggcaaaaaagacatttaaccctatccgggcaattgtggataacatgaaggtaaagccaaatcctaataagaccatgatctccttgtccattggagatcccaccgtgttcgggaaccttccaaccgatcctgaggttacccaggcgatgaaggatgccctggattctggaaagtataatggatatgcccccagcatcggctttctttctagtagggaggaaatagcttcttactaccactgccctgaggcgccgctcgaggccaaggatgtcattctcactagtggttgctcccaggccatagatctctgcctggccgtcttggccaaccctggccagaatatactagtcccaagacccggcttcagcctttacaagacactggccgagtccatgggcatcgaagttaaactgtacaatctgttacccgagaagagttgggaaatcgacctaaaacagcttgagtatctcattgatgagaagaccgcgtgtctgattgtcaacaaccccagcaacccttgcggatcggttttttccaagagacatctccagaagattctcgccgtcgcagccaggcagtgcgtaccgatactggcggacgaaatttatggcgatatggtgttttcagattgcaaatacgagcccctcgccaccctgtctaccgatgttcctattctgtcttgcggcggtctggcgaaacgatggttggttccaggatggaggctggggtggatccttatccacgatagaagagatattttcggtaacgagatccgagatggcttagtcaaattgtctcagcgtatccttggcccttgcaccattgttcagggcgcactgaagtctatcctgtgcaggacgcccggagagttttaccacaatacgttgtccttcttgaagtctaacgcagacctttgctatggggccctcgccgccatcccaggcttgaggccagtccggccaagcggggcaatgtacctcatggtcggaatcgagatggagcacttccccgaatttgagaatgatgtggaattcacagagagattagtagccgagcagtccgtgcactgtctgcctgcgacatgtttcgaatatccaaatttcattagggtagtgattacagtgccagaagttatgatgctcgaagcctgctcgaggattcaggaattctgcgaacaacactaccactgtgccgagggttcccaggaagaatgcgacaaa

SEQ ID NO: 20750 - DNA, 1362 bp, Artificial Sequence
  Description of Artificial Sequence: Synthetic coding sequence
atggacccatacatgatccagatgagttccaagggcaacctgccgtctattttggacgtgcatgtgaacgtgggaggaaggtccagcgtcccagggaagatgaagggaaggaaggctcgatggtccgtgaggccctcagacatggccaaaaagacatttaaccctattagggctatcgtcgataacatgaaggttaagccaaacccaaacaaaacaatgatcagtctttcgatcggagacccgacagttttcggaaacctgcccaccgatccagaggttactcaggctatgaaagacgccctggacagcggcaagtataatggttatgccccttccatcggtttcctgtcgagtcgcgaagaaatcgcatcatactatcactgtccagaagcacccctggaggctaaagatgttatcctgacgtcgggatgttcccaggccatcgacttgtgcctcgcagttctcgccaatcccggtcagaatatattggttcctaggcccggttttagcctttataaaaccttggctgagagcatgggcattgaggttaagctctacaacctcttacccgagaagagctgggaaatcgatttgaagcagctagaatatttaatagatgaaaagacagcgtgtctgatagtgaacaacccatccaatccctgcggctcggtgttcagtaagcgtcacctccagaaaattctcgctgtagccgctcgacagtgcgtgcccatactcgcggatgaaatttatggtgacatggtgttcagtgactgtaaatacgagcctctagctaccttatccacagacgtccccattctgtcttgtgggggtctggcaaagcggtggttggtccctggctggagattagggtggattttaatccatgatcgcagagacattttcggtaatgaaatccgggacggactggtaaagctgtcccagaggatcctgggcccctgtactattgttcaaggagctctgaagtctattctgtgtcggacaccaggcgaattctatcacaacacgctgtctttcctgaaatccaacgctgacctgtgttatggcgcgttagctgccatccctggtctacgccctgtccggccatcgggcgcaatgtatcttatggtcggtatcgagatggaacattttccagagttcgagaacgacgtggaatttacagagcggcttgtagcagagcagtctgttcactgtctgcccgcgacttgttttgagtatcccaatttcattcgggtggtgataacagtgcccgaagtcatgatgctggaagcctgttcaagaatccaggaattctgcgaacaacattaccattgtgcggagggatcacaggaagagtgtgacaaa

SEQ ID NO: 20751 - DNA, 1362 bp, Artificial Sequence
  Description of Artificial Sequence: Synthetic coding sequence
atggacccttatatgatccagatgtcttcgaagggcaacctcccctccatccttgacgttcacgtaaacgtgggcgggcgaagttccgtccccgggaaaatgaaagggaggaaagcaagatggagtgtgaggccctcggacatggctaaaaaaaccttcaatcccattagggcgatcgtggacaacatgaaggtgaagccaaaccccaacaagacaatgatctctctctcaattggggacccaactgtgtttggaaacctaccaaccgacccggaagttactcaggctatgaaagatgctctggacagcggcaaatacaatggctacgctccatcaattgggtttctcagctctcgggaggagattgcaagctattaccactgccctgaggctccgttggaggcaaaagatgtgattctgactagcggatgttcccaggctatcgacctgtgtctggctgtcctagctaatcctggccagaatatactggtcccaagaccaggcttctccctgtacaagaccttggccgagagcatgggaattgaggtgaagctgtataacctcttgccagaaaaatcctgggaaatagacctgaagcagcttgaatatctaattgacgagaaaactgcatgtctgattgtcaacaacccaagcaacccctgtggcagtgtgtttagtaaaagacacctgcagaaaatccttgctgtggctgctaggcagtgtgtcccgattctagctgacgagatttatggagacatggtgttcagtgattgcaaatacgagccgctggctacactctcaaccgatgtgcccatactgtcatgtggcggacttgccaagcggtggctggttccaggctggcgcttgggctggatccttattcacgacagacgcgacatcttcggcaacgagatccgagacggcctggttaagctgagccagagaatcttaggcccatgcacgattgtacagggggcactgaagagcattctgtgccgcactccgggagagttctaccacaacactctgagctttctgaagtcgaacgcagatctgtgttacggtgcgctggctgccatccctgggctgaggcccgttagaccttctggtgccatgtatctgatggtgggcatagaaatggagcactttcccgaattcgagaatgacgtcgaattcacagaacgcctagtagcagaacagagcgttcattgcctccccgcgacctgcttcgagtacccaaatttcatccgcgtggtcattacagtacctgaagtaatgatgctcgaagcatgttcgcgaatccaggagttctgcgagcagcactatcattgcgcggagggaagtcaagaagaatgtgacaag

SEQ ID NO: 20752 - DNA, 1362 bp, Artificial Sequence
  Description of Artificial Sequence: Synthetic coding sequence
atggacccttacatgatccaaatgtcctcgaaagggaacctcccaagtattttggacgttcacgtcaatgttggagggcgtagttctgtgccaggtaagatgaaagggcgaaaggcaagatggtccgtgaggcccagcgatatggccaagaaaacgtttaatcctatccgggcgatcgtcgacaatatgaaagtgaagcccaatcctaataaaacaatgatatccctttctatcggagacccaacagtgtttggtaacctgcccacagaccccgaagtgactcaggctatgaaagacgcactggactcaggtaagtacaatggttatgcacctagtatcggcttcctcagctcgcgcgaggaaattgcatcatattatcactgcccggaggctccgcttgaggcaaaggacgtgatcttgactagtgggtgttctcaggccattgacctctgcctggccgtcctggctaatcctgggcagaatatattggtgccacgccccggcttcagtctatacaagacactagcagaatcaatgggcattgaagtaaaactgtacaacctgctacccgagaagagctgggagatcgacctaaaacagctggagtacctgatcgatgaaaaaacagcttgcctgatcgtgaataatccatccaacccttgtggctcagtatttagcaagcggcatctgcagaaaatactggccgtggcggccaggcaatgtgtacccatactggcagatgagatttacggagacatggtcttttctgattgtaagtacgagccactggccacgctttcgaccgatgtcccaatactgtcttgcggtggtctggccaagcggtggttggtgcctggatggcgcctgggatggatcttgattcacgatcgtagggacatttttgggaacgagatccgcgatgggctggtcaaactcagtcagaggattctaggtccttgcaccatagtccagggggctctgaaatctatcctctgtcgaaccccaggcgagttctaccacaacactctatcattcctgaaatcgaatgccgacctgtgttatggcgctttagcagctatacccggactgcgaccggtgcggccttcaggagccatgtacctgatggtcggcattgagatggagcatttccccgagttcgaaaatgacgtggagttcaccgagaggctcgtcgccgagcagagcgtgcactgtctccctgccacttgttttgaataccctaatttcatcagagtggtcatcacagtgcctgaagttatgatgctagaggcttgttcccgcattcaggagttttgcgaacagcattaccattgcgccgaggggagccaagaagaatgtgataag

SEQ ID NO: 20753 - DNA, 1362 bp, Artificial Sequence
  Description of Artificial Sequence: Synthetic coding sequence
atggacccatacatgattcagatgtctagtaagggcaatctgccaagcatcctggacgtccacgtgaacgtgggtggtagatctagtgtgcctggaaagatgaaggggcggaaagctcgctggagtgtaagaccttcagacatggcaaagaagaccttcaaccccattcgcgctatcgtcgataatatgaaagttaaaccgaaccccaataagacaatgatatcactttccatcggtgacccaaccgtcttcggcaacttgccaaccgacccagaagtcactcaggccatgaaagatgctctagacagcggtaaatacaacgggtacgcccccagtattggatttctctcttcccgcgaagagattgcctcttactaccattgcccagaggcgccactggaagctaaggacgttattctgaccagcggatgctcacaggccatcgacttgtgtctagcagtcctggccaatcccggccagaacattctggtgccacggcccggcttctcattatataaaacactggccgagtccatgggtatcgaagtgaagctgtataatctgcttcctgagaaatcttgggagattgacttgaagcagctcgaatatcttatagatgaaaagacggcctgtttaattgtgaataaccctagcaacccatgcgggtcagtgttcagcaagcgccacttgcagaagattttggcggtcgctgcgagacagtgcgtacccatcttggccgacgaaatatacggagacatggttttctccgattgtaagtacgaacctctggctactctaagcaccgatgtgccaatcctctcatgcggtgggctcgccaaacgctggctcgtgcccggctggaggctgggttggattctcattcatgaccgacgtgacatttttggcaatgagattcgcgacggactggtcaagctgtctcagaggatcctgggcccctgtaccatcgtgcaaggcgctctgaagtccatcctatgcagaacacccggcgaattttatcataataccctcagctttctgaagagcaacgcggatctatgctacggcgctctcgctgccatccccggtctgcggcccgtccgcccatcgggagcgatgtacctaatggtgggtatagaaatggagcactttcctgagtttgagaacgacgtcgagtttacggagaggctcgtcgcagagcagagtgtacattgcctgccagccacatgctttgagtaccccaactttattcgggttgtgatcactgttccagaggttatgatgttggaagcttgttcccgaatccaggaattttgtgagcagcattaccattgcgccgagggcagccaggaggagtgcgacaag

SEQ ID NO: 20754 - DNA, 1362 bp, Artificial Sequence
  Description of Artificial Sequence: Synthetic coding sequence
atggacccctacatgattcagatgtcttcaaagggaaacctgccctccatcttggacgtacacgtcaatgtcggtggcaggagcagcgttcctgggaaaatgaaaggccgcaaagcgcgctggagcgtcagacccagcgatatggccaagaagactttcaatcccattcgcgcaatcgtggataatatgaaggtgaagcccaaccctaataagacgatgattagtcttagcattggtgacccaacagtgttcggcaatctaccgaccgaccccgaggtcacacaggccatgaaagacgccctcgacagcggcaaatacaacgggtacgctcccagcatcggttttctgagtagcagggaggaaattgcctcctactatcactgtccagaagctcccctggaggcaaaagatgtgatcctaacctccggctgttctcaggccatcgacttatgtttagctgtgttggctaaccccggtcaaaatattctcgtgccgaggcctgggtttagcctgtacaagaccctggcggagtccatgggcatcgaggttaagctttataacttgctgccggaaaagagttgggagatcgatctgaagcagctcgaatatctgatcgatgagaagacagcttgccttattgtgaataacccctcaaacccgtgtggtagcgtgttttccaagaggcatctgcagaagattctagccgtcgccgcgcgccagtgtgtgcccatcctggcagatgagatctacggcgatatggtgttctcagattgtaagtacgagccactggcgaccctgtcaactgatgtaccaatacttagttgcggtgggttggctaagcggtggttggtgccaggctggcggctgggttggattttgatacacgataggcgagatattttcggcaacgagattcgcgacgggttagttaagctgtctcagaggatactggggccgtgtaccatagtgcagggtgccctaaagtccatcctctgtaggactcccggcgaattttaccacaatacccttagctttcttaaaagcaatgccgatctgtgttatggcgccctcgccgccattccgggcctaaggcccgtccgtccttcaggggctatgtatctgatggtaggcattgagatggaacacttccccgaatttgagaacgacgtggagtttaccgaaagattggtggccgaacagagcgtccattgtctgcccgccacatgttttgagtatccgaactttattcgcgtggtgattaccgtgccggaggtgatgatgctagaggcctgttcgcgcattcaggaattttgtgagcagcattaccactgcgcagaaggttctcaagaggaatgcgataag

SEQ ID NO: 20755 - DNA, 1362 bp, Artificial Sequence
  Description of Artificial Sequence: Synthetic coding sequence
atggacccctacatgattcaaatgtctagcaagggcaacttgccctctatcttggacgtccacgtgaatgtgggcgggcgatcttcagttccaggcaagatgaagggacggaaggcacgatggtctgtacgcccgagcgatatggcgaagaagacgttcaaccccattcgtgcgatcgtggacaacatgaaggttaaacctaaccctaacaagacgatgatttcactgtcgatcggcgatccgacggtgttcggaaacctgcccaccgaccctgaggttacgcaagctatgaaggatgcactcgactctggaaaatacaacgggtatgctccgtctatcggcttcctttcttcgcgcgaagagattgccagctactaccactgtcctgaggcgccccttgaggccaaggatgtcatccttacgtccggttgcagccaggccatcgatctgtgtctcgccgtcttggctaaccccggccagaacatcttggtccctcgcccggggttcagcctgtacaagacgcttgcggagtctatgggtatcgaggtcaagctctacaatctgctccctgaaaagtcctgggagattgatcttaagcagctagagtatttgattgatgagaagaccgcctgtcttattgttaacaatccgagcaatccttgtggtagcgtgttcagcaagcgtcatttgcagaagattcttgccgtcgcagcccgacaatgcgtcccgatactggccgatgaaatctacggagacatggtgttctccgattgtaaatacgaacccctggcgactttgagtaccgacgtcccgatcctgagctgtggtggcctcgctaagcgatggcttgttcctggctggcggctaggctggatattgatccacgacaggcgagatatcttcggtaacgagatcagggacggactagtgaagctgtcgcaacgtattctgggtccgtgtacaatcgtgcagggggcgcttaagtctattttatgccgcacccccggtgagttctaccacaataccctgtcctttcttaaatccaacgccgatttgtgctacggcgcccttgccgcgatccctggccttcgccctgtccgcccctcgggtgccatgtacctcatggtggggatcgagatggagcactttccggaattcgagaacgacgttgaattcactgagcgacttgtcgccgagcagagcgtgcattgccttccagccacttgttttgagtaccccaactttatccgggtagtcatcacggtgccggaagtcatgatgttagaggcctgcagccgcatccaggagttctgcgagcagcactatcactgtgctgaaggcagccaggaggagtgcgataag

SEQ ID NO: 20756 - DNA, 1362 bp, Artificial Sequence
  Description of Artificial Sequence: Synthetic coding sequence
atggatccttatatgatccagatgtcatccaagggcaatctaccgtctatcttggacgtgcacgtgaatgttggcggcaggtcctctgtgccgggaaagatgaaagggaggaaggccaggtggtcagtgcgtccctctgacatggccaaaaaaacctttaatcccattagggcaatcgtggacaatatgaaggttaagcctaaccccaataaaacaatgatttctctttccataggagaccccaccgtgttcggaaacctcccgacagaccccgaagtgactcaagcaatgaaagatgcactggactccggaaagtataatggctatgcaccatctatcggtttcctgtcttcaagggaagagatagcttcttattaccactgccctgaggctcccctggaagcgaaggacgttatcctgactagtggctgttcacaggccatcgatctctgtctcgccgtgctggcaaatccaggtcaaaacatcctggtgcctcgcccgggcttttctctatataagactctcgctgagtccatggggatcgaggtgaagctgtacaatttgctcccagagaaatcttgggagattgacctaaaacagctagagtacctgatagacgaaaagaccgcctgcctcatcgtgaataatccaagtaacccttgcggttccgtgttctccaagagacatcttcagaagatcctggcggtggccgcgcgacagtgcgtcccaattctcgcagacgaaatatacggcgacatggttttttctgactgcaagtatgaacccctggccactctatccacagatgtccccatcttgtcttgcggcggtctggctaaaaggtggctagtcccaggctggcgtctaggctggatactgatccatgacagacgagacatcttcggcaatgaaatcagggacggcctggtgaagctgtcccaacgtatcctcgggccttgtactatcgtgcaaggagccctgaagagtatcctctgcaggacacccggagaattctatcataacacactgtccttcctgaagtctaacgcagatctatgctatggagcactcgccgctattcctggtctaaggccagtgcgtccaagcggagccatgtatttgatggttggcatcgaaatggagcattttccagagtttgaaaacgatgtcgaatttactgaaaggttggtcgccgagcagtctgttcattgtttaccggccacatgttttgaataccctaactttattagggtagtgataaccgtaccagaggtgatgatgctggaagcgtgctccagaattcaagaattttgcgaacagcattaccactgtgccgaaggatctcaggaagaatgcgacaaa

SEQ ID NO: 20757 - DNA, 1362 bp, Artificial Sequence
  Description of Artificial Sequence: Synthetic coding sequence
atggatccttatatgattcaaatgagttctaagggaaatttaccatcaattttggatgtgcatgttaatgtgggaggtagatcatcagttccaggaaaaatgaaaggaagaaaagctagatggagtgtcagaccatcagatatggcaaaaaaaacattcaatcctataagagcaattgttgataatatgaaagttaagccaaatccaaataaaactatgatctctttaagtataggagatccaacagtttttggaaatcttccaactgatcctgaagttacacaagcaatgaaagatgcattagattctggaaaatataatggatatgcaccatctattggatttttatcttcaagagaggaaattgcttcatattatcattgtccagaagcaccattagaagctaaagatgtaattttaacttctggatgttcacaagctatagatttatgtttagcagttttagcaaatccaggacaaaatattttagttccaagacctggattctctttatataaaactcttgctgaaagtatgggtattgaagttaaattatataatttattaccagaaaagtcttgggaaattgatttaaaacaattagaatacttgattgatgagaaaactgcatgtttaattgttaataatccaagtaatccatgtggatctgtattctcaaaaagacatcttcaaaaaattttagctgtcgcagctaggcaatgtgtacctattttggctgatgaaatttatggagatatggtattctctgattgtaaatatgaaccacttgccacgttatctactgatgttcctatattatcttgtggtggtcttgcaaaaagatggcttgttccaggttggaggttaggatggattttgatccatgatcgtagagacatatttgggaatgaaattagagatggacttgttaaactttctcaaagaatcttgggtccatgtactattgtacaaggagcacttaaatcaatcttatgcaggacacctggagaattttatcataatacactttctttcttaaaatctaatgctgatttatgttacggagcacttgcagcaattccaggtctcagaccagttagacctagtggagctatgtatttaatggtaggaattgaaatggaacattttccagaatttgagaatgatgttgaatttactgaaagattagtagcagaacaatctgttcattgtttaccagctacatgttttgaatatccaaattttattagagttgtgatcacagtcccagaagttatgatgcttgaagcttgttcaagaattcaagaattttgtgaacaacattatcattgtgcagaaggttcacaagaagaatgtgataaa

SEQ ID NO: 20758 - DNA, 1362 bp, Artificial Sequence
  Description of Artificial Sequence: Synthetic coding sequence
atggatccgtacatgatccaaatgtcctcgaaggggaatctgccgtcaatcctggatgtgcacgtcaacgtcggcggacggagcagcgtgcctggtaaaatgaagggtcgcaaggcccggtggtcggtcagaccaagcgacatggcaaagaaaaccttcaatcctatccgcgccattgttgataatatgaaggtgaagccgaatcctaacaaaactatgatctccctcagcattggagatcccaccgtgttcggaaacctcccgaccgatccagaggtgactcaggcaatgaaggacgcactggactccggaaagtataacggatacgctccttccatcggtttcctgtcgtcacgggaagaaatcgcgtcatactaccattgtccagaggctccgctggaggccaaggacgtgatccttacttctggatgctcgcaagcgatcgacctttgtctggccgtgctggctaaccctggacagaatatcctggtcccaagaccagggttctcactgtacaaaactctcgcagaaagcatgggcatcgaagttaagttgtacaatctcctccctgagaaatcctgggagatcgacctgaagcagctggagtacctcatcgacgaaaagacggcctgcctcatcgtgaacaacccatccaacccctgtggatcagtgttcagcaaacgtcatctgcagaagatactggccgtcgccgcccgccaatgcgtgccgatcttggcggatgagatctacggtgacatggtctttagcgactgcaagtacgaaccgctcgcgaccctctccaccgatgtgccgattctttcgtgcggaggccttgccaagcggtggctcgtgccaggatggcgcctgggctggatcctgatccacgacagacgagacatcttcggaaatgaaatccgcgatgggttggtcaaactgagccagcgcattctggggccgtgcactatcgtgcagggggccctgaaatcgatcctctgtcggacccctggcgaattctatcataacaccctgtcgtttctgaagtcgaacgctgatctgtgctacggagcgttggccgcaattccgggccttagacccgtgaggccctcaggcgcgatgtacctcatggtgggaatcgagatggaacatttcccagaatttgaaaacgacgtggagttcactgagaggttggtagcagaacagtccgtccactgcctgccggctacgtgcttcgaatacccgaactttatccgcgtcgtgatcaccgtgccggaagtgatgatgctggaggcgtgctcgcggattcaagaattctgcgaacaacactaccactgtgccgagggaagtcaggaggagtgcgacaag

SEQ ID NO: 20759 - DNA, 1599 bp, Artificial Sequence
  Description of Artificial Sequence: Synthetic coding sequence
atggccgtcgaaagccagggaggccgaccgcttgtcctcggcctcctgctctgcgtgcttggaccagtggtgtcgcacgccggcaagatcctcctcatccctgtggatggctctcattggctctccatgttgggcgcaatacaacagctccagcaacgtggccatgaaatcgtggtcctcgcaccggatgcgtccctctatatacgtgacggcgctttttacacccttaaaacctaccccgtgccttttcagcgcgaggacgtgaaggagtcgttcgtcagccttgggcataatgtttttgaaaacgactcatttctgcaacgagtgattaagacttacaagaagataaagaaggactctgcaatgctgctttccggatgtagccatcttcttcacaataaggaactgatggcatcgctggctgagtccagctttgacgtgatgctcactgatccgttccttccttgttcccctattgtggcccaatacctcagcctgcctactgtgttcttcctgcatgcactgccgtgctcactggagttcgaggcaacccagtgtccgaacccattttcgtatgtgccacgcccacttagttcgcatagcgaccacatgacgttccttcaaagagtgaagaacatgctgatcgccttttcgcaaaactttctgtgtgacgtggtttattcgccttacgcgactctcgcctcagaattccttcaacgggaagtcactgtgcaggatctgttgtcgtcagcctcggtgtggctttttcgttcggattttgtgaaggactacccaagaccaatcatgccaaatatggtctttgtcggaggcattaactgtctgcaccagaatccactgtcgcaggaattcgaagcctacattaatgcatctggagagcatggtattgttgtcttttcccttggttccatggtttcggaaattcctgaaaagaaagcaatggcgattgcagatgcactgggcaagatacctcagacggtgctttggagatacaccggcactcgccccagcaaccttgctaacaacaccattcttgtcaagtggctcccccaaaacgatctcctcggacaccccatgacgagggcttttatcactcatgcgggctcgcatggtgtgtacgagtccatttgtaatggagtgcctatggtgatgatgccacttttcggggatcagatggataacgcaaaacgaatggaaactaagggggccggggtgaccctgaacgtcctggagatgaccagtgaggatttggaaaacgcattgaaggccgtgattaatgataagagttacaaggagaacattatgcggctcagctccctgcataaggatcgccctgtggagcctcttgacctggctgtgttttgggttgaatttgtgatgagacataaaggagctcctcatcttcggcccgcggcacacgatctgacctggtaccaataccactccctcgatgtcattggatttctgctggcagtggtcctgactgtcgcattcatcacttttaagtgttgcgcatacggataccgtaagtgcctggggaaaaaaggaagagtgaaaaaggcgcataagtccaagacccac

SEQ ID NO: 20760 - DNA, 1599 bp, Artificial Sequence
  Description of Artificial Sequence: Synthetic coding sequence
atggccgtggaatctcaagggggccgtcccttggtgcttggactactgctgtgcgtgctggggcctgttgtaagtcatgctggcaagattctgttgatcccagtcgatggcagccattggcttagcatgcttggcgctatacagcagcttcagcaaagggggcacgaaatcgtggtgctagcaccagacgctagcctctatatcagggatggcgcattctatactttgaagacataccctgtcccgttccaaagggaggatgtgaaagagtcatttgtgtcactcggccataatgtcttcgaaaacgacagttttctgcagagggtgatcaagacctacaaaaagattaagaaggattctgcaatgctgctctccggctgttctcatctgctccacaacaaggaattaatggcatcgctggccgagtcgagtttcgacgtaatgttaacagacccgttcctgccgtgctcgccaatagtcgcacagtacctctcattgcccaccgtgttcttcctgcacgctttaccttgttcactcgaatttgaggcgacgcaatgtccaaatccattctcctatgtaccaaggcctctgtcctcgcatagcgaccacatgacatttttgcagagagtgaagaatatgttgatcgccttctcccagaatttcctgtgcgatgtagtgtacagcccttacgcaactctggcgtctgaatttctgcagagggaagtgacagtgcaggacctgttaagctcagctagtgtgtggctctttcgatccgacttcgtgaaagactatcctagacctatcatgcccaatatggtcttcgtgggtgggatcaactgcctgcatcagaaccctttatctcaagagtttgaagcatacatcaacgcatctggtgaacacggaatcgtcgtgttctcccttggctccatggtcagtgagattcccgaaaagaaagccatggctatagcagatgcgctgggcaagattccccagactgtgttatggagatatacaggcacaaggccaagtaaccttgcaaacaacaccatattggtaaaatggctgccccagaacgaccttctcggacacccgatgacgagagcattcattactcacgctggcagtcacggagtctacgaatccatctgcaacggagtccctatggtgatgatgcctctgtttggggaccagatggacaacgctaaacgaatggagacaaagggtgccggcgttacactcaacgtcctggaaatgactagcgaggatctcgagaatgccttgaaggccgtcataaatgataaaagctacaaggaaaatatcatgcgtctgtcgtcattacacaaggatcggcccgtggaacccctggacctagccgtattctgggtcgagtttgtgatgagacataaaggcgctccgcacctgcgaccagccgctcacgatctgacctggtaccaataccacagcctcgatgtgattgggttcctgctcgccgtcgttctgaccgttgcattcattactttcaaatgttgcgcctacggatatagaaaatgtctggggaagaagggtcgagtgaagaaggctcataagagtaaaacccat

SEQ ID NO: 20761 - DNA, 1599 bp, Artificial Sequence
  Description of Artificial Sequence: Synthetic coding sequence
atggcagtggaatcacaggggggcagacctctggtgcttgggctgctgctgtgcgttttgggtccagtggtcagccatgctggaaagatcttgttgatcccagtcgatggctcgcattggctgagcatgctcggggccatccaacagctgcagcaacgcgggcatgaaattgtggtgctggcacccgacgcttcgctgtacattagagacggtgcgttttacaccctgaaaacgtaccctgtcccgttccagagagaggacgtcaaagagtcatttgtgtccctcggccataatgtgtttgagaacgattccttcctgcagcgggtgatcaagacttacaagaagatcaaaaaggattcagctatgctcctgtccggctgctcgcatctgttgcacaacaaggagttgatggccagcctggcggagtccagcttcgacgtgatgctgaccgatccgttcctgccatgctctcccatcgtcgcacagtacctgtcactgccaacggtgttctttctccacgcgctcccgtgctctctcgaatttgaagcaactcaatgcccgaacccgttctcctacgtcccgcgcccattgtcgagccacagcgaccacatgaccttccttcagagagtgaagaatatgctgattgcattttcgcagaacttcctctgcgatgtggtctactcaccctacgccaccctggcgtcagaattcctgcaacgggaagtcaccgtccaggacctcctctcctcggccagcgtgtggctcttccgctccgatttcgtgaaggactacccgcgcccaattatgcctaacatggtgtttgtgggaggcatcaactgcctgcaccagaatccactgtcccaggaattcgaagcctacatcaacgcctccggcgagcacggcattgtggttttctccctgggttccatggtgagcgaaatccctgagaaaaaagccatggccattgctgacgccctggggaaaatccctcagaccgtgctgtggaggtacactggaacgcgccctagcaacctggcgaacaatacgatcttggtcaagtggctgcctcagaatgacctgctggggcatccgatgacgcgcgcattcatcactcatgcgggctcgcacggagtgtacgaatcgatctgcaatggtgtcccgatggtcatgatgccattgtttggagatcagatggacaacgcaaagcggatggaaactaagggggccggagtgacgctcaatgtactggagatgacttccgaggacctcgagaatgcactgaaggccgtgatcaatgacaaaagttacaaggaaaacattatgcggctgagctccctccataaggatagaccagtggagccactggacctggccgtgttctgggtggaattcgtcatgcgccacaagggagcccctcatcttcggccggctgcccatgatctgacttggtaccagtaccactcccttgatgttatcggattcctgctggccgtggtgttgactgtcgcgttcataaccttcaaatgctgtgcttacggataccggaagtgcctcggaaaaaagggaagggtcaaaaaggctcacaaaagcaagacgcac

SEQ ID NO: 20762 - DNA, 1599 bp, Artificial Sequence
  Description of Artificial Sequence: Synthetic coding sequence
atggccgtcgagtcgcaaggaggtcgcccactggtgctgggacttctgctctgcgtgctcggccctgtcgtgtctcacgcagggaagatcctgcttatcccagttgatggatcgcattggctctccatgctgggagccattcagcaactgcagcaaagagggcatgagattgtagtcctggccccggatgcatcactttacatccgtgacggagcgttctataccctcaagacctaccccgtgccattccagcgggaagatgtcaaggaatcctttgtgtccctgggacacaacgtctttgaaaacgattcctttcttcaacgcgtgatcaagacctacaagaagattaagaaggattcggcaatgcttctgtcggggtgtagccaccttctccacaataaggaacttatggcttccctggcagaatccagcttcgatgtgatgctcactgatccattcctcccttgctcccctatcgtggcgcaatacctgagccttcctaccgtgttcttcctgcacgcgctcccttgcagccttgagtttgaagcaacccaatgccctaacccattttcgtacgtccccagacccttgagctcacattccgatcatatgacgtttctgcagcgggtcaagaatatgcttatcgcattttcccaaaactttctttgtgatgtggtctactccccttacgccacgctggcttcggaattcttgcagagagaggtgaccgtccaggatctgttgtccagcgccagtgtctggctgtttagatccgattttgtcaaagattatcctcgtccaattatgcctaatatggtctttgtgggtgggattaactgtctgcatcagaatccgctttcccaagaattcgaagcatacattaacgccagcggagaacatggaattgtggtgttcagcttgggatcaatggtgtccgagatccctgagaagaaagcgatggctatcgcagacgcactgggtaagattccgcagactgtcctgtggaggtacaccggtacgcggccgtccaatctggcaaacaatactatactggtgaagtggctgccccagaacgatctcctgggtcaccctatgactcgcgctttcataactcatgcagggtcgcatggagtctatgaatcgatttgcaacggagtgcctatggtcatgatgcctctctttggcgaccaaatggataatgcaaagcggatggaaactaagggagccggggtcacccttaatgtgctggagatgacttcagaggaccttgaaaatgcgcttaaagccgtcatcaacgacaaatcgtacaaggagaatatcatgcgcctttcctcgctgcataaggaccgtcctgtggagcctctggatctcgcagtgttctgggtggaatttgtgatgagacataaaggagcccctcatctgcgcccagcagcccatgatcttacctggtaccagtaccacagccttgatgtgatcggttttcttctggcggtggtgcttaccgtggcatttatcacctttaagtgttgtgcgtacggatacagaaagtgccttggtaagaagggtcgcgtgaagaaggctcataagagcaaaacccac

SEQ ID NO: 20763 - DNA, 1599 bp, Artificial Sequence
  Description of Artificial Sequence: Synthetic coding sequence
atggccgtggaaagtcagggcggaagacccttagtgttgggcctgctgttatgcgtactcggtcccgtcgtttctcacgcaggcaagatcctgctgataccggtggacggctctcattggctttcgatgcttggcgctattcaacagctgcaacagagaggacacgaaatcgtcgtgttagccccagacgcctctctgtatatcagggacggagctttttacacacttaagacctatcctgtgccttttcagcgcgaggacgtgaaggagtctttcgtgtctttgggtcacaatgtattcgaaaacgattcttttcttcaacgcgtcattaagacctacaaaaaaatcaagaaagattcagccatgctactgtctggatgcagccacctcctccataataaggagctgatggcaagcctggctgagtcgagttttgacgttatgttgacagatccttttctgccctgcagccccatcgtggcgcagtacctctctctgcctactgtcttcttcttgcacgcgctaccttgtagtcttgaattcgaggctacccaatgtccaaacccgtttagttacgtgccacggcctctttccagccacagcgaccacatgaccttcctgcagagggtcaagaatatgttgatcgccttcagccagaatttcctgtgtgacgtagtctatagcccttacgccaccctggcaagcgagttccttcaaagggaagttacagtacaggatctattatctagcgccagcgtatggctcttccggagcgatttcgtgaaagactatcccaggcctatcatgccgaacatggttttcgtgggcggcatcaattgtctgcatcagaaccctcttagccaggaatttgaggcctacatcaatgcaagcggtgagcatggcatcgtggtattttcccttggctcaatggtgagcgagatacccgagaagaaggcaatggcaatagcagatgcgttggggaagatcccccagacagtactgtggaggtatacaggaactcggcctagcaaccttgccaacaacaccatactcgtgaagtggctgccacaaaacgatctgctaggccatcctatgactagggctttcatcactcacgctggttctcatggagtgtacgaatctatctgcaacggcgtacccatggtgatgatgccacttttcggtgatcaaatggataacgctaaacgtatggagacaaagggagctggcgtgacgctcaatgtcttagagatgacttcagaagacctggagaacgctcttaaggccgtgatcaatgataaaagctacaaagagaacattatgcggctttctagcctacacaaggataggccagtggagccccttgatctggcagtgttttgggtggagttcgtgatgagacacaagggcgctccacacctgcgcccggcggctcacgatctgacttggtatcaataccacagcctggatgttatcggcttcctgctggccgtggtgctgacagttgcatttatcaccttcaagtgctgtgcgtatggctacagaaagtgcctgggaaagaaaggcagggtaaaaaaagcccataaatccaagacccat

SEQ ID NO: 20764 - DNA, 1599 bp, Artificial Sequence
  Description of Artificial Sequence: Synthetic coding sequence
atggcagtggagagccagggcgggcgcccactcgtccttggcctgctgctctgtgtgttgggtcctgtggtcagtcatgcaggcaagatactgctgattcctgtggatggatcacattggctgtcaatgctgggggccattcagcaacttcaacagcgcgggcatgaaattgtcgtccttgccccagatgcatccctttacattcgtgacggagcattttacaccctgaaaacttaccctgtgccatttcaacgagaggatgtcaaagaatcctttgtctccctgggacacaacgtgttcgaaaacgattctttcctgcaacgcgtgattaagacctacaagaaaatcaagaaagattctgcgatgcttttgtcgggatgttcccatctgcttcacaataaagaacttatggcctcactggcagagtcctccttcgatgtcatgctcactgatccattcctgccatgttcacccattgtcgcgcagtacctgtcacttccgaccgtcttttttctccacgcccttccgtgttcgctggagtttgaggctacccagtgccccaacccgttctcatacgtcccccgccctctgagcagccatagcgaccatatgacctttctccaacgcgtgaagaacatgctgattgcattttcgcaaaactttctgtgtgacgtggtgtacagcccttacgccactctcgcatccgaatttctgcaaagagaggtgaccgtgcaagatcttcttagctcggcatcagtttggctctttcggtccgactttgtgaaagattaccctaggccaattatgccgaacatggtgttcgtgggaggaattaactgtctgcatcagaatcccttgtcgcaagaatttgaagcatacattaacgcctcgggcgaacatggtattgtggtcttttcgctgggttccatggtgtcagaaattcctgaaaagaaggcaatggcgattgccgatgcacttgggaaaataccacagaccgtgctttggagatacaccggaaccagaccttcgaatttggcaaataacaccatccttgtcaaatggctgccacaaaatgaccttcttggccatcccatgacccgagcattcatcactcacgccggttcccatggcgtttacgaatcgatttgtaatggagtgcctatggtgatgatgcctctgtttggggatcagatggataatgcaaaacgcatggagacgaaaggagcaggggtcactctgaatgtcctggaaatgacctccgaggacctggaaaacgccctgaaggcagtcatcaacgataaatcgtataaggaaaacatcatgaggctttcgtcactccataaagacagacctgtcgaacctctcgacttggccgtgttttgggtggaatttgtcatgcggcacaaaggagcaccacatctgcgacccgcagctcatgaccttacttggtaccagtaccactccttggacgtcattggatttctgcttgcggtcgttcttaccgtcgcgtttatcaccttcaaatgttgtgcttatggctaccgcaaatgcctgggaaagaagggacgcgtgaaaaaggcgcacaagagcaagactcac

SEQ ID NO: 20765 - DNA, 1599 bp, Artificial Sequence
  Description of Artificial Sequence: Synthetic coding sequence
atggcagttgagtcacagggagggagaccattggttctgggccttctgttatgcgtgctggggccagtggtctcccatgccggcaagattctactgataccggtcgacggctcgcactggttaagcatgttaggcgccatacagcagctccagcagaggggacatgagatcgtcgttcttgctccagatgccagcttgtacataagagatggcgctttttacacactgaagacatatccagtgccgtttcagcgagaagatgtcaaagagagtttcgtcagccttggccacaacgtgtttgagaacgattccttcctgcagagggtcattaagacttacaaaaaaattaagaaggactcagcaatgttactgtccggttgctctcacctcttgcataataaagagttgatggcttctctggccgagagttcttttgatgtaatgttgacagatccattcctgccatgctctcctatcgtggctcaatatctatcattacccactgtgttctttctccacgcccttccttgctccttagagttcgaggccacacagtgtccaaaccccttttcctatgtgcctcggccattgagcagccactcagaccacatgacttttctccagagggtaaaaaatatgctcatcgcttttagccagaatttcctgtgtgacgtggtctatagcccctatgccaccctggccagtgagttcttacaaagggaggtcacggtgcaagacttattaagtagcgcatctgtgtggctgtttaggtcagactttgtcaaagattaccctcgaccaatcatgcctaatatggtttttgtcggagggattaactgcctacatcagaatcccttgagccaggagtttgaggcctatatcaatgcctctggcgaacacggaatcgttgtgttttcgctcggttccatggtgagtgaaatccctgagaagaaggctatggcgatcgctgatgccctgggaaaaataccacagacggtgctctggcgctacaccggcactcgcccatctaacctagcaaataataccatcctggttaagtggcttccgcagaacgacttgctagggcatccgatgactagggcctttattacccatgccggctctcacggcgtctacgagtcaatctgtaatggggtgccaatggtaatgatgcccctgttcggagatcagatggataatgcaaaaagaatggagacaaagggagcaggggttacattgaacgtgcttgagatgacctcagaggatttagagaacgcactgaaagctgtgatcaatgacaagtcgtataaagagaatatcatgcgcttgtcttctttgcataaagatcgcccggtggagcccctagatctggcggtcttttgggtggagttcgtaatgcggcacaagggggcgcctcacctgcgcccagcagctcatgacttaacctggtatcagtaccacagtctagatgtcatcggttttctgctggcggtcgtcttaaccgtcgcattcatcactttcaaatgctgcgcctacggctaccgcaagtgtcttgggaaaaaagggcgtgtgaaaaaagcgcacaaatcgaaaactcac

SEQ ID NO: 20766 - DNA, 1599 bp, Artificial Sequence
  Description of Artificial Sequence: Synthetic coding sequence
atggctgtcgagtcacagggaggtaggccactggttttagggttattgctgtgcgtcttgggcccggtcgtctcacacgccgggaagatcctgcttatacccgttgacggtagccactggctctctatgttaggcgctattcagcaacttcagcagcggggtcatgagattgtggtgctcgctcccgacgctagtctgtacatccgcgatggggctttctatactttaaaaacatatcccgttcccttccagcgggaagacgtgaaggaatcttttgtgagcctagggcataacgtctttgagaacgactcttttctccagagagtgattaaaacatataagaagatcaagaaagattcagccatgcttctttccggctgcagccacctgctgcataacaaggagctgatggcctcactggctgagagctcttttgatgtgatgctgactgatccatttttaccctgttctccaatcgtcgctcagtacctcagtcttcccacagtattcttcctacacgcgctcccttgtagcttagaattcgaggccacacagtgtcctaatccctttagctacgttcccagaccgctctcctctcattctgaccatatgacattcctgcaacgggtcaagaatatgctcatcgctttctcacagaattttctgtgcgacgtggtgtacagtccctatgcaacactggccagcgaatttctgcagagagaggtcacagtgcaggacctgctgagctcggcttccgtgtggctctttagatctgatttcgtcaaagactaccctcggcccattatgcctaacatggtcttcgttggcggcatcaactgcctccaccagaaccctctctcccaggaattcgaagcttacataaacgcctcaggcgaacatggcattgtagttttcagcttgggcagtatggtgtccgaaatccctgagaagaaggctatggccattgccgatgcgctaggtaagattcctcagacagtgctgtggcgctacaccgggactcgaccttccaacttagccaacaatactatcctggttaagtggttgccacagaacgacctcctcggtcacccgatgaccagggcattcatcacccacgcggggagtcatggcgtctacgaaagcatttgtaatggggtgcccatggtcatgatgcctctgttcggcgatcagatggacaacgccaaacggatggagaccaagggcgcaggtgtaactctaaacgtgctggagatgaccagtgaggacctggagaacgcgcttaaggctgtcattaatgataaatcttataaagaaaacattatgcgtttgtctagcttgcacaaggaccgccctgtggagcccctagatctcgcggtgttttgggtagaattcgtcatgcgccacaaaggagccccccatttgcggcccgctgcgcatgacttaacgtggtatcaatatcattccttggacgtaatcggattcctgctggccgtagtgctcaccgtggcttttataacgttcaagtgttgtgcttacgggtaccggaaatgcctgggaaagaagggaagggttaagaaggcccataagtccaaaactcac

SEQ ID NO: 20767 - DNA, 1599 bp, Artificial Sequence
  Description of Artificial Sequence: Synthetic coding sequence
atggcagtggagtcccagggcggtcgtcccctggtgctcggtttgctgctctgcgtcttgggccctgtggttagccacgctggcaaaattctgttgattcctgtggatgggagtcactggttatcaatgctaggcgcaatacagcagctacagcaacgtgggcatgaaatcgttgtcctggcaccagacgcgtcactctatattagggacggcgccttttacactttgaaaacataccccgtgccgttccagagggaggatgtgaaagaatccttcgtttcgctgggtcacaatgtttttgagaatgactcattcctccaacgcgtgataaaaacgtataagaaaattaaaaaggattcagcgatgcttctaagtgggtgctctcacctgctccacaataaggagttgatggcgagtctggccgagagcagcttcgatgtaatgctgactgaccctttccttccgtgctccccgattgttgcacagtatctctccctgccgaccgttttcttcctacacgctctgccatgctctttagaatttgaggcaacccagtgcccaaacccattttcttacgtccctcgccccctctccagtcattccgatcacatgactttcctccagagagtaaagaacatgctcatcgccttttcgcaaaatttcctgtgtgatgttgtttattcgccctacgccactcttgcaagtgaatttttgcagcgagaggttaccgtacaagatttgcttagttctgcatcagtttggctgttcaggtcggatttcgtcaaagattacccacgccccattatgcctaatatggtgtttgtgggggggatcaattgtctccaccagaacccactgagtcaagagtttgaggcttatattaacgcaagcggcgagcacggaattgtcgtgttcagcctagggtccatggtttcagagattccagaaaagaaagccatggcgatcgcagatgccctaggtaaaataccccagacagttttatggagatatacaggaacccggccatctaacctcgctaacaataccatccttgttaagtggcttccacagaatgatctgctaggccaccctatgacacgcgcgttcatcactcatgcagggtcgcatggggtttatgaatctatctgtaacggggtgcccatggttatgatgccactcttcggagaccaaatggacaacgctaagagaatggaaacgaagggcgcgggcgttactctgaatgtcttggagatgacatcggaggatttggagaacgctcttaaggccgttatcaacgataagagctataaggagaacattatgcgattgtcatcactacacaaggacagacctgtggaacctttagaccttgctgtgttttgggtcgaattcgtgatgaggcacaagggggcaccacacctgagacctgctgcacatgacctaacatggtaccagtatcacagtctggacgtcattggattcctgctcgccgttgtgctgaccgtcgcgtttattacttttaagtgctgtgcgtacggatatagaaagtgtctgggcaagaagggacgcgttaaaaaggcgcacaagtctaaaacacat

SEQ ID NO: 20768 - DNA, 1599 bp, Artificial Sequence
  Description of Artificial Sequence: Synthetic coding sequence
atggcagtggaaagccaaggaggacgacctctggtgctcggtctgctcctgtgtgtgctgggccctgtcgtgtcccacgcgggcaagatattgctgatcccagtggatggatcccattggctttcgatgctgggtgcaattcagcagctgcagcagaggggacatgagatcgtggtcttggcccccgacgccagcctttacatcagggacggggctttttacactctgaaaacttaccctgtcccttttcaaagggaggacgtcaaggagagctttgtgtcgctgggacataacgtgttcgaaaacgattcattcctgcaacgggtcatcaaaacctacaagaaaatcaaaaaggactccgcgatgctgcttagcggatgctcccatcttctgcacaataaagagcttatggcgtcccttgcagaatcctcgttcgacgtgatgctgacggatccgttcctgccttgcagccctattgtcgcgcaatacctgagcctccctaccgtgttctttctgcatgctctgccttgttcgctggagtttgaggccacccaatgcccaaacccattttcatacgttccacgcccactctcgtcgcattccgatcacatgactttcctgcagcgggtgaaaaacatgctcattgccttctcgcagaatttcctttgtgatgtggtttattctccctacgctacgctggcatccgaatttctgcagcgcgaggtgaccgtgcaggatctgctttccagcgcttcggtctggcttttcagaagcgattttgtgaaggattacccccggcctattatgcccaacatggtctttgtgggaggtattaactgtctgcatcaaaatccgttgtcccaagaatttgaggcttacatcaacgcatccggagagcatgggattgtggtgttttcgctcggatcgatggtgtcagaaattcctgagaaaaaggcgatggcaatcgctgatgcactcggcaaaattcctcaaactgtactttggcggtacactggaacccgcccttcaaatcttgccaataacactatactggtgaagtggctcccccagaacgatcttctggggcatccaatgactcgggcgttcataacccatgcaggatcgcatggcgtgtacgaatccatctgtaatggtgtgcctatggtcatgatgccactgtttggagatcaaatggataacgccaaacgtatggaaaccaagggggcgggtgtcacccttaatgtgttggaaatgacctccgaagatttggagaacgcgcttaaggcagtcattaacgacaagagctacaaggaaaacattatgcgactgtctagcctgcataaagacagaccagtggaaccacttgaccttgcggtgttctgggtggaattcgtgatgagacataagggagcccctcatctgcggccagcagcccatgacctgacttggtaccagtaccattccctggatgtgattgggttccttctggccgtggtgcttactgtggcattcattacgtttaagtgttgcgcatacggatacagaaaatgtcttgggaagaaggggcgggtcaaaaaggcacataagtctaagacgcat

SEQ ID NO: 20769 - DNA, 1599 bp, Artificial Sequence
  Description of Artificial Sequence: Synthetic coding sequence
atggccgtggagagtcaggggggcagacccttggtgctgggtctgctcttgtgcgtgttgggccctgttgtatctcacgccggcaagattctcctcatacctgtggacgggtcacattggctttcaatgctgggggccattcagcagctgcaacagagagggcatgaaatcgtggtcctggctccggatgcttctctttacatacgagatggagctttctacactctgaaaacatatccggtcccctttcagagggaggacgtaaaggagtccttcgtgagcctgggacacaacgtctttgaaaatgatagtttcctgcagcgcgtgattaaaacgtacaagaagatcaaaaaggatagtgccatgctcctctccggttgcagccaccttctgcacaataaggaactcatggcctcattggccgagtccagcttcgacgtgatgctgactgacccctttctgccatgctctcccattgttgcacaatatctttctctgccgacagtgttcttcctgcacgcgctcccctgcagcctcgaatttgaggccacccaatgtccgaatccgttttcatacgtcccacgaccactgagcagccacagtgaccacatgacttttctgcagagggtcaaaaacatgttgatcgcgttctctcaaaattttctctgtgacgtggtctacagcccctatgccaccctcgctagtgaatttctgcagagagaggttacagttcaggatctgcttagctcagcctcagtttggttgttcaggtctgattttgttaaggactatcccaggcccatcatgccaaacatggtgtttgtgggcggtattaattgcctgcaccagaacccgctctcacaagagtttgaggcatatatcaatgcaagtggcgagcacggcatcgtggtcttcagcctcgggtctatggtcagcgaaatccctgagaagaaggcaatggcaattgccgatgccctgggcaagattccgcagacagtgctgtggcgatacactggaacaaggccctctaatctggcaaataacactatcctcgttaaatggctgccacagaatgacctgcttggccatcccatgacacgggcctttattacccacgcaggcagtcatggcgtgtatgagagtatttgcaacggggtccccatggtgatgatgccccttttcggcgaccaaatggataacgcaaagagaatggaaaccaaaggcgctggtgttacccttaatgtgctggagatgacaagtgaggacctggagaatgctctcaaggctgttataaatgataagtcttacaaggaaaatatcatgagactgtcctctctgcacaaggatagacctgtcgagccgttggacctggcagttttctgggtcgaattcgtcatgaggcataaaggcgctccgcatctgcggccagcggctcacgacctgacatggtaccagtaccacagcctcgacgttataggcttcctgctcgccgtggtgttgaccgtggcattcatcaccttcaagtgttgcgcttatggctatcgaaaatgcctgggcaagaaagggagggtcaagaaggcgcacaaatccaagactcac

SEQ ID NO: 20770 - DNA, 1599 bp, Artificial Sequence
  Description of Artificial Sequence: Synthetic coding sequence
atggcggttgaatcacagggcgggcgacccttggtcctcggactccttctctgcgtgctggggcctgtagtcagccatgcaggaaaaatattattaatcccggttgatgggtcccactggttgtctatgctcggcgcaatccagcaactacagcagcgcggccacgaaattgtcgtccttgctcccgatgcatcgctatatatccgggatggcgctttctacaccttaaagacatatccggtgcccttccaacgcgaagacgtaaaagaatccttcgtgtcgctaggtcacaacgtgttcgagaatgatagctttctgcagcgggtcatcaaaacgtataaaaagattaagaaagatagtgccatgctcttgtcaggatgttctcacctgctgcataataaggagctcatggcttcactcgctgagtcctctttcgatgtgatgctgacggaccctttcttaccctgctcacctattgtggcgcagtatctctcgctgccaacagtgttctttttacacgcactgccttgtagcctcgaatttgaggccactcaatgcccgaaccctttctcgtatgtgcccagaccactttcatcacactctgaccacatgacgtttctgcagcgcgtgaaaaacatgctcatcgctttcagccaaaacttcttgtgcgacgttgtgtattccccatatgctacactcgcttccgagttcttgcagcgcgaggtcactgtgcaggatctgctcagttccgcctcagtgtggctgtttcgatctgacttcgttaaagactaccctcgacctatcatgccaaacatggttttcgttgggggcatcaactgtctgcaccagaaccctcttagtcaggagttcgaagcgtatattaacgcctccggagaacatggtatcgtggttttttccctgggcagcatggtcagcgagattccagagaagaaagccatggccatagcagatgccttaggaaagataccccagaccgtgctgtggcggtacaccggcactaggccaagcaatctcgccaacaatactatcctggtgaagtggctgccacagaatgacctgctcggccatcctatgactagggcctttataacccatgccgggtcccacggagtctatgagtcaatctgcaacggagtgccgatggtgatgatgccgctatttggcgatcagatggataatgccaaacgcatggaaacaaagggggccggcgtaacgttaaacgtactggagatgacatccgaagacttggaaaatgctttaaaagcagtgattaatgacaaaagctacaaagagaatatcatgagactgtccagtctgcataaggaccgtcctgttgagccgctcgatttggcggtcttttgggttgagtttgttatgaggcacaaaggggcccctcacttacgaccggccgctcacgatctgacatggtatcagtatcattctctcgacgtgattggtttcctacttgctgtggtactgacggtcgcattcattacgttcaaatgctgtgcgtacggataccgaaaatgtcttggtaagaagggcagagtcaagaaagcccacaagtcgaagacccat

SEQ ID NO: 20771 - DNA, 1599 bp, Artificial Sequence
  Description of Artificial Sequence: Synthetic coding sequence
atggccgtcgaatctcaaggagggagaccattagtcctaggattgcttctttgtgtgctggggcctgtggtctcacacgccggaaagatcctcctcatcccagtcgatggttcccactggttgtctatgctcggcgctattcagcaactgcagcagcgggggcacgaaatcgtggtcctggctccggatgcatcactctacatcagggatggtgctttctacacactcaaaacctaccctgttccttttcagagggaggatgtcaaggaaagtttcgtctctcttgggcacaatgtttttgagaacgactctttcctgcaacgagttattaaaacttacaaaaaaatcaaaaaggactcagccatgttgttgagcggatgttcacacttgctccacaacaaagagctcatggccagtctggccgagagctcctttgacgtgatgctgaccgacccttttcttccttgttcccccatagtagcccagtatctgtctcttcccacggttttctttcttcacgccctgccatgctccctggagtttgaagccacacaatgtcccaaccctttttcctatgtgccacgccccctgtcttcacacagcgatcacatgactttcctgcagcgggtgaaaaacatgctgatagctttcagccagaattttctgtgtgatgtcgtatacagcccatacgcaacactggcatctgaattcttgcagcgggaggtgacagttcaagacctcctgtcctctgccagtgtttggttgttcaggtccgactttgttaaggactatcccagacctattatgccaaacatggtttttgtgggcgggataaattgcctgcatcagaaccccctgagccaggaattcgaagcgtatatcaacgcatccggagagcacggcatagtagtgttctccctcggctcaatggtctccgagattcctgagaagaaggctatggccatcgctgatgccctgggcaaaataccacagaccgttctgtggcgctataccgggacacggccaagtaatctggcaaacaataccatcctggtgaagtggctcccacagaacgatttactgggacatcccatgacaagggctttcatcactcatgcgggtagccacggagtgtacgagtccatctgcaacggggtccccatggtgatgatgccactgttcggcgatcagatggacaacgcgaagcgcatggaaacgaagggagccggggtgacccttaacgtgcttgagatgactagcgaggatctcgaaaatgctttaaaagccgttataaatgacaaaagttacaaggagaacataatgcgtctgtctagtcttcataaggaccgccctgttgaacctctagatctggctgtgttttgggttgagttcgtgatgcgccacaagggggccccacacttgagaccagcagcgcatgacttgacatggtaccagtatcatagccttgacgtgattgggttcctactagctgtagtgctgactgttgccttcataacgttcaaatgttgcgcctacggatatcgaaagtgcctgggcaagaaaggaagagttaagaaggcccataaaagtaagactcac

SEQ ID NO: 20772 - DNA, 1599 bp, Artificial Sequence
  Description of Artificial Sequence: Synthetic coding sequence
atggcagtcgaatcgcaaggtggacgccccctcgtgcttggtttgctgctttgtgtgctcggaccagtcgtgtcgcacgccggtaagatccttcttattcctgtggatggttcgcattggctgtcaatgcttggtgcaatacagcagttgcagcagcgcggccacgaaattgttgtcctggcaccagatgcgtcgctctacattcgagacggagcgttttacacccttaaaacctacccagtgccattccagcgagaggatgtgaaagagtcattcgtgtcgcttggtcacaacgtctttgaaaacgattcgtttctccaaagagtgattaagacttacaaaaagatcaagaaagattcagcgatgctcctgtcgggttgtagccacctcctgcacaataaggagctgatggcttcactcgccgaatcctcatttgatgtgatgcttactgacccgtttctgccttgctcgccaattgtggcacaatacttgtcactccctaccgtgttttttcttcacgcattgccatgttccctggaattcgaagcaactcagtgccccaacccattttcttacgtccctagacctctgagctcacatagcgatcatatgacctttctgcagagagttaagaacatgctgatcgcctttagccaaaactttctgtgcgacgtggtgtacagcccgtacgccactttggcgtcagagtttctgcagcgggaagtgacggtccaagatctcctctcgagcgcatccgtgtggctttttcgatccgattttgtgaaggactaccccaggcccattatgcccaatatggttttcgttggcggaattaactgcctgcaccagaatccgctttcacaggaatttgaagcatacattaatgcatcgggcgaacacggcattgttgtgttctcactgggctcaatggtatccgagattcccgagaagaaggcgatggcaattgcagatgcattgggaaagattcctcaaactgtgctgtggcgctacaccggtactcggcctagtaatcttgccaataacaccatccttgtcaagtggctccctcaaaacgatctgctggggcatcctatgactcgggcgtttatcacccacgccggtagccatggagtgtacgaaagcatttgtaatggtgtcccgatggtgatgatgccactttttggcgaccagatggataatgcaaaaaggatggaaactaagggtgcaggagtcaccctcaacgtgcttgagatgacgtcagaagatttggaaaacgctcttaaggccgtgattaatgacaagtcgtacaaggaaaacatcatgaggcttagctcactccataaggatcggcccgtggaacctttggatctggccgtcttttgggtcgagtttgtgatgcgccataaaggagcgcctcacctcagaccagccgctcatgatctgacgtggtatcagtaccatagccttgatgtgattggattcttgcttgcggtggtgctgaccgtggcattcataactttcaaatgttgtgcatacggctacaggaagtgtctgggtaagaaggggagagtgaagaaggcacataagtcgaaaacccac

SEQ ID NO: 20773 - DNA, 1599 bp, Artificial Sequence
  Description of Artificial Sequence: Synthetic coding sequence
atggctgtcgagtcccaaggaggtcgaccacttgtcctaggtttgcttctgtgcgtgcttgggcctgtcgtgtcccatgcgggaaagattctactgatccccgttgatggatcacactggctctcaatgcttggggccattcaacagcttcagcaacgcggccacgaaatcgtcgtcttggcccccgacgcctctctttatatcagagacggggcattttataccctgaagacatatcccgtccccttccagcgcgaagatgtcaaggagtcattcgttagtctaggacacaacgtgtttgaaaatgatagctttttgcagcgcgtcatcaagacctacaaaaagattaagaaggattcagcaatgttactgtctggttgttcccatcttctgcacaacaaagaattgatggcgtccctagcggagtcgtccttcgacgttatgctgaccgacccttttttgccatgtagtcctatcgttgcacagtacttatccctgccgacagtgttcttcctccacgcacttccatgcagtctcgagttcgaggcgacgcagtgcccaaatccgttctcatacgttccgagaccattgagctcgcattctgatcatatgacgttcctgcaaagagtgaagaatatgctaatagcattctctcagaatttcttatgcgatgttgtttattctccgtacgccaccttggcatccgagtttcttcaacgagaagttacggttcaggatctactctcaagtgcttcggtctggctcttccggtcagacttcgtcaaggactatccacgacctattatgcctaatatggtatttgttggcgggattaattgcctccaccagaacccactttctcaagagttcgaggcatatattaacgcgagcggtgagcatggcattgttgtgttctcgctgggaagtatggtgagtgaaatccctgaaaaaaaggctatggccatcgctgacgctttaggtaagatcccacagacggtcctgtggcggtatactggaactagaccttcgaacttggcaaacaacacgattcttgttaagtggctaccgcagaatgacctgttgggtcatcccatgacccgggcgttcataacgcatgccggctcgcatggcgtttacgaaagtatctgcaacggcgtgcctatggtgatgatgccgctttttggagatcaaatggacaacgcaaagcgaatggagacgaagggcgccggcgtaacccttaacgtcctagagatgaccagcgaggacctggagaatgccctaaaagcggtaataaacgataagtcgtataaggagaatattatgcgtctctcatccttgcacaaggaccgcccagttgagccactcgatttggccgttttctgggtcgaatttgttatgcggcacaagggggcgccacacctcagacccgctgcccacgacctcacttggtatcagtaccattccctggatgtcatcggattcctgctggcagtggtgctaaccgtggcattcatcacattcaaatgctgcgcctatggatataggaagtgcctcggaaagaagggtcgcgtaaagaaagcgcataagagtaaaacccat

SEQ ID NO: 20774 - DNA, 1599 bp, Artificial Sequence
  Description of Artificial Sequence: Synthetic coding sequence
atggccgtggagagccaaggtgggcgccctcttgtgctgggactgctgctctgcgtgctgggtcctgtcgtgtcccacgctggaaagatcctccttatcccggtcgacggatcccactggctgtcgatgctgggagctattcaacaactgcagcaaagaggacatgaaatcgttgtgttggcccctgacgcgtcattgtacatccgggatggggccttttacactcttaagacttatccagtgccgttccagagagaagatgtgaaggaatcattcgtgtcattgggtcacaatgtctttgagaacgattcattccttcagcgggttatcaagacgtacaagaaaatcaagaaagattcggccatgctcctctccggctgctcccacctgctgcacaacaaggagctgatggccagcctggcggaatccagctttgacgtcatgctgaccgacccttttctgccttgctcaccgatcgtcgcccagtacctctccctgccgactgtgttcttcctccacgcactgccatgcagcttggagttcgaagcgacgcagtgtccgaaccctttctcgtacgtgcctagaccactgtccagccattcagaccacatgaccttcctccaaagagtgaagaatatgctgatcgctttctcgcagaatttcttgtgcgacgttgtgtacagcccgtacgcgaccctggcctcggagttcctccagcgcgaggtgaccgtccaggacctcctgtcgtctgcgtcagtctggctcttcaggagcgacttcgtgaaggactaccctcgcccaatcatgccgaatatggtgttcgtgggaggtatcaactgtctgcatcaaaacccgctgtcccaggagtttgaagcctacatcaatgcaagcggagagcacggcatcgtcgtattcagccttggatccatggtttccgaaataccggaaaagaaggcaatggctatcgctgacgccctgggtaagatcccgcagaccgtgctgtggaggtacactggaacccgcccctccaacctggctaacaacactatcctcgtgaagtggctgccacaaaacgacctcttgggacacccaatgactcgcgccttcattactcacgcaggttcgcacggggtgtacgaatcaatctgcaacggcgtgcccatggtcatgatgcctctgttcggtgatcagatggacaatgccaagcgcatggaaaccaagggtgccggtgtgaccctgaacgtgctggaaatgacttccgaagatttggagaacgcactgaaggctgtcatcaatgataagtcgtacaaagagaacatcatgagactcagctccttgcataaggaccggcccgtggaaccgctcgacctggccgtgttctgggtggagttcgtgatgcggcacaagggagcgccacacctccgccctgccgcccacgatttgacctggtaccaataccactcgctcgacgttatcggattcctgctcgcagtggtgctgactgtggctttcatcaccttcaagtgctgcgcctacggataccgcaagtgcctgggaaagaaaggaagggtcaagaaggcgcacaagagcaaaacccac

SEQ ID NO: 20775 - DNA, 1599 bp, Artificial Sequence
  Description of Artificial Sequence: Synthetic coding sequence
atggccgtagagtcacagggaggacggcccctggtattgggactgttactctgtgttcttgggccagtggtctcccatgccggaaaaattttactcatccctgtcgatgggtctcactggctctctatgctcggagcaatccagcagttgcagcagaggggacatgaaatcgtggttctggcccccgatgcgagtctctatatccgggatggagcattttatactctcaagacatatcctgtcccctttcagcgcgaagatgtcaaagagtcttttgtctccctaggacataatgtgttcgaaaacgatagtttcctgcagcgcgtcatcaaaacttataaaaaaataaaaaaagactctgctatgctcttatctggatgctcacatctgcttcacaacaaagagctcatggcctctctcgcagaaagtagttttgatgtcatgttgactgacccctttctcccctgttcacccatcgtagcccagtatctctctttaccaacggtctttttcttacacgctctaccctgctccctcgaatttgaggctacacagtgtccaaaccccttttcatacgtccccagacccctctcttctcatagtgaccacatgacattcctccagagagtgaaaaacatgctcatcgctttttcacagaatttcctctgtgatgtggtgtatagtccctacgctactctcgcttccgaattcctgcagagggaagtgactgtgcaggatcttttgtcctccgcatctgtgtggctctttcggtctgatttcgttaaagactacccaagacccattatgcccaacatggtgttcgttggagggatcaattgcctacaccagaatccattgtcccaggagttcgaagcttatataaatgcaagtggagaacatggaatcgtcgtgttttcactcgggagtatggtttccgaaatccctgaaaaaaaagccatggctattgctgacgctcttgggaaaataccccagactgtactttggcggtacactggaactaggccctccaacctagccaacaatactatcctagtaaagtggttgccccagaatgatctgctcgggcatccaatgacacgcgcattcatcactcacgccggatctcacggggtttatgaaagtatctgtaacggagttccaatggtcatgatgccactcttcggggatcagatggataatgccaaacgcatggaaacaaagggagcaggagtaacactcaacgtcttagaaatgacttcagaagatcttgaaaatgctctgaaggcagtcatcaacgataaatcttataaagagaacatcatgcgtctgtcttccctgcacaaagatcggccagtggaaccacttgatttggctgtgttttgggtggaatttgtcatgcgccataaaggagccccacacctaaggcccgccgcccacgatctgacttggtatcagtatcactctttagatgtgatagggttcctgcttgctgtcgttctgactgtggcttttattacattcaaatgttgtgcttatgggtacaggaaatgtcttgggaaaaaagggagagtcaaaaaagcccataaatccaagacacac

SEQ ID NO: 20776 - DNA, 1599 bp, Artificial Sequence
  Description of Artificial Sequence: Synthetic coding sequence
atggccgtggaatcccagggtggacggccgctcgtgttgggactgctgctgtgcgtcctgggaccggttgtttcccatgctggaaagatcctcctcatcccggttgatggctcacactggctctccatgctgggagctatacagcagctgcagcaacgcggacacgaaattgtggtgttggcgccagacgctagcttgtacattagggacggcgccttctacaccctgaaaacttatccggtgcctttccaaagagaggatgtgaaagagtcattcgtgagcctgggacataacgtctttgaaaacgattcgttccttcagcgggtgatcaagacctacaagaagatcaagaaggattccgccatgcttctttcgggatgtagccatctgctccacaacaaggagttgatggcgagcctcgccgagtcatctttcgatgtcatgctcaccgaccctttcctgccgtgctcccccatcgtggcccagtatctgtcccttccaaccgtgttcttcctgcacgcactcccttgcagcctggaattcgaggccacccagtgccctaaccccttttcatacgtcccccggccattgtcgtcccactccgaccacatgaccttccttcagagagtgaagaatatgctgatcgcgttctcgcaaaactttctctgcgacgtggtctactcaccgtacgccaccctggctagcgagttcctgcagagagaagtcactgtgcaagacctcctgtcatcggccagtgtgtggttgttccggtcagatttcgtgaaagattatccacgccctataatgccaaacatggtgtttgtgggtggcatcaattgcctccatcagaatccactgtcacaagaattcgaagcatacatcaacgcctccggtgagcacggaatcgtggttttctcgctggggagtatggtgtcggaaatcccggagaagaaggcaatggctattgcggatgccctgggcaagattccacaaactgtgctgtggcgctacactggaaccagaccttccaatcttgccaacaacactatcctcgtgaagtggctgcctcagaatgaccttctcgggcacccgatgactagggcttttatcactcatgctggtagccacggtgtgtacgagagcatctgtaatggcgtgccgatggtgatgatgccgttgtttggggaccagatggataatgcgaagaggatggaaacgaaaggcgcgggggtcaccctgaacgtgctggagatgacgtcggaggatctggaaaacgcacttaaggcggtgattaacgacaagagttacaaggaaaacattatgagattgtcatcattgcacaaagaccgccctgtcgaacctctcgacctggctgtgttttgggtcgagttcgtcatgcggcataagggtgcgcctcatctgcgcccggccgctcatgaccttacctggtaccaataccactcgctcgacgtgatcggattcctgctggcggtggtactgaccgtagcattcattaccttcaagtgctgtgcctacggatacagaaagtgcctcggaaagaaaggacgagtcaaaaaagcccataagtcgaaaactcac

SEQ ID NO: 20777 - DNA, 1599 bp, Artificial Sequence
  Description of Artificial Sequence: Synthetic coding sequence
atggctgttgaatcacaggggggcagaccgttggtcctcggcttgctcctttgcgttctgggacctgtggtgtcacacgcgggtaagattttgttgattccagtcgacgggtctcactggctttccatgcttggggctatccaacagctccagcagagaggtcacgaaatcgttgtgcttgccccagacgcctcattgtacatccgggacggagcgttttacacactgaagacgtaccctgttccatttcagagggaagacgtcaaggagagcttcgtatccttgggccataacgtgtttgagaacgactccttcctgcagagggtgatcaagacatataagaagatcaagaaggactccgcgatgttactctctgggtgttcccatctactgcataacaaggaacttatggctagcctggctgaatcaagttttgatgtgatgctgaccgacccgtttttaccctgctcccccatcgtagctcaatatcttagcctgcctactgtcttcttcctgcatgcactaccctgttccctggaatttgaggcaacacagtgtcccaatcccttttcttacgtgccaaggccactaagcagtcactccgaccacatgactttcttgcagagggtaaagaacatgctgattgctttctcacaaaacttcctttgtgatgtcgtgtacagcccttatgcaacactagcctccgaatttttgcaaagagaggtgactgtgcaggatttgctgtcaagcgcctctgtgtggctattccggtctgattttgtgaaggattaccccagaccaatcatgcccaatatggtgttcgtgggcgggattaattgtcttcaccagaatcccttgtcccaggaatttgaggcatatattaatgcctctggggaacacggcatagtcgtcttcagcctgggttccatggtgtcagaaatacccgagaaaaaggcaatggccatcgcggacgcactgggaaagattccccaaaccgtgctttggcggtacacaggcacacgcccatccaacctggccaacaatactatccttgtgaagtggctgccccagaatgatctacttgggcatccaatgacacgggccttcataacgcacgcgggttcccatggggtgtacgagtctatttgtaacggagtgccaatggttatgatgcccctctttggcgatcagatggataatgcaaagaggatggagacaaaaggcgcaggcgtgactctcaacgtcctagagatgacaagcgaagatctagagaatgccctgaaggccgtgatcaatgataagagctacaaagagaacatcatgagactctcttctctgcataaggatcgtcctgttgagcccctcgatctggcggtgttttgggtggagttcgtaatgagacacaagggggcccctcacctccgcccagcagcacatgatctcacctggtatcagtaccacagtctggacgtcatcggatttctgctcgcagtggtgcttaccgtcgcttttatcacttttaagtgttgcgcgtatggctacaggaaatgcttggggaagaagggaagagtcaagaaagcccacaaatcaaaaacgcac

SEQ ID NO: 20778 - DNA, 1599 bp, Artificial Sequence
  Description of Artificial Sequence: Synthetic coding sequence
atggccgtggaatcgcagggcggtagaccgctggtgttgggactcctcctctgcgtgctcggaccagtggtcagccacgccggaaagatcttgctcattccagtggatgggagccactggctgtcgatgctcggtgctatccagcaattgcaacaaaggggacacgaaatcgtcgtgctggccccggacgcaagcctgtacatccgggacggggcattctacaccctcaaaacttacccagtccctttccagcgggaggacgttaaggagagctttgtgagcctgggacataacgtgtttgaaaatgattcattcctgcagcgcgtgatcaagacttacaaaaagatcaagaaagatagcgcaatgctgctgtccggctgttcccacctgttgcataacaaagaactgatggcctccctcgccgaaagttcattcgacgtgatgctcactgacccgttcctgccttgctcgcctatcgtcgcccagtacctctccctgcctactgtgtttttcctgcacgcgctgccatgcagtctggaatttgaagccactcagtgtcctaatcctttctcatacgtcccgcggccactgtcctcacattcagatcacatgactttcctccagcgcgttaagaacatgctgatcgcatttagccagaacttcctgtgcgacgtggtgtactcgccgtacgcaactttggcgtccgaattcctccagagagaagtgacggtccaggatctcttgagctccgcctcggtgtggctctttcgcagcgatttcgtgaaagactacccgcgtccgatcatgccaaacatggttttcgtcggtgggatcaattgcctgcaccagaacccgctgtcacaggaattcgaagcctacataaacgcgtccggggaacacggcatcgtcgtgttttccctgggctccatggtgtccgagatcccagaaaagaaggccatggcgatcgcggacgctctcgggaagatcccgcagaccgtcctgtggagatacactggcacccggccgtcgaacctcgcgaacaatactatcctggtcaagtggctgccgcaaaatgacctgctcggacaccccatgaccagagcgttcatcacgcacgcaggatcacacggagtgtatgagtcgatctgcaacggtgtgcctatggtgatgatgccgttgttcggcgaccagatggataatgccaagcgcatggaaaccaaaggagcaggggtgaccctcaatgtgctcgagatgacgtcagaggatctggagaacgccctgaaggctgtgatcaacgacaaatcgtacaaggaaaatatcatgcggctctcgtccctgcataaggatagacccgtggaaccgctggatttggcagtgttctgggtcgaattcgttatgcggcacaagggagccccacacctgcgcccggctgcgcatgatttgacctggtatcagtaccattcgctggacgtcatcggattcttgctcgccgtcgtcctgaccgtggcttttatcactttcaagtgttgcgcgtacggatacaggaagtgcctgggaaagaaaggaagagtgaaaaaggcccataagtcaaagacgcac

SEQ ID NO: 20779 - DNA, 1599 bp, Artificial Sequence
  Description of Artificial Sequence: Synthetic coding sequence
atggcggtggaatcacaaggtggtcggccgcttgtgctgggcttgctgctgtgcgtgctgggaccggtcgtttcccacgcaggaaagatactcctgatccccgtggacgggtcccattggttgtccatgctgggcgcgatccagcaattgcaacagagggggcatgagatcgtcgtcctcgccccagacgcctccctgtacattcgagacggagccttctacacgctgaaaacctaccctgtgccatttcaacgcgaggacgtgaaggagtcttttgtgtccttgggccacaacgttttcgaaaatgactcctttctgcagagagtgatcaagacttacaagaaaatcaaaaaggattcggccatgctgttgtccggatgtagccacctcctgcacaacaaagaactgatggcttccctggcagaatcctccttcgacgtcatgctgaccgatccgttcctgccatgctcgccgatcgtggcccagtacttgtcactgccgaccgtgttcttcctgcacgctctcccatgctcgctggaatttgaggccacccagtgcccaaacccgttcagctatgtgccccgccctctctcttcacactcggaccacatgaccttcctgcagcgggttaagaacatgttgatcgctttcagccagaattttctgtgcgacgtcgtctactcgccctacgctactcttgcatccgaattcctccagcgggaagtgactgtgcaggacctcttgtcctctgcatccgtgtggctgtttcgctcggattttgtgaaggattaccctcggccgatcatgccgaatatggttttcgtcggtggaatcaattgcctgcaccagaatccactgtcccaggaatttgaagcgtacattaacgcctcaggggaacatggaatcgtggttttcagcctgggctcgatggtgtcagagatccccgaaaagaaggcgatggccatagcagacgcactcggaaagattccgcagactgtgctgtggcgctacactggaactagaccgtccaatctggccaataacacgatcctcgtgaaatggctcccacaaaacgatctgctgggacaccctatgacccgggcattcatcacccacgctggatcccacggagtgtatgagtctatctgcaacggagtgccaatggtcatgatgcccctgttcggggatcaaatggacaacgcgaaaagaatggagactaagggagcgggggtgaccctcaatgtgctggagatgacttcagaggaccttgaaaacgcgctcaaagccgtgatcaacgacaaatcatacaaggaaaacatcatgaggctctccagcttgcataaagaccgccctgttgagccgttggatctcgcagtgttctgggtggagttcgtgatgcgtcacaagggagcaccacatctgcgaccagctgcacatgacctgacttggtaccaataccatagccttgatgtcatcggcttcctgctggcggtggtcctgaccgtggccttcatcaccttcaagtgttgcgcctatggctaccgcaaatgtctgggcaagaagggaagggtgaagaaggcgcataaaagcaagacccat

SEQ ID NO: 20780 - DNA, 1599 bp, Artificial Sequence
  Description of Artificial Sequence: Synthetic coding sequence
atggccgtggaatcgcaaggtggacgacccctggtgctgggactgcttttgtgcgtccttggacccgtggtgtcgcacgctggcaaaattcttctgatccctgtggatggatcccattggctctccatgctcggagccattcagcagcttcagcaacgcggacatgaaattgtcgtcctggctccagacgcatctctgtacatacgagacggagccttctatactctcaagacctacccagtgccgtttcaaagagaagatgtgaaggagagcttcgtgtcgttgggccacaatgtgttcgaaaacgattcctttctgcaaagggtgatcaagacctacaagaagattaagaaggatagcgcaatgctgctgagcggatgctcgcatcttctgcacaataaggaactgatggcatcgctcgcagagtcgtcatttgacgtgatgctcactgacccttttcttccttgttcccctatcgtggcccagtacctgagccttccaactgtgtttttcctgcacgcacttccatgtagcctcgaatttgaggcaactcaatgcccgaaccctttttcctacgtccctaggccactctcatcgcattctgaccacatgacgtttcttcagcgagtgaagaatatgctgatcgcattctcccagaactttctctgtgatgtggtgtactccccatacgcaacgctcgcatcagagttcctgcaacgggaagttaccgtgcaggatctcttgtccagcgcgagcgtgtggctctttagatctgattttgtgaaggattaccccagacctattatgccgaatatggttttcgtgggcggtataaactgtttgcatcaaaatccattgtcgcaagagttcgaggcttacatcaatgcgtcaggagagcacgggatcgttgtgttttcgttgggttccatggttagcgaaattccagaaaagaaagccatggctatcgcagatgcacttggcaagattccgcaaacggttctttggagatacactggtaccagaccttctaatcttgcaaataacactatccttgtgaagtggcttccacagaacgatctcctgggtcatccaatgactagggcatttatcacccatgcaggatcccacggcgtctacgagtcaatctgtaatggcgtgcctatggtgatgatgcctctctttggtgatcagatggacaacgctaagcgtatggaaaccaaaggggcgggtgtgaccctcaatgtgctcgaaatgaccagtgaggaccttgaaaacgcactgaaagccgtgataaacgataagtcatacaaagagaacataatgcgtttgagctccctgcataaggatagacctgtcgaacctctggacctcgcggtcttttgggtggaattcgtcatgagacataagggagctccacaccttcggccggcggcccacgatttgacgtggtaccagtaccattcccttgatgtgattggttttcttttggcagtggtgcttacggtcgcgttcataacttttaagtgttgtgcatacggatatagaaagtgcctggggaagaagggtcgtgtgaaaaaggcgcataagtctaagactcat

SEQ ID NO: 20781 - DNA, 1599 bp, Artificial Sequence
  Description of Artificial Sequence: Synthetic coding sequence
atggcagtggagtcgcaaggcgggcgccctctggtcctcgggctgctgctgtgcgttctggggccagtggtgtcccatgctggcaagattcttcttataccagttgatgggagccactggctgtccatgctgggcgctatccaacagctgcagcagcgtggacatgagatcgtcgttctggccccggatgcatctctatacattagggatggtgcattttataccctgaaaacctatcccgtcccattccaaagagaggacgtgaaggagtcattcgtgtccttagggcataatgtgttcgagaacgatagtttcttacagagagtgataaagacatacaaaaagattaaaaaggactcggctatgctgttgtccggatgcagtcatctcttgcacaacaaagaactgatggctagcctcgcagaatcttctttcgatgtgatgctcacagacccattcctcccatgttcccctattgtcgctcagtacctgtccctccccacagtgtttttcctccatgcattaccatgttccctggaatttgaagccacacagtgcccaaatccattctcgtatgtcccaaggcccttatctagccatagtgatcacatgaccttcctccaacgggtgaaaaacatgcttatcgcttttagtcagaatttcttatgcgatgtcgtttactccccttatgctaccctggcatctgagttcctgcaaagggaagtgacggtgcaggatctactgtcctccgcatccgtttggttattcaggtcagattttgtgaaagactatccacgcccgatcatgccgaacatggttttcgtggggggcattaattgcctccatcaaaacccactgtcacaggagtttgaagcgtacattaatgcgtccggcgaacacgggatcgtggtgttcagtctgggctctatggttagcgagattcccgaaaaaaaggccatggctatcgctgacgctctgggaaaaatcccccagactgttctctggagatacacaggcacccggccttccaatttggcgaacaacacaattctcgtcaagtggctcccacagaacgatctgctggggcacccaatgacacgcgcctttatcacccatgcaggctctcacggcgtctatgaaagtatttgtaacggcgtccctatggttatgatgcccttattcggggatcaaatggacaacgcgaagcggatggagacaaagggtgcgggggtcaccctgaatgtgctggaaatgacctccgaggatctagaaaacgcgctcaaagccgttattaacgacaaaagctataaagagaatatcatgaggctgtcctctctgcacaaagatagacccgtggagcccctggacttagcggttttttgggtcgagtttgtgatgcggcacaaaggcgcgcctcatctgaggccagccgcccatgacctgacatggtaccagtatcacagccttgacgtgatcggcttcctcctcgctgtcgtcctgaccgtggcttttatcacgtttaaatgctgtgcttatggctaccggaaatgcctgggcaagaagggtcgagtgaagaaggcgcacaaatccaaaactcat

SEQ ID NO: 20782 - DNA, 1599 bp, Artificial Sequence
  Description of Artificial Sequence: Synthetic coding sequence
atggctgtagagtcgcagggcggcagaccactggtgctggggctgttgctctgcgtgctaggcccagtggttagtcacgccggcaagattttactgatcccagttgacggctctcactggctgagcatgctaggagcgattcagcaactgcagcagcgggggcacgaaatagttgttctcgcccccgacgcgagcctctatatcagggacggggccttttacacactaaagacctatcccgtgccattccaacgggaagacgtgaaagagtcatttgtctcactcgggcacaacgtttttgaaaatgactccttcctgcaacgggtgatcaagacctacaaaaagattaagaaggattcagccatgttgcttagcggatgctctcacctgttacataataaggagttgatggcatccttggctgaatcgtcatttgacgtcatgctgacagaccctttccttccatgttcgcctatagtggctcagtacctgtccctgccgacagtgttcttcctgcatgccctgccttgctcgttagaattcgaagccacgcagtgcccaaatccttttagctatgtgccgcgtcccctgagttcgcattccgatcacatgacatttctgcaacgagttaaaaatatgctgattgccttttctcagaacttcctctgtgatgtggtgtattcaccttacgcaacgctggccagcgaatttctgcagcgcgaggtcaccgttcaggatctgcttagctctgcttctgtctggctttttagaagtgactttgtgaaggattatccccgccctatcatgcctaatatggtgttcgtggggggcattaactgtctgcaccagaacccactcagccaggaattcgaagcctacattaatgccagtggcgagcacgggatcgtggttttctcgttgggatccatggtttctgaaatacccgagaagaaggctatggccatcgctgatgctctggggaaaataccacagaccgtactgtggcgttataccggaacaagaccctccaacctcgcaaataacactatcctggttaagtggttgccccaaaacgacctgctgggacatcccatgacgagggctttcatcacacatgccggctctcacggcgtgtatgaaagcatctgcaatggcgtccccatggtgatgatgcccctgtttggcgaccagatggacaatgccaagcgaatggagacaaagggcgccggcgttacattgaatgttttggagatgacctccgaagacctggagaatgccctgaaggcagtgatcaacgataaaagctataaggaaaatatcatgaggctgagtagtcttcataaagataggccagttgagccactggatctagcagtcttctgggtggagtttgtgatgcggcacaaaggcgctcctcatctgcggcccgcagcccacgaccttacctggtaccagtatcacagcctagacgttattgggtttctgcttgctgtggtattgacagtggctttcattactttcaagtgctgcgcctacggttatagaaagtgtctaggcaagaaaggacgcgtgaaaaaggcccacaagagcaaaacccac

SEQ ID NO: 20783 - DNA, 1599 bp, Artificial Sequence
  Description of Artificial Sequence: Synthetic coding sequence
atggcagtggagtcacagggtggacggccgcttgttctgggccttcttctctgcgtgctgggcccggtcgtgtcacacgccgggaagattctgctgattcctgttgatggttcgcactggctgtccatgttgggggccattcagcaactccaacagaggggtcacgagatcgtggtcctggcccctgatgcatccctgtacatccgagatggagcgttctataccctgaaaacttacccggttccattccagcgagaggacgtgaaggaatcctttgtgagcctcggacataacgtgttcgagaacgactcgttcctgcagcgtgtgatcaaaacttacaagaagatcaagaaagatagtgcgatgctcctgagtggatgctcccatctcctccacaacaaggagcttatggcctccctcgctgagtcgtcattcgacgtgatgctgaccgatcctttcctgccgtgttcacctatagtcgcacagtacctgagcctgccaaccgtgttctttctccacgcgctcccttgctctctggaattcgaggctacccagtgtcccaatccgttttcctacgtcccacggcccctctcctcccattcagatcacatgaccttcctccagagagtcaagaacatgcttatcgccttctcccagaacttcctgtgtgacgtggtctacagcccctacgcaaccctggctagcgaattccttcaacgcgaggtgactgtgcaagacctgttgtcgtcggctagcgtctggctgtttcgttctgatttcgtgaaggactatccccggccgatcatgcccaacatggtgttcgtcggcggaatcaattgcctgcatcagaatcctttgtcgcaagaattcgaagcctacatcaatgcgtccggggaacatggaatcgtggtgttcagcctggggagcatggtgtccgaaattccagaaaagaaggctatggccatcgcggatgccctggggaaaatcccgcaaaccgtgctctggcgttataccggaactagaccatcgaatctggcgaacaataccatcttggtgaagtggctgccccaaaatgacttgctgggacatccaatgacgcgcgcctttatcactcatgcaggatcgcacggagtctacgagtccatttgcaatggagtgccaatggtcatgatgccactgtttggggatcagatggacaacgcaaaacgcatggaaactaagggagccggagtcacgctgaacgtactcgagatgacttcagaggacctcgaaaatgccctgaaggctgtcatcaacgataagtcgtacaaggagaacatcatgcggctctcatcactgcacaaagacagacctgtcgaaccgttggacctcgctgtgttctgggtggagttcgtcatgcggcacaagggcgccccgcacctgcgcccggcggcacacgatctcacttggtaccagtaccatagcctcgacgtgatcggattcctgcttgccgtcgtgctcacggtcgcgtttatcacttttaagtgctgcgcgtacggctatagaaagtgcctcggcaagaagggacgcgtcaagaaagctcataaatcaaagactcac

SEQ ID NO: 20784 - DNA, 1599 bp, Artificial Sequence
  Description of Artificial Sequence: Synthetic coding sequence
atggccgtggaatcgcagggaggtagacccctggtgctgggcctgctgctttgcgtgctcggaccagtggtttctcacgcagggaagattctgctcatcccggtcgatggaagccactggctgtctatgctgggggctatccagcagctccaacagagaggacacgaaatcgtcgtcctcgctccggacgcatcactctacatccgggatggggctttctacacgctgaaaacctaccctgtgcctttccaacgcgaagatgtgaaagagtcattcgtgtccctcggtcataatgtgttcgaaaacgactcattcctgcagcgcgtcatcaaaacctacaagaagatcaagaaagattcggccatgcttctgagcggatgctcgcacctgctgcacaataaggagcttatggcctccctcgcggagagctcattcgacgtgatgctcaccgatccttttttgccttgttccccaatcgtcgctcaatacttgtctctgccgaccgtgttctttctccacgccctgccctgctcactggaatttgaggcgacccagtgccccaacccgtttagctatgttccgcggccgttgtcatcccattccgatcacatgacgtttctccaacgggtcaagaacatgctgattgcattctcccagaacttcctctgcgacgtcgtgtacagcccgtatgcaactttggcctcagaattcttgcaaagggaagtgactgtgcaggacctgctgagctctgcctcggtgtggctgttcaggtcggattttgtcaaagactacccacgaccgatcatgccaaatatggttttcgtcggaggaattaactgtctccaccagaacccgctttcccaagagttcgaggcctacatcaacgcatcaggagaacacggaatcgtggtgttctcgcttggatcgatggtttccgaaatcccggagaagaaggcgatggctatcgccgacgccctgggtaaaatcccacaaaccgtgttgtggagatacactggaacgcgcccatcaaatctggcgaacaatactatccttgtcaaatggctgccccagaacgatttgcttgggcacccgatgaccagggcgttcatcacccacgcgggatctcatggcgtgtatgaatctatctgcaacggcgtgccaatggtcatgatgcccctgttcggcgaccagatggacaatgccaagcgcatggagactaaaggtgcaggagtgaccctgaatgtgctggagatgacctctgaagatctggaaaacgccttgaaggcggtcattaatgataagtcgtacaaagagaacatcatgcgactgtcctcgctgcataaagacagacctgttgaaccccttgacctcgctgtgttttgggtggagttcgtcatgcggcataagggtgcaccgcatcttcggccagctgcccatgacctgacttggtaccagtaccatagccttgacgtgatcggctttctgctggcagtggtgctcacggtggccttcataaccttcaagtgttgcgcctacggctaccggaagtgcctcggtaagaagggacgcgtgaaaaaggcgcataagtccaaaactcac

SEQ ID NO: 20785 - DNA, 1599 bp, Artificial Sequence
  Description of Artificial Sequence: Synthetic coding sequence
atggccgtggaatcccagggggggaggccgctcgttcttggactgctcttgtgcgtacttggaccagtggtctctcacgccgggaagattttgcttatcccagttgatggcagtcactggctgagtatgctcggagccattcagcagctccagcagcgaggccacgaaatcgtggttctggctcctgatgctagcttgtacataagggatggagcattttacactctgaagacatacccagtgccttttcagcgggaggacgtcaaagagtcctttgtcagcctaggacacaatgtattcgagaatgactccttcttgcaacgcgttatcaagacctataaaaagatcaagaaggattccgctatgctccttagcgggtgctcgcaccttctccacaacaaggaactgatggcctctctggcggagagctccttcgacgttatgcttacagatccatttctcccgtgctccccaatcgtggcgcaatacctgtccttacccacagtattttttctgcacgccctcccatgcagtcttgaatttgaagctacccagtgccctaatcccttcagttacgttccaaggccgctgtcatcgcactcagatcacatgaccttcctccagcgcgttaaaaacatgctgatcgctttttcccagaattttctgtgcgacgtagtttactcaccttatgccactctcgctagtgaatttctccaacgagaagtgacggtgcaggacctgctatcgtccgcgtcagtctggctgttcaggtccgatttcgttaaagattatcccagacccatcatgccaaacatggtgtttgtcgggggtatcaactgcttacaccagaacccactctcccaagaatttgaagcgtacatcaacgccagcggtgagcacggaattgttgttttttccctcggctccatggtcagtgagatccctgagaagaaggcgatggctatcgccgacgccctggggaagatcccccaaacagtcttatggcgctacactggtaccagaccctctaaccttgctaacaacactatccttgtgaaatggctgcctcaaaatgaccttctggggcacccaatgaccagagcttttatcacccacgctggaagccatggtgtctacgaaagcatttgtaacggggttcccatggttatgatgccgctcttcggcgaccagatggacaacgcaaaacgaatggaaactaaaggggctggagtgaccctaaacgttcttgaaatgacatccgaggaccttgagaacgcattaaaggctgtgattaacgataaatcttataaggagaatataatgaggttgagttcactgcataaggatcggccagtcgagcccctcgaccttgcggtgttttgggttgagtttgtcatgcgtcacaagggcgcccctcacttgagacctgcagcccacgacctgacatggtatcagtaccattctttggatgtcatcgggtttctgttggccgtggttcttaccgtggcctttatcacattcaagtgctgtgcttacggatatagaaaatgcctgggaaaaaagggcagagtgaaaaaagcccacaagagtaagacccat

SEQ ID NO: 20786 - DNA, 1599 bp, Artificial Sequence
  Description of Artificial Sequence: Synthetic coding sequence
atggccgtggagtctcagggtggaagacccctggtactcggcctgctcctatgtgtgctcggacctgtcgtgagtcatgcagggaaaatcctgcttatccccgtagatggatctcattggctgtccatgttaggcgcgatccaacagttgcaacagcgaggacacgagatcgtggtgctcgcccccgacgcctcattgtatatccgtgatggtgccttctataccctgaaaacctacccagttcctttccaacgagaggacgtcaaagagagcttcgtatccctagggcataacgtgtttgagaacgattcttttctgcagcgtgtcatcaagacctacaagaaaataaaaaaagattcggcaatgctgctgagcggttgttcccacctattgcacaataaggaactcatggcatctctagccgaatcctcattcgatgttatgctgactgacccgttcttgccctgctcgcccattgtggcccagtatttgtccttaccaaccgttttctttcttcacgccctaccatgttcattggagttcgaagcgacccagtgtccaaatccatttagttacgtccctcggcctctgagctcccattcagaccatatgacttttctgcagcgggtgaagaacatgctgattgcttttagtcaaaattttctgtgtgatgtcgtatactctccttatgctaccctggccagtgagtttctgcagagagaagttacggtgcaggatctcctcagctctgcatccgtttggttatttagatcagattttgtaaaagactatccacgccccattatgccaaacatggtgttcgtggggggtattaattgcctgcaccagaaccctctgagccaggaattcgaggcatacattaacgctagcggggagcacgggatcgtcgtctttagcctggggtctatggtctccgaaattcctgagaagaaggctatggcaatagctgacgcactcggcaaaattccgcaaactgtgctttggcggtataccggcacaaggccatccaatctggccaacaacactatcctggtgaaatggttgccacagaatgacctgctgggccatcccatgactcgagctttcatcactcacgccggcagccatggcgtctatgaatctatatgcaacggtgtccccatggtcatgatgcccctgtttggcgaccagatggataacgctaagaggatggagacaaaaggagccggcgtgactctgaacgtcctcgagatgactagtgaagatctggagaacgcactgaaggcagtgataaatgataaatcctacaaagagaacataatgcgtctctctagcctgcacaaggataggccagttgagcccctcgatttggctgtcttctgggtagagttcgtgatgcgccataaaggtgctccacacctccgtccggctgcgcatgacctgacttggtatcagtatcacagcctagatgtgattggctttctgcttgctgtcgtgctgacagtagctttcatcaccttcaagtgctgtgcatacgggtacagaaagtgtttgggcaaaaagggccgggtgaagaaggcccacaagtccaaaacccac

SEQ ID NO: 20787 - DNA, 1599 bp, Artificial Sequence
  Description of Artificial Sequence: Synthetic coding sequence
atggcggtcgaatcccagggtggacggccgctagttctgggactattgctctgcgtgcttggccctgtggtgagccacgcgggcaagattctcctgatcccggtcgacggctcccattggctgtcaatgctcggcgctattcagcagctccagcagcgtggccacgagattgtcgtgttggctccggatgcaagtttgtatattcgtgacggcgcgttttacactctcaagacataccccgttccgtttcaacgcgaagacgtcaaggagagtttcgtttcgttggggcataacgtctttgagaacgactccttcctgcagcgggtgattaagacgtacaagaagattaaaaaggacagcgcaatgctcctgtccggatgcagccatcttttgcataacaaggagctcatggcttctctggccgagtcctctttcgatgtcatgctgacggatcccttccttccgtgttccccgatcgtggcccagtacctcagcctgccgactgtattctttctccatgcattgccctgcagcctcgaattcgaagcaacccaatgcccaaaccctttcagttacgttcctcgccccctttcgtcccattctgaccatatgacgttcttgcaaagggtcaagaacatgctcatcgcgttttcccaaaacttcctctgtgacgtcgtatatagcccgtacgctaccctggcttccgagtttctacaacgcgaagtcacagtgcaagatctgctgtcgtcggcctcggtgtggctcttccgtagtgacttcgtcaaggattacccgcgacccatcatgcctaacatggtcttcgttggcggcattaattgccttcaccagaaccctctgtcccaagagttcgaggcatacattaacgctagcggtgagcacggaattgtagtcttctctctgggttccatggtctctgaaattccagagaagaaggctatggccatcgctgacgctttgggtaagattccccaaacagtcttgtggcgttatactggaactcggccctctaacctggcaaataacactattttggttaagtggctcccccagaatgatctcctgggccacccgatgactcgcgcatttattacacatgctgggtcgcacggtgtgtacgagagtatctgtaacggagtgccgatggtcatgatgccgttgtttggtgaccaaatggataatgccaaacgaatggaaaccaaaggagcgggtgtcaccctgaacgttttggagatgacatctgaagatttggagaacgctttgaaagcagtcatcaatgacaaatcttacaaggagaacatcatgcggctgtccagcctgcacaaggatcgtccagttgagcccctggacttggccgtcttttgggtcgagttcgtcatgcggcacaagggggctccccacctgcgacccgcagcccacgacctcacctggtaccagtatcattccttggacgttatcggttttctgttggccgtggtgctgaccgtcgcgtttataaccttcaagtgctgcgcctacggctatcgtaagtgcctcggtaagaagggacgtgtcaagaaagcgcataaatccaagactcat

SEQ ID NO: 20788 - DNA, 1599 bp, Artificial Sequence
  Description of Artificial Sequence: Synthetic coding sequence
atggcagtggagtcacagggggggaggcctctggtacttggactgctgctgtgtgtgttgggtcctgtcgttagccatgcagggaagattctgcttatccccgtagacggcagccactggctgagtatgctgggcgcaattcagcagcttcagcagagaggtcatgaaatcgtggtgctggctccagacgcaagcttgtatatccgggatggcgcgttttacaccctgaaaacatacccagtaccctttcagcgagaggacgtgaaggaaagcttcgtgtccctgggccacaacgtgtttgagaacgactcatttctgcagcgagttattaagacatacaaaaagatcaagaaggatagcgctatgctgctgtccgggtgctctcacctgcttcataacaaggaactgatggcttccctggcggagtcctccttcgatgtgatgcttacagatccgttcctcccatgttcccccatagtggcccaatatctctcactccctaccgtgttctttttgcatgctctgccgtgctcacttgagttcgaagcgacacaatgcccaaacccgttcagctacgtaccacgacccttgagcagtcacagtgaccacatgacatttctgcagagggtgaaaaatatgctcatcgcctttagccagaacttcctgtgtgacgtggtgtactccccatacgcaaccctggctagcgaatttttgcagagggaggtgaccgtgcaggatcttctgagcagtgctagcgtgtggctttttaggtcagattttgtgaaagactatccgagaccaatcatgccaaatatggtgtttgtcggtggaatcaactgcttgcaccagaatccgttgagccaggaattcgaggcctatatcaacgcaagcggagaacacggcatagtagtgttcagcctgggaagcatggtcagcgagattcctgaaaaaaaggcaatggctatagcggacgctctgggtaaaatacctcaaactgtactgtggcgatacactggaacacggccttctaacctcgccaacaatacaatcttggtgaagtggctgcctcagaacgacctcctgggccacccaatgacacgggcctttatcacccacgcaggttcacatggcgtctacgaaagcatttgcaatggggtgccaatggtgatgatgccactcttcggtgatcagatggacaacgctaaacggatggaaaccaagggcgcaggagtcaccctgaacgtgctggaaatgacttcagaggacctggaaaacgctttgaaagctgtgattaacgacaaaagttacaaggagaacatcatgcggttgagtagtttgcacaaggaccgccctgttgaacccctcgacctcgccgtcttctgggtcgaattcgtgatgagacataagggggccccccacctccgcccggccgcacatgatctgacatggtaccaatatcatagccttgatgtgatcggatttctgctcgcagttgtgctgaccgtggctttcataacgtttaaatgttgcgcctatggctatagaaaatgcttggggaaaaaaggtagggtgaagaaagcgcacaagtcaaaaacccac

SEQ ID NO: 20789 - DNA, 1599 bp, Artificial Sequence
  Description of Artificial Sequence: Synthetic coding sequence
atggcagtcgagtcccagggtgggcggcccctggtgcttggactgctgctctgtgtgttgggtccagtggtgtctcacgcaggaaagattctgctcataccagtcgatggttcccattggctttccatgttgggtgccattcagcagctccaacagaggggacatgagattgtggtcctggcccctgatgcaagtttgtatatccgtgacggagcattttacactctgaaaacttaccctgtcccattccagcgcgaggatgtcaaggaatcctttgtgtctttgggacataacgtgtttgaaaatgatagcttcctgcaacgagtgattaagacgtacaaaaagataaagaaggattctgcaatgcttctctccggatgcagccatcttctgcataacaaagaacttatggcaagcctggcggaatcatcgtttgacgtgatgctcaccgacccttttttgccatgttcaccaatcgttgcccaatatctgagcctccctactgttttctttcttcatgcactgccctgctccctcgagtttgaggcaactcaatgtccgaatccgttctcatacgtgcctaggcctctgtcatcgcatagcgatcatatgacttttcttcaacgcgtgaagaatatgttgatcgcttttagccagaacttcctttgtgatgtggtgtacagtccatacgccactcttgcaagcgagttcctgcagagagaggtgaccgtgcaggatcttctgtcatcagcctccgtgtggctttttcggtcggacttcgtcaaggactacccccggcctattatgccaaacatggtctttgttggtggtattaactgtctccatcagaacccactgtcacaagaatttgaagcctacatcaatgcatcaggagaacacggtatagtggtcttttctctcggatctatggtgtccgaaatcccagagaagaaggcaatggccatagcagatgcccttggcaaaatccctcaaacggtcctttggagatacactgggacccggccttccaaccttgcgaacaacaccatcctggtcaagtggctccctcaaaatgacctcttgggacaccctatgacgcgggcattcattacccacgcaggctcacacggtgtctatgaatcgatttgtaacggtgtgcccatggtgatgatgccgttgttcggagatcaaatggataatgcgaaacgaatggaaactaagggagccggcgtaaccctgaacgtgctcgaaatgactagcgaggatctcgaaaacgcccttaaggccgtgattaacgacaagagctacaaggagaatatcatgcgcctctcctcacttcataaagacaggcctgtggaacccctggatctggcagtgttttgggtggaattcgtcatgcggcacaaaggcgcaccgcatctccggcccgcggctcatgatctgacctggtaccaataccactccctggatgtgatcggctttctgcttgcagtggtacttacggtggcatttatcactttcaagtgttgtgcatacgggtacaggaagtgtctcggaaagaaaggacgcgtcaagaaggctcataaaagcaaaactcac

SEQ ID NO: 20790 - DNA, 1599 bp, Artificial Sequence
  Description of Artificial Sequence: Synthetic coding sequence
atggctgtggagtctcagggcggtcgcccccttgttctaggcctcttactctgtgtgctcggacccgtggtgtcgcacgccgggaaaattctgctcatccctgtggatggcagccactggctcagcatgctgggcgccattcaacagcttcagcagaggggacatgaaatcgtcgtcctggcaccagacgctagtctttacatccgcgacggcgctttctacactctgaaaacctacccggtgcccttccagcgcgaagatgttaaagagtcctttgtgtcactgggccacaatgtgtttgaaaacgactctttcctgcagcgcgtgatcaagacatacaagaagatcaagaaagactcggcgatgcttctgagcgggtgctcccatcttctgcataacaaggagctgatggctagtctcgctgagagctccttcgatgttatgctgacggatccattcctgccatgtagtccgatcgtggctcagtacctgtccctgcctacggtattttttcttcacgccctcccctgctcgctggagttcgaggccacccagtgtcctaaccccttcagctacgtcccacgcccattgtcttctcactctgaccacatgacattcttgcagagagtgaaaaacatgctgatcgccttttctcagaactttctttgtgatgtggtgtatagcccctatgctactctcgcctctgagtttctacagcgtgaagtgaccgtgcaagaccttctatctagcgcttcagtgtggctgtttaggagcgactttgtcaaggactacccccggccaataatgcccaacatggtcttcgtgggcggtattaactgtcttcaccagaacccattgtcacaggagtttgaggcatatattaatgcatcgggggagcatggcattgttgtattctcactcggatccatggtgtctgaaattcctgagaagaaggctatggctatagctgatgcactcggcaagatcccccagactgtgctgtggcggtatactggcacccgcccatccaatctggctaataacacaatcctggtgaagtggcttcctcagaacgaccttctgggccatcccatgacccgagcttttatcacacacgccggatcacatggagtttatgaatccatctgcaacggggtgccgatggttatgatgcctctttttggcgaccagatggataatgccaagcgtatggagacgaagggagctggcgtgactctgaacgtgctggagatgacatcagaagacctggaaaatgcgctgaaggccgtcatcaacgacaaaagttacaaggagaacataatgagactctccagcctgcataaggataggccagtagagccactggaccttgcagtattttgggttgaatttgtaatgaggcataaaggggcaccccatctgaggccagccgcgcatgatctgacctggtatcagtaccatagcctggatgtgattggcttcttgcttgccgtcgtgctgacggtagccttcattacattcaagtgttgcgcgtatggctatagaaagtgcctgggaaagaaagggagagtcaagaaggcacataagtctaagacgcac

SEQ ID NO: 20791 - DNA, 1599 bp, Artificial Sequence
  Description of Artificial Sequence: Synthetic coding sequence
atggctgtggaaagccagggaggccgcccgttggtgctcgggctgctgctgtgcgttttgggaccagtggtgtctcatgcgggaaagatactgttgatccccgttgacggctctcactggctcagcatgctgggggcgattcaacagctgcaacagagaggtcatgagattgtggtgcttgcgcctgacgcctctctctacatccgcgacggagcattctacactcttaagacttatccagtgccattccaacgggaggacgtgaaggagtccttcgtctcccttggacacaatgtctttgagaacgactcctttcttcagcgcgtgatcaaaacttacaaaaagatcaagaaagacagcgccatgctgctctcagggtgttcgcacctcttgcacaataaagaactcatggccagcctggcggaaagctcctttgacgttatgctcaccgatccgtttctgccctgttccccgatcgtcgcacaatacctgtctcttccgactgtgttcttcctgcacgccctgccgtgctcactcgaattcgaagccactcagtgcccgaacccattctcctacgtgccacggccactgtcgtcccattcggatcacatgactttccttcaacgtgtgaaaaacatgctgattgccttctcacagaatttcctttgcgatgttgtgtacagtccgtacgctactctggcatcggaattcctgcaacgcgaagtgacggttcaggatctcctgtcctccgcttcggtctggctctttaggtccgacttcgtcaaggactaccccagacctatcatgcctaacatggtgttcgtgggcggcatcaattgcctccatcagaatccattgtcccaagagttcgaagcgtacatcaacgcgtcgggggaacacggaatcgtcgtcttttcactgggatcaatggtttcggagatcccggagaaaaaagcaatggccatcgccgacgccctgggtaagatccctcagaccgtgctgtggagatacacgggaactcggccgtccaacttggccaacaacaccatcctggtgaagtggctcccgcagaatgacctgctcggtcaccctatgaccagagctttcatcacgcacgctgggagccacggagtctatgagtcgatctgcaacggcgtacctatggtgatgatgccactgtttggagatcaaatggataacgcaaagcgcatggaaactaagggagcaggagtgaccctcaacgtgctggaaatgacgtcggaggacctggagaatgccctcaaggcggtcattaacgacaaatcctacaaggagaacataatgagactctcgtcgctgcataaggaccggccggtggaaccgctggatcttgcagtcttttgggtggaatttgttatgcgccataagggtgctccgcatctgaggcccgcagcccacgatctgacctggtaccagtaccactctctggatgtgatcggatttcttctggcggtcgtgctgactgtcgctttcataaccttcaagtgttgcgcgtacggctacaggaaatgccttggcaaaaagggccgcgtgaagaaggcccataagtccaagacccac

SEQ ID NO: 20792 - DNA, 1599 bp, Artificial Sequence
  Description of Artificial Sequence: Synthetic coding sequence
atggcggttgaatctcagggaggccggcccttggtactcgggctccttttgtgcgtgttgggaccagtggtgtcacacgccgggaagatcttgttgatccccgtcgacggatcacactggttgtcgatgctgggtgcgatccagcagcttcagcagcgcggacatgaaatcgttgtgctcgcaccggacgcctctctttatatacgagatggggccttctacaccctgaaaacttatccagtgcccttccagagggaagatgtgaaggagtcctttgtgtcacttggacacaacgtattcgagaacgatagttttctacagcgcgttatcaaaacatataagaagatcaagaaggattccgctatgctgctgtcgggctgctcacatctgttacacaacaaagagcttatggcgagtttagccgaaagctctttcgatgtgatgctgaccgaccccttccttccgtgttctcccatcgtcgcgcagtacctgtcgttgcccacagtcttctttctgcacgctctcccttgcagcctcgaattcgaagcgacacagtgtccaaatccattctcttacgtgccacgtcccttatctagtcactctgatcacatgacgtttctccagcgggtgaagaacatgctgattgcctttagccagaatttcctctgtgacgtggtctactctccctatgcaacccttgcctcggaatttctgcagagagaagttaccgtgcaagatcttctgagcagcgcctccgtctggctttttcgctctgatttcgtgaaggactatccgcgccctattatgccgaacatggtgttcgtgggtggaatcaattgtctgcatcagaacccactttcccaggagttcgaggcttatatcaacgcctccggggaacatggcattgtcgtgttctcattgggcagcatggtgtccgagatccctgaaaaaaaggctatggctatagccgatgcgctcggaaaaattccccagacagtgctgtggagatatacgggcacccgcccaagcaatctggccaataatacgattttggtgaagtggcttccacagaatgacctgctaggacatcccatgacacgcgcctttataacccatgccggctcacatggcgtttacgaatcgatatgtaacggcgtgcccatggtaatgatgccattgttcggcgaccagatggataacgcaaagcgcatggagaccaaaggggcgggggtgaccctgaatgtgttggagatgaccagcgaggatcttgagaatgcactaaaagcagtcataaatgacaaatcatacaaggaaaacattatgcgtttgtcgtccttgcacaaagaccgcccggtggagccattggacctcgccgtgttttgggtggaattcgtgatgcgacataagggcgcccctcacctgcgacccgcggcccatgacctcacgtggtatcagtaccatagcttagatgtcatcgggttcctcttggcagtggtgttgaccgtagcattcataacttttaagtgttgcgcttatggatatcggaagtgcctaggtaagaagggacgtgtgaagaaggcacacaagtcaaagactcat

SEQ ID NO: 20793 - DNA, 1599 bp, Artificial Sequence
  Description of Artificial Sequence: Synthetic coding sequence
atggctgtggagagccagggagggaggcccctggtgttgggactgctcttgtgtgtgttaggacctgtggtaagccacgccggaaagatcttgctgattccagtggatggcagccattggctgagcatgctgggtgctatccagcagctgcaacagagaggccatgagatcgtcgtgcttgcacccgatgccagtctgtatatcagggacggtgctttctacactcttaagacctaccccgtaccgtttcagagggaggacgtgaaagagtcgtttgtcagtctcgggcataatgtgttcgaaaacgacagtttccttcagcgcgtcatcaaaacctataagaagattaaaaaggactcagccatgttgctttctggctgcagccacttgcttcacaacaaggaactaatggcgtctttggcagagagcagtttcgatgttatgctgacggatcccttcctgccttgctccccaatagttgctcagtatctctcactgccgacggtgttcttcctgcacgctctcccctgttcattagagtttgaggccacacagtgcccgaatcccttcagctacgttcctcggcctctttctagtcactccgaccatatgacattcctccagcgcgtcaaaaatatgctcatcgcgttctctcaaaatttcctgtgtgatgtggtctattcaccgtacgccacactcgccagcgagttcctgcagcgggaagtcacggttcaagacctcctcagttccgcgtcagtctggctattcaggtctgatttcgtgaaggactacccacggccaatcatgccgaatatggtctttgtgggaggcatcaattgtctgcaccagaatccgttatctcaggaatttgaggcctacataaacgcctctggggagcacggcattgtggtgttctcccttggctctatggtctctgagattcctgagaagaaggctatggctatcgccgacgcacttggaaagatcccacaaactgtgctgtggcggtacaccggcacaagaccctcaaacttggccaataataccattctggttaagtggttgcctcagaatgatctgctggggcacccaatgactcgagcttttatcacgcatgcaggtagtcacggagtgtatgagtcaatctgcaatggcgtacccatggtcatgatgccactattcggggaccaaatggacaacgccaaaagaatggagaccaagggtgctggtgtgactctgaatgtgctggaaatgacctcagaagacctcgagaacgctctgaaggcggtgattaacgacaaatcctacaaagagaacattatgagattaagttccctgcacaaagaccgccccgtcgaacctcttgacctggctgttttctgggtggagttcgtgatgagacataaaggcgccccacatttgagacccgctgcccatgacctgacctggtaccagtatcacagcctcgatgtgataggcttcttactcgccgtggtacttactgtcgcctttattacttttaaatgttgcgcttacggctaccggaaatgtctagggaagaaaggtagagtgaagaaggctcataagagcaagacacac

SEQ ID NO: 20794 - DNA, 1599 bp, Artificial Sequence
  Description of Artificial Sequence: Synthetic coding sequence
atggccgtagagagccagggcggccgaccattagtgctgggccttctcctctgtgtcctgggaccagtcgtgtcccatgccggaaaaattctgctcatcccagtcgatgggagccactggctatcgatgctgggcgccattcagcagctacagcagagaggccacgaaatcgttgtattggcccccgatgctagcctgtatattagagacggtgccttctacaccctcaagacctatcccgtacctttccagcgtgaggacgtcaaagaatcattcgtgagtctaggacacaacgtcttcgaaaatgactcctttctccagcgcgtgatcaaaacatacaagaagatcaagaaggacagcgcaatgttgctctccggatgctcgcatcttcttcataacaaggagcttatggcttccttagccgaaagtagcttcgatgtgatgttgacagaccccttcttaccttgttctcccatcgtggcgcagtatctaagcctccctacagtttttttccttcatgctctgccgtgttcactggaatttgaggctacacagtgccccaacccattctcatacgtgcctaggcccctctcaagccactcagaccacatgacctttctacaacgagttaaaaacatgctcatcgcctttagtcagaacttcctgtgtgacgttgtatacagcccgtacgctaccctggccagcgagtttctgcagcgggaggtcactgtccaggatttactgtctagcgctagtgtgtggctcttccgcagcgatttcgttaaggactatcccaggccgatcatgccaaatatggtgtttgtgggcggcatcaattgtctccaccaaaatccactttcgcaggagtttgaggcgtacataaatgcatctggtgagcacggaatcgttgttttctcactggggagtatggtatccgaaattcccgaaaaaaaagctatggccatcgcagatgctctggggaagatccctcaaacagtgctctggcgctacacaggaacacggccttcgaacttggccaataacaccatcctggtgaagtggttgccccagaatgacctgctgggacatccaatgacacgggctttcattactcatgctgggagccacggagtgtatgagtccatctgcaatggcgtccccatggtgatgatgcctttgtttggggatcaaatggataacgctaaacgaatggaaacaaaaggagcaggcgtgactttaaatgtgctcgagatgaccagcgaagacttggaaaacgccttaaaggccgttattaacgataaaagctataaagagaatataatgcgtctcagctcacttcacaaggatcgcccggttgaaccgttggatctcgcggtattctgggtcgaattcgtcatgcggcataaaggagctccccatctgaggcccgcggcacacgacctgacttggtatcagtatcactctctagacgtgattggattcttgctcgccgtggtcttaacagtcgcttttataacctttaaatgctgtgcctatggctatcgcaagtgcctcggaaagaagggcagagtgaagaaagcccataagtccaagacccat

SEQ ID NO: 20795 - DNA, 1599 bp, Artificial Sequence
  Description of Artificial Sequence: Synthetic coding sequence
atggcggtggagagccagggtggcagaccattggtgcttggactcctgctctgtgtcctcggccccgtggtttcacacgcgggtaaaatcctgctcatacccgttgatggctcgcactggctgtcgatgcttggtgccatccagcaactgcaacagcgaggacatgaaattgtggtgttggccccagatgcaagcctgtacattcgcgatggagccttttacacccttaagacctacccagtgccttttcagagagaggacgtgaaagaatcgttcgtgtcactgggtcacaatgttttcgagaacgactcatttctgcaaagggtcattaagacctacaagaagataaagaaggactctgcaatgctgctttccggttgttcccacttgctccataacaaggagttgatggcgtcactggcagagagcagctttgatgtcatgctgactgaccccttccttccttgtagcccgattgtggcacaatatctttcgttgccaaccgtctttttcctgcatgcactgccgtgttcgctcgaattcgaagcaactcaatgtcctaacccttttagctacgtcccacggcctctttcctcgcattcggatcacatgaccttccttcaacgtgtgaagaacatgctgattgcgttttcacaaaacttcctttgtgatgtggtgtattcaccttacgcaaccttggcctcagaattccttcagcgcgaagtgactgtgcaggaccttctgtcgtccgccagcgtttggctctttcggtctgattttgtgaaagattacccccgacctattatgccaaatatggtgtttgtgggcgggatcaattgcctccaccaaaatcccctgtcccaggaatttgaggcatacattaacgcatccggagaacacggtatcgttgttttttcgctcggctcgatggtcagcgagatcccagaaaagaaagctatggcaatcgctgatgccctcgggaagattccccaaaccgtcctttggcgatacacggggactcgcccaagcaacctcgcaaataacactatactggtcaaatggcttcctcagaatgatctcctgggccatcctatgacccgggcatttatcacgcatgcaggttcacatggggtgtacgaatcaatatgcaatggagtgcctatggtgatgatgcctcttttcggagatcagatggacaacgcaaagcgtatggagacgaaaggtgcaggcgtgactctgaacgtccttgaaatgaccagcgaagatcttgaaaacgctttgaaggcggttatcaatgacaaatcctacaaggaaaacatcatgagactctcctcactgcataaggaccgtccggtggaacccttggatctggccgtgttctgggtggagtttgtcatgcgccataagggagcgccgcatctgaggccagccgcacatgatctcacctggtaccaataccactcccttgacgtgattggtttcttgcttgccgtggtgcttactgttgcttttatcacgtttaagtgttgcgcatacggataccgcaaatgcctcggaaaaaagggacgcgtgaaaaaggcgcacaagtccaagacgcac

SEQ ID NO: 20796 - DNA, 1599 bp, Artificial Sequence
  Description of Artificial Sequence: Synthetic coding sequence
atggcagttgagtcccagggagggcgtcccctggtgctcggacttcttctttgtgtgctgggccctgtggtgagccatgcggggaagatcctgttgatccctgtggacggctcgcactggctgagcatgttgggggccattcaacaacttcaacagcgcgggcatgaaattgtggtcctggcaccggatgcgtctctgtacatacgggatggggcattctatactcttaagacctaccctgtgccattccaacgtgaggatgtcaaggagtcgtttgtctccctcggacataacgtgtttgaaaatgactcgtttctccagagagtgataaagacttacaagaaaatcaagaaggacagcgcaatgcttctgagcgggtgttcacacctccttcacaataaggagcttatggcctcgctggccgaatcttcgttcgatgtaatgcttaccgatcccttccttccatgttcgccaatagtggcacagtacctttcgctccccaccgttttctttcttcatgctttgccctgttcgctggagttcgaagccactcagtgcccaaaccctttttcgtacgtgcctcgccctctgtcctctcattccgatcatatgacgtttcttcagcgggtgaagaacatgctgattgcgttctcccagaattttctgtgcgacgtggtctactccccgtacgctactctcgcatcagaatttcttcaacgcgaggtgaccgtccaagatctgctcagcagtgcctcagtgtggctgtttcgcagcgactttgtaaaagattacccccgtccaattatgcctaatatggtctttgtgggtgggataaactgtctccatcaaaaccctcttagccaggaattcgaggcttacatcaacgcttcaggtgagcatggtatcgtggtgttctcccttggctcgatggtgtcggaaatccccgagaagaaggccatggctattgccgatgcccttggaaagattccacaaactgtcctttggagatacacgggtactagaccgtccaatctggccaacaacacgattctcgttaagtggctgccacagaatgacttgctgggccaccctatgacgagagcgtttatcactcacgccggttcacatggtgtgtacgagtcgatttgcaacggtgtccccatggtgatgatgcctctttttggcgaccaaatggataacgcaaaaagaatggaaactaagggagcaggagtgaccctcaatgtcttggaaatgacgtcagaagatctggagaacgctctgaaagcagtgattaacgataaatcctataaagaaaacattatgagactgtcatcgctccacaaggataggccagtggaacctctcgatctggcggtcttttgggtggaattcgtcatgcggcataagggagctcctcacctcagacctgcagcccatgatctgacttggtaccagtaccatagcctggacgtcattggatttcttcttgcggtagtgttgactgtcgcattcattactttcaaatgctgtgcatacggataccgaaagtgtctcggaaaaaagggtagggtcaagaaggcccacaagagcaaaactcat

SEQ ID NO: 20797 - DNA, 1599 bp, Artificial Sequence
  Description of Artificial Sequence: Synthetic coding sequence
atggcagtggaatctcaaggtggccggcctctggtgctgggccttctgttgtgtgtccttggaccagtggtttcccatgctggaaagattctgctgattccggtcgacggatcccactggctctccatgcttggagcaattcagcaactgcagcagagagggcatgaaatcgtcgtgctggcgcccgatgcatcactctacattagggacggggcattctacactctgaaaacctaccccgtgcctttccaacgcgaagatgtgaaggaatcattcgtctctctgggtcacaatgtctttgaaaacgactcatttctccaaagagtgatcaaaacttacaagaaaatcaaaaaggactcagccatgctgctgtctggttgctcccacctgctgcacaataaggagctgatggcttcacttgctgagtcgtcttttgacgtgatgctgaccgaccctttccttccatgcagcccaattgtggcacaatatctgtccttgcccaccgtctttttcctgcacgctctcccatgttcactggagttcgaagcaacccagtgcccgaacccattttcgtacgtcccgcgccccctgtcgtcacacagcgatcatatgacctttctccaacgagtgaagaacatgcttattgccttcagccagaattttctctgtgatgtggtgtactcgccttacgcaaccctggcaagcgagtttttgcaaagagaggttaccgtgcaggatctgctttcatccgccagcgtgtggttgtttcgctcggattttgtcaaagattacccgcggccaattatgccgaacatggtgttcgtcggagggatcaattgtctccatcaaaaccctttgtcgcaagagtttgaagcatacattaatgccagcggtgagcacggaattgtggtgttttcgctgggatccatggtttccgaaatccccgagaagaaggcaatggcaattgcggatgcactcgggaaaatcccacagacggttctttggcggtacactgggaccagaccctcgaatctggcaaacaataccatcctggttaaatggctgccacagaatgacctgctgggccatccaatgactagagcattcatcacccatgcaggcagccatggagtgtacgagagcatatgtaacggagtgccaatggtcatgatgccactttttggtgatcaaatggacaacgcaaagagaatggagactaagggagctggagtgactcttaacgtgttggagatgacttcggaagatcttgagaacgctctgaaggcagtgattaatgataagtcgtacaaggaaaacatcatgcgtctgtcgtccctgcataaagatcgccctgtcgagcctctcgacctggcggtgttttgggtggaatttgtcatgcggcataagggcgcacctcatttgcgacccgcggcacatgatctcacttggtaccagtaccattcgcttgacgtcatcggatttctgcttgcagtcgtgcttaccgtcgcctttatcacttttaagtgttgcgcatacggataccggaaatgcctgggaaagaagggacgggtcaagaaagcacataagtccaagacccat

SEQ ID NO: 20798 - DNA, 1599 bp, Artificial Sequence
  Description of Artificial Sequence: Synthetic coding sequence
atggctgttgaatcacaaggaggaagaccacttgttcttggtttgttactatgtgttttaggaccagttgtttcacatgcaggtaaaattcttttgattccagtagatggatcacattggttgtcaatgttaggagcaattcaacagttacaacaaagaggtcacgaaattgtagttttagctcctgatgcaagtttatatattagagatggagcattttatacattaaagacatatccagttccatttcagagagaagatgtaaaggaatcttttgtttcattgggacataatgtttttgaaaatgactcatttttacaacgtgttattaaaacctataaaaaaatcaaaaaagattcagctatgttactttctggatgtagtcatttacttcataataaagaacttatggcatcattagctgaaagttcatttgatgttatgcttactgatccattcttgccatgttcaccaattgttgcacaatatcttagtttgccaactgttttttttttacatgcattaccatgtagcttagagtttgaagctactcaatgtccaaatccattcagttacgttccaagacctctttctagtcattctgatcacatgacatttttacaaagagttaaaaatatgttaattgcattttctcaaaactttttatgtgatgttgtgtactcaccttatgcaactttggcaagtgaatttttgcaaagggaagttactgtacaagatttattgtcaagtgcttcagtgtggctttttagatctgattttgtgaaggactaccctagaccaattatgccaaacatggtttttgttggtggaataaattgtttacatcaaaatccattatctcaagaatttgaagcatatataaatgcatcaggagaacatggtatagttgttttctctcttggatctatggtttcagaaattccagaaaaaaaagcaatggctattgctgatgcattaggaaaaattcctcaaacagtattatggagatatactggaacaagaccatcaaatcttgccaataatactattttagtaaagtggttacctcaaaatgaccttttaggacatcctatgacaagagcttttataactcatgctggtagtcatggagtttatgaatcaatttgtaatggagttccaatggttatgatgccattatttggagatcaaatggataatgcaaaaagaatggaaacaaagggagctggagtaacattaaatgttttagaaatgacttctgaagatttagaaaatgcattaaaagcagttataaatgataaatcgtataaagaaaatatcatgagattatcatcacttcataaggacagaccagttgaacctttagacttggcagttttctgggtcgaatttgtaatgagacataaaggagctccacatttacgaccagctgctcatgatttaacatggtatcaatatcattctttagatgttattggatttcttttagcagttgttcttacagtagcatttattacatttaaatgctgtgcatatggatatagaaaatgtttaggtaaaaaaggaagagttaaaaaggcacataaatcaaaaacacat

SEQ ID NO: 20799 - DNA, 1599 bp, Artificial Sequence
  Description of Artificial Sequence: Synthetic coding sequence
atggctgtggagtcgcagggcggaaggccactggtgctcggcctgcttctgtgtgtgcttggtcctgtcgtgagccacgccggtaagatactgcttatcccagtagacggatcgcattggctgtctatgctcggagctattcaacaacttcaacagagagggcacgaaatcgtcgtcctggcgcccgatgcctcattgtacatacgagacggagcattctacacgttgaaaacctaccctgtccctttccaaagagaggatgtgaaggagtccttcgtgtccctcgggcataacgtgtttgaaaacgacagctttctccaaagagttatcaagacctacaagaagataaagaaggatagcgcaatgctgctcagcggatgctcccatcttctgcacaacaaggaactgatggcatcgctcgcagaaagctcctttgacgtgatgctgacggatccctttctgccttgttcaccaattgtcgcacagtacctgtcactgccgactgtcttttttctgcatgcactgccatgtagcctggagtttgaagccacgcagtgtccaaatcccttttcctacgtccctagacctctttccagccacagcgatcatatgaccttccttcaacgggtgaagaacatgcttatcgcattttcccaaaactttctgtgtgatgtcgtctattcgccttatgcaactctcgcttcagaatttcttcagagagaagtgactgtgcaagatctcctgtcatcggcgagcgtgtggctctttcgatcagattttgtcaaggattacccaagaccgatcatgcccaacatggtttttgtgggtggcattaactgtctccatcagaaccctctttcacaggagtttgaggcatatatcaacgcaagcggagaacacggaatagtggtgttttcgcttggatcgatggttagcgaaatcccagagaaaaaagcgatggcaatcgctgatgcccttggtaagataccacaaacggtgctgtggagatacaccggtactcgcccatcgaatcttgccaataacactatacttgtgaagtggctgcctcaaaatgacctgctgggtcatcctatgaccagagctttcattacccatgcaggtagccatggagtgtacgaatcgatttgtaacggggtccctatggtcatgatgccccttttcggtgaccaaatggacaacgcaaagagaatggaaactaaaggcgccggcgtgactctgaatgtgcttgagatgacttctgaggatcttgaaaatgcgcttaaggccgtcattaatgataaatcatacaaggagaacatcatgcgcctcagctcgcttcataaggatcgccctgtggaacccctggatctcgccgtgttttgggtcgaattcgtcatgcgacataagggggcaccccatcttagacccgcagcacatgatttgacctggtaccagtaccactcgctggatgtgatcggattcctgctggccgtggtcttgaccgtcgctttcattactttcaagtgctgtgcatacggatacagaaaatgtctgggaaagaaaggtagagtgaaaaaagcccataagtccaaaacgcac

SEQ ID NO: 20800 - DNA, 1599 bp, Artificial Sequence
  Description of Artificial Sequence: Synthetic coding sequence
atggcagtcgaatcgcagggagggcggcccctggtcctgggactgctgctttgcgtgctgggaccggtggtgtcacacgctggcaagatccttctcatcccagttgacggatcccattggctctccatgttgggtgcgatccaacagctgcagcaacgcggacatgaaatcgtggtcctcgcgccagatgcatcgctttacatccgcgacggggcattctacacccttaagacttacccggtaccctttcaacgcgaagatgtgaaggagtccttcgtgtcgcttggacacaatgtgtttgaaaacgacagcttccttcagagagtgatcaagacctacaaaaagatcaagaaagattcagccatgcttctctcaggatgcagccacctgctgcataacaaggagctgatggcctcactggccgaatcatccttcgatgttatgctcactgatcctttcctcccgtgctcaccgattgtggcccaatacctttcgctccctaccgtgtttttccttcacgcactcccatgctccctggagtttgaagcaacccagtgcccaaacccgttctcctacgtgccgcgccccctgtcatcacactcagaccacatgacgtttctccagagggtcaagaatatgctgattgcattttcgcaaaacttcctctgcgacgtcgtgtactctccgtacgccactctggcgtcggagttcctgcaacgcgaagtcaccgtgcaggaccttctctcgtccgcctccgtttggctgttccggtctgatttcgtcaaagattacccacgaccgatcatgcctaacatggtgttcgtgggaggtatcaactgtctgcatcagaatccgctttcgcaagaattcgaagcctacattaatgcatcgggagagcatggaatcgtggttttctccctcggtagcatggttagcgaaattcctgagaaaaaggcaatggccatcgccgatgccctggggaaaataccgcagactgtgctctggcggtatacgggtacccggccgtccaacctcgcgaataacactattctggtgaagtggctgcctcagaatgatttgctgggccatccaatgacccgggcctttatcactcacgcaggatcgcatggagtgtacgagtccatctgtaacggcgttccgatggtgatgatgccgctctttggggaccagatggacaacgccaagcggatggaaaccaagggagcgggagtgactctgaacgtcttggaaatgacttccgaggatctggaaaatgccctgaaagcggtgatcaacgacaagagctacaaggagaacattatgagactttcgtcactgcacaaggatcgaccagtggagccgctcgatctggctgtcttttgggtggagttcgtgatgcgccacaagggagccccccacctgcggcctgcggcgcatgaccttacctggtaccagtatcactcgctggatgtgattggctttctgctggccgtcgtactgaccgtcgccttcatcactttcaagtgctgcgcatacggctacagaaagtgtctcggcaagaagggacgggtgaagaaggcacacaagtcgaaaacccac

SEQ ID NO: 20801 - DNA, 1599 bp, Artificial Sequence
  Description of Artificial Sequence: Synthetic coding sequence
atggctgtcgagtcacaaggtggaaggcccctggtgctggggctcctgctgtgtgtccttggcccggtggtcagtcatgcgggtaaaatcctcttaatacctgtcgatgggtctcattggttgagtatgttgggagccatccagcagctgcagcagaggggacacgaaatagtggtcctcgcccctgatgcaagtctgtatattagggacggcgccttctacactttaaagacctatcctgtgccgttccaaagagaggacgtgaaggagagtttcgtgtccctgggacataacgtgttcgagaacgactctttcctgcagagagtgatcaaaacttataaaaaaataaagaaagattccgccatgttactgagtggatgttctcatctccttcataacaaggaactgatggcaagccttgccgaatcttcttttgatgtgatgctgaccgatccatttttaccctgtagccctattgtggcccagtacctgagccttcctacagtctttttcttacacgccctaccgtgttctttggaatttgaggctacgcagtgcccaaatcccttctcttatgtgccccggccgctcagctctcactcagatcatatgacgtttctccagcgcgtaaaaaacatgttgatcgcgttctctcagaacttcctgtgcgacgtggtctacagtccatacgccactcttgccagcgagttcttacagagagaagtgacggtgcaggacctgctatcttctgcctccgtgtggctgttccggagcgactttgtaaaggattatcctaggcctatcatgcctaatatggtgtttgtcggcgggatcaactgtctccaccagaatcccctatcacaggaattcgaagcttatataaacgctagcggagagcatggcatcgtagttttcagccttggctccatggtttccgagatacctgaaaagaaagcgatggccatagcggacgccttagggaagattccacagactgtactttggcggtacactggaactcgtccaagcaaccttgcaaataataccatcctggtgaaatggcttccacagaacgacttgctgggtcatcccatgactagggcattcatcacccacgccggtagccacggcgtttacgagtccatatgtaacggagtacctatggtcatgatgccactctttggcgaccaaatggacaatgccaagcggatggagacgaagggtgcaggcgtaacactgaacgtactcgaaatgacctccgaggacctggagaatgccctgaaggctgttatcaatgataaatcttataaagaaaacatcatgcgcctttctagcctccacaaggacagacctgtggagccactggatcttgcagtcttctgggtcgaatttgtgatgcgccataaaggagctccacacttaagaccggccgcacacgacctcacatggtatcaataccactctctggatgtaataggattcctgctggccgttgtacttaccgtggcttttatcaccttcaaatgttgcgcctatggctaccgaaagtgtctcggaaagaaaggccgggttaagaaagcacacaaatccaagacccac

SEQ ID NO: 20802 - DNA, 1599 bp, Artificial Sequence
  Description of Artificial Sequence: Synthetic coding sequence
atggcagtggagagccaaggaggacgacctctcgtcctgggtctcctgctgtgcgtgctggggcccgtggtgtcccatgcgggaaagatcctgttgatccctgtagatggctcccactggttgagtatgcttggagctatacaacagctccaacagagggggcacgagatcgtggtcctggcgcctgacgcctctctatacattagggatggcgcattctatactctgaagacctacccagtgccctttcagagagaagacgtgaaagagtctttcgtttccctcgggcacaatgtgtttgaaaatgactcctttctgcagagagtaatcaaaacatataagaagattaaaaaagattccgccatgctgttgtccggctgttctcatcttcttcacaataaggagctgatggcctctctcgctgaatctagctttgatgttatgctaaccgacccattcctcccctgcagtccaattgtagctcaatacctgtcactgccaacagtgttcttcttgcacgcactgccatgtagcttggaatttgaggcaacacagtgtcccaatccattttcatacgtaccacgtcctctttcctcacactccgaccacatgaccttccttcaaagggtgaagaacatgctcattgcattctcacaaaattttttgtgcgacgtggtgtattctccatatgcaactttggcctctgagtttcttcagcgggaagttacggttcaggatctgttatcaagtgccagtgtttggctgttccggagcgattttgtaaaggattatccgcgcccaatcatgcctaatatggtttttgttggcggaataaattgtttgcaccagaaccctctgtcgcaggagttcgaggcttatatcaatgcttctggagagcatggcattgtcgtgttctcacttggcagcatggtgtctgagatcccagaaaaaaaagccatggccattgccgacgccttgggaaaaatcccacagacagtattatggcggtacacaggtacaagaccgtctaacctggccaataatactatcctggtcaagtggcttccccaaaacgatctgctgggccatcctatgacacgtgcattcataacgcacgccggctcacacggagtttacgagtccatatgcaacggtgtgccgatggtcatgatgcccctctttggcgatcagatggataatgccaagaggatggagaccaagggggctggggtcactctgaacgttctggagatgaccagcgaggacttggagaacgccctgaaggccgtgatcaacgataagtcctacaaggaaaatattatgagactgagcagcctgcataaagatcgaccagtggagcctctagatctagccgtcttttgggtggagttcgtaatgaggcacaagggggctccccacttgcggccagcagcacacgatcttacatggtatcagtatcactcactggacgtcatcgggtttctcttggccgttgtgctgaccgtggccttcattacttttaaatgctgtgcctatggctatagaaaatgtctgggaaaaaagggaagagtcaagaaggctcacaagtccaagacacat

SEQ ID NO: 20803 - DNA, 1599 bp, Artificial Sequence
  Description of Artificial Sequence: Synthetic coding sequence
atggccgttgaaagtcagggaggccgtcccctagtgctaggcctcctgctctgcgtgcttggcccagttgtgtctcacgccggaaaaatcctcctgattcccgtggacggatcccattggctgagcatgctgggggccatccagcagctacaacagcgtggacatgagattgtggtcctcgctcccgacgcaagcctgtacatacgagatggcgccttttacaccctgaagacctaccccgtcccttttcagagggaagatgtcaaggaatcattcgtgtcactcgggcataatgtgtttgaaaacgactcctttctccagagggtgatcaagacctataaaaagattaaaaaggattctgctatgctgttaagcggatgttcccatttgctccacaacaaggaactaatggctagtctggctgagagtagctttgatgttatgctcacagacccattcctgccttgtagtccaatagtcgcacagtacctgagtctgccaaccgtgttcttcttgcatgctttaccatgcagcctggagtttgaggccacccagtgccccaatcctttctcctacgtgccaaggcctctgagctcccattctgatcacatgaccttcctgcagagagtaaaaaatatgctcatcgcattcagtcagaattttttgtgcgacgtggtttatagcccatacgcaacactagccagcgagttcttacagagggaggttactgtgcaagatctcctgagtagcgcctctgtgtggctgtttcgcagcgacttcgtgaaggactatcctcgccctatcatgccaaacatggttttcgtgggcggtataaattgcctgcaccagaaccccctaagccaggaattcgaagcctacataaacgcctctggagagcatggcatcgtggttttcagtctcggaagtatggtctctgaaataccggaaaagaaagccatggcaattgcagatgccttaggcaagatcccccagactgtcctgtggcggtacaccggaacccgaccatcaaatctagccaataatacaatactggtgaagtggttaccacagaacgacttactcggccacccaatgacaagggcctttattactcacgctggctctcatggcgtctacgagtccatctgcaacggggttcctatggtcatgatgcccctatttggggatcagatggacaatgcaaagcgcatggagacaaagggtgccggggtgactctaaatgtgctggagatgaccagtgaagatttagaaaatgccctgaaggccgtgataaatgataagagctacaaagagaacatcatgcgtctcagcagcctgcacaaggaccggcctgtggagcccctggacctggctgtgttttgggttgagttcgttatgaggcacaaaggcgctcctcacctgaggcccgctgcccacgacctcacctggtaccaatatcacagcctggatgtgatcgggttcctactcgctgttgtgctcactgtggcctttattaccttcaagtgttgcgcctacggctatagaaagtgcctggggaagaagggacgggtaaaaaaagcacacaagagtaagacccac

SEQ ID NO: 20804 - DNA, 1599 bp, Artificial Sequence
  Description of Artificial Sequence: Synthetic coding sequence
atggcagtagaatcacagggaggaagacccctggtcttagggctcctcctatgtgttttaggtcccgtcgtctctcacgctggaaagatcttgcttattccagttgatggctcccactggctgagtatgctgggcgccatccagcaactgcagcagagaggacatgagatcgtggttcttgcaccggatgccagcctctacatccgcgacggagcattctacacccttaaaacgtatcccgtccccttccagagagaggatgtaaaagagagtttcgtttctctgggccacaacgtcttcgagaacgactcgttcctgcaaagagtcattaagacatataaaaagatcaaaaaggactcggcaatgctgctttcaggctgttctcatctgctgcataacaaagagctgatggcatctctagcggagtcctctttcgatgtaatgctaacagatcctttccttccatgttccccaattgttgctcaatacctcagtttgcccaccgtattcttccttcacgctctaccctgcagcttggaattcgaagccacccagtgtccaaatcctttctcctatgtgccgcgaccgctctcatctcatagcgaccatatgacatttctgcaacgcgtcaaaaatatgctaattgcattcagtcagaactttttgtgtgacgtggtttattcgccctatgctaccctagcctccgaattcctgcaaagggaagtcacagtgcaagacctccttagtagcgcctccgtgtggctgtttaggtcagactttgtgaaggattatcctcgcccaattatgccaaatatggtttttgtgggcggaatcaactgccttcaccagaatccattaagtcaggagttcgaggcctatatcaatgcttcaggggaacacggcatcgttgtgtttagcctaggctccatggtttcggagattcctgagaagaaagcaatggccatcgctgacgccctgggaaaaattccgcagaccgttctttggaggtataccggcacccggccctccaatttggcaaataatactattctcgttaagtggctcccccagaacgatctcctgggtcacccaatgaccagagcctttataacccacgcgggttcccacggagtgtacgaaagtatctgcaatggtgtaccaatggttatgatgccattgtttggagaccaaatggacaatgcaaaaagaatggagaccaagggtgctggcgtaaccctcaacgtcctggaaatgacatcagaggacctggaaaacgccctcaaagccgttattaatgacaaaagctacaaggagaacataatgcggctgtcctcgttacataaggatcgaccagtagaacctctcgacctggctgtcttttgggtagagttcgttatgcgacataaaggcgcccctcacttgagacctgcagcacacgacctgacttggtatcaatatcattcgctcgatgtcataggcttcctcttggcggtcgtgctgacggtggcgtttattacgttcaagtgttgcgcttacggataccgaaaatgtctcggaaaaaaaggccgggttaaaaaagcccataagtcaaagactcac

SEQ ID NO: 20805 - DNA, 1599 bp, Artificial Sequence
  Description of Artificial Sequence: Synthetic coding sequence
atggccgtggaatcccagggagggcgaccattggtcttgggtttgctgctgtgtgtcctgggaccagttgtctctcatgcgggtaaaatacttctgattcctgtggacgggagccactggctcagtatgctgggagctatccagcagctgcagcagcgagggcacgagatcgttgtcctcgcacccgacgctagcctttatatccgggatggcgccttttacactctgaaaacctatcctgtgcccttccagcgagaggatgtgaaagaatcgtttgtatctttgggtcacaatgtgttcgagaacgacagctttctgcaaagggttataaagacttataagaaaatcaagaaagactcagccatgctactgtccgggtgtagccacctgctgcacaataaggagctcatggcaagtctggcagagagtagctttgatgttatgttaacggaccctttcctcccatgttcccccattgtggcccagtacctgtctttgcccacggtcttctttttgcacgctcttccttgttcacttgaattcgaggccactcagtgccccaatccattctcctatgtcccccggcctttgtccagccattctgatcacatgaccttcctgcagagagtgaaaaatatgctgattgcgtttagtcagaactttctatgtgatgttgtgtactccccatatgctacactggccagcgagttcctgcagagggaggtgactgtgcaggacctcctgtcaagtgcatccgtctggctgtttagatccgacttcgtgaaggattatcctcgaccaatcatgcccaacatggtttttgtcgggggcatcaactgcttgcaccagaatcccctgtctcaggagttcgaggcctatataaatgcaagcggggagcacgggattgtggttttctcgcttggaagtatggtgtccgagattcccgaaaaaaaggcaatggctattgccgatgctctagggaaaataccccagactgtactctggcgatacacaggcactcgtccctctaacctagctaacaacacgatcttggtcaaatggctgccccaaaacgatcttctagggcacccgatgaccagagcattcatcacccatgccggttctcatggcgtgtatgagtccatctgcaacggagtcccaatggtgatgatgcctctgtttggggatcagatggacaatgccaaacgtatggagacaaaaggtgcgggggtgactctgaacgtgctggagatgacgtccgaagatctggaaaacgccctgaaggccgttataaatgacaagagttataaagaaaacattatgagactctccagcctgcataaagatagacccgtcgaacctttggacctagccgtcttctgggtggagtttgtgatgaggcacaagggcgctccacacctccgccctgccgcgcacgatttgacatggtatcaatatcatagtctagacgttatcggctttttactggccgtggtcctaaccgtagcgtttattacatttaagtgctgtgcctacggctatagaaaatgtttgggaaagaaaggtagggtgaagaaggctcacaagtctaagacccac

SEQ ID NO: 20806 - DNA, 1599 bp, Artificial Sequence
  Description of Artificial Sequence: Synthetic coding sequence
atggccgtggagtcccagggcggcagacctttagtgttgggcctgctgttatgcgtcctgggtccggtcgtttcccacgctggaaaaatcctgcttattccagtggatggctcacactggctgagcatgctgggcgcaatccagcaacttcagcagcgcgggcacgaaattgtagtactcgctccggatgcttccttgtacatccgcgacggggccttctatacactgaaaacttatccagtccccttccaacgcgaggacgtgaaggaatcttttgtcagccttggacacaatgtctttgagaatgattccttcctacagcgggttatcaaaacctataagaagataaaaaaggactcggccatgctgctctcagggtgttcacacctcctccacaacaaggagttgatggcgtctctcgcggagtcatcctttgacgtaatgttgacagaccctttcctaccctgctctcctatcgttgcgcagtacctgagtctgccaacggtcttcttcttgcatgccctgccatgcagcctggagtttgaggcaactcagtgccccaatccattttcatatgtcccaagacccctgagctcacatagtgaccacatgacgttcttacagcgagtgaaaaacatgctgatcgccttctcccagaattttctgtgcgacgtcgtctactctccctacgcaaccttggcgagtgagtttctgcaaagggaagtgacagttcaggatctgttgtccagcgcatccgtgtggttgtttcgctcagatttcgtgaaggactacccgcgtccgatcatgcccaacatggttttcgtgggcggcattaactgccttcaccaaaatcccctgagccaggaattcgaggcctatattaacgcaagcggggagcacggcattgtagtgttctcattgggatcgatggtgagcgaaatcccagaaaaaaaggctatggcaatcgcggacgcgttgggcaagatcccccaaactgtgctgtggcgttataccggtacccgaccctccaaccttgccaacaataccatcctggtgaagtggttgcctcagaacgatctgttggggcatccaatgacccgcgctttcatcacccacgccggatcacacggtgtatacgaaagcatctgtaacggtgtgcctatggtaatgatgcctctattcggcgaccagatggacaatgccaagcgtatggagacaaaaggagctggtgtgaccttaaacgtcttggagatgaccagtgaagacctggaaaatgcgttaaaggccgtgattaatgataagtcgtacaaagaaaacatcatgcgccttagcagcctgcacaaagaccggccagtagaaccactagacctcgccgttttttgggtggagtttgtgatgagacacaaaggtgcccctcacctgcgcccagccgcacacgatctgacttggtaccaataccactcgctagacgttattgggtttctcttagctgtcgtgctcacggtcgctttcatcacgtttaagtgctgcgcctacggttacagaaagtgtctgggcaagaagggtagagtgaagaaagcccacaagtcaaaaactcac

SEQ ID NO: 20807 - DNA, 1599 bp, Artificial Sequence
  Description of Artificial Sequence: Synthetic coding sequence
atggcagtcgaatcacaggggggtagaccccttgtgctcggcctgttgctttgtgtccttggaccagtggtgtcacatgcgggaaaaatccttcttattccggtggacggttcacattggctgtcgatgctgggcgccattcaacaactgcaacaaaggggccatgaaatagtcgtgctggcaccagatgcttccctgtacatcagagatggtgcgttttacacgctcaagacttatcctgtcccattccagagagaggacgtgaaggaatctttcgtctcgctcggtcataacgtgttcgagaacgatagctttcttcaaagagtgattaagacctacaagaaaatcaagaaggattccgcaatgctgctgtcaggatgttcacatctgctgcacaacaaagaactcatggcatctctggcagagagctcgtttgatgtgatgcttaccgaccctttcctgccgtgttcgcctatcgtcgcacagtacttgtcgctgcccactgtgtttttccttcatgcactgccatgctcgttggaattcgaggcgacccagtgcccaaacccttttagctacgtgccccgacccttgtcatcccattcggaccacatgaccttcctgcaacgggtgaagaatatgttgatcgcgttctcgcagaatttcctctgtgacgttgtctattcaccttacgcgacccttgcctccgagtttctccaaagagaggtgaccgtgcaagatctcctttcaagcgcctctgtctggctgttcagaagtgattttgtcaaagattaccccaggcccatcatgcctaatatggtattcgtcggaggcattaactgtctccaccagaatcccctttcacaagaattcgaagcgtacatcaatgccagcggcgagcatgggatcgtcgtctttagcctggggagcatggtgtcggagattccggagaagaaggcgatggcaatcgcagacgcactgggcaagatcccccaaaccgtgctctggaggtacactggaaccagaccttcaaaccttgcaaacaatacgatcctggtcaagtggcttccacagaacgatctccttggacatccgatgactcgcgccttcattactcatgcaggatcccatggagtctacgagtccatttgtaacggggtgccaatggttatgatgccgcttttcggagatcagatggacaatgcaaagcgaatggaaactaaaggtgccggggtgaccctgaacgtgcttgagatgacgagcgaggatcttgagaatgccctgaaggctgtcattaatgataagtcgtacaaggaaaacataatgcgactgagctccctgcacaaggatcgccccgtggaaccccttgacctggcagtgttttgggtcgaatttgtcatgcggcataagggggcgcctcatcttcggccagccgcacatgatcttacttggtaccagtaccattcgcttgacgtgattggctttctgttggcagtggtcctgaccgtggccttcatcacttttaagtgctgtgcatacggatatcgcaagtgtctgggaaaaaagggtcgggtcaaaaaggcacataagtccaagacccat

SEQ ID NO: 20808 - DNA, 1599 bp, Artificial Sequence
  Description of Artificial Sequence: Synthetic coding sequence
atggctgtggaatcgcaaggaggacgcccgctggtgcttggcctcctgctttgtgtcctgggaccagtggtgtcccatgcaggaaagatccttctgatcccagtcgacggatctcactggttgtcaatgctgggcgccatccagcaacttcaacagcgcggacatgaaatcgtggtgctggcgccggacgcttccctgtacatccgcgatggagcgttctacactcttaagacctatccagtcccgttccagagggaagatgtgaaggagtcgtttgtgtcattgggccacaacgtgttcgagaatgacagcttcctccaacgcgtgattaagacttacaaaaagatcaaaaaagattcggcaatgctgctctctggatgcagccaccttctgcataacaaggaattgatggcgtctcttgcggaatcgtcgtttgacgtgatgctgaccgatccttttctgccgtgcagcccgatcgtcgcccaatacttgtccctcccgaccgtgttcttcctgcatgcactcccatgcagcctggaattcgaggcaactcagtgcccgaatccgttttcctacgtgcctcggcctctttcgtcgcactcagatcacatgacctttctgcaacgcgtgaagaatatgctcatcgccttctcacagaacttcctgtgcgacgtggtgtactcaccctacgctactctggcctcagaattcctgcaaagagaagtcaccgttcaggacctgctgtcgtcggcgtccgtgtggctcttccgctcggatttcgtgaaggattaccctcgcccaatcatgccaaacatggtgttcgtcggaggaattaactgtttgcaccagaacccactgtcacaagaatttgaagcctacatcaacgcctccggcgaacacggcatcgtggtgttctccctcggctccatggtgtccgaaatcccggaaaagaaggcaatggcgatagcggacgccctgggaaagattccccagaccgtgctgtggcgatacaccggtactcggcccagcaacctggccaacaacactatcttggtgaagtggctgccacagaacgatctcctcggacacccgatgacgcgggccttcatcactcacgctggatcgcacggagtgtacgaaagcatctgcaatggagtgccgatggtgatgatgcccctctttggcgaccaaatggacaatgcgaaacggatggaaaccaaaggcgctggtgtcactctgaacgtgctggaaatgacttcggaagatctggaaaatgccctcaaggctgtgattaatgacaagtcttacaaggagaacatcatgcgcctcagctccctgcataaagatagaccggtcgagcccttggatctggcagtgttctgggtggagttcgtgatgcgccataagggagccccccacctcaggccggccgcacacgatctcacctggtaccagtaccatagcttggacgtgatcggcttccttcttgccgtggtgctgaccgtggctttcatcacctttaagtgttgtgcctacgggtaccgcaaatgcttgggaaagaagggaagagtgaagaaggcccacaagtcaaagacgcac

SEQ ID NO: 20809 - DNA, 1599 bp, Artificial Sequence
  Description of Artificial Sequence: Synthetic coding sequence
atggccgtggaatcccagggagggcgtcctctcgtgctcggactccttctgtgtgtcctgggcccggtggtgtcacacgcaggtaaaatcctgctgatcccagttgatgggtcccattggctgtcgatgctcggagccatccagcagctccaacaaagaggacatgaaatcgtggtgctggcccccgacgcctctctctacattagggacggcgccttctacactctgaaaacctacccggtgccgtttcagcgcgaagatgtgaaggagagctttgtgtccctcgggcacaacgtgttcgagaacgactcgttcctccaacgggtcatcaaaacctacaagaagatcaagaaggacagtgccatgctccttagcggctgcagccacctcttgcacaataaggagctcatggcctctctggccgagtcatcctttgatgtgatgttgaccgacccttttctgccgtgctccccgatcgtggcgcagtacctgtccctcccaactgtgttcttcttgcatgccctgccgtgtagcctcgaattcgaagccacccagtgcccgaaccctttctcgtacgtgcctcgtccgctgtcctcccacagtgatcacatgactttcctgcagcgcgtgaagaatatgctgatcgcgttctcacaaaacttcctgtgcgatgtggtgtattcaccatacgcaactctcgcatcggagtttctgcaaagggaggtgaccgttcaggatctgctctcatccgcgtcagtttggctcttcagatctgatttcgtgaaagactatccgcgcccgatcatgccgaacatggttttcgtcggaggtatcaactgcctgcatcaaaaccccctgagccaggagtttgaggcatacatcaatgcctcaggcgagcacggaatcgtcgtattctccctcggatccatggtgtccgaaatccctgagaagaaggccatggcaatcgccgacgctctcggaaaaatcccgcaaaccgtcctgtggagatacaccggaacgaggccttccaacttggccaataacactattctggtcaaatggctgccccagaacgacctgttggggcaccccatgactcgggcgttcatcactcacgcgggatcccacggtgtctacgagtcaatctgtaatggagtcccgatggtgatgatgccgcttttcggtgaccagatggataacgcaaagcgcatggaaacgaaaggagccggcgtgactttgaacgtgctcgagatgacgtcggaagatttggaaaatgccctgaaggctgtgatcaatgacaagtcctacaaggaaaacataatgaggctgtcgagcctgcacaaggatcggcctgtggaaccgctggacctcgcggtgttttgggttgaattcgtcatgcgccataagggcgctccacacctgaggcctgcggcacatgacttgacgtggtaccagtaccatagcctcgacgtcattgggtttctgcttgctgtggtgctgaccgtggcattcattacttttaagtgctgcgcctacggatacaggaaatgcctcgggaagaagggacgcgtgaagaaggcgcacaagtcaaagacccat

SEQ ID NO: 20810 - DNA, 1599 bp, Artificial Sequence
  Description of Artificial Sequence: Synthetic coding sequence
atggctgtcgaatcgcaggggggtcgtcctctggtgcttggccttctgctgtgtgtgctcggcccggtggtcagccacgccgggaagatccttcttatccctgtggatggaagccattggcttagcatgcttggagccattcaacagctccaacagcgggggcacgagatagtcgtgctggctcctgatgcctcattgtacattcgcgacggcgccttttacacccttaagacgtacccagtgccgttccaaagagaggacgtgaaagaatcatttgttagcctcgggcacaacgtgtttgaaaatgattcctttttgcagcgcgtgataaagacctacaagaagattaagaaagattccgcgatgctgctgtccggatgttcacacctgcttcataacaaggagttgatggcaagcctcgcagagagctcgtttgacgtgatgctcactgatccctttcttccatgttcccctattgtggcacagtacctttcgcttccaactgtctttttcttgcacgcactcccctgttcactcgaatttgaagcaacgcagtgcccaaaccccttctcatatgtccctcgacccctgagcagccattccgaccatatgactttccttcaaagagtgaagaacatgcttatagcatttagccaaaacttcctttgtgatgtcgtgtactcaccatacgcaactcttgcatcggaatttctccagagagaagtcactgtgcaagatctcttgtctagcgcaagtgtgtggcttttcagatccgacttcgtcaaagattacccgcgtcccattatgccgaacatggtgttcgtgggtggtatcaactgccttcaccaaaaccccctgtcgcaagaattcgaagcatacattaacgctagtggagaacatggtatcgtggtgttttccctggggtcgatggtcagcgaaattcctgagaagaaagcaatggcaatagcggacgcacttgggaaaattccacagaccgttctgtggagatacaccggcacccggccctctaatctcgcgaacaataccattctcgtcaaatggcttccacaaaatgacctgctcggtcatcctatgacccgggcatttatcactcatgcaggttcgcatggagtgtacgagagcatatgcaacggagtgcctatggtgatgatgcctctgttcggcgatcagatggataatgcgaagcgcatggagactaagggggcaggggtcacccttaacgtgctcgaaatgacctccgaggatctcgaaaatgcactgaaagcagtcataaacgacaagagctacaaggagaacataatgaggctttcgtcactgcataaggaccgcccagtggagcctttggacctcgccgtgttctgggttgaatttgtaatgagacacaagggagcccctcacctgaggccagccgctcatgatcttacttggtaccagtatcactcgcttgacgtgattgggtttcttctcgcagtcgtgctgacggtggctttcattacctttaagtgctgtgcctatggttaccgtaaatgcttgggtaaaaagggtagagtcaagaaagcacacaaatctaagacgcac

SEQ ID NO: 20811 - DNA, 1599 bp, Artificial Sequence
  Description of Artificial Sequence: Synthetic coding sequence
atggctgtggaatcccagggaggacggcccctggtgctcgggctcctgctttgcgtcctcgggcctgttgtaagtcatgctgggaaaatactcctgatccctgtcgatgggtctcactggctctccatgctgggggcaatacagcagcttcaacagaggggacatgaaatcgtggtgctggcacctgatgcctcactctatatcagggatggagctttctacacgttgaagacatatccagtacccttccagcgcgaagatgtgaaagaatcatttgtctccctaggacacaatgttttcgagaatgattcattcttgcagagagtgatcaaaacatacaaaaaaattaagaaagattctgctatgctactctctggatgtagtcatctgctccacaacaaagaactcatggcctcccttgccgaaagtagtttcgatgtgatgttaacagatccatttctaccctgttccccaatagtggcccagtatctgtcactaccaactgtcttctttcttcatgcactcccatgtagtttggagttcgaagccacacagtgtcccaacccattttcctatgttccccgaccactttcctctcattctgatcatatgactttcctccagagggttaaaaatatgcttatcgctttttcccagaacttcctgtgtgatgtcgtttactcaccctatgctactctcgcttcagaattcctccagcgggaagtgacagtgcaggatctgctgtcaagtgcttctgtatggctgtttaggtctgatttcgtgaaagattatccccgccctataatgccaaacatggtgtttgtgggaggaattaactgccttcatcagaaccctctttctcaggaattcgaagcctacatcaatgcctctggggaacacggaatagtcgttttcagtctcggatctatggtaagtgaaatacccgaaaaaaaagcgatggctatagccgatgctctcgggaaaatccctcagacagttctgtggcgatatacagggactagaccatccaatttagcaaacaatacaatccttgtgaagtggctccctcagaatgatctgctaggacatcctatgactcgcgcttttatcacacatgccggatcacatggggtatatgagagtatctgtaatggggttcccatggttatgatgcccctgttcggagatcagatggataatgctaaacggatggagacaaaaggggcaggggttactcttaatgttctcgaaatgacatcagaagatctagaaaatgcgctgaaagccgtcatcaatgataaatcatataaagaaaatataatgcggctatcatctctccataaagatcggcctgtggaaccattagatctcgctgtattttgggtggaattcgttatgcgacataaaggggcacctcacctacggcctgcggctcacgatctcacatggtatcaatatcattccttagacgttatcggatttctgctggccgtcgttctaacagtcgctttcatcactttcaaatgttgcgcttatgggtaccggaaatgcctggggaaaaaagggagggtaaaaaaagcccacaagtctaaaactcac

SEQ ID NO: 20812 - DNA, 1599 bp, Artificial Sequence
  Description of Artificial Sequence: Synthetic coding sequence
atggcagtggagtcgcaaggtggacgacctctggtcctggggttgctgctgtgtgtccttggtcctgtcgtgagtcatgccggaaagattctgctgattcctgtggatggtagccattggctttccatgctgggagcaatccagcaattgcaacaaagaggtcatgaaatagtggtgctggcccccgacgcatccctctacatccgcgatggtgcattctacactcttaagacctaccccgtgccgtttcagagggaagatgtcaaagagtcgtttgtgagccttggtcataatgtctttgagaacgatagtttcctccagagagtcattaagacctacaagaagattaagaaggactccgcaatgctgctgagcggatgttcccatctgctgcataacaaagaacttatggccagcctggccgagtcgtcctttgatgtgatgctgaccgatccatttcttccgtgctcacctattgtggctcaatatctctcccttcctactgtcttttttctccacgccctgccatgctccctcgaatttgaagcaacgcaatgtcctaaccccttttcatacgtgccacggccactgagctcgcatagcgaccatatgacttttcttcaacgggtcaagaatatgctgattgcattttcgcagaactttctctgtgacgtggtctactcgccatacgcaactctggcatccgaattcttgcaaagagaggtgaccgtgcaagacctgctcagctcggcctcggtgtggttgtttcgctcagactttgtgaaagattaccccagaccaattatgcctaacatggtctttgtcggagggatcaattgtctgcaccagaatccactctcgcaggaatttgaagcctacatcaacgcctccggggaacacggaatcgtggtgttttccctcggtagcatggtgtctgagataccggagaagaaggccatggccattgccgacgcactgggaaagattcctcaaactgtgctctggcgatatactggtactagacctagcaatcttgcaaacaacaccatcttggtcaagtggctcccacagaatgatcttctcggacatcctatgaccagggcattcattacccacgccggctcccatggcgtgtatgagagcatttgcaacggtgtgccaatggtgatgatgcctctgttcggtgatcaaatggataacgcaaagaggatggagactaaaggagcaggggttactcttaatgtccttgaaatgacctcagaggaccttgagaatgcgcttaaggcagtcatcaacgataaatcatacaaggaaaacattatgcggctctcgtcgcttcataaagaccgcccagtggaaccacttgatctcgctgtgttttgggtggaatttgtgatgagacataagggggcaccgcacctgcgccccgcggcacatgatctgacttggtatcagtatcatagccttgatgtgattggctttcttcttgccgtggtcctgaccgtggctttcataaccttcaagtgttgcgcatacggataccggaaatgtctgggcaagaagggtagagtgaagaaggcacataaaagcaagacccat

SEQ ID NO: 20813 - DNA, 1599 bp, Artificial Sequence
  Description of Artificial Sequence: Synthetic coding sequence
atggctgtggaatctcagggaggaaggccattggtgctggggctgctcttgtgcgtgttggggcccgtggtatctcacgcgggaaaaatactgctaattcccgtcgatggaagccactggttgtctatgctgggcgctatccagcagcttcagcagagagggcacgaaattgtggtactggcacccgacgccagcttatatattcgagacggggcgttttacaccctgaagacttatcctgttcctttccagcgtgaggacgtgaaggagtctttcgtttccttgggccataacgtgttcgagaacgacagctttctgcagagggtgattaagacttacaaaaaaattaaaaaagatagcgctatgcttctgtctggatgcagtcacctgctgcacaacaaagaactgatggccagccttgccgaaagctcttttgatgttatgctgacagacccatttttaccatgtagtccaatcgtggcacaatatctctcattgcctactgtgtttttcctgcacgctctgccatgttccctggagttcgaggcaacgcagtgcccaaacccattctcgtacgtccctcggcccttgtcatcccattcagatcatatgactttcctacagcgcgtcaaaaacatgctcattgccttttcgcagaatttcttgtgtgatgtggtgtactcaccgtatgcgactcttgcaagcgagttcctacagcgggaggtaaccgtgcaggacttgcttagctctgcttccgtatggctgtttaggtcagacttcgtgaaagattatccccggccaataatgccaaatatggtgttcgtgggcggtatcaactgcctccaccaaaacccgctgtctcaggaattcgaagcgtacatcaatgcatcaggggagcacgggatcgtggtgttcagcctaggttcaatggttagcgaaatccccgaaaaaaaagctatggcgatagctgacgcactgggaaagatacctcagacagtgctctggaggtataccggcactcgcccgtctaatctggccaacaacacaatcctggtcaagtggctccctcaaaatgatctactgggccaccccatgacgcgcgccttcatcacccatgctggctcccatggcgtatacgagtccatctgtaatggagttcctatggtcatgatgccactgtttggagaccagatggataatgctaagaggatggagactaaaggagccggagttaccctgaacgtgctggaaatgacaagtgaggacctggaaaatgcactcaaagccgtgatcaatgataagtcctacaaagagaacatcatgcgcttgtcatccctgcacaaagacagacctgtggagcccctcgacctcgcggtgttctgggtagagttcgttatgcggcataagggggcccctcatctccggccagccgcccacgatctgacatggtaccagtaccattctctggatgtaatcggctttctcctggctgtcgttttgacagtggcattcatcacgttcaagtgctgcgcctatggctaccggaagtgcttagggaagaaaggacgggtgaagaaggcacacaaatccaaaacacac

SEQ ID NO: 20814 - DNA, 1599 bp, Artificial Sequence
  Description of Artificial Sequence: Synthetic coding sequence
atggccgtcgaatcccaaggggggaggccgcttgtcctgggtttgctcctctgcgtgctgggaccagtggtgtcccacgccggtaagattctgcttattccagttgatggctcacattggctttctatgctgggagcaattcagcaacttcagcagagaggacatgagattgtcgtgcttgcacctgacgcctctctgtacatcagagatggggcattttacactctgaaaacctaccctgtgccttttcaaagagaggatgtcaaagaatcatttgtgtcactgggtcacaatgtctttgaaaacgattcgtttcttcaacgggtgattaagacctacaagaagataaagaaggactcggcaatgctcctctccggttgttcgcatctgcttcacaacaaagaactgatggcgtcccttgccgaatcatcctttgatgtgatgcttaccgatcctttcctgccttgttcaccaatcgtcgcccaatacctttcccttccaactgtgttttttctgcatgctctcccatgctctttggaattcgaggccactcagtgcccaaacccattcagctacgtcccaaggcctctgtcatcgcatagcgatcacatgaccttcctgcaacgcgtgaaaaacatgcttattgcattttcacaaaactttctgtgtgacgtggtctactcgccttacgcaacgcttgcttcggagtttctgcaacgagaagtgactgtgcaagatttgctgagctccgcctccgtctggctgtttcgatccgattttgtgaaggactacccccggccaatcatgcctaacatggtgttcgtggggggcattaactgtctccatcagaatccattgtcccaggaattcgaagcgtacatcaatgcaagcggggagcatggtattgtggtgttttcacttggaagcatggtgtccgaaatccccgaaaagaaagcgatggcaattgcggacgcacttgggaaaattccccagactgtgctttggcggtacaccggaacgcgaccaagcaacttggccaacaataccattctggtgaagtggttgcctcagaacgacctccttggccacccgatgactagggcgttcataactcatgcagggtcgcatggcgtttacgaaagcatctgtaatggagtccctatggtgatgatgccactcttcggtgatcaaatggacaacgcaaaacgtatggaaaccaagggagccggcgtgaccctgaacgtccttgaaatgacttcggaggaccttgagaacgctcttaaggccgttatcaacgacaagtcctacaaggaaaacattatgagactgtcctccctgcacaaggaccggcctgtcgagccacttgatctggccgtgttttgggtggaatttgtgatgcgtcacaaaggtgcaccgcaccttcgtccagcagcgcatgaccttacctggtaccaataccatagcctcgatgtgattggcttcctgctcgctgtggtccttaccgtcgctttcatcacctttaagtgttgtgcttatggttaccgcaaatgtctgggaaagaaaggacgtgtgaaaaaggcacataagtccaagacccat

SEQ ID NO: 20815 - DNA, 1599 bp, Artificial Sequence
  Description of Artificial Sequence: Synthetic coding sequence
atggctgtggaaagccaaggtggtaggcccctggtgctaggcctgctcttatgcgtcctagggcccgttgtgtctcacgccggcaagattctgctgattccagtagacggctcacactggctatcaatgctgggggccattcagcagctgcagcaaagagggcacgagatcgtggttttggccccggatgcatcattatacattcgcgacggcgctttttacaccctgaagacatacccggtgccgttccagagagaagatgttaaagagtcttttgtgtcactggggcataacgtcttcgaaaacgatagttttctgcagcgggtcatcaagacgtataagaagataaagaaggatagcgccatgctcctatctgggtgtagccacctgttgcataacaaggagctgatggcttcccttgccgagagcagcttcgacgtgatgctgacagatccattcctcccatgcagtcctatcgttgcccagtatttatcgttgccgactgtttttttcctccatgctctgccttgttctctggagtttgaagccacccagtgtcctaacccattttcctacgtgccccgtccccttagctctcacagcgaccatatgactttcctgcagcgggtgaagaacatgctcatagccttttctcagaatttcttgtgtgatgtcgtgtattctccctatgctaccttggctagcgagtttctccagagggaggtgaccgtacaggatctgttgagtagcgctagcgtttggttattcagatccgacttcgttaaggattatccaagacctatcatgcctaacatggtctttgtcgggggcattaactgcctgcatcaaaatccgctgagccaggagttcgaggcttatattaacgcctctggagaacacggcatcgtggttttctcacttgggtctatggtttcagagatcccggagaaaaaggctatggcaatcgcggatgctttgggcaagatcccccagactgtcctgtggcggtataccgggacgcgaccctctaacctggctaataataccatattagtgaaatggctcccccagaatgatctgctgggtcacccaatgactcgcgcctttatcacccacgccgggtcccacggagtttacgaatcaatttgcaacggggtgcccatggttatgatgcccctattcggtgatcagatggataatgctaagaggatggagactaaaggagctggtgtcacgctgaatgtcctcgagatgaccagcgaggatctggaaaacgccctgaaggcagtcatcaatgacaaatcctacaaggaaaatatcatgagacttagttcattacacaaagatcggccagttgagccactggatctggcagttttctgggtggaattcgtcatgagacacaaaggagcaccacacttaagacccgcagcccatgacttgacctggtaccagtatcatagcctggacgtcatagggtttctgctagccgtggttctcactgtggcattcattacctttaagtgttgcgcttatggctatcgcaagtgcttgggaaaaaagggtcgggtcaagaaagcccataagtctaagacgcat

SEQ ID NO: 20816 - DNA, 1599 bp, Artificial Sequence
  Description of Artificial Sequence: Synthetic coding sequence
atggccgtggagagccaaggcggaagacctctcgttcttgggcttctgttgtgtgtgctgggacccgtggtatctcacgccggcaaaatcctgctaatccctgtggacggctctcactggctgagtatgctgggcgcaatacagcagttacagcagcgcggccatgaaattgtggtactagctccggatgcgtccttatacataagggatggcgctttttacacgctcaaaacatatcccgtgccttttcaaagagaggacgtgaaagagtcatttgtgagcttgggtcataatgtgttcgagaatgattcttttcttcaacgagtgatcaaaacctacaaaaaaatcaagaaggacagcgctatgctcctctccggttgctcgcaccttctacacaataaggaacttatggccagtctcgctgaatctagcttcgatgtcatgctcaccgaccccttccttccctgtagccccattgtcgcccagtacctgagcctccccacagtatttttcctgcacgctctgccctgttcgcttgagttcgaagccacccagtgtccaaacccctttagttacgttccacgacctctttcatcccactccgaccacatgacctttctacagcgtgtcaaaaacatgctcatagccttttcccaaaatttcttgtgtgacgtggtgtactctccttatgcgaccctggcttctgaattcctccaaagggaagttaccgttcaggacctgctatcatccgccagcgtgtggttgttcaggtctgacttcgttaaagactatccaaggcctattatgcccaacatggtctttgtgggcggaatcaactgtctccatcagaacccactgtctcaggaatttgaggcttatatcaacgctagcggtgagcacggtattgtggttttttccctgggcagcatggtgtccgagatcccggaaaaaaaagcaatggccatcgccgatgctctcgggaaaatcccccagaccgtcctttggcggtacacgggtactcggccctccaatctggcaaacaataccattctggtcaagtggctcccgcaaaatgatctcctcggtcaccccatgacgcgcgccttcattacacacgctggctctcatggcgtgtatgaatcaatctgtaacggcgtcccaatggtgatgatgccactttttggcgaccagatggacaatgcaaagcgtatggagacgaagggtgcaggggtgacgctcaatgtgctggagatgacctctgaggatctagagaatgccttaaaggccgtaattaacgataagagctacaaggaaaatatcatgcgccttagctctctgcacaaggatcgaccagtggagcccctggacctcgccgtgttttgggtggagttcgtgatgcggcacaagggagccccacacctgaggcctgccgcccatgacctgacgtggtatcagtaccatagcctcgatgtcattggtttccttttggccgtggtgctgaccgtcgcattcatcacgttcaaatgctgtgcatacggctataggaagtgccttggaaagaaaggcagggtcaaaaaagctcataagagtaaaacacac

SEQ ID NO: 20817 - DNA, 1599 bp, Artificial Sequence
  Description of Artificial Sequence: Synthetic coding sequence
atggctgtggagtcgcaaggtggacggccgctggtgttgggactcctcctctgcgttctgggaccggtggtgtctcacgctggtaagatccttttgattccggtggacgggagccactggctgtcgatgttgggagcgatccagcagcttcaacagagaggacacgagattgtggtgctggcgcccgacgcgtcactgtacatccgggacggagctttctacactctcaagacctaccctgtgcctttccagagagaagatgtgaaggaaagtttcgtgtccctggggcacaacgtgtttgagaacgatagttttctgcagcgcgtcatcaaaacctataagaagatcaagaaggattcggcaatgctgttgagcggatgcagccatctgctgcacaataaggagctcatggctagcctggctgaatcgtccttcgacgtcatgctcaccgaccccttcctgccgtgctccccgatcgtggcccaatacctgagtctcccgactgtgttcttcctgcacgccttgccgtgctcgctggagttcgaggccacgcagtgcccaaatccgttttcctacgtgccccgcccgctgtcgtcccattccgaccatatgacgtttctccaacgcgtcaaaaacatgcttatcgccttctcacagaatttcctctgcgatgttgtctactcgccgtacgcgaccttggcctcagaattcctccagcgggaagtgacggtgcaagacctgctgagctccgccagcgtctggctttttaggtccgacttcgtgaaggactatccgaggccaatcatgccaaacatggtgttcgtgggcggcatcaactgcctccatcagaacccgttgtcgcaggaatttgaggcgtatatcaatgctagcggagaacacggcatcgtggtgttctccctgggctccatggtgtcagagattcccgagaagaaagccatggcaatcgcggacgcattgggaaagattccgcaaacggtgctttggcgatacaccggaactcggcctagcaacctcgcaaataacaccatcctcgtcaagtggctgccgcaaaatgatctgctggggcatcctatgacccgcgcttttatcactcacgccggatcccacggagtgtacgagtcgatttgcaatggagtgcccatggttatgatgccgctgttcggcgaccaaatggataacgccaagcggatggagactaaaggagcaggagtcaccctgaatgtgttggaaatgacttccgaagatctggagaatgctctgaaggcagtgatcaacgacaagtcctacaaagaaaacatcatgcgcctctccagcctgcacaaggatcgcccggtggaaccgctggacctcgccgtcttttgggtcgaattcgtgatgagacacaagggtgccccacatctgcgaccggcggcgcatgacctgacctggtaccaataccacagcctcgacgtgatcggattcctgctcgccgtggtgctcactgtggcgttcatcactttcaaatgctgcgcctacggatatcggaagtgcctggggaagaagggtcgcgtcaagaaagcccacaaatcgaaaacccat

SEQ ID NO: 20818 - DNA, 1599 bp, Artificial Sequence
  Description of Artificial Sequence: Synthetic coding sequence
atggctgtggagtcccagggaggtcgaccgctggtcttaggtctcttgctttgcgttttgggtccagtagtctcccatgctggaaagattttgttaatacctgttgatggatctcactggttatctatgctaggagctattcaacaactgcaacagcgaggacatgaaattgtagttttagctccagatgcttccttatatattagagacggagctttttacacccttaagacttaccccgttccgtttcagcgtgaagacgttaaggagtcattcgtttcattgggccataatgtttttgaaaatgattcgttcctgcaacgcgttatcaaaacatacaaaaagattaaaaaagattcagccatgctactgtcgggatgctctcatctcttgcataataaggaattgatggcgagtctagcagaaagttcctttgatgtcatgcttacagatccattccttccatgctcgcccatcgtagctcaatatctttcactcccaactgtttttttcttgcacgcattaccatgttctcttgagttcgaggccacacagtgcccgaatccttttagctatgtgccccgaccgttgtcatcacactccgaccatatgacctttcttcagcgtgttaaaaacatgcttattgccttcagtcagaatttcctttgtgacgtggtatattcgccctacgcaactcttgcttcagagtttctacaaagagaagtcactgttcaggatttacttagttcggcttccgtttggctcttccgctctgatttcgtgaaagattatcctcgacccattatgcctaatatggtttttgtcggaggcataaactgtcttcaccaaaatccgctatcgcaagagtttgaagcatatattaatgcttcaggagaacatggcatagtggttttctccctcggatcaatggtatcagaaattcccgaaaaaaaagcaatggcgattgcagatgcccttggaaaaatcccccagactgttctttggcgatacacagggactagaccgagtaatctcgccaacaacacaattctcgttaaatggctgccacagaatgatttgctaggtcatccgatgaccagggcattcattacgcacgctggatcgcatggagtgtacgagagtatctgcaatggtgttccaatggtaatgatgccactttttggcgatcaaatggataatgccaagcgtatggaaacgaagggagctggggttactttgaacgtgctggaaatgacatccgaagaccttgagaacgctctcaaggcagttatcaatgataaaagctataaagaaaatatcatgcgcttgtcttcacttcacaaagatagacctgttgagccgctcgaccttgctgtattctgggttgaatttgtgatgcgacacaaaggcgcaccacatttacgtccagcagctcacgatcttacgtggtaccaatatcacagtcttgatgtcatcggattccttttggcggtagttttgacagttgctttcattacgtttaagtgttgtgcgtacggatacagaaaatgtttgggaaagaagggtagagttaaaaaagctcataagtcaaaaacccac

SEQ ID NO: 20819 - DNA, 1599 bp, Artificial Sequence
  Description of Artificial Sequence: Synthetic coding sequence
atggccgtggaatctcagggaggacgcccactggtcctgggcctgttgttgtgcgtgctcggccctgtggtgtcccacgcgggcaaaattctcctgatcccggtggacggctcccactggctcagcatgctgggggcgatccagcaactgcagcagcgcggacacgagatcgtcgtgctcgctcctgacgcgtcgctgtacatacgtgacggggcgttttacactctgaaaacttacccggtcccgttccagcgggaggacgtcaaggaatcattcgtctcactcggacacaacgtgttcgagaatgactcgttcctccaacgggtcatcaagacctataagaagattaagaaagacagcgccatgctcctgtctggttgttcccacctgctccacaacaaagaactgatggcctccctggccgagagctcatttgacgtgatgctcaccgacccattcctgccttgttccccgatcgttgctcagtacctgtcgcttcccactgtgttcttcctccatgccctcccgtgcagcctcgagttcgaagctactcaatgcccgaacccattcagctacgtgccaagaccgctttcatcgcattcagatcacatgacgttcttgcagcgggtgaagaatatgttgatcgctttctcacaaaactttttgtgtgacgtggtgtactccccgtacgcaactctggccagtgagtttctgcagcgtgaagtgacggtgcaggacctgctttcgtcagcttcggtgtggctgttccgctcagacttcgtgaaagattaccctagaccgatcatgccgaatatggtctttgtcggtgggatcaactgcttgcatcaaaatcctctgtcacaggagttcgaggcctacatcaacgcgtccggagaacatgggatcgtggtgttttcactgggaagcatggtgagcgagatcccagaaaagaaggctatggcgatcgcggacgcgctgggaaagatcccgcaaaccgtgctgtggaggtacaccggaactaggccgtcgaaccttgcaaataacacgatcctggtcaagtggctgccgcaaaatgatctcctgggccaccctatgactcgggccttcattacccatgccggtagccacggagtctatgagtccatctgcaacggagtgccaatggtgatgatgccgctgttcggagatcagatggacaatgccaaaagaatggaaaccaagggggcaggtgtgacgctgaacgtcctcgaaatgacctccgaggacctcgagaacgctctgaaggctgtgatcaatgacaaatcgtacaaggaaaacattatgcgactgtcctccctccacaaggatcgccctgtggaaccactcgatcttgcagtattctgggtggaattcgtgatgcgccataagggggcgccgcacctgcggcccgctgcacatgatctgacttggtaccagtaccatagcctggatgtgatcggattcctcctcgcggtggttctgactgtggcgttcatcacttttaagtgctgcgcctacggataccgcaagtgcctggggaagaaagggcgtgtgaaaaaggctcataagtcgaaaacgcat

SEQ ID NO: 20820 - DNA, 1599 bp, Artificial Sequence
  Description of Artificial Sequence: Synthetic coding sequence
atggcagtcgaatcacaaggagggcggcctttggtgctgggtctgctgctgtgtgtcctcggcccagtcgtgtcacatgcaggcaagatacttcttatccctgtggatgggtcccattggctgtcgatgcttggagcaattcaacaacttcagcagcgggggcatgagatcgtggtgctggcccctgacgcatccctgtacatcagggatggagcgttctacaccctgaaaacgtaccctgtgcccttccagagggaggacgtgaaggagtcattcgtgtccctgggacataacgtgtttgagaacgactcctttcttcagagagtgataaagacttacaagaagatcaagaaggattcggcaatgctgctctcgggatgcagccatcttctgcataacaaagaattgatggcctcactggcagagtccagctttgatgtgatgcttaccgatccattcctgccctgtagccctattgtggcacaataccttagtctgcccactgtgttctttttgcatgcacttccttgttctctcgagttcgaggcaactcaatgcccgaacccattcagctacgtgccacggccacttagctcccattcagatcatatgacttttctgcagcgggttaagaatatgctcattgcattttcgcaaaactttctctgtgatgtggtgtactccccatacgccacccttgcatccgaatttctccagagggaagtgaccgtgcaggacctcctgagcagcgcatccgtgtggctttttagatcagatttcgtcaaagactaccctaggcctattatgcctaatatggtgtttgtgggtggtatcaactgcttgcaccaaaatccactctcccaagaattcgaagcatacattaatgcatcgggtgaacatggaatcgtggtgttcagcttgggaagcatggtgtcagaaattcccgagaagaaagcaatggcaatagcggacgcacttggcaagattccccagactgtcctgtggcgttacactgggaccaggccaagcaacctcgccaacaacaccattcttgtgaagtggctgccgcagaacgacctcctcggtcatcctatgactcgagcattcataacgcatgccggctctcatggcgtgtatgaatcgatttgcaacggtgtcccaatggtcatgatgcccttgttcggcgatcaaatggacaatgcgaaacggatggaaactaagggagccggggtgacccttaatgtgctcgaaatgacttcggaagatcttgagaacgcacttaaggccgtcattaatgataagagctataaagaaaacattatgaggctgagctcactccacaaggatcgtccagtcgaaccactggacctggcagtgttctgggtcgaatttgtcatgcgtcataagggcgcacctcatttgaggccagcggctcatgaccttacctggtatcaataccattccttggatgtgattggctttctccttgccgtcgtgctcaccgtggcgtttatcacctttaagtgctgtgcctacggttacagaaaatgtctgggaaagaaaggccgcgtgaagaaggcgcacaaaagcaagacccat

SEQ ID NO: 20821 - DNA, 1599 bp, Artificial Sequence
  Description of Artificial Sequence: Synthetic coding sequence
atggccgttgagtcccagggaggtcgtccactggttctgggactgctcttatgcgttttgggacctgtggtgtcacacgccggtaagatcctgcttattcctgtcgatggttcccattggctcagcatgctgggagccattcagcagctgcaacagcgggggcatgagatcgtagtccttgcgccagatgcctctctctacatcagagacggagccttctatactctaaaaacctaccccgtcccctttcagagagaggatgtgaaggaatctttcgtgtccctggggcataacgtcttcgagaacgactcctttctccagcgtgtgatcaagacctacaaaaagatcaaaaaagacagcgccatgctgctgtccggatgctcgcatttgctgcataacaaggagctgatggctagcctggctgagtcctcctttgacgttatgttgacagatcccttcctcccatgtagtccaatcgtcgctcagtatctgagcctgcctacggtgtttttcttgcatgctctgccatgctcattagagttcgaagcaacccagtgccctaatccttttagctatgtgccaagacctctttcgtctcactcagatcacatgacgtttttgcagagagtgaagaacatgctgatcgcctttagtcagaacttcctctgtgatgtggtgtactccccctatgcaaccctggctagcgaattcctccagcgcgaggtgaccgtgcaggatctcttaagtagcgcatcggtctggctgttcaggtctgacttcgttaaggactaccctcgccccatcatgcccaatatggtgttcgtgggtggaatcaactgtctgcaccagaatcctttgtctcaagaattcgaagcttacatcaacgcgagtggcgagcacggaatcgtggtcttctcactgggtagcatggtaagtgaaatccctgagaagaaggcgatggccatcgctgatgcactaggaaagatcccccagacagtcctgtggaggtacacggggacacgcccctctaatctggctaacaacaccatattggtgaagtggctcccccagaacgacctgctgggtcaccctatgacccgtgctttcatcacccacgccgggtcccatggggtgtatgagagcatctgtaacggtgtgccaatggtgatgatgcccctgtttggggatcaaatggataatgccaaaaggatggagactaagggcgctggcgtaacactgaacgtgctggagatgactagcgaggatttagagaacgcactaaaggccgtcattaatgacaagtcttataaagaaaacataatgaggctatcaagccttcacaaggatcgtccggtagaacccctggaccttgccgtcttctgggtagaattcgtgatgagacataaaggcgcacctcatctccggcccgccgctcatgacctgacttggtatcaatatcatagtttggatgttataggctttctgttggcagtggtcctgacggttgcctttatcacttttaagtgttgcgcatatggttatcgtaagtgcctcgggaaaaagggcagggtgaagaaggcccataagagcaagacacac

SEQ ID NO: 20822 - DNA, 1599 bp, Artificial Sequence
  Description of Artificial Sequence: Synthetic coding sequence
atggctgttgagtcccaaggcggccggccccttgtcctgggacttctgttgtgtgtgctgggacctgtggtaagccatgccgggaaaatcctcctgataccggtggacggctcccattggctgagcatgctgggtgcaatccagcaactccagcaaagggggcacgaaatcgtggtcctggcaccagacgcatccctatacatcagagatggggcattttatacactgaaaacgtatcccgttccctttcaacgggaagatgtcaaggagtccttcgtcagcctcgggcacaatgtatttgaaaacgactctttcctccagcgagtaataaaaacctataaaaagattaagaaagattccgcgatgctgctgagcggctgctctcacctgttgcacaacaaagagctgatggcatcattggccgagtcctcctttgacgtgatgctgactgatccatttctcccatgcagtccaattgtggcacagtacctgtccctgcccactgtgttcttcttacatgcgctgccttgcagcctcgagtttgaggccacacagtgccccaaccccttctcctacgtccctcgccctctttctagccattccgaccatatgacgttcttgcagcgtgtgaaaaatatgctcattgccttctctcagaatttcctttgtgacgtggtctatagcccttatgctactctggccagcgagttcttgcagcgcgaggtgacagtgcaggatctcttgtcatccgcatcagtgtggctgttcaggagcgacttcgtgaaggattatcctaggccaatcatgccaaacatggtgtttgtgggaggaatcaattgtttgcaccagaaccccttgtcacaggaattcgaagcttacataaacgcctccggagaacacggcatcgtcgtgttttcgctcggatcaatggtgagtgagattcccgagaaaaaggcaatggctatcgcggatgccctaggcaagattccccagactgtactgtggcggtacacaggaacaagaccctcaaacctagcaaacaacacgatcctggtcaaatggctcccacagaatgatctgctgggccaccctatgactcgagcgtttatcacccacgccggcagccatggggtttacgaatccatctgcaatggagtgcctatggttatgatgccgctatttggagaccaaatggacaacgccaagagaatggagacaaagggcgccggagtgaccttaaacgtgctcgagatgacgagtgaagacctcgaaaacgcattgaaggcagtgattaacgataagtcttacaaagaaaacattatgcgtctatcaagtctgcataaggatcgtcctgttgaacctttggaccttgcagtgttttgggttgaatttgttatgcggcacaaaggcgcgccccacctaagaccagccgctcatgatctgacgtggtatcagtatcactcgttggacgttattgggttcctcctcgcagttgtgctgactgtagcgttcattacattcaaatgctgtgcttacggctaccggaagtgtctgggaaaaaagggacgagtgaaaaaggctcacaaatcaaagacgcac

SEQ ID NO: 20823 - DNA, 1599 bp, Artificial Sequence
  Description of Artificial Sequence: Synthetic coding sequence
atggctgttgaatctcaaggaggcaggccactggtcctgggtctgctcctttgcgtactgggccctgtcgtgtctcatgccggcaagatcttgctcattcctgtggacggctcccactggctgtcaatgttgggtgctattcaacagctgcagcagcgcggacatgagattgttgtgctggctccagacgcttcactttacattagggacggcgcattttataccctcaaaacctatcctgtacccttccagagggaagacgtcaaagaatccttcgtgtctttgggccataacgttttcgagaatgatagttttctgcagcgtgttataaagacctacaagaagattaagaaggatagtgccatgctcctttctggttgcagccatctgctccacaacaaggagctgatggcctcactggccgaatcttcttttgatgtcatgctgactgatccttttcttccatgttctcccatcgttgcccagtatctgagcttgcccactgttttctttctgcacgcattgccctgttcattggagttcgaggcaactcagtgtcccaacccattttcatacgtgccacgtcccctgtccagccatagcgatcacatgacattccttcaaagagtgaaaaacatgctcattgctttctctcagaatttcctctgtgacgtggtctatagcccatatgctacacttgcttctgaattcttgcaacgtgaagtcacagttcaagatctgctgtcttccgctagtgtatggctcttccgctctgactttgtgaaggactatcccagacccatcatgcccaacatggtcttcgtgggtggcatcaattgtctgcaccaaaacccactcagccaagagtttgaagcatatatcaatgcttccggagagcatggtatcgtagtgttctctctgggctctatggtatccgagattccagagaagaaggccatggccatcgccgacgctctgggtaagattccacaaactgtgctgtggaggtacaccggtacacgtcctagcaacctggccaacaacaccattctggtaaagtggttgcctcaaaacgatctgctcggacaccccatgaccagggcctttattactcacgccggatcacatggtgtatacgaaagcatatgcaacggtgtccccatggttatgatgccactgtttggcgatcagatggacaacgccaagcgcatggagacaaagggagccggtgtaacactcaacgtgctggagatgacaagcgaggatttggaaaatgccctgaaggctgtcattaatgataagagttacaaagaaaacatcatgaggttgagctctctccacaaggatagacctgtggaacctttggatctggctgtgttctgggtggagttcgttatgagacataagggcgctccccatcttcgccctgccgctcatgatttgacctggtatcaatatcacagtctcgatgttattggattcctgctggctgttgtgttgaccgtcgcattcatcactttcaaatgttgcgcctatggctacaggaagtgcctgggaaagaagggcagagtaaagaaagctcacaaatccaaaacacac

SEQ ID NO: 20824 - DNA, 1599 bp, Artificial Sequence
  Description of Artificial Sequence: Synthetic coding sequence
atggccgtggagtcacagggcggacggccgctcgtgctcgggttgctgctgtgcgtcctgggaccggtggtgtcccacgccggcaaaattctgctgattccggtcgacggttcgcactggctctcaatgcttggggccatccagcagctgcaacagcgcggacacgagattgtggtcctggccccagatgcgtccctctacatccgcgacggtgctttctacactctgaaaacttacccggttccgttccagcgggaggacgtcaaggagagtttcgtgtccctgggacacaacgtgtttgagaatgattccttccttcagcgcgtaatcaagacttacaagaagattaagaaagactcggctatgctgctgtcggggtgctcgcatctcctgcacaataaagagctcatggcctcgctcgctgaatcgtcatttgacgtgatgctgaccgacccattcctcccatgttcgccaatcgttgctcagtacctctcgctcccgactgtctttttcctgcacgccctgccgtgttcgctggaattcgaggccactcaatgcccaaaccctttttcctacgtccctaggccgctcagctcacattcggatcatatgacctttcttcagcgggtgaagaacatgctgatcgccttctcccagaatttcctctgcgatgtcgtgtacagcccgtacgcgaccctggccagcgaattccttcaacgggaggtgacggttcaggacctgctctcttcagcaagcgtgtggctgttccggagcgacttcgtgaaggactacccccgccctattatgccgaatatggtctttgttggaggaatcaactgcctccaccagaacccgctctcacaggagttcgaggcatacatcaacgcctcaggagaacacggaatcgtcgtcttttctctgggctcgatggtgtcggagatcccagaaaagaaagctatggccatcgcagacgcgctgggaaagatcccgcaaaccgtgctgtggcgctacactggcaccagaccatccaatctcgcgaacaacactattctcgtgaagtggctgccacagaacgacctgctgggacacccgatgactagagcgttcataactcacgctggaagccatggggtgtacgaatccatctgtaacggtgtgccaatggtaatgatgcccctgttcggggatcagatggataatgccaagagaatggaaactaagggtgccggtgtgactctgaacgtgttggaaatgacgagcgaggacctggaaaacgcgctcaaggccgtcatcaatgacaaaagttacaaggaaaacatcatgagactctcttccctgcacaaagaccgcccagtggagccccttgaccttgccgtgttttgggtcgagttcgtgatgaggcataagggcgccccacacttgcgcccggcggcgcatgacctgacttggtaccagtaccacagcctggatgtgatcggcttcctcctggctgtggtcctgaccgtggcattcatcaccttcaagtgctgcgcctatggttacaggaagtgcctgggaaagaaagggagggtgaaaaaggcccataagtccaagacccat

SEQ ID NO: 20825 - DNA, 1599 bp, Artificial Sequence
  Description of Artificial Sequence: Synthetic coding sequence
atggccgtggagagtcaggggggtcgacccttggttctgggcttgctgttgtgcgttctagggcccgtggtgagccacgcaggtaaaatacttctcatcccagttgacggcagccactggctctcaatgctgggagccattcaacagttgcagcagcggggtcatgagattgtcgtgttagcccccgatgcttccttgtacattagagatggcgccttttacactctcaaaacctatccagtacctttccagcgcgaggacgtcaaagaaagcttcgtgagtctagggcataacgtttttgagaatgattcctttttgcagagagtcataaaaacctacaaaaagattaagaaggattccgccatgttgctttccggctgctcccacctgcttcataataaggagctgatggctagcctcgccgagtctagttttgatgtcatgttaactgacccttttctgccttgtagccccatagtggcgcaatatctgtcgctaccaacagtcttttttctccatgcccttccgtgctccctggagtttgaggcaactcagtgccctaaccccttttcgtatgtcccgagaccattgtcctcccactccgatcacatgacttttctacaaagagtcaaaaatatgttgatcgccttcagccagaacttcctgtgcgacgtggtgtatagtccatacgcaaccctggccagtgagtttctgcaacgcgaggtaaccgtgcaagatctactgtcttctgcaagcgtgtggcttttcagatccgattttgtaaaagattaccctcggcccataatgcccaatatggtctttgtgggcggtattaactgcctccatcagaatcctctgagtcaggaatttgaagcctatattaatgcaagcggcgagcatggtatcgtagtgtttagcctcggttctatggtgtccgaaatccccgagaagaaggctatggctatagctgacgcattaggcaagatccctcagacagtgctgtggcgatacaccgggactcgaccatctaatctggctaacaacacgattcttgtcaaatggctgccgcagaacgatttactggggcatcctatgacccgggcattcattactcatgccggcagccacggcgtttatgagtctatatgtaacggcgtgcctatggttatgatgcccctgtttggagaccagatggacaatgcgaaaaggatggaaactaaaggcgctggggtgacactgaacgtgctcgagatgacctctgaggatctggaaaacgctctgaaagctgtgattaatgacaagagctacaaagaaaacatcatgagactgtcctctcttcacaaggatcgcccagtcgagcccctggatctcgcagtcttttgggtggagtttgtgatgagacataaaggagccccacatctgagacctgccgcgcacgatctgacctggtatcagtaccattctctcgatgtcatcggatttttgttggcagtcgtgcttacggtcgccttcattacttttaagtgctgcgcctacgggtaccgcaaatgcctggggaagaaaggcagagtaaaaaaagcccacaagtccaaaactcac

SEQ ID NO: 20826 - DNA, 1599 bp, Artificial Sequence
  Description of Artificial Sequence: Synthetic coding sequence
atggcagttgagagccagggaggtaggcctctcgtgctagggctcctgttgtgcgtcctgggaccagtcgtgagccacgccgggaaaattttgcttattcccgtagacgggtctcactggctctccatgctaggagccatccagcagctgcaacagagagggcacgagatcgtggtgctcgcccctgatgcctcactgtacataagagatggggctttttatacccttaaaacatatccggtcccctttcaaagagaagatgttaaggagtcgttcgtaagtctgggccataatgtcttcgaaaacgactctttccttcagagagttatcaagacatataaaaagataaagaaagattccgctatgctgctgagcggatgtagccatctgctgcataacaaggagctcatggcgtcattggcggaatcttcctttgacgtaatgttgacagatccattcctaccatgttcgccgattgtggcccagtatctgtctctgccaactgtcttctttttacatgccttaccctgcagtctcgaattcgaggcgacacagtgccctaatcctttctcctatgtgcctcggccactcagttctcattccgatcatatgacctttttacaacgtgttaagaatatgttgattgctttctcgcagaattttctgtgcgatgtagtgtactctccatacgcgaccctggcaagcgagttcctgcagagagaggttacagtgcaggatctgctcagcagcgccagcgtctggctgttcaggagtgattttgttaaggactaccccagaccaatcatgcccaatatggtgttcgtgggcggcattaactgtctacaccagaatcccctttcccaggaattcgaggcttacataaacgcctctggagagcatgggattgtggtcttctccctgggcagtatggtatctgaaatacctgagaagaaggccatggccatcgctgacgcacttggaaagatcccgcagactgtcctatggaggtatactgggactcggcctagtaacctcgcaaataacacaatacttgtgaagtggctgccccaaaatgatctcctggggcacccaatgaccagggcctttattacccacgccgggagccatggggtctacgaatcgatttgcaacggcgtccctatggtaatgatgccgctgttcggtgatcagatggacaacgctaagaggatggagactaagggcgctggcgtgactcttaatgtgctggagatgacgagcgaagacctcgaaaatgcattgaaggccgtgattaacgataaatcctataaagagaacatcatgagactttcttctcttcataaagaccggcccgtggaaccattggatctggctgtattttgggtcgaattcgtcatgcggcacaagggcgctcctcatctccgacccgcggcccatgacttgacgtggtatcagtaccacagtcttgacgtgatcgggttcttgctggcagtggtcctgaccgtggcgtttatcacctttaagtgctgtgcatatgggtaccgaaagtgtctcggcaagaaagggcgtgtgaagaaggcccacaaaagtaagacccac

SEQ ID NO: 20827 - DNA, 1599 bp, Artificial Sequence
  Description of Artificial Sequence: Synthetic coding sequence
atggccgtggaaagtcagggcggcaggccacttgtcctcgggctgttgctgtgcgtgctcggccccgtggtgtcacatgcgggaaagattcttttaatccccgtggatggaagccactggctgagcatgctgggcgcgattcagcagctccagcaaaggggtcacgagatagttgtgctggcccctgacgccagcctatacatcagggatggagccttctataccttgaagacctaccctgttccctttcagagggaagatgtgaaggagagcttcgtaagtctcggacacaatgtgttcgaaaacgactcttttctgcagagggtcattaagacctataagaagattaaaaaggactccgccatgctgctgtctggttgctcccacctgctgcataacaaggaactcatggcctcattggccgagagttccttcgacgttatgctcacagatccattccttccatgctcacccatcgtggcccagtacctgtcattaccgacagtgtttttcctgcacgccttgccgtgtagtctggaattcgaggcgacacagtgtcccaatccgttttcctatgtgcctagacccctttcaagtcatagtgaccatatgaccttcctgcagcgggtcaagaatatgttgatcgcattttcgcagaacttcttgtgtgacgtggtgtattccccatacgcaacactagccagtgagttcctgcaacgtgaagtgactgtccaagacctcctgtcttccgcttcggtttggttattccgctctgactttgttaaggactatcctcgtccaatcatgcctaacatggttttcgtcggagggatcaattgtctccaccaaaaccctctttctcaggaatttgaggcctacatcaatgctagcggtgaacatgggatcgtggtcttttcactagggagcatggtcagtgagatcccagagaaaaaggcaatggccattgccgatgcgctaggaaagatcccacaaaccgtcctatggcggtacaccggcactaggccctccaacctagctaacaatactattctggtaaagtggctcccgcaaaatgatctcctgggccaccctatgactagggcttttatcacacacgccggctcacatggagtctatgaatctatctgtaatggggtgccaatggtaatgatgcccctgtttggggatcagatggataatgctaaaaggatggaaacgaagggggccggcgtgaccttgaatgtgctggagatgactagtgaggacctcgaaaatgctttgaaggctgtgatcaatgacaaatcttacaaagaaaacataatgcgactgtcctccctgcataaagataggcccgttgaacctttagatttggccgtcttttgggtggaattcgtgatgcgccataagggtgctccgcacttgcgccccgcggctcatgacttaacttggtatcagtaccactccctcgacgttattggctttttgctagccgtggtactcacggtggccttcatcacattcaagtgttgcgcatatggttatcggaaatgcctcggtaaaaaggggagggtcaagaaagcccacaaatctaaaacccac

SEQ ID NO: 20828 - DNA, 1599 bp, Artificial Sequence
  Description of Artificial Sequence: Synthetic coding sequence
atggcggtcgaaagccaggggggacggcctctggtgctgggcttgcttctttgtgtgctggggcccgttgtgtcacacgctggaaagatcctcctcattcctgtggatgggtcacattggctgtcgatgctgggcgcgatccaacagctgcagcagaggggccatgaaattgtggtccttgcacccgatgcctcgttgtacattagagatggtgccttttacactcttaagacgtaccccgtgccttttcaaagagaagatgtcaaggagtcctttgtgagccttggacataacgtctttgaaaatgattccttccttcaaagggtgataaagacttacaaaaagattaagaaggattccgccatgttgcttagcggctgctcacacctgctgcataacaaagagctgatggcatcgctggcagaatcttcttttgacgtgatgctgaccgacccattcctgccttgttcacctatcgtcgcacagtacctgtcgcttccaactgtgttctttttgcatgcactgccctgttctctggagtttgaggcaacccagtgtcctaatccattcagctacgtcccacggccactttcgtcgcacagcgaccatatgacgtttctccagagagtcaagaacatgctgattgcattctcccagaactttctttgcgatgtggtgtactccccctacgccaccctggcgtcggaattcctgcaacgcgaagtgacggtccaggatttgctctcgtcagcaagcgtgtggctgtttcgatcagattttgtcaaagattacccaaggccgattatgcccaacatggtgtttgtgggtgggattaactgcctgcatcaaaacccactctcacaagaattcgaagcatacatcaatgcatcaggtgagcacgggattgtcgtgttttccctgggttcgatggtgtcggagattcctgaaaagaaagcaatggcaatcgcagacgcacttggtaagattccccagactgtgttgtggagatacacggggactagaccaagtaatctcgctaataacactattctggtgaagtggctgccgcaaaacgatctgcttggacatccaatgacccgggcttttatcacccacgcgggatcccatggcgtgtacgaaagcatttgtaatggtgtgccaatggtcatgatgcctctttttggagatcagatggataacgcaaagagaatggagactaagggtgcaggtgtgactcttaacgtcctggagatgacctcagaggaccttgagaatgcattgaaggcggtgattaacgataaaagctacaaggaaaacattatgaggctctctagccttcacaaggatcggcctgtggaacccctggatttggccgtgttttgggtggaatttgtcatgaggcataaaggcgcaccccacctccgccctgcggcgcatgatctgacttggtaccaataccactcgctggacgtcatcggatttctgttggcagtggtcctgaccgtcgctttcattactttcaaatgttgcgcttacggatatcgcaaatgtctgggaaaaaagggtagagtcaaaaaggcacacaaatccaagactcat

SEQ ID NO: 20829 - DNA, 1599 bp, Artificial Sequence
  Description of Artificial Sequence: Synthetic coding sequence
atggccgtcgagagccagggggggcggcccctagtcctgggccttctcctgtgcgtgctgggcccagtggtttcacacgcagggaaaatcctacttattcctgtggacggctcacactggctctcaatgctgggggcaatccagcagctgcagcagcgaggacatgagatcgtcgttctagctccagatgcgtccctgtatattagggacggagccttctacacgctgaagacgtatcccgtgcccttccagagagaggacgtgaaagaatcatttgtatccttagggcacaacgttttcgaaaacgattctttcctccagcgtgtcattaaaacctataaaaaaatcaaaaaggactcggcgatgttattgtctggatgcagccatctactgcacaataaggaactgatggcctccctcgccgagagctcatttgacgtcatgctaacagaccctttcctaccgtgttcaccaatcgtcgctcaatatctttccttgccaacagtgttctttttgcacgccctcccttgttctctggagttcgaggctacccagtgcccaaatccattctcctacgttcctcggcctttgagctcccattccgatcacatgaccttcctgcagagagttaaaaacatgttgatcgcgttctcacagaacttcctctgtgatgtagtatacagcccatatgcgacgctggctagtgagttcttacagagggaagtgacagtccaggaccttctaagctctgccagtgtgtggctgtttcgctcagactttgttaaggattacccaaggccgattatgcccaacatggtgttcgtgggcggtatcaattgcctccatcagaaccctctctcacaggagtttgaggcatacataaacgcctccggcgagcacgggatcgtggtgttcagcctcggaagcatggtctccgagattcctgagaaaaaggcgatggcgattgctgacgctctgggcaagatcccacagactgtgctgtggaggtacacaggtacacggccctccaatcttgctaataacaccatcctggtgaaatggctcccccagaacgaccttctcggccaccccatgactcgggcattcatcacacacgccggttctcacggcgtgtacgagagcatatgtaatggcgttccgatggtcatgatgccgctctttggcgaccagatggacaatgctaagcggatggagacaaagggcgccggcgtaacactcaatgtgcttgaaatgacctccgaggacctagaaaacgctctgaaggcagttatcaacgacaagagttataaggaaaacattatgcggctgtcaagtttgcataaagaccgtccagtcgagcccctggatcttgcagtgttctgggtggagttcgtcatgaggcataaaggtgcccctcatctgcggcctgctgcccatgatctgacctggtatcaatatcattccctggacgtgattggttttcttctggcagtcgtcctgacagtggcttttatcaccttcaagtgttgcgcttatggttataggaagtgtctgggaaagaaaggacgtgtgaagaaagcccacaagtctaagacacac

SEQ ID NO: 20830 - DNA, 1599 bp, Artificial Sequence
  Description of Artificial Sequence: Synthetic coding sequence
atggcagtggagtctcagggtggaaggccgctagtccttggtctcctgctctgcgttcttggtcctgttgttagtcacgctggaaaaatattgctaatcccagttgatggatctcattggctgagcatgcttggagcaattcaacaactgcagcaaaggggacatgagatagttgttctggctcctgacgcttctttgtatattcgagatggagctttctatacgcttaaaacttatcctgtcccgtttcaacgtgaagacgttaaggagagctttgtgagcttgggacataatgtatttgagaatgactcttttttacaaagagtgattaaaacttataaaaagataaagaaggattctgccatgttgcttagcggttgttctcatctactgcataataaggaactcatggcaagccttgcagagtcttcattcgacgtaatgctaaccgatccctttttgccatgctcaccaatagttgcacaatacctgtccttacctaccgtcttcttcttacatgctttgccttgctcactcgagttcgaagctacccaatgtcccaacccatttagctatgtaccgagacccttgtcgtcgcattctgaccacatgacatttctgcagagagttaaaaacatgcttatcgctttttcccagaattttttgtgcgacgtagtgtactctccgtacgctactttagctagcgagtttctgcaaagagaagttacagtacaagatttactatcctcagcatcggtatggctattcagaagtgattttgttaaagattatcccagacctatcatgcctaatatggtgttcgttggagggattaattgcctccatcagaaccctcttagtcaggagtttgaggcctatatcaatgcaagcggcgaacatggcatcgttgtcttctctctaggcagtatggtctccgagatacctgagaaaaaagctatggccatcgctgatgcactcggaaaaatcccacaaactgttttgtggcgctacaccggaacccgcccatcgaacttggctaataacacaattctggtgaaatggcttcctcagaacgatcttctcggacatccaatgactcgagccttcataacccatgccggaagtcatggggtgtatgagtctatttgcaatggggtaccaatggttatgatgcctctctttggtgaccaaatggacaacgctaagagaatggaaactaaaggagcgggtgttactcttaatgtgttggagatgaccagcgaagacttggaaaacgcattgaaggctgtaatcaatgataaatcatacaaagagaatattatgaggcttagtagtcttcataaggatagacccgtcgaaccgttggacctcgccgtattttgggtggaattcgtgatgaggcacaagggggctccccatttgcgtccagccgcccatgatcttacttggtatcaatatcatagtcttgatgtcataggctttttactggcagttgtgttgactgtggcttttatcacttttaaatgttgtgcgtacggatatcgtaagtgtctgggaaagaaaggcagagttaaaaaagcacataagagcaagacacac

SEQ ID NO: 20831 - DNA, 1599 bp, Artificial Sequence
  Description of Artificial Sequence: Synthetic coding sequence
atggcggtcgaatcgcaaggaggacggcccctcgtgttgggactgctgctctgcgtgcttggaccagtggtgtcccacgcggggaagatcctcctgatccccgtcgatggatcccactggctctcaatgcttggagcgatccagcaactgcagcagcgcggacacgagatcgtggtccttgcccctgacgcctccttgtacatccgcgatggcgctttctacaccctgaaaacctacccggtgccgttccagcgcgaagatgtcaaggaatcatttgtgtcgctcggtcataacgtctttgagaatgattcattcctccagcgcgtgatcaaaacttacaagaaaattaagaaggacagcgccatgctcctgtcgggctgctcccatctgctgcacaacaaggagctcatggcctcgcttgccgagagcagctttgatgtgatgctgactgacccattcctgccgtgctccccgatcgtggcgcaatacctgtccctcccaactgtgttctttctccatgcactgccttgcagccttgaattcgaagctacccagtgccctaacccattctcgtacgttcctcggccgctcagctcgcactcggaccatatgactttcctgcagagggtgaagaacatgctgattgcattcagccagaatttcttgtgtgatgtcgtctactcgccctacgcaactctggcttccgaatttctgcagagagaggtgactgtacaagacttgctgtcgagcgcctcagtctggctgttcagaagtgacttcgtgaaagactacccgcggccgatcatgccaaacatggtgttcgtcgggggcatcaactgtctgcaccaaaacccgttgtcccaggagttcgaagcgtacatcaacgcatccggagaacatggcatcgtggtctttagcctcggctctatggtgtcagagattccagaaaagaaagcaatggccatcgccgacgccctgggaaagatccctcagacggtgctgtggcgctacactgggacccggccgtccaatctcgccaataataccatcctcgtgaaatggctgccgcagaatgacctgctgggacatccgatgacccgggctttcatcacccacgctggctcccacggagtctatgagtcgatttgcaacggcgtgccaatggttatgatgcctctgttcggagatcaaatggacaacgcaaagcggatggaaaccaagggagccggggtgaccctgaacgtcctggagatgactagcgaagatctggagaacgccttgaaggcggtgatcaacgataaatcatacaaggaaaatatcatgcgcctttcgtcactccataaagacaggccggttgaacccctcgacctggccgtgttctgggtcgagtttgtgatgcgtcacaagggggccccacacctcagaccggcggcgcacgacctgacgtggtaccaataccactctctcgacgtgatcggttttctgttggcagtggtcctgaccgtggcgttcattactttcaaatgctgcgcctatggttaccgaaagtgtcttggaaagaagggtagagtgaagaaggctcacaagtcaaagacgcat

SEQ ID NO: 20832 - DNA, 1599 bp, Artificial Sequence
  Description of Artificial Sequence: Synthetic coding sequence
atggcggtcgaaagccagggaggacgccctctggtgctcgggttgctcctctgcgtgctgggaccggtggtcagtcatgcgggaaaaatcctgctgattccagtggacggatcgcactggctgtccatgctgggcgcaatccaacagttgcagcaaagaggacatgaaatcgtggtcctggcaccggatgcaagcctttacatccgggacggcgcgttttacaccctgaaaacctatcctgtgcccttccagcgcgaggacgtgaaggagagcttcgtgtcgctgggacacaatgtctttgagaacgactcgtttttgcagcgcgtgatcaagacctataagaagatcaagaaggactcggccatgctgctgtctggctgctcacatctcctgcacaacaaggaacttatggcgtccttggctgagtcgtcctttgacgtcatgctgactgacccgttcctgccgtgctcccctatcgtcgcccagtacctctcacttcctactgtgttctttctccacgcgctgccttgttcgctggaatttgaagcaacccaatgtccgaatcccttttcgtacgtgccgcggcccctgagctcgcactcagaccatatgaccttcctgcagagggtcaagaacatgctgatcgccttttcgcagaatttcctgtgtgatgtggtgtactcgccatacgccactctggcctcggagttcctccaacgggaggtgactgtgcaagatctgctgtcgtctgccagcgtgtggctgttccgcagcgatttcgtgaaggattacccgcgccctatcatgcctaatatggtgttcgtcggaggcatcaactgcctgcatcagaatcccctgagtcaagaattcgaagcctacatcaacgcctcaggggaacatggtattgtggtctttagcctcggcagcatggtatccgagatacccgagaagaaggcaatggcgatcgccgacgcactgggaaagatcccacaaaccgtgctttggagatacactggcacgaggccatcaaacttggcgaacaacactattctggtgaagtggcttccacaaaacgacttgctgggccacccgatgacccgggctttcattacccacgcaggaagccacggcgtgtacgaatcaatctgcaatggagtgccgatggtgatgatgcctctgttcggagatcagatggataacgcaaaacggatggaaaccaagggagcgggagtgactctgaacgtgctcgagatgacttcggaagatctggaaaatgccctgaaagccgtgatcaacgacaagtcctacaaggagaatatcatgcgcctctcatctctccataaagaccgccctgtcgaacctcttgacctcgcggtgttctgggtggaattcgtgatgagacacaagggagcaccacacctccggccagccgcgcacgatctgacttggtaccaataccattccctggacgtcattgggtttctgctcgcagtggtgctgactgtcgccttcatcacctttaagtgctgcgcctacggctatagaaagtgtctcggcaagaaggggcgcgtgaagaaagcccataagtctaagactcac

SEQ ID NO: 20833 - DNA, 1599 bp, Artificial Sequence
  Description of Artificial Sequence: Synthetic coding sequence
atggcggtggaaagccagggaggtaggccactggtccttggtttgttgctgtgcgtactgggacctgtggtcagccacgcagggaagatcctcctgattcctgtcgatggctcacattggttgtcaatgctcggcgcaatccaacagcttcaacagcgaggtcacgaaatagttgtactggcaccagacgcgagcctgtacatccgggacggcgccttttatactttgaagacctatcccgttcccttccaacgggaggacgtgaaggagtcttttgtcagccttggccataacgtgttcgagaacgatagcttcctgcagagggtcataaaaacctacaagaagataaagaaagacagcgctatgctcttgagtgggtgctcccacctcctgcataacaaggaactgatggcatccctggcagaaagttcttttgatgtgatgctgactgacccgtttctgccctgttcccctatagtagcccagtaccttagcctgcctaccgtattttttctccatgccctcccttgctccctcgaatttgaagccacccagtgccctaatcccttcagttacgttccacgacctctgtcatctcatagtgaccatatgacgtttctccagagggtgaagaacatgctgattgccttcagtcaaaatttcttgtgtgacgtggtgtatagcccgtacgcaacccttgcctccgagttccttcagagagaggttaccgtgcaagacttgctgtcctcagcgtccgtgtggctcttccggtctgattttgtcaaggattacccacggcctatcatgccaaacatggtgtttgtaggaggcattaactgcctgcatcaaaaccctctgagccaggaattcgaagcatatattaatgctagtggagaacatggtatcgttgtgtttagcctggggtccatggttagtgaaatccccgaaaagaaggcaatggcaatagccgacgcactcggtaagattccacagaccgtcttgtggaggtacacaggtacaagaccatccaacttggccaacaataccatccttgtgaagtggctcccacagaatgacttgctgggacaccccatgaccagagcctttatcacccacgcagggtcacacggagtttatgagtctatttgcaacggcgtgcctatggtcatgatgcccctgtttggggatcaaatggacaatgccaaaaggatggagactaagggcgccggtgtgaccctcaacgtgttggagatgacgtccgaagatctggaaaacgcgcttaaggcggtgataaacgataagtcctacaaagagaatatcatgcggctgagtagtctccacaaggaccgaccagttgagcctcttgatttggccgttttttgggtggaattcgtcatgcggcacaagggtgcgcctcatcttcggcctgccgcacacgaccttacttggtatcagtatcattctctggacgtgatcggtttcctgcttgccgttgtcctgaccgttgctttcatcactttcaagtgttgcgcatatgggtaccgaaaatgcctcggtaagaaggggagagtgaaaaaggctcataaatcaaagacgcac

SEQ ID NO: 20834 - DNA, 1599 bp, Artificial Sequence
  Description of Artificial Sequence: Synthetic coding sequence
atggccgtcgaatcgcagggaggccggccgctcgtcctcggactcctgctgtgtgtgctgggcccggtggtgtcccacgccggaaagatcctcctcatcccggtggacggttcacactggttgtcaatgctgggcgcgattcagcagcttcagcagcgcgggcacgaaatcgtggtgctcgcgccggacgcatccctctacatccgggatggagctttttacactctcaagacttacccggtcccgttccagagggaagatgtgaaggaatcatttgtgtccctcggccataacgtgttcgagaacgatagctttctgcagcgagtcatcaagacttacaagaagatcaaaaaggatagcgccatgctgctgtcgggttgctcccacctgttgcacaacaaagaacttatggcttcccttgccgaatcgtcgttcgatgtcatgctgactgatccttttctgccgtgcagcccgatcgtggcgcagtacttgtcgcttccgaccgtgtttttccttcacgcgctcccttgttcgctcgagttcgaagcgacccaatgccctaaccccttttcgtacgttccgcggccgctgtcgtcgcactcggatcacatgacgtttctccaacgcgtgaagaacatgctgatcgcgttctcacagaactttctctgcgatgtagtctactccccatacgcaaccttggcctcagaattcctccaaagagaggtcaccgtgcaagacctcctgtcaagcgcctcggtctggctgttccgcagcgacttcgttaaggattacccaagaccgattatgccaaatatggtgttcgtggggggtatcaattgcctgcaccagaatcctctttcccaagaatttgaggcatacataaacgcctctggagaacatggaatcgtggtgttctcactgggatccatggtgtccgagatccctgagaagaaggctatggcaatcgccgacgcactggggaagatcccccagactgtgctctggcgctacaccggaacccggccgtccaacctcgccaacaatacgatcctcgtgaagtggttgccccagaacgacctgctgggccacccgatgaccagggcgttcatcacgcacgctggatcacacggtgtgtacgaatccatctgcaacggggtcccgatggtcatgatgcctctgtttggcgaccagatggacaatgccaaacggatggagactaaaggcgccggcgtgaccctcaacgtgctggaaatgacttcggaagatctggagaatgcgctgaaagctgtgatcaatgataagtcctacaaggaaaacatcatgcggctgtcgtccctgcataaggatcgcccagtcgagccgctggacctggccgtgttctgggtggaatttgtgatgcggcataagggagcaccgcatctccgcccagcggctcacgacctcacctggtaccagtaccacagcttggatgtgattggattcctgcttgcggtggtcttgaccgttgcctttatcactttcaaatgctgtgcttacggttaccgaaaatgcctgggaaagaagggccgggtgaagaaagcgcataagtcaaagacgcac

SEQ ID NO: 20835 - DNA, 1599 bp, Artificial Sequence
  Description of Artificial Sequence: Synthetic coding sequence
atggcagtggaatcccagggcggtcgcccgcttgtactgggtcttttgctgtgtgtgttaggacccgtggtctctcacgccggcaagatacttttgattccggtagacggctctcactggctgtcgatgctgggagcgattcagcaacttcagcagcggggccacgagatcgtggtgctggctcctgacgcgtcactgtacatccgggatggagcgttctacaccctgaaaacataccccgtgcctttccagcgtgaagatgtgaaggaatcgtttgtttctttgggccataatgtcttcgagaacgattcgttcttgcagagggttattaagacatataaaaagatcaagaaggatagtgccatgctgttatctggatgctcccacctgctacataataaggaactcatggcttcgctagcagagtctagctttgacgtgatgctcaccgatccgtttctcccctgtagcccaattgttgcccagtacctctcgctgcctaccgtattctttctccatgccttgccttgcagtctggagtttgaggccacgcagtgtcctaatcccttcagttacgttccccgcccgctgtccagtcattccgaccatatgacattcttgcaacgagtcaaaaacatgctgattgccttcagtcagaacttcttgtgcgatgtggtgtattcgccatatgccacgctggcaagtgagttcttacagcgagaagtaaccgtgcaagatctgcttagttccgcaagtgtttggctgttccgtagtgactttgtgaaggattacccacggccgattatgcctaacatggtgttcgtcggtggtatcaactgtttacatcaaaaccccctgtcccaggagtttgaggcctacataaacgcctccggcgagcacggaatcgtggtgttctctctcgggtcgatggtgtccgagattcccgaaaagaaggccatggcgattgccgacgccctggggaagatcccacagacggtgctgtggcggtacacgggcacacggccgtccaacttggccaataataccatcttagtgaagtggctaccccagaacgacttactaggacacccgatgacacgagccttcatcacgcacgccggtagccatggcgtttacgagtccatctgcaatggagttccaatggtaatgatgccgttattcggagatcaaatggacaacgccaagcggatggaaactaagggtgcaggcgtaacactaaatgtcttggagatgacgtctgaggatctggagaacgctctgaaggccgtgatcaacgataagtcctataaagagaatattatgaggttaagctcgctgcacaaagatcgtccggtcgaacccctagacttggcggtgttctgggtggagttcgtgatgaggcataagggtgctcctcacctacgccccgccgcccacgatctgacgtggtatcagtatcactccctggatgtgatcggattcctgctggccgtcgtgctgacggttgcgtttatcacttttaaatgttgtgcctatggctaccgaaagtgtctgggtaagaaaggccgcgtaaagaaggcccacaagagcaagacccat

SEQ ID NO: 20836 - DNA, 1599 bp, Artificial Sequence
  Description of Artificial Sequence: Synthetic coding sequence
atggccgttgagtcccagggggggcgtcctttggtgctgggtctcctcctgtgtgttttgggccctgttgtctcccacgctggcaagatcctgctcatcccagttgacgggagtcactggctctctatgctgggagccattcagcagctgcagcagcgcggccacgaaattgttgtgttggctccagatgcctcactgtacatccgtgacggcgccttctatacactaaagacttatccagtcccttttcaaagggaagacgttaaagaatcattcgtgtccctaggacacaatgtgttcgagaatgacagtttcttgcaacgcgtgattaagacctacaagaaaatcaaaaaagactccgctatgctgctaagcggatgtagtcatttactccacaataaggaactaatggcaagcctggctgaaagcagtttcgacgttatgctgaccgacccttttttaccttgttcccccatcgtcgcccagtatctgtcactgccgaccgtgtttttcctgcatgctttaccgtgcagcctggagtttgaggcaacccagtgtccaaatcctttttcctatgtaccccggcccctatcctcccattctgatcacatgaccttcttacagagggtgaagaatatgctgatcgcctttagccagaattttctttgcgacgtggtgtattcaccctacgctaccctggcttcagagtttctccagagagaggtgactgttcaggacttactgagttccgcctccgtgtggttgttccggtcagactttgtcaaggactaccccagacccatcatgccaaatatggtgtttgtgggaggaattaactgccttcaccaaaatccactcagtcaggaattcgaggcctatataaacgcatccggcgaacatggcatcgtggtattttccttgggctccatggtgagcgagattcccgagaagaaggccatggcaatcgccgacgcccttggcaagatcccccagacggtgctgtggcgttatacagggacccgcccgtccaatctggcgaataatacaatccttgtgaagtggctgccacagaatgacctgctggggcaccctatgacccgagccttcatcacgcacgcaggatcccacggggtctacgaatcaatctgcaatggagtaccaatggtaatgatgcccctgtttggcgatcagatggataacgccaagaggatggagacaaagggagcaggagtcacgctcaacgttcttgagatgacaagtgaggacctggaaaatgccctgaaggccgtcataaatgacaagtcctataaggagaatatcatgagactgagtagcctccacaaggaccgtccggttgagccgcttgaccttgcagtcttctgggtggaattcgtcatgcggcataagggagccccacatctgaggcctgctgctcatgaccttacgtggtaccagtatcattcacttgatgtgattggctttctgttagcagttgtcctgacagtggccttcattaccttcaagtgttgcgcatacgggtatcggaagtgccttgggaagaagggccgggttaaaaaggcacataagtcaaaaacacac

SEQ ID NO: 20837 - DNA, 1599 bp, Artificial Sequence
  Description of Artificial Sequence: Synthetic coding sequence
atggccgttgagtcacaaggcggtaggcctctggtgcttgggcttctactctgcgtcctcgggccagtggtgagtcacgccgggaaaatcttgcttataccggtagacggtagccactggctgtctatgttaggcgcgatccagcagctgcaacagcgggggcatgagatcgtggtgctggcgcccgacgcctccctatatataagggacggagcattctacacacttaaaacgtaccccgtcccatttcagagagaggacgtcaaggaatccttcgtaagcctgggtcacaacgtcttcgaaaatgacagctttcttcaacgtgttattaaaacatacaaaaagattaagaaggattctgccatgttgctgagcgggtgttcccacttgctgcacaataaagaattgatggcgagcctcgcagagtcctccttcgatgtgatgttgaccgacccttttttgccatgctcgcccattgtggcccagtatctttccctccccaccgttttttttctgcacgccctaccctgttccctggaattcgaggcaactcagtgccccaatccctttagttacgtgccacggcctctgtcaagccactccgaccacatgactttcctgcagcgggtgaagaacatgctgatcgcatttagtcaaaatttcttgtgtgacgtcgtttactcaccctatgccacgctcgcctccgaattcctccagagggaggtcacggtccaggatctcctgtcttcagcttccgtgtggttgtttcgttcagacttcgtcaaggattacccccgccctatcatgccaaatatggtgttcgtgggcgggattaactgtctgcaccagaatccgttaagccaggagtttgaggcttacattaatgcgagcggagaacacgggattgtcgtgttctcactgggttctatggtgtcagaaattccggagaagaaggctatggcaattgccgatgcactgggcaagattccccagactgtgttgtggcggtacacgggcactaggcccagcaatctggctaataataccatcctagttaagtggctgcctcagaacgacctgctgggccacccaatgaccagggcattcatcacccatgctgggtcccatggggtgtacgaaagtatatgtaacggggtgcctatggtgatgatgccactcttcggagatcagatggataacgctaaacgtatggaaacaaagggagccggggtgacactcaacgtgttggaaatgacctccgaggacctggaaaacgctctgaaagcagtgattaacgacaaaagctataaggaaaatatcatgagactgagcagtcttcataaagacagaccagtggagcccctagacctggcagttttttgggtggaattcgtaatgcgacacaaaggagcccctcatctaaggcccgcagcccacgatctcacttggtaccagtatcactcactggatgttattgggttcctcctggccgtggtgttgaccgtggctttcattacattcaaatgctgtgcctacggctacagaaaatgtctgggcaaaaagggacgggtgaaaaaagcacataaatctaaaactcat

SEQ ID NO: 20838 - DNA, 1599 bp, Artificial Sequence
  Description of Artificial Sequence: Synthetic coding sequence
atggcagtggagagccaagggggacgcccacttgtcttgggcctcctgctgtgtgtgctgggcccggtggtaagccacgccggaaagatcctgcttatccctgtggacgggagtcactggctgagcatgttgggggctattcagcagcttcagcagcgcggtcacgagattgttgtattggctcctgatgctagcctgtacataagagacggtgccttttacacgttgaaaacttacccggtcccattccagcgcgaggacgtgaaggagagcttcgtctccttgggccataatgttttcgaaaatgattcttttctgcaaagggtcatcaagacgtataagaaaatcaagaaggacagcgctatgcttctatccggctgtagccatctgctgcataacaaggagcttatggcgagcttggctgagagcagcttcgacgtgatgcttaccgaccctttcctgccgtgcagcccgatcgtcgcgcaatacctgagcctcccaaccgtgttctttcttcatgcactcccgtgttccctcgaatttgaggcaacacagtgcccaaaccctttttcctacgttccgcgccctttgagctcccatagcgaccacatgactttcctgcagagagttaagaacatgctgatcgccttcagccagaactttctgtgcgacgtcgtgtactcaccatacgcaaccttggcgagcgaattcttgcagcgcgaggttactgtgcaagatctgttgagctccgcgagcgtgtggctttttcgctccgacttcgtaaaggactatccaagaccgattatgccgaacatggtcttcgtcggaggtattaactgtcttcaccagaaccctttgtcccaggaatttgaggcttacatcaatgcttccggcgagcacggtatagtcgtgtttagcctgggcagtatggtcagcgaaatccctgagaaaaaggctatggccattgcagatgcattgggtaagatcccgcagaccgtgctgtggcgatatactggcacccgtccgagcaacctggcaaataataccatactggtgaaatggcttccgcaaaatgatctccttggccacccaatgactcgtgcatttatcacgcacgccgggagccacggcgtctacgagtccatatgtaacggcgtccctatggtgatgatgccattatttggcgaccagatggacaacgccaaacggatggagacgaagggtgccggagtcacgctcaatgtcctggaaatgacttctgaggatctggagaacgcactgaaggccgtcattaatgataagtcctataaggagaacataatgcgcctgagtagccttcacaaagaccgccctgtggagccgctcgatctggccgtcttttgggtggagtttgtgatgcgtcacaagggagcaccacatttgcggccagcggctcatgacttgacgtggtatcagtaccattcattggatgttatcggttttcttctggcagtcgtcctgaccgtggcttttatcactttcaagtgctgcgcctatggatatcgtaaatgtctgggcaagaagggtcgtgttaagaaagcgcacaagtccaagacccat

SEQ ID NO: 20839 - DNA, 1599 bp, Artificial Sequence
  Description of Artificial Sequence: Synthetic coding sequence
atggcagtcgaatcgcagggaggtcggccgctggtcctgggcctccttctctgtgtcctcggaccggtggtgtcgcatgcgggcaaaattctgttgatcccggtcgatggctcgcattggctctccatgcttggagcaatccagcaactgcaacagcgcggccatgagatcgtggtgctcgctcccgatgcctcgctttacatccgcgacggtgcgttttacaccctgaaaacctaccctgtcccgttccagcgcgaagatgtaaaggagtcgttcgtgtcgctcgggcacaatgtgttcgagaacgactcattcctgcaaagagtgattaagacctacaagaaaatcaaaaaagactccgcaatgctgctgtcgggatgctcccatctgctccataacaaggaactcatggcctcactcgccgaatccagcttcgacgtgatgctgacggatccattcctgccttgttcaccgatcgtggcgcagtacttgtcgctgccgacggtcttttttctgcacgctctgccctgtagtcttgagttcgaagcaactcagtgcccaaatccgttttcttacgtgccgcggcctctgtcctcacacagcgaccatatgacgttcctgcaacgggtgaagaacatgttgatcgctttttcgcagaacttcctgtgcgacgtggtctattcgccatacgcaaccctggcatcggaattccttcaacgcgaagtgactgtccaggacctgctgtcctcggcatccgtgtggctgttccgctccgacttcgtgaaggactatccgcgaccgatcatgccaaacatggtgttcgtaggaggcattaactgcttgcaccaaaatcctctttcccaagagttcgaggcgtacatcaacgccagcggagaacacggcatcgtggtcttttcccttggcagcatggtttcggaaattccggagaagaaggcgatggcgatcgctgatgcactcgggaagatcccacagaccgttctgtggcggtacactggaaccaggccctcaaacttggcgaataacaccatcctggttaagtggcttccacagaacgatctgctggggcatccaatgaccagggcattcatcacccacgcgggatcacacggcgtgtacgagtcgatatgtaatggtgtgccgatggtgatgatgccactgttcggggatcaaatggacaatgctaagagaatggagacgaagggcgccggcgtcaccctgaacgtcctggagatgaccagcgaagatctggaaaacgccttgaaagcagtgatcaacgataagtcctacaaggagaacatcatgagactgtcctcgttgcacaaggaccgccccgtggaaccgctggatttggcagtgttctgggtggaatttgtgatgcgccacaagggcgcccctcaccttcggccggcggcgcatgatcttacgtggtaccagtaccattcactggacgtcatcggattccttctggcggtcgtgctgaccgtcgcgttcatcaccttcaagtgctgcgcctacgggtatcggaagtgtctcggaaaaaagggaagagtgaaaaaggcccataagtcaaagacccat

SEQ ID NO: 20840 - DNA, 1599 bp, Artificial Sequence
  Description of Artificial Sequence: Synthetic coding sequence
atggccgtagagtcacaaggagggaggcctttggtgctaggtcttttgttatgcgtcttagggccggtggtgtctcatgcaggaaaaattcttctcattccggttgacggcagccattggctttcaatgttaggcgctatccaacaacttcaacaaaggggccatgaaattgtcgtcttagcaccggatgcaagtctctacattcgcgatggagcgttttatactttgaaaacatacccagtgccgtttcaaagagaggacgttaaagaatcctttgtctcattagggcataatgttttcgaaaacgatagctttcttcaaagggtaatcaaaacgtataagaaaatcaagaaagactcagcgatgctgctctctggatgtagccatttactgcataacaaagaactgatggcaagtttagcagaatcctcgtttgatgtcatgctgacagaccctttcctcccttgctcccctattgtcgcacagtatctcagccttccgacagtgttctttttgcatgctctcccttgctccctggaatttgaagctacgcagtgccctaatcccttcagctatgtgccgcgtccactgtcaagtcacagcgatcacatgactttcttgcagcgcgtcaaaaacatgctgattgctttctctcaaaattttttatgcgatgtcgtatattcaccctacgcgacgcttgcatctgaattccttcagcgcgaggtgaccgtccaggatttgctttcctccgcgtcagtctggttatttagaagtgatttcgttaaagattatccgcggccgattatgcccaatatggtctttgtgggcggaattaattgtttacatcaaaacccattaagccaggaatttgaagcgtatattaacgcctcgggcgaacatggtatagtagttttttcactgggatccatggtgagcgaaattccggagaaaaaggctatggccattgccgatgctttaggaaaaatcccgcagacagtattatggcgctacacgggaacgcgaccgtctaatttagcaaacaatacaatcttggtcaaatggttacctcagaatgaccttttgggacatccaatgactcgtgcctttattacccacgccgggtcccatggcgtttatgagtctatttgcaatggagtgccgatggtaatgatgccgttgtttggggaccaaatggataacgcaaagcgtatggaaacgaaaggcgcaggggtcacattaaatgtccttgaaatgacaagcgaggatcttgaaaatgcccttaaagcagttattaacgacaaatcctataaagaaaatattatgagactttcttcattgcataaggaccggcctgtcgaaccactcgatctcgctgtgttttgggtcgaatttgtaatgcgccataaaggtgcgccgcatctcagaccggctgcacatgatcttacttggtaccagtatcactctctcgatgttattggctttttattagctgtggtacttacagttgcttttatcacgttcaaatgctgcgcgtatgggtatagaaaatgcttaggcaaaaaaggacgagtcaagaaagcccataagtccaagacgcat

SEQ ID NO: 20841 - DNA, 1599 bp, Artificial Sequence; identical to SEQ ID NO: 20777
  Description of Artificial Sequence: Synthetic coding sequence

SEQ ID NO: 20842 - DNA, 1599 bp, Artificial Sequence
  Description of Artificial Sequence: Synthetic coding sequence
atggcggtagaatctcagggaggccgccccctggttctcggactcttgttgtgtgtactcggtccggttgtgtcccatgccggaaagatattgcttattcccgtggacggctcccattggttgagcatgttgggagccatacaacaattgcagcagcgcggccacgagatcgtggtcttggcacccgacgcctcactctacataagagacggtgccttctatacactgaagacctaccccgttccgttccagagggaggacgtcaaagagtcttttgtgtcactgggacacaatgtattcgagaatgattcctttcttcagcgcgtaatcaagacatataaaaagattaagaaggacagcgctatgctgttgtccggatgctcccatcttctgcacaataaggagctgatggcgtctctcgctgagagctctttcgacgtgatgctgactgaccctttcttgccgtgctctcccatcgtggctcaatacctcagtctccccaccgtcttcttcctgcacgccctgccatgctctctggagttcgaggccacacagtgccccaaccctttctcctacgtgccgcgccctctctcctctcattcagaccatatgacattcctgcaaagagtgaagaatatgctcatcgctttcagccaaaacttcttgtgcgacgtcgtgtattccccttacgctactttggcgtcagagtttctgcaaagggaagtaacagtgcaggatcttttgtcctctgcgagtgtatggctgttcaggtccgattttgtgaaggactatccacgcccgattatgcccaatatggtattcgtcggcggaataaactgtctccaccaaaacccactcagccaagaatttgaggcctacatcaacgcttccggagagcacggaattgtggtcttctccttgggaagcatggtctccgaaattccagaaaaaaaagcaatggcaatagccgatgcgcttggtaagatcccacagacagttctttggcgctatacaggcacccgccccagcaacttggccaacaatacgatcctcgtcaagtggttgccccagaacgaccttttgggacatcctatgaccagagcctttatcactcatgctggtagccacggagtatatgagtccatctgcaatggtgtcccaatggtcatgatgccgctcttcggtgatcaaatggataatgcgaaacgcatggaaacaaagggagccggcgttacactcaacgtcctggaaatgacttctgaggatcttgaaaacgccctgaaggccgtgatcaacgataagagttacaaagaaaacataatgagattgagttccttgcacaaagataggcccgtcgagccactggatctcgccgtcttctgggttgaattcgtgatgcgccacaaaggagcccctcatctccgccctgccgcacacgacctgacatggtaccaatatcactcacttgacgtgatcggtttcctgcttgccgtggtcctcaccgtggccttcattacgtttaagtgctgtgcttacggctataggaagtgtttgggaaagaaaggtagggtcaagaaagcacacaagagtaagacccat

SEQ ID NO: 20843 - DNA, 1599 bp, Artificial Sequence
  Description of Artificial Sequence: Synthetic coding sequence
atggcagtggaatctcagggtggaaggccgctggtccttggcctcctgttgtgtgtgctgggccccgtggtgtcccacgcagggaaaatcctcctgatccccgtagacggaagccactggctgtccatgctgggagctatccagcaattgcagcagagaggccatgagatcgtcgtcttggcacctgatgcgagtttgtacatccgcgatggggccttctatacactgaagacatatccagtaccctttcagcgagaggacgtcaaggagagctttgtgagtctagggcacaatgtgtttgaaaacgattccttcctccagcgagtgataaagacgtataagaaaatcaaaaaggactctgccatgctactctctgggtgctcccacctcttacacaataaggaactaatggcttccttagctgagagcagcttcgacgttatgctcacggatccttttttgccgtgttcccccatcgtggcccagtatttgagtctgcctactgtgtttttcctccatgctcttccttgctccctggaatttgaggcaacccagtgccctaaccccttttcatatgtgcctagaccactatcatctcacagcgatcatatgacctttctgcagagggtcaagaatatgcttatcgccttttctcagaacttcctctgcgatgtggtgtattccccatacgcaaccctggcctcagaattcttacagcgggaagtgactgtccaggatctgttgagctccgcctccgtctggctcttccgttctgattttgtcaaagactatccacggccgattatgcccaacatggtgttcgtaggcggtatcaactgccttcaccagaatccactgtcacaggagttcgaggcctacatcaatgcgagcggcgaacacggtatcgtcgtattttctttgggatctatggtctctgaaataccagaaaagaaggccatggctattgctgatgcccttggaaagattccgcagacggtgctatggcgatacactggtacgcgcccttcaaacctcgctaacaatactatcctcgttaaatggctaccgcaaaacgacttgctcggtcaccctatgaccagagctttcattacgcacgcaggaagtcacggcgtttatgagtctatctgtaacggggtacccatggtcatgatgcctctttttggtgaccagatggacaatgcaaagagaatggagaccaagggggcaggcgtgacgctaaatgttctggagatgaccagcgaagacctggaaaacgcactgaaagctgttatcaacgataaaagttacaaagagaatatcatgcgcttgagcagtctgcacaaggatcgacccgtggaaccgcttgatctcgctgtattctgggtggagtttgtcatgaggcataaaggagcccctcacctgcgaccagcagcacacgatctgacttggtatcagtatcactctttagatgtgatcggttttctgctggccgtagtgctgaccgtcgcttttataaccttcaagtgttgcgcatacggatatcgaaaatgtttgggtaaaaagggacgggtgaagaaggctcataaatctaagacgcac

SEQ ID NO: 20844 - DNA, 1599 bp, Artificial Sequence
  Description of Artificial Sequence: Synthetic coding sequence
atggccgtggagtcacagggaggacggccgctcgtgctgggcctgctgctctgtgtgctggggccagtagtctcccacgctggaaaaatcctgcttatcccggtggacggcagccactggctgtcgatgctgggcgcgattcagcaactgcaacaacgtgggcacgagatcgtggtactcgccccagatgcctcactctacatccgcgatggtgccttttacacgctgaaaacttacccggtgcccttccagcgggaagatgtcaaagaatcgttcgtgtccctgggacacaacgtttttgaaaatgactcattccttcagcgggttatcaagacctataagaagataaagaaggactcggcaatgctcctgtctggatgctcgcacctgcttcacaacaaggaactcatggcctcgctggcagaaagcagctttgacgtgatgctgactgacccgttcctcccgtgctcgccgatcgtggcccagtacctctcgcttccgactgtgttcttcttgcatgccctcccttgctcactggagttcgaggccacccaatgcccgaaccccttctcctacgttccccgccccctttcctcgcattcggatcatatgaccttcctgcaacgtgtgaagaatatgctgattgcgttttcccagaatttcctgtgcgacgtggtctacagtccgtacgcgaccttggcgtccgaatttctgcagcgcgaggtgacggtgcaagatcttttgagctcagcttcagtctggttgttcaggtctgactttgtgaaggactacccgaggccgatcatgccaaacatggtgtttgtcgggggcatcaattgtctccaccaaaacccgctgtcccaggaattcgaggcttacatcaacgcctcgggcgagcatggaatcgtggtcttttcattggggagcatggtttccgaaatccccgaaaagaaagcgatggcgatcgctgacgcgctgggaaagattcctcagaccgtgctttggcgctacactgggactagaccttcgaatctggctaacaacacgattcttgtgaagtggctgcctcagaacgatctgctgggccatccaatgaccagagctttcatcacccatgcgggttcacatggagtgtacgaatcgatctgcaacggggtcccaatggtcatgatgccattgttcggcgaccagatggataacgcaaaacggatggagactaaaggagcaggagtgaccttgaacgtcctggaaatgactagcgaagatttggagaatgccctgaaagcagtcatcaatgataagagctacaaggagaatatcatgcgcctctcatccctgcacaaggaccgtcctgtcgagcccctggatctcgcagtgttctgggtcgaattcgtgatgcggcacaaaggcgccccacacctgcggcctgccgcacacgacctgacttggtaccagtaccactcactcgacgtaatcggattcctgctcgccgtcgtgttgaccgtggccttcatcaccttcaaatgttgcgcttatggatacagaaaatgcttgggaaaaaagggtcgagtgaagaaggcacataagagcaagacccac

SEQ ID NO: 20845 - DNA, 1599 bp, Artificial Sequence
  Description of Artificial Sequence: Synthetic coding sequence
atggcggtagaatcgcaaggtggtcgtccgctagttctaggtctattattatgtgtattaggtccggtagtatcgcatgcgggtaaaatattactaataccggtagatggttcgcattggctatcgatgctaggtgcgatacaacaattacaacaacgtggtcatgaaatagtagtattagcgccggatgcgtcgttatatatacgagatggtgcgttttatacgctaaaaacgtatccggttccgtttcaacgtgaagatgtaaaagaatcgtttgtttcgctaggtcataatgtatttgaaaatgattcgtttttacaacgtgtaataaaaacgtataaaaaaataaaaaaagattcggcgatgttattatcgggttgttcgcatttactacataataaagaactaatggcgtcgttagcggaatcgtcgtttgatgtaatgttaacggatccgtttttaccgtgttcgccgatagttgcgcaatatctatcgttaccgacggtattttttctacatgcgttaccgtgttcgctagaatttgaagcgacgcaatgtccgaatccgttttcgtatgtaccgcgtccgttatcgtcgcattcggatcatatgacgtttttacaacgtgtaaaaaatatgctaatagcgttttcgcaaaattttctatgtgatgtagtttattcgccgtatgcgacgttagcgtcggaatttttacaacgagaagtaacggtacaagatctactatcgtcggcgtcggtatggttatttcgatcggattttgtaaaagattatccgcgtccgataatgccgaatatggtttttgtaggtggtataaattgtttacatcaaaatccgttatcgcaagaatttgaagcgtatataaatgcgtcgggtgaacatggtatagtagtattttcgctaggttcgatggtttcggaaataccggaaaaaaaagcgatggcgatagcggatgcgttaggtaaaataccgcaaacggttttatggcgatatacgggtacgcgtccgtcgaatttagcgaataatacgatattagtaaaatggttaccgcaaaatgatctactaggtcatccgatgacgcgtgcgtttataacgcatgcgggttcgcatggtgtttatgaatcgatatgtaatggtgttccgatggtaatgatgccgctatttggtgatcaaatggataatgcgaaacgtatggaaacgaaaggtgcgggtgtaacgttaaatgtattagaaatgacgtcggaagatttagaaaatgcgctaaaagcggttataaatgataaatcgtataaagaaaatataatgcgtttatcgtcgttacataaagatcgtccggtagaaccgttagatttagcggttttttgggtagaatttgttatgcgacataaaggtgcgccgcatctacgtccggcggcgcatgatctaacgtggtatcaatatcattcgttagatgtaataggttttttattagcggttgttctaacggtagcgtttataacgtttaaatgttgtgcgtatggttatcgaaaatgtttaggtaaaaaaggtcgtgtaaaaaaagcgcataaatcgaaaacgcat

SEQ ID NO: 20846 - DNA, 573 bp, Artificial Sequence
  Description of Artificial Sequence: Synthetic coding sequence
atgaatttcctgttgtcttgggttcattggagtctggctttacttctatatctgcatcacgccaagtggagccaggccgctccgatggccgagggcggagggcagaaccatcatgaggtagtgaaattcatggacgtgtatcaaaggtcttactgtcatccaatcgagactctggtggacatatttcaggagtacccagacgagatcgaatatattttcaagccaagctgcgttccactaatgagatgcgggggctgctgtaacgatgaaggactggagtgtgtgccgacggaggaaagtaacatcacaatgcagattatgaggatcaagccacaccagggccagcacatcggagagatgagctttctccagcataacaaatgtgaatgtagaccaaaaaaggaccgtgcccgccaggagaatccatgcgggccgtgttccgagcggcggaagcatctattcgtccaggacccacagacgtgcaaatgcagttgcaaaaacaccgactctcgttgtaaggccagacagttggagcttaacgagagaacttgtagatgcgataagccgcgcaga

SEQ ID NO: 20847 - DNA, 573 bp, Artificial Sequence
  Description of Artificial Sequence: Synthetic coding sequence
atgaacttccttctgtcctgggtccattggagcctcgctctcctgctgtacctccaccacgcaaagtggtcccaagccgcgcccatggcagaagggggaggacagaaccatcacgaggtcgtgaaattcatggatgtgtaccagcggtcctattgccaccccatcgagaccctggtggacatcttccaggagtaccctgatgaaatagagtacatcttcaaaccttcctgcgttcctctgatgagatgtggtggctgttgtaatgacgagggactcgagtgtgtgcccacggaagagtccaacatcactatgcagatcatgcgcatcaaaccccaccaagggcaacacatcggggagatgtcattcctccaacacaataagtgcgagtgccgcccaaagaaggatagggcgagacaagagaatccttgtggaccctgcagtgaaagaagaaaacacctcttcgtccaagacccgcagacctgcaagtgctcatgcaaaaataccgactcccggtgtaaggctcggcagctggagcttaacgaacgaacctgtcgttgcgacaaaccgcggcga

SEQ ID NO: 20848 - DNA, 573 bp, Artificial Sequence
  Description of Artificial Sequence: Synthetic coding sequence
atgaactttcttttgtcttgggtccattggtcgttggctctgttgctctatctccaccacgccaagtggagccaggctgctcctatggccgagggtggaggacaaaatcatcacgaggtcgtcaagttcatggatgtctaccagaggtcctattgccaccccatcgagaccctggtcgatatttttcaggagtatccggatgagatcgagtacattttcaaaccttcttgcgtcccccttatgcgttgtggcgggtgttgcaatgacgaggggctcgaatgcgtccctaccgaagagtctaacatcaccatgcaaatcatgcgtatcaaaccccaccagggtcagcacatcggtgaaatgtcctttctccagcataacaaatgcgaatgccgaccaaaaaaagaccgtgctcgtcaggagaacccatgcgggccttgctccgagcgtcggaagcatttgttcgtccaggacccacagacctgtaagtgctcttgtaagaataccgattcccgctgcaaagccagacagctggaattgaatgagcgcacctgccgctgtgataagcctcgtcgc

SEQ ID NO: 20849 - DNA, 573 bp, Artificial Sequence
  Description of Artificial Sequence: Synthetic coding sequence
atgaactttctcctgtcttgggtgcactggagcctcgccctactgctgtacttgcaccatgcaaaatggagccaagctgctccaatggccgaaggagggggccagaaccaccatgaagttgtaaaattcatggacgtgtaccagcgctcctactgtcacccaatcgagacactggtggatatcttccaggaataccccgacgagatcgaatatatctttaagccttcctgtgtgcccttgatgagatgcggcgggtgttgcaacgatgagggcttagagtgcgttccaaccgaggagagcaacataaccatgcagataatgcgaataaagccccaccagggccagcatatcggggaaatgagcttcctgcaacacaacaagtgtgagtgtcgcccaaagaaagacagagcacggcaagaaaatccttgcggcccctgctctgaacgtagaaagcacctgttcgtgcaggatccacaaacctgtaagtgcagctgtaagaacaccgattcccgatgtaaggcccgccagctggaactgaatgagcggacctgtcgatgcgacaaacctagacgt

SEQ ID NO: 20850 - DNA, 573 bp, Artificial Sequence
  Description of Artificial Sequence: Synthetic coding sequence
atgaatttcctgctttcttgggttcactggtcacttgcattgcttttatatctccatcatgcaaagtggtcccaagctgcaccaatggccgaaggaggggggcaaaatcaccacgaagtcgttaaattcatggacgtctatcaaagatcttattgtcacccaattgagactttggttgatatatttcaggagtatccagatgaaatcgagtacatcttcaagccttcgtgcgtaccgcttatgagatgtggaggatgctgcaatgatgaaggattggaatgcgtcccgactgaagaatccaatattactatgcaaataatgcgaatcaaaccacatcagggccagcacattggcgagatgagtttcttgcaacataataagtgcgaatgtagacctaaaaaagaccgcgcacggcaagaaaatccatgtggtccatgtagcgagcgacgaaagcacctctttgtgcaagatccacaaacttgtaaatgctcatgcaaaaataccgatagccgatgtaaagctcgacagttggaacttaacgaacgaacatgtagatgtgacaagccacgacgg

SEQ ID NO: 20851 - DNA, 573 bp, Artificial Sequence
  Description of Artificial Sequence: Synthetic coding sequence
atgaacttcctgctctcatgggtccattggagcctggctcttcttctctacctgcatcacgccaaatggtcgcaggctgcgccaatggcagagggaggcggacagaaccaccatgaggtggtgaagtttatggacgtgtaccagcggagctactgccacccgatcgaaaccctcgtggacatcttccaggagtacccggacgaaatcgaatacattttcaagccatcgtgtgtgccgctgatgcgctgtggaggatgctgcaatgatgaaggtttggaatgtgtcccgactgaggaatcgaacatcactatgcagatcatgagaatcaaaccccaccaaggacaacacatcggtgagatgtcgtttctgcaacacaacaaatgcgaatgcagaccaaagaaggaccgggctagacaagaaaacccgtgtggaccatgctcagagaggaggaagcatctctttgtgcaggatccgcagacttgtaagtgttcgtgtaagaacaccgactcccgctgcaaagccagacagctcgaactgaacgagagaacttgtcgctgcgataaacccagacgg

SEQ ID NO: 20852 - DNA, 573 bp, Artificial Sequence
  Description of Artificial Sequence: Synthetic coding sequence
atgaattttttattatcgtgggttcattggtcgttagcgttactattatatctacatcatgcgaaatggtcgcaagcggcgccgatggcggaaggtggtggtcaaaatcatcatgaagtagtaaaatttatggatgtatatcaacgttcgtattgtcatccgatagaaacgttagttgatatatttcaagaatatccggatgaaatagaatatatatttaaaccgtcgtgtgtaccgctaatgcgttgtggtggttgttgtaatgatgaaggtctagaatgtgttccgacggaagaatcgaatataacgatgcaaataatgcgaataaaaccgcatcaaggtcaacatataggtgaaatgtcgtttctacaacataataaatgtgaatgtcgtccgaaaaaagatcgtgcgcgtcaagaaaatccgtgtggtccgtgttcggaacgacgtaaacatttatttgtacaagatccgcaaacgtgtaaatgttcgtgtaaaaatacggattcgcgatgtaaagcgcgacaattagaattaaatgaacgtacgtgtcgatgtgataaaccgcgacga

SEQ ID NO: 20853 - DNA, 573 bp, Artificial Sequence
  Description of Artificial Sequence: Synthetic coding sequence
atgaacttcctgctctcgtgggtgcattggtcactggcactcttgctctacctgcatcacgctaagtggtcgcaggccgcccccatggccgaaggcggaggacagaatcatcacgaggtcgtcaagttcatggacgtgtaccagcggtcctactgtcaccctattgaaacccttgtcgatatcttccaggagtaccctgatgaaatcgagtacattttcaagccatcgtgcgtgccgttgatgcggtgcggtggatgctgcaatgacgagggactcgagtgcgtcccaactgaagaaagcaacatcaccatgcaaatcatgcggatcaagccacaccagggccaacacatcggtgaaatgtccttcctccaacacaataagtgcgaatgtagaccgaaaaaggaccgcgcacgtcaagagaacccttgcggtccgtgcagcgaaagacgaaagcatctgttcgtccaagacccgcagacctgtaagtgctcctgcaagaacactgactcaagatgcaaggcccggcagctcgaactgaacgaacgcacttgcaggtgtgataagcctagacgg

SEQ ID NO: 20854 - DNA, 573 bp, Artificial Sequence
  Description of Artificial Sequence: Synthetic coding sequence
atgaacttcctgctgtcctgggtgcattggtcactggccttgttgctttacctccaccatgccaaatggtcccaggcggccccaatggcggagggaggaggtcaaaaccatcatgaagtcgtgaagtttatggacgtttaccagcggtcctactgtcaccctatcgaaactctcgtggacatctttcaggagtacccggacgaaatcgagtatatctttaaaccgtcgtgcgtgccgctgatgcggtgcggaggatgctgcaacgatgaaggcctggagtgcgtcccgaccgaggaatcaaacatcacgatgcagatcatgcgcattaaaccgcaccagggacagcacatcggcgaaatgtcatttctgcaacataacaaatgtgaatgccggccgaagaaggaccgcgcccggcaggaaaatccgtgtgggccctgttcggagcgccgcaaacatcttttcgtgcaagatccgcagacctgcaagtgttcatgcaagaacactgattcaagatgtaaggcacgccagctggaacttaacgaacgcacctgccgctgcgacaagccgaggaga

SEQ ID NO: 20855 - DNA, 573 bp, Artificial Sequence
  Description of Artificial Sequence: Synthetic coding sequence
atgaatttccttctgagctgggtacactggtcactcgcacttctgctctatctgcaccacgccaaatggtcacaagccgcaccaatggccgagggcggtggtcaaaatcatcacgaggtggtgaagtttatggatgtgtaccagagaagctattgtcacccaattgaaactttggtggatatctttcaagagtaccccgacgaaatagagtacatcttcaaaccatcctgcgtgccacttatgcgctgcggcggttgttgcaacgacgagggtctggagtgcgtccccactgaagaatcaaacatcacaatgcagattatgcgtatcaaaccacaccagggtcaacacatcggcgagatgagctttcttcagcacaataagtgtgagtgcaggcctaagaaagaccgcgcccgccaggagaatccctgcggtccttgtagtgagaggcgcaagcatctgtttgttcaggacccccaaacttgtaagtgttcctgtaaaaacacagattctcgttgcaaggctcgccagctggagcttaacgaacgtacctgccgttgcgacaagccaaggcgc

SEQ ID NO: 20856 - DNA, 573 bp, Artificial Sequence
  Description of Artificial Sequence: Synthetic coding sequence
atgaacttcctcttgtcgtgggtgcactggtcactggccctgctcctctatctgcatcacgccaagtggagccaagctgcgccgatggccgaaggaggaggacaaaatcaccatgaggtcgtgaagttcatggacgtgtaccagcgctcatactgtcacccgattgaaaccctcgtggacattttccaggaatacccagacgaaatcgaatacatcttcaagcctagttgcgtgccgttgatgcgctgtgggggctgctgtaacgacgagggactggaatgcgtgcctaccgaagagagcaatatcactatgcaaatcatgagaatcaagccccaccagggccaacatattggagaaatgtctttcctgcaacacaacaaatgcgaatgcagaccaaagaaagatcgcgctagacaagaaaatccatgcggcccttgctccgagagaaggaaacatcttttcgtccaggacccgcaaacctgcaagtgttcgtgtaagaacactgactcaagatgcaaggcaagacagctcgaactgaacgagagaacctgccggtgcgacaagccgcgccgc

SEQ ID NO: 20857 - DNA, 573 bp, Artificial Sequence
  Description of Artificial Sequence: Synthetic coding sequence
atgaactttctgctttcttgggtgcattggtcgctggccctgttgctctacctgcatcacgccaaatggtcccaggccgcaccaatggcggagggaggaggccagaaccatcatgaggtggtcaagttcatggacgtgtaccaaaggagctactgccaccctatcgaaacgctcgtcgatatcttccaagaatatccggacgaaatcgaatacattttcaaaccgtcatgcgtgccgctgatgcggtgcggtggatgctgcaatgacgaggggttggagtgcgtgcctactgaagaatccaacatcaccatgcagattatgcgcattaagccacaccaaggacaacacatcggagagatgtcgttcctccagcacaacaaatgcgagtgccgaccgaagaaggacagagctcggcaagaaaatccctgtggcccgtgctccgaacggcgcaagcacttgttcgtgcaggatcctcagacttgcaaatgctcatgcaagaatacggatagccgttgtaaagcacggcaactggaattgaacgagcgcacctgtcgttgtgacaagcccagacgc

SEQ ID NO: 20858 - DNA, 573 bp, Artificial Sequence
  Description of Artificial Sequence: Synthetic coding sequence
atgaatttcctgctcagttgggtgcactggagcctagccttgttgctgtatttgcaccacgccaaatggtctcaggcggcacccatggctgaagggggtggacagaatcaccatgaagtggtgaaattcatggacgtgtaccaacgatcttattgccacccgattgagacactggtagatattttccaggagtaccccgatgagattgagtacatcttcaaaccttcctgtgtacctctgatgcgctgtggggggtgctgtaatgacgagggactcgagtgtgtaccaacagaggagagcaatatcaccatgcagatcatgcggataaagcctcatcagggccagcatatcggcgaaatgagtttccttcaacacaataagtgtgagtgccgaccgaaaaaggatcgcgcccgccaggaaaatccgtgcggtccttgtagtgaacggcgcaaacatctcttcgtgcaggatccccagacatgcaaatgcagctgcaagaatacggactctcggtgtaaggcccgccagctggagctgaacgagaggacatgcagatgtgacaaacctagacga

SEQ ID NO: 20859 - DNA, 573 bp, Artificial Sequence
  Description of Artificial Sequence: Synthetic coding sequence
atgaattttctcctgtcatgggtccattggtcgctggcacttcttctgtaccttcaccatgcgaaatggtcgcaagcagcgcctatggccgaaggcgggggtcaaaaccatcatgaagtggtcaagtttatggatgtgtaccagaggagctactgtcaccctattgagactcttgtcgacatttttcaggaatatccagatgaaatcgaatacatctttaagccgtcgtgtgttcccctcatgcgctgcggtgggtgctgtaacgatgaaggtctggaatgcgtgcctactgaagaaagcaatatcacgatgcagattatgagaattaagcctcatcaaggacaacatattggagaaatgtcgtttctgcagcataacaagtgcgaatgcaggccaaagaaagatagggcacgtcaggagaacccttgcggaccttgtagcgagagacgaaaacatctctttgttcaagaccctcaaacttgcaagtgtagctgcaagaacacggattctcgatgtaaggcacggcagttggaactgaacgaaagaacctgtcgatgtgacaaacccagacga

SEQ ID NO: 20860 - DNA, 573 bp, Artificial Sequence
  Description of Artificial Sequence: Synthetic coding sequence
atgaacttcctcctgtcctgggtccattggtcactcgcactgctcctttacctgcatcacgccaaatggtcgcaggcagcccctatggctgaaggcggaggccagaatcatcatgaagttgtcaaattcatggatgtgtaccaacgctcgtactgtcacccgatcgaaaccctggtggacatcttccaggaatatcctgacgagatcgaatacatctttaagccgagctgcgtgcccctcatgaggtgcggaggatgctgcaatgatgagggcctggagtgtgtgccgaccgaagagagcaacattactatgcaaatcatgcggatcaagcctcaccagggacagcacatcggagagatgtccttcttgcaacacaacaagtgcgaatgccggccgaaaaaggatcgggcgcggcaagaaaatccgtgcggtccatgctcagaacgccgtaagcacttgtttgtacaggacccgcagacgtgcaagtgctcctgtaaaaacacggactcgcgctgcaaggctcgccaactcgagctcaacgaaagaacctgtcggtgcgacaagcctagacgt

SEQ ID NO: 20861 - DNA, 573 bp, Artificial Sequence
  Description of Artificial Sequence: Synthetic coding sequence
atgaactttctgttgagctgggttcactggtctcttgcattgctgctttatctccaccatgcgaagtggtcgcaggccgcccctatggcagaaggaggaggccagaatcaccacgaggtggtcaaattcatggatgtatatcagagatcctattgccacccgattgagacgctggtcgacatatttcaggagtatcccgatgaaatcgagtacatatttaaacccagctgtgttcctctaatgcgttgcgggggatgttgtaacgatgaggggttggagtgtgtgcctacggaggagagtaatatcaccatgcagattatgcgaatcaagccgcatcaggggcaacacataggggaaatgtcatttctgcaacacaacaagtgcgaatgtagaccaaaaaaagaccgcgccagacaggaaaacccatgtggtccctgctcagagcgcagaaagcacctgttcgtgcaggatcctcagacgtgcaagtgttcttgcaagaatacggactctcggtgcaaggcccggcaactcgagttgaacgaaagaacctgtagatgcgacaagccgcggaga

SEQ ID NO: 20862 - DNA, 573 bp, Artificial Sequence
  Description of Artificial Sequence: Synthetic coding sequence
atgaattttctgctgtcatgggtgcattggtcgttagctcttcttctctacctccaccacgctaagtggagccaggcagctcccatggcagagggaggtggccagaaccatcacgaagtggtgaaatttatggacgtataccagagaagctattgtcatccaattgagacccttgtggatatttttcaggaatatcccgacgaaatagaatacatcttcaaaccatcatgtgtgcctctgatgcgatgtggaggctgctgtaatgacgaaggcctggagtgcgtgcccacagaggaatcaaatattacaatgcaaatcatgaggatcaaacctcaccagggtcagcatattggagaaatgagcttcctccaacataataagtgtgagtgtcggccgaagaaagatcgcgcccgccaggagaatccttgcggaccatgctcagaacgccggaaacacctcttcgtccaagatcctcaaacctgtaaatgttcttgcaagaataccgactcccgctgcaaagcccgacagctggagttgaatgagagaacctgccgttgtgataagccaagacgc

SEQ ID NO: 20863 - DNA, 573 bp, Artificial Sequence
  Description of Artificial Sequence: Synthetic coding sequence
atgaattttcttctctcgtgggtgcactggtccctcgcccttcttctctacctgcatcacgcaaaatggagccaggcagcaccaatggctgagggtggcgggcagaatcaccatgaagtggtgaagttcatggatgtgtaccaacggtcgtactgtcatccaattgaaactttggtggacatatttcaagagtacccagatgagattgaatacattttcaagccctcctgcgtgcctctcatgcgttgtggtggctgctgtaacgatgaaggactggagtgtgtgccaaccgaagagtccaacataactatgcagattatgcgtatcaagcctcatcaaggacagcacataggagaaatgagctttctgcaacataacaagtgtgaatgcagacccaagaaagatcgcgcacgccaggaaaatccgtgcggtccatgttccgaacgtaggaaacatctgttcgtgcaagatcctcagacctgcaagtgtagctgcaagaataccgatagccgttgcaaagcaagacagcttgaacttaatgaaagaacgtgtcggtgtgataagcctagacga

SEQ ID NO: 20864 - DNA, 573 bp, Artificial Sequence
  Description of Artificial Sequence: Synthetic coding sequence
atgaacttcctgctctcctgggtgcactggtccctggcgcttctgctgtacttgcatcacgcgaagtggtcgcaagcggcgccgatggcagagggagggggacagaaccatcacgaagtggtgaaattcatggatgtgtaccagcggtcgtactgccaccccattgaaactctggtggacatcttccaggagtacccggacgagatcgaatacatctttaaaccttcttgcgtgccacttatgcggtgcggcggctgctgcaatgacgaggggctcgaatgtgtcccgactgaggaaagcaacatcactatgcagatcatgcgcatcaaaccgcatcaaggtcagcacatcggcgagatgtcgttcctgcaacacaacaagtgcgagtgccggccaaagaaggaccgcgcacggcaggagaatccatgcggaccttgttcagaaaggcgcaagcacctttttgtgcaggatccacaaacctgcaagtgctcatgcaagaacacggacagcagatgtaaagccagacagttggagcttaatgagaggacttgccggtgcgataagccacgccgt

SEQ ID NO: 20865 - DNA, 573 bp, Artificial Sequence
  Description of Artificial Sequence: Synthetic coding sequence
atgaatttcttgttgagttgggttcactggagcctcgcccttctgttgtatttgcaccacgctaaatggtcacaagctgcgcccatggctgagggtggtggtcagaatcaccatgaggtcgtaaaatttatggacgtctatcagagatcctattgtcatcctattgagacattggttgacatcttccaggagtaccctgatgagatcgagtacattttcaaacccagctgcgtcccattaatgcgctgcggagggtgctgtaacgatgaaggtttggaatgtgtgcctactgaggaaagtaatattacgatgcaaattatgcgtatcaagcctcaccagggacagcatattggagagatgtcattcttgcagcataacaaatgcgagtgccggccaaaaaaggatagagctagacaggaaaatccttgtggcccttgctctgagcggaggaaacatctctttgtccaagatccacaaacttgcaagtgctcttgcaaaaatacggatagtcgttgcaaggctcgtcagttagagttgaacgagagaacctgtcggtgtgataaacctaggaga

SEQ ID NO: 20866 - DNA, 573 bp, Artificial Sequence
  Description of Artificial Sequence: Synthetic coding sequence
atgaactttcttcttagctgggttcattggtcgttggctctgttgctgtatctgcatcatgccaaatggtcgcaagccgcccccatggccgaaggaggtggccaaaatcatcacgaagtcgtgaagtttatggacgtgtaccagcggagctactgtcatccaattgaaaccttggtcgatatcttccaggaataccccgatgaaattgaatacattttcaagccttcctgtgttcctctgatgcgttgtggtggatgctgtaatgacgagggactggaatgtgtgcctactgaagagagcaacattactatgcaaatcatgcgcattaagcctcatcaaggtcagcatataggagaaatgtccttcctgcagcacaacaagtgcgaatgtaggcctaaaaaggaccgagcacgccaggaaaacccgtgtgggccgtgctcggaaaggagaaagcacctctttgtgcaggatccacaaacctgtaagtgctcgtgtaaaaacaccgattcccgctgcaaggcacgccagctggaacttaatgaacgtacgtgcagatgtgataagcctcggcgg

SEQ ID NO: 20867 - DNA, 573 bp, Artificial Sequence
  Description of Artificial Sequence: Synthetic coding sequence
atgaatttcctgctgtcatgggtgcattggtccttggcccttctgctgtaccttcaccatgcaaagtggtcccaggctgcgccaatggcggaggggggcggtcagaatcatcacgaagtggtgaagttcatggacgtgtaccagcggtcctactgtcaccccatagagaccctggttgatatattccaggaataccccgatgaaatcgagtatatctttaaaccctcatgcgttccattgatgcgctgtggggggtgctgcaatgacgaaggccttgagtgtgtgcctaccgaggagtcgaatatcactatgcaaattatgaggatcaaaccacatcaagggcagcatattggggagatgtcattcctacagcacaataagtgtgagtgcagaccgaagaaagacagggccagacaggaaaatccttgcggaccttgttccgagcgcagaaaacacctttttgtgcaggaccctcagacatgcaagtgttcctgtaagaacaccgacagcaggtgtaaggctcggcagctcgagctgaacgagcggacatgtaggtgcgataagcccagacga

SEQ ID NO: 20868 - DNA, 573 bp, Artificial Sequence
  Description of Artificial Sequence: Synthetic coding sequence
atgaattttctgctttcgtgggtccattggtcgctggcacttctgctgtacttgcatcacgccaagtggtcacaggcagcccccatggcagaaggaggaggtcagaaccatcatgaagtggtcaaattcatggacgtgtaccagcgttcctactgtcatccgattgaaaccctggtggacatatttcaggaataccccgatgagattgagtacatctttaagccatcatgcgtgcctcttatgcgctgtggtggatgctgcaatgacgaggggctggaatgtgtgcctaccgaagaatcgaacatcactatgcagataatgcgtatcaagcctcatcaaggacaacatatcggcgagatgagctttcttcaacataacaaatgtgaatgtagacctaagaaggatcgcgcacggcaagaaaacccttgcggaccctgcagcgaacgacggaagcatctgttcgtccaggatccccagacttgcaagtgttcatgcaagaataccgattcgagatgcaaggctcggcaactcgagctgaacgaacgcacctgtcggtgtgacaaacctagacga

SEQ ID NO: 20869 - DNA, 573 bp, Artificial Sequence
  Description of Artificial Sequence: Synthetic coding sequence
atgaactttctgctttcgtgggtgcattggagccttgcacttctgctctaccttcatcacgcaaagtggagccaagcagcgcctatggcagaaggtggcggtcaaaatcaccatgaagtcgtgaaattcatggatgtctaccagagatcatactgtcatccaatcgaaactctggtggatatcttccaagagtaccctgacgaaatcgagtacatctttaaaccatcgtgtgtgccactcatgcggtgtggagggtgctgcaacgatgaagggctggagtgtgtgccaaccgaagaatccaacattaccatgcaaatcatgagaatcaagcctcaccagggacaacatatcggtgagatgtcatttttgcaacataacaaatgcgaatgtcgcccgaagaaagacagggcgcggcaggaaaatccttgtgggccttgttcggaaagacgaaaacatctgtttgtgcaagatccgcagacgtgcaagtgctcttgtaagaataccgatagccgatgtaaagcaaggcagctggagctgaacgagaggacctgccgttgtgataagccaagacgc

SEQ ID NO: 20870 - DNA, 573 bp, Artificial Sequence
  Description of Artificial Sequence: Synthetic coding sequence
atgaattttctcctgtcctgggtccattggtccctggccctgctcctgtatcttcatcatgccaaatggtcccaagcagcccctatggccgaaggtggcggtcagaatcatcatgaagtagtcaaattcatggacgtataccaacggtcctactgtcatccaatcgagaccctggtcgacatctttcaagagtatccagacgagattgagtacattttcaaaccatcttgtgtcccactcatgagatgtggtgggtgttgtaacgatgaaggactagaatgcgtgccaaccgaggagagtaacattaccatgcagataatgaggataaagccacaccaggggcagcacattggtgagatgtccttccttcagcacaacaagtgtgagtgccgcccaaagaaagacagggcaagacaggagaatccttgcggcccctgcagcgagcgcagaaaacatttgtttgtacaggatccccaaacttgtaaatgttcatgtaaaaataccgactcgagatgtaaggccagacagcttgagctcaacgagcgaacatgtaggtgcgataaacctcggaga

SEQ ID NO: 20871 - DNA, 573 bp, Artificial Sequence
  Description of Artificial Sequence: Synthetic coding sequence
atgaacttcctgctgtcttgggtacattggagtctggccctgctgctgtatcttcaccacgcgaagtggagccaagcggcaccaatggcagaggggggcggtcagaatcatcacgaggtcgttaagttcatggacgtctatcagagatcttactgtcatccaattgagactctggtggatatcttccaggagtacccagacgagattgaatatattttcaaaccctcctgcgtccccctgatgaggtgcggtggttgttgtaacgacgaggggctggaatgcgtgcccactgaggagagcaacatcactatgcaaatcatgagaatcaaacctcatcaaggccagcacattggagagatgtccttcctgcagcacaacaagtgcgagtgccgtcctaagaaggacagagctaggcaggaaaatccatgcgggccgtgttctgagaggaggaagcacctgtttgtacaggatccccagacttgcaagtgtagttgtaaaaacaccgactcaagatgcaaggcaaggcagctggaacttaatgaacggacctgtcgatgcgataaaccgcgtagg

SEQ ID NO: 20872 - DNA, 573 bp, Artificial Sequence
  Description of Artificial Sequence: Synthetic coding sequence
atgaatttcttactgtcctgggtgcattggtctctggcgctgcttttgtacctgcaccacgctaaatggagtcaagcagccccaatggctgagggaggcggacagaaccaccatgaagtggtgaagtttatggatgtatatcaacgttcttactgccatccaatcgaaacccttgttgatatctttcaggagtaccccgatgaaattgagtatatctttaaacctagctgcgtgccgcttatgagatgcgggggctgctgtaacgatgaaggcctggagtgcgtacctaccgaggaatctaacattacaatgcagattatgcgcatcaagccacaccagggccagcatattggtgagatgagctttctccaacacaacaagtgcgaatgcagacccaaaaaggatagggcacggcaggagaatccgtgtgggccttgctccgagagacgcaagcatctgttcgtacaggaccctcaaacttgtaagtgctcttgtaagaatactgactcacgctgtaaggcccgtcagctggagcttaatgagcgaacgtgccgatgtgacaaaccgcgtagg

SEQ ID NO: 20873 - DNA, 573 bp, Artificial Sequence
  Description of Artificial Sequence: Synthetic coding sequence
atgaactttttactgagctgggtccactggagcttggctctattgttgtacctgcaccacgcgaaatggagccaagctgcgccgatggcagaaggtggcgggcagaaccatcacgaggttgtgaagttcatggatgtgtaccagcgctcttactgtcatcctattgagacattggtggatatcttccaggaatatccggacgagatcgaatacatcttcaaaccgagctgcgtgcctctcatgagatgtggtggttgttgcaacgacgaaggtctcgagtgtgtgccaactgaggaaagcaatataacaatgcaaattatgcgcatcaaaccgcaccaaggtcaacacattggagaaatgagttttctgcaacacaacaagtgcgagtgtcgtccaaagaaggatcgagcccgccaggagaatccgtgtggcccatgctccgagcgcaggaaacaccttttcgttcaggatccacagacttgcaaatgttcatgtaagaacactgactcccggtgcaaagcgcgccaattggaactgaacgaaaggacctgccgttgcgataagccgcgtcgg

SEQ ID NO: 20874 - DNA, 573 bp, Artificial Sequence
  Description of Artificial Sequence: Synthetic coding sequence
atgaacttcctgctgtcgtgggtccattggagtctggcgttgctgctctatctccaccatgccaaatggtcccaggccgcgccgatggctgaaggaggaggtcagaaccatcacgaagtggtgaagttcatggacgtgtaccagcgctcgtactgccacccgatcgagactctggtggatatcttccaagaatacccggacgaaattgaatacatcttcaagccgtcgtgtgtgccacttatgcgctgtggaggatgctgcaatgacgagggactggagtgcgtcccgaccgaagaatcgaacatcactatgcagattatgcggatcaagccacaccagggccagcacatcggtgagatgtcattcctccagcataacaagtgcgaatgcagacccaagaaagatcgtgcacgccaggaaaacccctgcggcccatgctcggagaggcggaagcacctcttcgtgcaggacccgcagacctgtaagtgctcatgcaagaacacggattctcgatgcaaagcgcgccaactggaattgaatgaacgcacctgccgctgcgacaagccgcgccgc

SEQ ID NO: 20875 - DNA, 573 bp, Artificial Sequence
  Description of Artificial Sequence: Synthetic coding sequence
atgaacttcctcctgagctgggtccattggtctttggcgctcctgctttatttgcaccatgcgaagtggagtcaagcagcccccatggccgaaggtgggggccagaatcatcatgaagtagttaagttcatggacgtgtaccagaggtcatattgccatcccattgagacccttgttgacatcttccaagagtatccagatgaaattgaatatattttcaagcccagctgcgtgccgctgatgaggtgcggaggatgctgcaatgacgagggcctggaatgcgttccaaccgaggaatctaatatcaccatgcaaatcatgcgtattaagcctcaccagggacagcatattggggaaatgagttttctgcaacacaacaaatgtgagtgtaggccaaagaaggatcgagctcggcaggagaatccttgtgggccctgttctgagcgccggaaacacctgtttgttcaagatccgcagacgtgtaagtgctcatgtaaaaataccgactcaaggtgcaaagcccgccagctcgagctgaatgagagaacatgtcggtgcgacaagccacgccgt

SEQ ID NO: 20876 - DNA, 573 bp, Artificial Sequence
  Description of Artificial Sequence: Synthetic coding sequence
atgaacttcctcctgagctgggtgcattggtcgcttgcactccttctttacctgcatcatgcgaagtggtcccaagccgcaccaatggcagaaggaggtgggcagaatcaccatgaagtggtcaagtttatggatgtgtaccaacgttcctactgtcatcctattgaaaccctggtcgacatttttcaggaataccctgatgaaattgaatacatctttaagccaagctgcgttcctctgatgcgatgtggggggtgttgcaacgatgagggactggagtgtgtgcccaccgaagagtcgaacataactatgcagattatgcgtatcaaaccccaccaaggacaacacatcggagagatgagttttctgcagcataacaaatgtgaatgtcggccgaagaaagacagagcacgccaagaaaatccctgcggcccttgcagtgaacggcggaagcacctcttcgtgcaggacccacaaacctgcaagtgttcctgtaagaacactgattccagatgcaaggcacggcagctggaacttaatgagaggacctgtcgctgtgacaaacctcgtaga

SEQ ID NO: 20877 - DNA, 573 bp, Artificial Sequence; identical to SEQ ID NO: 20872
  Description of Artificial Sequence: Synthetic coding sequence

SEQ ID NO: 20878 - DNA, 573 bp, Artificial Sequence
  Description of Artificial Sequence: Synthetic coding sequence
atgaactttcttctctcttgggtgcattggtctctggctctgctgctctatttgcaccacgccaaatggtcacaggcggcaccaatggctgagggaggcggccaaaatcatcatgaagtggtgaagttcatggatgtgtatcagagatcgtactgtcatccgattgaaactctcgttgatatttttcaggagtatccggacgagatcgaatacattttcaagccctcttgcgtgcctcttatgcgatgcggcggctgctgtaacgacgagggcctggaatgtgtgcccactgaggagagcaatataaccatgcagattatgagaatcaagccgcaccaggggcaacacattggtgagatgtcgttcctgcagcacaacaaatgcgagtgccggccgaagaaggatagagcgagacaggagaatccctgtggcccatgctctgagcgccggaagcacctgttcgtgcaggacccacagacgtgcaagtgtagctgtaagaatacggactcccgttgtaaggcaagacagttagagctgaatgagcggacctgcaggtgcgataaaccaaggagg

SEQ ID NO: 20879 - DNA, 573 bp, Artificial Sequence
  Description of Artificial Sequence: Synthetic coding sequence
atgaacttccttctctcctgggtccactggtcactggcactcctgttgtacctgcaccatgccaagtggtctcaggcagccccaatggcggaaggaggaggtcagaaccaccatgaagttgtgaagttcatggatgtgtaccagaggtcttattgtcatccaattgaaaccttagtcgacatattccaagaatatcccgatgagatcgagtacatcttcaaaccctcatgtgtgccactcatgagatgcggcgggtgctgcaatgatgagggattggagtgcgtgcccactgaagaatcaaatattaccatgcagattatgaggatcaaaccccaccaaggtcagcatattggagagatgagcttcctgcagcacaacaagtgcgagtgtagacccaaaaaggatcgagccagacaggagaatccctgcggaccctgttccgagagacgcaaacatttgtttgtgcaggacccccagacatgtaagtgttcttgcaagaacaccgattccaggtgtaaggcccgacagctggagctgaacgagagaacctgtagatgcgataaacctcgaaga

SEQ ID NO: 20880 - DNA, 573 bp, Artificial Sequence
  Description of Artificial Sequence: Synthetic coding sequence
atgaattttcttttgtcgtgggtccattggtccctggccctgttgctgtacttgcaccatgccaagtggtcccaagcagcacctatggcggaaggcggtggacagaaccatcacgaagtggtcaaattcatggatgtgtaccagagatcctactgtcaccctattgagactttggtggacattttccaggaatacccagatgagatcgaatacatctttaagccttcgtgtgtcccactgatgcgctgtggaggttgttgcaacgacgaaggactggagtgcgtgccaactgaagaatccaacattactatgcaaatcatgagaattaagccgcatcaaggacaacatataggtgaaatgtcattccttcagcataacaagtgtgaatgtcggcctaagaaggaccgggccagacaggagaatccatgcggcccatgctccgagcgccgcaaacatctctttgtgcaggatcctcaaacctgcaagtgttcatgtaagaacaccgattctcgttgtaaagcgcggcaacttgaactgaacgaaagaacctgtcgctgtgataagcctcggcgg

SEQ ID NO: 20881 - DNA, 573 bp, Artificial Sequence
  Description of Artificial Sequence: Synthetic coding sequence
atgaattttcttctgtcctgggtccattggtcgctcgccctgctgctctatttgcatcatgctaaatggtcacaagcagcaccaatggcggaagggggaggacaaaaccaccatgaagttgtgaaattcatggatgtgtaccaaagatcatattgtcatcctatagaaacccttgttgatatcttccaggaataccccgatgaaattgagtacattttcaagcctagctgtgtcccactgatgcggtgtggtggctgttgtaatgacgaaggactcgaatgcgtgccgaccgaagaatccaacattaccatgcagattatgcggataaagccacatcaaggacaacacataggtgagatgtcattccttcagcataacaaatgtgaatgcaggcctaagaaggaccgagcaagacaagaaaacccgtgtggaccatgttccgagagacggaagcacctgtttgtgcaggacccacaaacctgcaaatgtagctgtaaaaacacggatagcaggtgtaaggcacggcaacttgaacttaacgaacgtacttgtcggtgtgataagcctagacgt

SEQ ID NO: 20882 - DNA, 573 bp, Artificial Sequence
  Description of Artificial Sequence: Synthetic coding sequence
atgaattttctcctgagctgggtgcattggtcgctggcactgctcctttacctgcatcacgcgaagtggtcgcaggctgcgccgatggccgagggcgggggtcaaaaccaccacgaagtcgtgaagttcatggacgtgtaccagagatcgtactgccacccgatcgaaactctggttgacatcttccaggaataccccgatgaaatcgagtatatctttaaaccgtcctgtgtgccactgatgcggtgcggaggatgttgcaatgacgagggactggaatgcgtgcccaccgaggagtcaaacattaccatgcaaatcatgaggattaagcctcatcaggggcaacacatcggcgaaatgagcttcctccagcacaacaaatgcgaatgtcgcccaaagaaagaccgcgcccggcaagagaacccttgcggaccgtgctccgaaagacgcaagcatttgttcgtccaggatccgcagacctgcaaatgttcctgtaagaatactgattcacgatgcaaggccagacagctcgaattgaacgagcggacgtgccggtgcgacaagccacgtcgc

SEQ ID NO: 20883 - DNA, 573 bp, Artificial Sequence
  Description of Artificial Sequence: Synthetic coding sequence
atgaatttcctactttcgtgggtgcactggtctctggcattactactgtacttgcaccacgctaagtggtctcaggctgctcccatggctgaaggggggggacagaaccaccacgaggtagtaaagttcatggatgtatatcaacggtcatactgccacccaatcgaaacactggtggatatcttccaggaatatccggatgagatcgaatatatcttcaaaccctcatgtgtgccccttatgaggtgtggggggtgctgtaacgacgaagggttagaatgcgtgcccacagaggaatcaaacatcactatgcagattatgcggataaaaccccaccagggacagcatataggagaaatgtcgtttctccagcacaataaatgcgaatgtcgtccaaaaaaagatcgggcgcgccaggaaaatccctgcggaccctgctcagaaaggcgaaaacatctttttgttcaggacccccagacatgtaagtgttcttgtaaaaacacagattcaaggtgcaaagctcggcagttagaactaaacgaacggacttgccgatgcgataaacctagaaga

SEQ ID NO: 20884 - DNA, 573 bp, Artificial Sequence
  Description of Artificial Sequence: Synthetic coding sequence
atgaacttcctcctgagctgggtacactggagcctagccttgctgctatacctgcaccacgcgaagtggtcacaagccgcgccaatggccgaaggcggtggacaaaatcaccacgaggtcgtcaagttcatggatgtttatcagcgcagttattgtcacccaatcgaaacactggtggatatcttccaagagtaccctgatgaaattgagtacatctttaagccttcctgcgtgccgctgatgcgctgcggtggctgttgtaacgatgaaggactagaatgcgtgccgactgaagaaagcaatatcaccatgcaaattatgcggatcaagccccaccagggccaacacattggtgagatgagttttctccagcataataaatgtgagtgccgccccaaaaaggatagggcaagacaggaaaacccatgcggaccatgctcggagcggcggaagcacttgtttgtccaggatcctcagacatgcaagtgctcgtgtaaaaatacagactctcgttgtaaggcccgccaactggagctgaacgagagaacgtgccgatgcgacaagcctcgacgc

SEQ ID NO: 20885 - DNA, 573 bp, Artificial Sequence
  Description of Artificial Sequence: Synthetic coding sequence
atgaacttcctgctttcttgggtgcactggtctttggccctcctcctgtacctgcatcacgccaagtggagtcaggctgcccctatggccgaggggggaggacagaatcaccatgaggtggttaagttcatggacgtgtatcaaagatcatactgtcaccctattgagacactggtggatattttccaggaataccctgacgaaatcgagtacattttcaagccctcttgtgtgcctctgatgcgctgtggcggatgctgcaacgacgaaggtctggaatgtgtcccaacggaagagtccaacattactatgcagataatgcggataaagcctcaccaggggcaacacattggcgagatgtctttcctgcagcacaacaagtgcgaatgcagacctaaaaaagatcgggcaaggcaggagaatccctgcggaccttgcagcgagaggcggaaacacctctttgtacaggaccctcagacctgcaagtgttcttgtaaaaacacagactcccggtgtaaagctagacagttggagctgaacgagaggacttgcagatgtgacaaacctagaagg

SEQ ID NO: 20886 - DNA, 573 bp, Artificial Sequence
  Description of Artificial Sequence: Synthetic coding sequence
atgaactttctgttgtcctgggtgcattggtccctggctcttctcttgtacctgcaccacgcaaaatggagccaggccgccccgatggcagagggagggggccagaaccaccatgaagtcgtgaagttcatggacgtctaccagcgctcctactgccatccgatcgaaactctggtggacatcttccaggagtacccggatgagatcgagtatatcttcaagccgagctgcgtgccactcatgcgctgtggaggatgttgcaacgacgagggactcgagtgcgtcccaactgaggaaagcaacatcaccatgcagatcatgcgaataaagccgcaccagggacagcatattggggagatgtcattcctgcaacataacaaatgcgaatgccgccctaagaaagaccgggcccgccaggaaaatccctgcggaccgtgttccgagcgcaggaagcacctgtttgtgcaggatcctcagacctgtaagtgcagctgcaagaacaccgattccagatgcaaggcaaggcagctggaactgaacgagcgcacctgcagatgcgacaagcccaggaga

SEQ ID NO: 20887 - DNA, 573 bp, Artificial Sequence
  Description of Artificial Sequence: Synthetic coding sequence
atgaacttccttctctcttgggtgcactggagcctggccctgctgctctacctccaccatgccaaatggtcgcaggccgctccgatggccgagggagggggccaaaaccatcacgaagtggtgaagttcatggatgtgtatcagagatcgtactgccaccccattgagactctggtggacatcttccaagaatacccagatgaaatcgagtacatctttaagcccagctgcgtccccctgatgcggtgcggaggatgctgcaatgacgagggcctggagtgcgtgcctaccgaagagtcgaacattaccatgcagattatgcggatcaagccgcatcaaggacaacatatcggagaaatgtcatttttgcagcacaacaaatgcgagtgtcgcccaaagaaagacagggcccgccaggaaaatccgtgtggtccgtgtagcgagcgccgcaaacacctcttcgtgcaagaccctcagacttgtaagtgttcctgcaaaaacacggattcaagatgcaaggccagacagctcgaactgaacgaacgcacctgcagatgcgacaagcctagacgc

SEQ ID NO: 20888 - DNA, 573 bp, Artificial Sequence
  Description of Artificial Sequence: Synthetic coding sequence
atgaatttcctgctttcctgggtccactggtcgctcgcacttcttttgtaccttcatcacgcgaaatggtcacaggctgctcccatggcagagggtgggggtcagaaccatcacgaggtggtcaagtttatggatgtataccaacgctcctactgtcacccaattgaaaccctggttgacatatttcaagaataccccgacgaaattgaatacattttcaagccatcgtgcgtgccacttatgcgatgtggaggatgctgtaatgatgagggcctggaatgcgtgccgacggaagaatcaaacatcaccatgcaaatcatgcgtatcaaaccacatcaggggcagcatattggagaaatgagcttcctgcagcacaacaagtgcgaatgcagaccgaaaaaagatagggcaaggcaggaaaacccttgtgggccttgtagcgaacgaaggaagcatctgtttgtgcaagatccgcaaacctgcaagtgcagctgtaagaatactgattcaagatgtaaagcacgacagctcgaattgaacgagcggacttgtaggtgtgacaagcctcggcgc

SEQ ID NO: 20889 - DNA, 573 bp, Artificial Sequence
  Description of Artificial Sequence: Synthetic coding sequence
atgaacttcttgctctcctgggtccattggagcctggctctgcttctgtatctccatcacgccaaatggtcgcaggcagctcctatggcggaaggcggaggacagaaccatcacgaagtggtgaagttcatggacgtctaccaacggagctactgccatccgatcgaaactctcgtggacatctttcaagagtacccagatgagatcgaatacatcttcaagccatcatgcgtgccgctgatgcgctgcggcggttgttgcaacgatgagggactggagtgtgtgccgaccgaagagtcgaatatcactatgcaaatcatgcgcataaagccacaccaaggtcagcacattggggaaatgtcatttctccaacacaacaagtgtgagtgcagaccaaagaaagatcgtgccaggcaagagaacccatgcggaccgtgctccgaacgacgcaagcatttgttcgtccaggacccgcagacttgcaagtgttcgtgcaagaataccgactccaggtgtaaagctcgacaattggaactcaatgagcgcacctgccgctgcgacaagcctaggaga

SEQ ID NO: 20890 - DNA, 573 bp, Artificial Sequence
  Description of Artificial Sequence: Synthetic coding sequence
atgaacttccttcttagctgggtacactggagtctggccctgctgttgtatcttcaccacgcgaaatggagccaggcagcaccgatggccgaaggaggaggtcagaatcaccacgaagtggtcaaattcatggacgtataccagagatcctattgtcatccaatcgagactctggttgacatctttcaggagtaccctgatgaaatagagtacattttcaagccaagctgcgtgccactgatgcggtgcgggggctgctgcaacgacgagggacttgagtgcgtgcccactgaagagagcaacatcacgatgcagattatgaggattaagccacaccaaggacagcacatcggcgagatgtcatttttgcaacataataagtgtgaatgtaggcccaagaaagatcgggcccgccaggagaacccatgtggcccttgtagcgagagaaggaaacaccttttcgtgcaagacccgcaaacatgcaagtgttcctgtaaaaacacggactcccggtgtaaggcacggcagctggagctcaacgagcgcacatgtagatgcgacaagcctaggcga

SEQ ID NO: 20891 - DNA, 573 bp, Artificial Sequence
  Description of Artificial Sequence: Synthetic coding sequence
atgaatttccttttaagttgggttcactggtcacttgcactgttgctgtacctccatcatgcaaagtggtcccaagcggcacctatggcggagggtggaggccagaaccatcatgaggtggtgaaattcatggatgtataccagagatcctattgccaccctattgagactttggtggacatttttcaggagtacccagatgaaatcgagtatatatttaagcctagctgcgtaccgttgatgaggtgcggtggctgctgcaacgatgagggcctggaatgcgtgccgacagaagaatccaacattaccatgcagataatgcgcatcaagccccatcaaggccaacacattggggaaatgagcttcctacagcacaacaagtgcgagtgtagacccaagaaggacagggctcggcaggagaatccatgcggaccctgttcagaaaggcggaaacatctgtttgtgcaggatccacagacctgtaagtgctcatgtaagaataccgattctagatgtaaagcacgccagctggaactcaacgagcgtacctgccggtgtgataagcctaggcgg

SEQ ID NO: 20892 - DNA, 573 bp, Artificial Sequence
  Description of Artificial Sequence: Synthetic coding sequence
atgaatttcctgctctcctgggtgcattggtctctcgcactgctcctgtacctgcaccacgccaagtggagtcaggccgcccccatggctgaaggcggaggacagaaccaccacgaggttgtcaagtttatggatgtataccagaggtcttactgtcatccaattgagaccctggttgacatcttccaggaatacccggatgagattgagtacattttcaagccatcgtgcgtgcccttgatgcggtgtggaggctgctgcaacgacgagggcctggaatgcgttccaacagaggaatctaatattaccatgcagatcatgcggataaagccacaccaaggccagcacattggcgaaatgtcattcctccagcacaacaaatgcgagtgccggccgaagaaagatcgggcacggcaggaaaacccatgcggtccttgttctgaacggaggaagcacctgtttgtccaagatcctcaaacctgcaagtgttcctgtaagaacaccgacagccggtgcaaggcacggcaactggagttaaatgaacgcacgtgccggtgtgataagccaaggagg

SEQ ID NO: 20893 - DNA, 573 bp, Artificial Sequence
  Description of Artificial Sequence: Synthetic coding sequence
atgaattttctgctgtcttgggtccattggagcctggccctactgctgtacctgcaccatgccaaatggagccaggcagctcccatggcagaaggcggcggtcagaaccaccacgaagttgtgaagttcatggatgtgtaccagcggagctactgccaccccatcgaaaccctagtagacatatttcaggaataccccgacgagattgaatacatattcaagccatcatgtgtgcccttgatgaggtgcgggggctgttgcaacgacgaaggccttgagtgtgttcccacagaagaatcgaatatcacaatgcagatcatgcggataaaacctcaccaagggcagcacatcggggagatgagctttctgcagcataataagtgcgagtgtcgtccaaaaaaagatcgggcgcgacaggagaatccttgcggcccgtgcagcgagcgtaggaagcatctgtttgttcaagacccacagacctgtaagtgctcctgcaagaataccgattcgagatgcaaggcacggcagctggagctaaacgaacgtacttgtaggtgcgataaacccaggcgc

SEQ ID NO: 20894 - DNA, 573 bp, Artificial Sequence
  Description of Artificial Sequence: Synthetic coding sequence
atgaattttctgctttcgtgggtgcactggagcctggcacttctcctttacctccaccatgccaaatggtcacaggctgcacctatggcagagggtggaggacaaaaccatcatgaagtggtgaagttcatggatgtgtatcaacggagctactgtcatcctattgagactcttgtcgatatcttccaagaataccctgatgaaattgaatacattttcaagccaagctgtgtgccactgatgagatgcggaggctgttgcaacgacgagggacttgaatgtgtcccaaccgaagagagcaacataacgatgcagataatgcgtattaagcctcatcaaggacaacatattggcgaaatgtcctttctccagcacaacaaatgcgaatgccgccctaagaaagatcgggcaagacaggaaaacccctgcggtccatgtagtgaaagaaggaaacatttgtttgttcaagatcctcaaacttgcaagtgtagctgtaagaacaccgattcgcgctgtaaggcacgtcagcttgagctcaatgaaaggacctgcaggtgcgataagccacgccgc

SEQ ID NO: 20895 - DNA, 573 bp, Artificial Sequence
  Description of Artificial Sequence: Synthetic coding sequence
atgaacttcctgctgtcctgggtccactggtcccttgcactgctgctgtacttgcatcatgcaaagtggagccaggccgcaccgatggccgaggggggtggccagaaccatcatgaggtcgtgaagttcatggacgtgtaccagcgctcttactgtcatccaatcgaaactctcgtggacatcttccaggagtacccggatgagatcgagtacatctttaagccgtcatgcgtgcctctgatgcggtgtggagggtgttgcaatgacgaagggctggaatgcgtgcctactgaggaatccaacatcaccatgcagattatgcggatcaagccgcatcagggacaacacatcggcgaaatgtcatttctgcagcacaacaagtgcgagtgccgaccgaaaaaggatcgagctcgccaggaaaacccgtgcggcccgtgttcagagcggcggaagcacctcttcgtccaagacccccagacgtgcaagtgctcgtgcaagaacaccgactcacgctgcaaagcccgccagcttgaactgaacgaaaggacctgccgctgtgataagccaagaaga

SEQ ID NO: 20896 - DNA, 573 bp, Artificial Sequence
  Description of Artificial Sequence: Synthetic coding sequence
atgaattttttgctgagttgggtgcattggtccctcgccctgctgctctacctgcatcatgctaagtggtcccaggcagctccaatggcagaaggggggggtcagaaccatcatgaagttgtcaagtttatggacgtgtaccagaggtcatattgccaccctatcgagaccttagtcgatattttccaagagtatcctgacgagattgagtatatttttaagccatcgtgtgtgcctctcatgagatgcggcggatgttgcaatgacgaagggttggaatgtgtcccgacagaggagagtaatatcacaatgcaaattatgcgtatcaaaccccatcagggtcagcacattggggaaatgagctttcttcaacataacaagtgcgaatgcagaccgaagaaggacagagcacgacaggagaatccttgcgggccctgttccgagcgacgtaaacatttgttcgttcaggacccacagacatgtaagtgttcttgcaaaaataccgattctaggtgcaaagctagacaactggagttgaacgaacgaacatgccgctgcgacaaacccaggaga

SEQ ID NO: 20897 - DNA, 573 bp, Artificial Sequence
  Description of Artificial Sequence: Synthetic coding sequence
atgaactttctgctcagctgggttcattggtccctcgccttgctcctgtatctgcaccatgcgaagtggtcacaggccgctcctatggcagaaggtggtggccagaatcaccacgaggtcgtgaaatttatggatgtctaccagagatcctactgtcatcccatcgagacactggtcgacatttttcaggaatatcccgatgagatcgagtatattttcaagccgagttgtgttcccttgatgcggtgtggcggttgttgtaacgatgaaggacttgagtgcgtgccgactgaagaatccaacatcactatgcaaattatgagaattaagccacatcaaggacagcatatcggcgaaatgagcttcctgcaacacaacaaatgcgagtgccgacctaagaaagacagggcgcgccaagagaacccatgtggcccatgttccgagaggcgcaaacatctctttgttcaagacccccagacctgtaagtgcagctgcaagaacacggactctcggtgtaaggccaggcagcttgaactcaatgagagaacctgtcggtgtgataaacctcggaga

SEQ ID NO: 20898 - DNA, 573 bp, Artificial Sequence
  Description of Artificial Sequence: Synthetic coding sequence
atgaactttcttctgtcctgggtgcattggtcattggcattgctcctttaccttcatcacgccaagtggtcgcaggcagcccccatggcagagggtggggggcaaaatcatcacgaagtggtgaagtttatggatgtctaccaacgcagttactgccaccctatcgaaacccttgtggacatctttcaggaatacccagatgaaattgaatacatcttcaagccctcgtgtgtgccgctgatgcgctgtggaggatgttgcaacgatgaaggtcttgagtgtgtgccaactgaagaatcaaacataacgatgcaaatcatgaggatcaagcctcaccaagggcaacacattggagagatgtcgttcctccaacataacaagtgcgagtgtcggccaaagaaggaccgcgcgagacaggaaaatccttgcggtccctgctcagaacgtcggaaacatctgtttgtccaggatcctcagacctgtaagtgttcctgcaaaaacactgactcccggtgcaaagcgagacaactggaactcaacgaacgcacttgccgttgcgataagcctaggaga

SEQ ID NO: 20899 - DNA, 573 bp, Artificial Sequence
  Description of Artificial Sequence: Synthetic coding sequence
atgaatttcctcctcagctgggtgcactggagcttggctctgctgctttacctacaccacgccaaatggagccaggccgccccaatggcagaggggggggggcagaaccatcacgaggtcgtcaagtttatggacgtgtatcagcgaagctattgccacccaattgagactctggtggacatattccaggaatatcccgacgagatcgaatacatattcaaacccagctgtgtgcctttaatgcgttgcggaggctgttgtaacgatgaggggttagagtgtgttccaactgaagaaagtaatatcacaatgcagataatgagaattaagccccaccaaggacaacatatcggtgagatgagcttcctgcagcataataagtgtgagtgcagacccaaaaaagaccgggcccgccaagaaaacccttgcggaccctgcagcgagcgccgcaaacatttgttcgtgcaagatccccaaacatgcaaatgctcctgcaaaaatacagactctcgatgtaaggctagacagctggaactcaacgagcgtacgtgcaggtgtgacaagccaagacgg

SEQ ID NO: 20900 - DNA, 573 bp, Artificial Sequence
  Description of Artificial Sequence: Synthetic coding sequence
atgaactttttgctttcgtgggtgcattggtcattagctcttctgctatatctgcatcatgctaagtggagtcaagcggctccaatggcggaaggaggtgggcagaaccaccatgaagttgtcaaatttatggatgtatatcaacggtcttactgccacccgatcgaaacgttggtagacatctttcaggaatatccggatgaaattgaatacattttcaaaccttcttgtgtaccccttatgcgttgtggcggatgttgtaacgatgagggccttgaatgtgtcccgacggaggaaagcaacattaccatgcagatcatgcgcatcaaaccacatcaaggccagcatattggcgaaatgagttttttgcagcataataaatgcgaatgccgcccaaagaaagaccgtgcgaggcaggagaacccgtgtggcccgtgttctgaacgtcgaaaacatctttttgttcaagatcctcaaacttgcaaatgttcatgtaaaaacaccgatagccggtgtaaagcaagacagttagaactcaacgaacgtacgtgccgttgtgataaaccgagacgt

SEQ ID NO: 20901 - DNA, 573 bp, Artificial Sequence
  Description of Artificial Sequence: Synthetic coding sequence
atgaatttcctgctgagctgggtgcactggagtctcgcactgcttctgtacttgcaccatgctaagtggtcgcaagcagcgcctatggccgaagggggaggacaaaaccatcatgaagtggtgaagttcatggatgtgtaccagagaagctattgtcacccaatcgaaactttggtggacatctttcaggaataccccgatgaaatcgagtacattttcaaaccttcctgtgtccccctgatgcgatgtggtggatgttgtaatgatgaaggattggaatgtgtgcccaccgaggaatcgaatatcactatgcagattatgcggattaaacctcaccaggggcagcatataggagagatgtcgtttcttcaacacaacaagtgcgaatgccgtcctaagaaggaccgagcacgacaagaaaacccatgtggtccttgttcagagcgccgtaaacatttgtttgtgcaggatccgcaaacgtgcaagtgtagctgtaagaacactgatagcagatgtaaggcaaggcaacttgagctcaacgaaagaacttgccgatgcgacaaaccgcggaga

SEQ ID NO: 20902 - DNA, 573 bp, Artificial Sequence
  Description of Artificial Sequence: Synthetic coding sequence
atgaactttttattgagctgggtacattggtccttagcactattactctacttgcatcatgctaaatggtcacaggccgcccccatggcggaagggggaggccagaaccaccatgaggtggtcaagtttatggacgtgtaccaacggagttattgccatcccatcgagacactagtcgatattttccaggaataccctgacgagatcgagtatatcttcaaaccgtcctgtgtgcctctgatgagatgtggaggttgttgtaacgacgaaggtcttgaatgcgtacccaccgaagaaagcaatatcaccatgcagattatgcgcattaagccccaccaggggcagcacataggagaaatgagctttctgcaacacaataaatgcgagtgtcgtccgaagaaggatcgcgctcgccaggagaatccatgcggaccgtgctccgagaggcgtaagcacttgtttgtgcaagatccacagacctgcaagtgttcctgtaagaacactgattccagatgcaaagcgagacagctggagctcaacgaaagaacttgccgatgtgacaaaccgcgacgc

SEQ ID NO: 20903 - DNA, 573 bp, Artificial Sequence
  Description of Artificial Sequence: Synthetic coding sequence
atgaatttcttgctcagctgggtgcactggtcccttgctcttctcttgtacctgcaccatgccaaatggtcacaggcagcccctatggcggagggagggggacagaatcaccacgaggttgtgaaattcatggatgtgtaccagcggtcgtactgccaccctatcgagactctagtagacatttttcaggagtaccctgacgagatagaatatatcttcaagccgagttgcgttcctcttatgaggtgcggcggctgctgcaatgacgagggtctcgaatgcgtcccgaccgaggagtctaacattacaatgcaaattatgcgcattaaacctcatcaaggtcaacacatcggggaaatgagcttcttgcagcacaacaaatgcgaatgccgccccaaaaaggacagagcacggcaggagaacccttgcgggccttgtagtgagagaaggaaacatctcttcgtccaggatcctcagacctgtaagtgttcatgcaagaacaccgacagtcgctgcaaagcacgacagctggagttgaatgaacgaacttgccggtgcgacaaaccacggcga

SEQ ID NO: 20904 - DNA, 573 bp, Artificial Sequence
  Description of Artificial Sequence: Synthetic coding sequence
atgaacttcctgctcagctgggtccactggtcgctggccctgttgctgtacctccaccacgctaagtggagccaggctgccccgatggcggaaggtggaggccagaaccaccatgaggtcgtgaagtttatggacgtgtaccagcgatcatactgccatccgatcgaaacgcttgtcgatatcttccaggagtacccggacgagatcgagtacatcttcaaaccttcgtgcgtgccgctcatgcgctgtggaggctgttgcaacgatgaaggacttgagtgtgtcccaactgaggaatctaacatcaccatgcagatcatgcgcatcaagccgcatcaggggcagcatataggagaaatgagcttcctgcagcacaataagtgcgaatgtaggccaaagaaagatagggcccgccaggagaacccatgcggcccatgctcagagcggcgaaaacacctgtttgttcaagatccgcagacctgcaagtgctcgtgcaagaacaccgactcgcggtgcaaggcaagacaactggaactgaatgaaagaacctgccgctgcgataaaccgagaaga

SEQ ID NO: 20905 - DNA, 573 bp, Artificial Sequence
  Description of Artificial Sequence: Synthetic coding sequence
atgaattttctcctcagctgggtgcactggtcactcgctttgctgttatacctgcatcacgctaaatggtcacaagctgcccctatggctgagggaggcggtcagaatcaccacgaggttgtcaagttcatggatgtttaccagcgctcatactgtcatcccatcgagaccctggttgatatcttccaagaatatcctgacgaaatagagtacatcttcaagccgtcttgcgttccactcatgaggtgtggaggttgctgtaatgatgaaggccttgagtgcgttcccacagaagaaagcaatataacaatgcagattatgcgaatcaagccccaccaggggcagcatatcggggagatgtcatttctgcagcacaacaaatgcgaatgccgtcctaagaaggatagagcacggcaggaaaacccttgcggtccttgctcagagcgtcggaaacatctcttcgtgcaggatccccaaacatgtaaatgtagctgtaagaatacagatagccgctgtaaagctaggcagcttgaattgaatgagcgtacgtgtcgctgtgacaagccgcgaagg

SEQ ID NO: 20906 - DNA, 573 bp, Artificial Sequence
  Description of Artificial Sequence: Synthetic coding sequence
atgaatttcctcctgtcttgggtgcattggagccttgcccttttgttgtacctgcaccacgcaaagtggagccaggccgcacctatggcagaaggaggcggacagaatcaccatgaggtagttaagtttatggacgtgtatcaaagatcctactgccacccaattgaaacactggttgatatcttccaagagtaccctgatgagatcgaatatatctttaagccttcttgcgtgcctctgatgcggtgtggaggatgctgtaacgacgagggactggagtgtgtgccaaccgaggagagcaatatcactatgcagatcatgcggatcaagccccaccaaggccaacatatcggggagatgagcttcctgcagcacaataaatgtgagtgcagacccaagaaagaccgcgcaaggcaggaaaatccctgcggaccttgcagtgagcgccgcaaacatttatttgtgcaggacccccagacctgtaagtgctcctgtaaaaacacggacagcaggtgcaaggcccggcagctggagctgaacgaacgcacttgccgctgtgataagcccagaaga

SEQ ID NO: 20907 - DNA, 573 bp, Artificial Sequence
  Description of Artificial Sequence: Synthetic coding sequence
atgaacttcctgctttcctgggtccattggtcgctcgcactgctcctgtacttgcatcacgccaaatggtcgcaggcagctccgatggccgaaggaggtggacagaaccaccacgaagttgtgaagtttatggacgtgtaccagcgatcgtactgtcaccctatcgagactctcgttgacatctttcaggagtatcccgacgagatcgagtacattttcaaaccatcctgtgtgcccctgatgcgctgcggagggtgctgcaatgatgaggggctcgagtgcgtcccaactgaggagtcgaacataactatgcagatcatgcgaatcaagccccatcaaggtcaacacatcggagaaatgtcatttctgcagcacaacaagtgtgagtgtaggccaaagaaggatagagctcgccaggaaaatccatgtggaccttgcagcgaacgccggaagcatctgttcgtgcaggatccacaaacctgcaagtgctcgtgcaaaaacaccgattcacggtgtaaagcccgccagctggaactcaatgagagaacctgccgctgcgacaagccgcgcaga

SEQ ID NO: 20908 - DNA, 573 bp, Artificial Sequence
  Description of Artificial Sequence: Synthetic coding sequence
atgaatttccttctctcctgggtccattggtcccttgcactcttgctgtacctccatcacgcaaagtggtcgcaggcagctcctatggccgagggaggtggccagaaccaccacgaggtggtgaagttcatggatgtgtaccaaaggtcttactgtcatcccattgagactcttgtggacatattccaagagtacccagatgagattgagtatatctttaaaccctcatgtgtgcctctgatgcgctgcggagggtgttgtaatgacgaggggttggaatgcgtgcccaccgaagaatcgaacattaccatgcaaatcatgcgcattaagcctcatcagggtcaacatattggagagatgtcctttctgcagcacaacaagtgtgaatgcagacctaaaaaggatcgagcaagacaggaaaacccctgcggtccatgttcggaacggcgcaagcatctgtttgtccaagatccgcagacctgtaagtgctcctgtaagaacaccgatagcagatgcaaagcacgacagcttgagctgaacgaacgaacttgccggtgtgataagcccaggcga

SEQ ID NO: 20909 - DNA, 573 bp, Artificial Sequence
  Description of Artificial Sequence: Synthetic coding sequence
atgaactttcttctctcctgggtccattggtccttggcgctgcttctctacctccatcacgcaaagtggtcgcaggccgctcctatggccgaagggggaggacagaatcatcatgaagtggtgaagtttatggatgtctaccaaagatcctactgtcatcctattgagactctggtcgacatatttcaggagtacccagatgagatcgaatacatctttaagccaagctgtgtgcccctcatgcgatgcggtggctgctgcaatgatgagggtttggaatgcgttcctaccgaagaatcgaacattactatgcaaatcatgcgcatcaagccacatcagggccaacatattggagaaatgtcctttcttcaacacaacaaatgtgagtgtagacctaagaaagatcgggcccggcaagaaaatccctgtggtccttgttcagagcggagaaagcaccttttcgtgcaggaccctcaaacgtgtaagtgctcgtgcaagaacaccgacagcagatgtaaggcgaggcaactggagctcaacgaacggacttgtagatgcgataagccaagaaga

SEQ ID NO: 20910 - DNA, 573 bp, Artificial Sequence
  Description of Artificial Sequence: Synthetic coding sequence
atgaactttctgttgtcttgggtgcactggtctctcgcgctgctgctctatttgcatcacgccaagtggtcccaggctgcgcctatggccgaaggcggtggccagaatcaccacgaggtagtgaagtttatggatgtctatcaaaggtcttattgtcatcctatcgagaccctggttgatatcttccaggaatacccggatgagattgagtacatattcaagccctcctgcgttcccctgatgagatgtggaggctgctgcaacgatgagggcctcgagtgcgtaccaactgaggaaagtaacatcacaatgcagattatgcgcatcaagccccaccagggacagcacatcggcgaaatgtcattcctgcaacacaacaagtgcgagtgtaggcctaagaaagacagagctcgccaggaaaacccttgcggcccttgctccgagagacgcaaacatctttttgtgcaggaccctcaaacatgtaaatgctcctgtaagaacaccgactctaggtgtaaagcgagacaactggagctgaacgaacgcacgtgtcgctgtgacaagcctaggcgc

SEQ ID NO: 20911 - DNA, 573 bp, Artificial Sequence
  Description of Artificial Sequence: Synthetic coding sequence
atgaactttctgttaagttgggtgcactggagcttggcactgcttctctatctgcatcacgctaagtggtcacaggcggctccaatggctgagggaggagggcagaaccatcatgaggttgtcaagttcatggacgtatatcagcgctcatactgtcatcctatcgaaacgctggtcgatatttttcaagaatatccagacgaaatcgaatacatatttaagccaagctgtgtgccgctgatgcgctgtggaggctgctgtaacgacgagggcctcgagtgcgtgccaaccgaggagtccaatatcaccatgcaaatcatgcgcataaagccgcaccaaggccaacacataggcgaaatgagcttccttcagcataataaatgcgaatgccggccaaaaaaagatcgggcccggcaagaaaacccatgcggaccctgtagcgagagaaggaagcacctgttcgtgcaagatcctcaaacctgtaagtgctcctgcaagaacaccgactcaaggtgcaaggccagacaattggaattgaacgaaagaacctgtagatgcgataagccgcgcaga

SEQ ID NO: 20912 - DNA, 573 bp, Artificial Sequence
  Description of Artificial Sequence: Synthetic coding sequence
atgaatttcctgctctcctgggttcattggtccttggcccttctgctatacctgcatcacgctaagtggagccaggctgcacccatggccgaggggggcggacaaaatcaccatgaagtggtcaagttcatggatgtgtatcagcgcagttactgccatccaatcgaaacactcgtagatatctttcaggagtatcccgacgagatcgagtacatctttaagcctagctgtgtgcccttgatgcgatgtggcggttgttgtaatgatgagggccttgaatgtgtaccaaccgaagagagcaatataacaatgcaaatcatgaggatcaaaccccatcaaggccagcacattggggagatgtcctttttgcagcataataagtgcgaatgcaggcctaagaaggacagggccaggcaggagaacccctgcggcccctgctctgaacgtagaaagcatctgttcgtgcaggatccacaaacatgcaagtgctcttgtaaaaacaccgattccaggtgcaaagcaagacagctcgaattgaatgagcggacatgccgttgcgacaaaccccggagg

SEQ ID NO: 20913 - DNA, 573 bp, Artificial Sequence
  Description of Artificial Sequence: Synthetic coding sequence
atgaattttcttctctcctgggtgcattggagcctcgcactactgctgtatttgcatcacgcaaaatggagtcaggccgctcccatggcagagggcgggggacaaaatcaccatgaggtggttaaattcatggacgtttatcagcggagctactgtcatccaatcgagacgctcgtcgacatctttcaggagtatcccgatgagatcgagtacatctttaaaccctcgtgtgtgcccctgatgcggtgtggtggatgttgtaacgacgaggggttggaatgcgtgccaaccgaggaatctaatatcacgatgcagattatgcgcatcaaacctcaccaggggcagcacatcggcgagatgtcctttcttcaacacaataagtgtgagtgccggccgaagaaggaccgcgcccgccaggagaatccctgcggaccatgttctgagaggaggaagcatctattcgtgcaggatccgcaaacctgcaaatgtagctgcaaaaacacagactcgcgatgcaaagcgagacaattggaactaaacgagcgcacttgtcgctgcgacaaaccccgtcgg

SEQ ID NO: 20914 - DNA, 573 bp, Artificial Sequence
  Description of Artificial Sequence: Synthetic coding sequence
atgaatttccttctgagttgggtccattggtcactggctttgctcttgtatcttcatcatgccaaatggagtcaagccgccccaatggctgagggcggtggacagaaccaccatgaagtggtgaagtttatggacgtgtatcaacggtcttattgccatcccatcgagaccctggttgatatcttccaagaatatcccgatgaaatagaatatatattcaaaccatcatgtgtgccgctcatgaggtgtgggggttgttgtaatgacgagggcctggagtgcgtccccacagaagagtccaacatcactatgcagatcatgcggatcaaaccgcaccagggtcaacatattggagagatgagctttctgcagcataacaaatgcgagtgccgtcctaaaaaagatagagcccgacaggaaaatccttgcggcccctgttctgagcgtagaaagcatctgtttgtgcaggacccccagacttgcaaatgctcatgtaagaacacagattctcgctgtaaggcgcgtcagttggaactgaatgaacggacatgtagatgcgacaaaccaagacgc

SEQ ID NO: 20915 - DNA, 573 bp, Artificial Sequence
  Description of Artificial Sequence: Synthetic coding sequence
atgaactttctccttagctgggtgcactggagtctcgctctcttgttgtacctccaccatgccaaatggagccaggctgcgccaatggcagagggggggggccagaaccatcacgaggtggtaaagttcatggatgtgtatcagcgaagctactgccaccccatcgagactctagtagatatcttccaggaatacccagatgagatcgagtacatcttcaagccgtcttgtgtccccttgatgagatgcgggggttgttgtaacgacgagggcttggaatgcgttcccacggaggagagcaatataaccatgcaaatcatgagaataaagccgcatcagggtcaacatattggagagatgtctttcctgcaacataacaagtgcgagtgtcgccccaaaaaagatcgggcgaggcaggagaacccgtgcggaccctgttccgaaaggcggaagcacctttttgtccaggatccccagacatgcaaatgttcatgcaaaaacaccgatagtagatgtaaggccagacagctggagctcaacgagagaacctgccgttgtgacaaaccaagacgg

SEQ ID NO: 20916 - DNA, 573 bp, Artificial Sequence
  Description of Artificial Sequence: Synthetic coding sequence
atgaacttccttctttcctgggtgcattggtctctggcacttctcctgtatctacatcacgccaagtggagccaagccgctccaatggctgaagggggcggacaaaaccaccacgaggtcgtaaagttcatggatgtctatcagcggagctattgtcaccccattgagacactggtggatattttccaggaatatcctgacgagatcgaatacatattcaagccttcttgcgtgccgttaatgcggtgtggtggatgctgcaacgatgagggactggaatgtgttcccacagaagaatccaacatcaccatgcaaattatgagaatcaagcctcatcagggtcagcacattggggagatgtccttcttacagcacaacaagtgcgagtgcaggcccaaaaaagatcgtgctcgacaggagaacccatgcggcccatgcagtgagagaaggaaacatctcttcgtgcaagatccccagacctgtaaatgctcctgcaaaaacacagatagccgatgcaaggccaggcaacttgagcttaacgaaaggacctgccgctgcgacaagccccgcaga

SEQ ID NO: 20917 - DNA, 573 bp, Artificial Sequence
  Description of Artificial Sequence: Synthetic coding sequence
atgaatttcctcctttcctgggtccactggtctctcgcccttctcctctatttacaccacgccaaatggtcccaggccgctcctatggcagagggcggtggccagaatcatcatgaagtagttaaatttatggacgtctatcagcgtagttattgccacccgatcgagactcttgtggacatcttccaagagtatccggatgagatagagtacatctttaaacctagctgcgtaccactcatgcgatgtggaggttgttgtaacgacgaaggtttggaatgcgtacctaccgaggagagcaatatcaccatgcaaattatgcgcatcaagccccaccagggacagcatattggggaaatgtctttcttgcagcacaacaagtgtgagtgccgtccgaagaaggaccgagctcgtcaagagaatccgtgcggaccatgctcagagaggagaaagcatttgttcgtccaggatccccagacgtgcaagtgctcatgtaaaaacacggacagtcggtgcaaggcccgccagcttgagctaaacgagaggacgtgccgatgcgacaagccgcgaagg

SEQ ID NO: 20918 - DNA, 573 bp, Artificial Sequence
  Description of Artificial Sequence: Synthetic coding sequence
atgaacttcctgctgagctgggtccattggtcactggcgctgttgctctacctgcaccatgccaagtggagccaggctgctcctatggcggagggagggggtcaaaatcatcacgaggtggtgaagtttatggacgtgtaccaaaggtcatactgccatccgattgaaaccctggtggatatctttcaagaatatcccgacgaaatcgagtacatcttcaagccgtcgtgcgtgcctctgatgaggtgcggcggatgctgtaacgatgaaggactcgagtgtgtgcctactgaagagtcgaatatcactatgcagatcatgcgcattaagccgcaccaaggacagcatatcggagaaatgtccttcctgcaacacaataagtgcgaatgcaggccgaagaaggacagagcacgccaagagaatccgtgcggaccttgtagcgagcggcgcaagcacctgtttgtccaggatccacagacctgcaaatgctcatgcaagaacactgattcgcggtgcaaggcacgccaactggaactcaacgaaaggacctgccggtgcgacaaaccacggcgg

SEQ ID NO: 20919 - DNA, 573 bp, Artificial Sequence
  Description of Artificial Sequence: Synthetic coding sequence
atgaactttcttctgtcatgggtgcattggtcccttgccctgctgctgtacctgcaccacgccaagtggtcccaagcagccccaatggccgaaggaggtgggcagaaccatcatgaggtagtgaagttcatggatgtgtaccaaaggtcctattgtcaccctatagaaaccctcgtcgacatttttcaggagtacccggacgagattgaatacattttcaaaccatcatgtgtgccactgatgcggtgtggggggtgctgcaacgatgaaggtttggaatgcgtgccaactgaggaatcaaatatcactatgcaaatcatgagaattaagcctcatcaaggacaacatattggggaaatgagctttctgcagcacaacaagtgtgaatgtcgtccaaagaaagatcgggcccggcaagagaatccctgcggtccatgcagcgaaagacgaaagcatctttttgtccaagatccacagacctgtaagtgctcttgtaaaaacacggattcgaggtgcaaggcgcgccagctcgaacttaatgagaggacttgtcgctgtgacaaacctcgccgc

SEQ ID NO: 20920 - DNA, 573 bp, Artificial Sequence
  Description of Artificial Sequence: Synthetic coding sequence
atgaatttccttctgtcgtgggtgcactggagccttgcattgcttctctacttgcaccatgcgaaatggtcccaagcggcacctatggccgaagggggagggcagaaccatcacgaagtcgtgaaattcatggacgtgtaccagcggtcttactgtcatccaattgaaaccctggtcgacatatttcaggagtacccggacgagatcgaatacatcttcaagccatcctgcgtgcctctgatgagatgcggcgggtgctgtaacgacgagggcctggagtgtgtgcccactgaagaatccaacataaccatgcagattatgcgtatcaagcctcatcagggacaacacattggagagatgagctttctccaacacaacaaatgtgaatgcaggcctaagaaagaccgagcccgtcaggagaacccttgcggtccatgctccgagcggagaaagcatctgtttgtgcaagatccacagacttgtaagtgttcgtgcaagaacaccgattcaaggtgtaaggcacgccaactggaacttaacgaaagaacttgtcggtgtgataaacctaggagg

SEQ ID NO: 20921 - DNA, 573 bp, Artificial Sequence
  Description of Artificial Sequence: Synthetic coding sequence
atgaacttcctcctgtcgtgggtgcactggagcctggcattgctgctgtacctccatcacgcaaagtggtcgcaggccgcgccgatggccgaaggaggcggacagaatcaccatgaagtggtgaagttcatggatgtctaccaacggagctactgccacccgatagagactctcgtggatatctttcaagagtacccagatgagatcgaatacattttcaagccgtcgtgtgtgccgcttatgcgctgcgggggctgctgtaacgatgagggtctggaatgcgtgccgaccgaggaatccaatatcactatgcaaatcatgcggatcaaaccgcatcaaggacagcacatcggagaaatgagctttcttcagcacaataagtgcgaatgtcgcccaaagaaagatcgcgccagacaagaaaacccctgcggcccgtgctcagaaagacggaagcacctgttcgtccaagacccacaaacttgcaagtgttcgtgcaaaaacaccgactccagatgcaaagcacgccagcttgaattgaacgagcgaacctgtagatgcgacaaaccacgcaga

SEQ ID NO: 20922 - DNA, 573 bp, Artificial Sequence
  Description of Artificial Sequence: Synthetic coding sequence
atgaattttctccttagctgggtgcattggagtctagctctgcttttgtaccttcaccatgcaaaatggtctcaggcagcccccatggccgagggcgggggacagaatcaccacgaggttgtgaagtttatggatgtttaccagcgcagttactgtcatcccatagagacactggtcgatatctttcaagagtatccagacgagatcgagtacatcttcaaaccgtcctgcgtgccattgatgcgttgtggaggatgctgtaacgacgaagggctggagtgcgtgcctaccgaagaatcaaatatcactatgcaaattatgcggattaaacctcaccaaggacaacatattggcgaaatgtccttcctgcagcataacaagtgtgagtgtagaccaaaaaaggatagggcaagacaagagaatccatgcggtccatgcagcgaaaggagaaagcatttattcgtccaggaccctcaaacctgcaaatgctcatgtaagaataccgacagccgctgcaaggcgagacagcttgagctcaacgagagaacctgtcgctgcgacaaacctcgccgg

SEQ ID NO: 20923 - DNA, 573 bp, Artificial Sequence
  Description of Artificial Sequence: Synthetic coding sequence
atgaattttctcctgtcctgggtacattggtctctggcacttttgttatatcttcatcacgctaaatggagtcaggccgctcccatggctgaagggggagggcagaaccatcatgaagtagtgaaattcatggatgtgtaccagaggtcatactgtcatcctatcgaaactctggtagatatcttccaggaatatcctgacgaaatcgagtatatattcaagcccagttgtgtgccactgatgcggtgcggagggtgttgcaatgatgaggggctggagtgcgtgcctacagaagagagtaacataacaatgcagatcatgagaattaaaccccatcagggacagcatataggggagatgtcttttctgcagcacaacaagtgtgaatgcagaccaaaaaaggatagagcaaggcaggagaacccttgtggaccttgctcagaaagaaggaaacatctttttgtgcaggatccacagacttgtaaatgtagttgcaaaaacactgatagtcggtgcaaggctcgacagctcgagctcaacgaacggacgtgcagatgcgataaacccagaagg

SEQ ID NO: 20924 - DNA, 573 bp, Artificial Sequence
  Description of Artificial Sequence: Synthetic coding sequence
atgaactttctcctctcatgggtccattggtcgctcgcactgctgttgtacctgcatcatgcaaagtggtcgcaagcggcgcccatggctgaagggggcggacagaatcatcacgaagtcgtgaagttcatggatgtctatcagagatcgtactgtcatcctattgaaactcttgtggacatatttcaagaataccccgacgaaatcgagtacatcttcaagccctcatgcgtccctcttatgcgatgcggcggttgttgcaacgatgagggtctggaatgcgttccaaccgaggaatcgaatatcacgatgcagattatgcgcatcaaaccgcatcaggggcaacacattggagaaatgtcctttctgcaacataacaagtgtgaatgcagaccaaagaaagatagggcgagacaagaaaacccttgcggaccttgtagcgaacggcggaagcatctttttgtccaggacccccaaacctgtaagtgctcctgcaagaacaccgactccagatgcaaagcgcggcagctcgaactcaacgagagaacgtgtcgttgtgataaacctagaagg

SEQ ID NO: 20925 - DNA, 573 bp, Artificial Sequence
  Description of Artificial Sequence: Synthetic coding sequence
atgaacttcttgctctcctgggtgcactggtcattagccttgcttctgtaccttcatcatgccaagtggtctcaggctgctccaatggccgaaggtgggggacagaaccaccacgaagtagttaaattcatggacgtctatcagagaagttactgccacccaatcgagacacttgtagatatatttcaggaatacccagatgaaatcgaatatatctttaaaccctcttgtgtgcccttgatgaggtgtggagggtgctgcaatgatgagggactggagtgtgtgcccaccgaggaaagcaatattacaatgcagatcatgcggatcaaaccccatcagggtcaacatataggagaaatgtcattcctgcaacacaataaatgcgaatgtaggcctaagaaggatcgcgcgaggcaagaaaatccttgcggcccttgctccgagcggaggaagcacctctttgtgcaggacccccaaacatgcaagtgctcctgcaaaaataccgactctcggtgtaaggcgaggcagctggaactcaacgagaggacatgtaggtgtgataagccccgcagg

SEQ ID NO: 20926 - DNA, 573 bp, Artificial Sequence
  Description of Artificial Sequence: Synthetic coding sequence
atgaacttcctcttgagttgggtgcactggagtttggcattgctcctatatcttcaccatgctaagtggtcccaggctgcaccaatggccgagggagggggacagaaccatcacgaggttgtaaagttcatggatgtgtaccagaggtcatattgccaccctattgaaaccctggtcgatatctttcaggagtatcccgatgaaatcgagtatatcttcaagccttcatgcgtgcctctgatgaggtgtggcggatgttgcaacgacgagggactggaatgcgtgcccactgaggaaagtaacattaccatgcagattatgagaatcaaaccccatcaagggcagcacataggagagatgtcattcctccagcataataagtgcgaatgcagaccaaaaaaagatagagctcgccaagagaacccatgtggcccatgtagcgaacggcgtaaacatctttttgtgcaggatccacagacctgcaagtgctcctgcaaaaatactgactcaagatgcaaggcacgccagctggaactgaatgaacggacatgtcgatgcgacaaacctagacgc

SEQ ID NO: 20927 - DNA, 573 bp, Artificial Sequence
  Description of Artificial Sequence: Synthetic coding sequence
atgaattttcttttaagttgggttcattggtcccttgcattattattatatttacaccatgctaaatggagtcaagctgcaccaatggcagaagggggtggacaaaatcatcatgaagttgtaaaatttatggatgtttatcaaagatcatattgtcatccaatcgaaactttagtagatattttccaagaatatccagatgaaattgaatatatattcaaaccttcttgtgtaccattaatgagatgcggaggatgttgcaatgatgaaggattagaatgtgttccaacagaagaatctaatattacaatgcaaattatgagaattaaaccacatcaaggacaacacatcggagaaatgtcattccttcaacataataagtgtgaatgtcgtccaaagaaggatagagcaagacaagaaaacccatgtggtccatgttcagagcgtagaaaacatctttttgtacaagatcctcaaacatgtaaatgttcgtgtaaaaatacagattctcgttgtaaggctagacaattagaattaaatgaaagaacatgtagatgtgataaaccaagaaga

SEQ ID NO: 20928 - DNA, 573 bp, Artificial Sequence
  Description of Artificial Sequence: Synthetic coding sequence
atgaacttcttgctgtcctgggtgcactggtccctggcactgcttctctacctgcaccacgctaagtggtcgcaggcagccccgatggcggagggcggaggtcagaaccaccatgaagtggtaaagtttatggatgtgtaccagcgctcgtactgccacccaatcgaaaccctggtggacatcttccaagagtaccctgacgagatcgaatacatcttcaaaccgtcgtgtgtgcctttgatgagatgtggaggatgctgcaatgatgaaggactggagtgtgtgcccactgaagagtcgaacattactatgcaaatcatgagaattaagccgcaccagggacaacatatcggcgagatgtcattcctccaacacaacaaatgcgaatgtaggccaaagaaagatagagccaggcaggaaaatccgtgcggtccatgctccgagcgccggaagcatctgtttgtgcaggatccgcagacgtgcaagtgctcgtgcaagaatactgactcccgctgtaaagcgagacagctggagctgaacgaacgcacctgtaggtgcgacaaacccaggcgc

SEQ ID NO: 20929 - DNA, 573 bp, Artificial Sequence
  Description of Artificial Sequence: Synthetic coding sequence
atgaacttcctgctgtcatgggtgcactggtcgctcgcactcctgctgtacctccaccacgctaaatggagccaagccgcaccaatggccgaagggggaggccagaatcaccatgaagtggtcaagttcatggacgtgtatcaacgctcgtactgtcaccctatcgagactctggtggatatcttccaagaataccctgatgaaattgagtacatcttcaaaccgtcctgcgtgcctctgatgagatgcggggggtgttgtaacgacgagggactggaatgcgtgcctacggaagagtccaatatcactatgcaaatcatgcgcatcaaacctcatcagggccaacatatcggcgaaatgagcttcctgcagcacaacaagtgcgaatgtcgccccaagaaggacagggccaggcaggagaacccgtgtggcccgtgctctgagcggcgcaaacatctgtttgtccaagatccacaaacttgtaagtgcagctgcaaaaacaccgactcgcgctgcaaggcgaggcagctcgaactgaacgaaaggacttgccgatgtgacaagccccggcgc

SEQ ID NO: 20930 - DNA, 573 bp, Artificial Sequence
  Description of Artificial Sequence: Synthetic coding sequence
atgaactttctcctaagctgggtgcactggtcattggctctgctactgtatttgcatcatgctaaatggagccaggctgcacctatggcagagggcgggggccagaatcaccatgaggtggttaaatttatggatgtctaccaacggagttactgtcaccccatcgagacgcttgttgatatattccaggagtacccagacgagatagaatacatctttaaaccttcatgcgtgcccctgatgcgatgtggggggtgttgcaacgacgaaggtttggagtgcgtccccacagaagagtcaaacatcaccatgcagatcatgcgcatcaagcctcatcaaggccagcacataggcgaaatgtcctttttacaacataataagtgcgagtgccggcccaagaaggacagggcgcgacaggagaacccatgcggcccctgcagtgagcggcggaaacatctgtttgtgcaagatcctcaaacatgtaagtgctcttgtaagaacacagactcccgatgcaaggccaggcagctcgaactcaacgagcgtacctgtcgatgtgacaagccccgcagg

SEQ ID NO: 20931 - DNA, 573 bp, Artificial Sequence
  Description of Artificial Sequence: Synthetic coding sequence
atgaatttccttctcagttgggtccattggtccctggctctcctcttgtaccttcaccatgcaaaatggagccaagcggctcctatggctgaaggcggcggccaaaaccatcacgaagtagttaaattcatggacgtttaccagaggtcttattgccaccccattgagacattagtggatattttccaagaataccctgacgagatcgaatatatctttaagcctagctgcgtgccgctcatgagatgtgggggctgctgtaacgacgaaggcctggaatgcgtgcccacagaggaaagtaatatcaccatgcagattatgcgaattaagcctcaccagggccaacatattggtgaaatgtcatttctacagcacaacaaatgcgagtgtcgcccaaagaaggaccgggcccgccaagagaacccctgcggaccttgctctgaacgccgaaagcatctgttcgtgcaggatccccagacatgcaaatgttcatgcaagaataccgactctagatgcaaagcgcgccaattggagttaaatgaacgtacttgcaggtgtgacaaaccccgtagg

SEQ ID NO: 20932 - DNA, 573 bp, Artificial Sequence
  Description of Artificial Sequence: Synthetic coding sequence
atgaatttcctgctgagctgggtccactggagtttggctttactgctgtatttgcatcatgccaagtggtcccaggccgccccaatggcggagggaggaggacaaaaccaccatgaggtggtgaagtttatggatgtgtaccaacgatcttattgtcatcccatcgaaacactcgtggatatctttcaggaatatccggatgagatcgagtacatatttaagccatcctgtgttcctctaatgaggtgtggggggtgctgtaatgacgagggtttggaatgcgtccctactgaggaaagcaatatcacaatgcagattatgagaataaagcctcaccaaggccagcatattggcgaaatgtctttcctacagcacaataagtgcgaatgccgtcctaaaaaagatcgcgcccggcaggagaacccgtgcgggccctgctcagaacgccgcaagcatctgttcgtgcaggaccctcagacatgcaagtgctcctgcaaaaatacggattcccgatgcaaagctaggcagttggagctgaacgaaagaacgtgcagatgtgataagccaagacgg

SEQ ID NO: 20933 - DNA, 1260 bp, Artificial Sequence
  Description of Artificial Sequence: Synthetic coding sequence
atgcacctgcttggatttttctccgtggcctgctcgctcttggcggcagcacttcttccaggaccaagggaagcgccagcagcagccgctgcttttgaatccggactcgatcttagcgacgcagaacctgatgcaggtgaagccactgcatacgcctctaaagacctggaagaacaactgcgctccgtctcgagcgtcgatgaactgatgaccgtgctgtaccctgaatattggaagatgtacaagtgtcaactgcgcaaggggggttggcagcataatagagaacaggccaatctgaactcacgcactgaagaaaccatcaagtttgctgccgcacattacaacactgagatactgaaaagcatcgacaacgaatggagaaagacccaatgcatgcctagggaagtgtgcattgatgtcggcaaagagttcggtgtggcaaccaacacgttctttaagccgccctgtgtgtccgtgtatcggtgtgggggctgttgtaactccgaaggacttcaatgtatgaacaccagcacctcgtacctgagcaagaccctttttgaaatcaccgtgcctctgtcccaagggccgaagccggtcacgatttcatttgccaaccacacttcgtgtagatgtatgtccaagctcgatgtgtacaggcaggtgcattctattatccgtaggtcgcttcctgccactttgccccagtgccaagcggccaacaagacctgtccgaccaattacatgtggaacaaccatatctgtagatgtctggcgcaggaggacttcatgttttcgtcagatgcgggagatgattccactgacggctttcacgatatttgtggcccaaacaaagaattggacgaggaaacctgccaatgcgtctgccgcgcaggacttcgacctgcaagctgcgggcctcataaggagctggatcgaaattcctgtcaatgtgtgtgcaagaacaagctctttccttcgcaatgtggagcaaatcgggagtttgacgaaaacacttgccaatgtgtgtgtaaaagaacttgtccgcgtaatcagccacttaatccgggtaagtgtgcctgtgaatgcactgaaagcccacaaaaatgccttctgaaggggaagaagttccaccatcaaacgtgttcctgttaccgtaggccttgtacgaaccgacagaaggcatgcgaaccaggattctcgtacagcgaagaggtgtgtcgctgtgtgccttcctattggaagcgtccacagatgatgagc

SEQ ID NO: 20934 - DNA, 1260 bp, Artificial Sequence
  Description of Artificial Sequence: Synthetic coding sequence
atgcatctccttggctttttcagtgtggcgtgttctttgcttgcagcagccctgctgcccggccctagagaagcaccagctgcagcagcagcgtttgaatccggcctggacctgtcggatgcggagccagatgcaggagaggcgaccgcctacgcttcaaaggatctggaagagcagctgaggagcgtgagctcggtcgatgaactgatgaccgtgctttaccctgaatactggaaaatgtacaagtgtcagcttaggaagggaggttggcagcataacagagagcaagctaaccttaacagcagaaccgaagaaacgataaagtttgcagcggcgcattacaataccgaaattctgaagtcgatcgataacgagtggcgtaagacccagtgtatgccccgcgaagtgtgcattgatgttgggaaggagtttggggtcgcaactaataccttcttcaagccaccttgcgtgtcagtctaccgctgcggaggatgctgtaactccgaaggacttcagtgtatgaacaccagcaccagctacttgagcaagaccctgtttgaaatcaccgtccctctttcacagggtcctaaaccagtcactattagcttcgcaaaccatactagctgcagatgtatgtccaagctggatgtgtaccgccaagtgcactcgattatcaggaggtcgctgccggcaaccctgcctcagtgtcaggcagcaaataagacctgtcccactaactatatgtggaataatcatatctgtagatgtctggcgcaggaggactttatgttctcaagcgacgctggggatgatagcactgacggttttcatgacatttgtggacccaataaggagcttgacgaggaaacttgtcaatgtgtgtgtcgcgctggtcttagacccgccagctgcggacctcataaggaattggatagaaattcctgccaatgcgtgtgcaagaataaacttttcccatcacaatgtggagcgaatagggagttcgatgagaacacctgtcaatgtgtttgtaaaagaacttgtccacgcaaccagccactgaaccctgggaagtgtgcctgtgagtgtaccgaatcgccacaaaagtgtctcctgaaaggaaagaagttccatcaccagacttgttcctgttacaggcggccatgtactaacagacaaaaagcatgtgaaccaggtttttcctactctgaagaagtgtgtcggtgcgtgccatcatattggaaaagaccccagatgatgtcc

SEQ ID NO: 20935 - DNA, 1260 bp, Artificial Sequence
  Description of Artificial Sequence: Synthetic coding sequence
atgcatctgctcggattcttttctgtggcttgctcacttctcgcagctgcactgctgcccggaccaagagaagccccagccgccgccgcggccttcgaaagtgggctcgatctctccgatgcagagcccgatgctggagaagccacagcctatgcctccaaagatctcgaagaacagctccggagtgtgtcttctgtggatgaacttatgacagttctatatccagaatattggaaaatgtataaatgccagcttagaaagggggggtggcagcataaccgggaacaggcaaatttaaactctcgaacagaagaaacaataaaatttgctgcagcccactataatactgaaattcttaagagtattgataatgaatggagaaaaactcaatgtatgccacgggaagtttgcatagatgttgggaaagaatttggggtggccactaacacatttttcaaacccccttgtgtatcagtgtatagatgcggaggatgctgcaattccgaagggctgcaatgtatgaatacatcaacttcttacctatcaaagacactgtttgaaataactgttcctctgagtcaggggccaaaacccgtgacaatctcttttgccaatcacactagttgtagatgtatgtccaaattagatgtttatcggcaggttcactcgataattcgacgctccttacccgccactctccctcagtgtcaagccgccaataagacatgtcccacaaactatatgtggaataaccatatatgtcggtgcctagcccaggaggatttcatgttcagtagtgatgctggagatgatagtacagacgggtttcacgatatctgcggaccaaataaggaacttgatgaagaaacttgtcagtgtgtctgcagggctgggctccggcccgcgtcatgtgggccccataaagaactcgacagaaattcatgccagtgtgtttgtaagaataaactgtttccttcccagtgcggagctaaccgcgaattcgatgagaacacttgccaatgtgtctgtaagcgcacttgtcctcgcaatcagcccttaaatcctggaaaatgtgcttgtgaatgtacagagtcaccccagaagtgtcttctcaaaggaaaaaaattccaccatcaaacttgctcttgttaccggaggccttgtacaaatagacagaaggcctgcgaacctggattctcttattcagaagaagtctgtaggtgcgtgccttcttattggaaaagacctcagatgatgagt

SEQ ID NO: 20936 - DNA, 1260 bp, Artificial Sequence
  Description of Artificial Sequence: Synthetic coding sequence
atgcatctgctgggattcttctctgtcgcctgttcgctgctagcagctgccctgttacccggtcccagagaggctcctgctgccgctgccgcatttgagtcggggttggacttgtctgacgccgaaccagatgcaggcgaggccaccgcatacgctagcaaggatctcgaagaacagctgaggagtgtatctagcgtcgatgagttaatgaccgtactgtacccggagtattggaaaatgtataaatgccaactgcgaaagggagggtggcagcacaatcgggagcaggcaaatctgaatagccgcacagaggagactataaaatttgccgccgcacattataacacagaaatcctaaaaagcatcgacaatgaatggaggaagacccaatgcatgcctcgagaggtttgcattgacgtaggcaaagagttcggggtcgctaccaatacctttttcaagcctccgtgcgtctctgtgtaccgctgtggtggatgctgtaattctgaggggcttcagtgcatgaacacaagcacgagctacctgtctaagaccctatttgaaattaccgtcccattaagccagggacccaagcccgtcactatctccttcgcaaaccacacatcctgccgttgcatgtctaagttggatgtctacaggcaagtgcacagcatcatcagacgttccctgcctgctacgttaccacagtgtcaggctgctaacaaaacctgtccaaccaactacatgtggaacaaccatatctgcagatgcctggctcaagaagattttatgtttagttctgacgctggggatgactccactgatggatttcacgatatttgcggcccgaacaaagaactggatgaggagacttgccagtgcgtatgtcgggcgggtctgaggcccgcctcttgcgggcctcataaggagctagacagaaacagttgtcaatgtgtatgcaaaaacaaactgtttcctagccagtgcggcgctaacagagagttcgacgagaacacttgccaatgcgtttgtaagaggacctgtccccgtaatcagcctctaaaccccgggaaatgcgcatgcgagtgcaccgagtctccacagaaatgcctgctgaagggaaaaaagttccaccaccaaacatgctcctgttataggcgcccttgcaccaataggcagaaggcatgtgaacccgggtttagttacagcgaggaggtgtgtcggtgcgtgcccagttattggaagagaccgcaaatgatgtct

SEQ ID NO: 20937 - DNA, 1260 bp, Artificial Sequence
  Description of Artificial Sequence: Synthetic coding sequence
atgcatctcctgggcttctttagcgtggcatgctcactccttgcagcagcccttctgccaggacccagagaagctcccgcggccgcagccgcatttgaatcgggattggatctctctgatgcagagccagatgcgggcgaagcaactgcctacgcgtccaaggacttggaagagcaacttaggagcgtctcttcagtcgatgaactgatgactgtgttgtatcctgaatactggaagatgtataagtgccaactccgtaagggcgggtggcagcacaaccgggaacaggcgaatctcaattcccgcaccgaagaaactattaagtttgcagcagcacactataacaccgagatacttaagtcgattgacaacgaatggcgaaagactcaatgtatgccaagagaggtgtgcattgacgtgggaaaggaatttggagtggcaaccaacactttctttaagccgccctgtgtgtccgtgtaccgctgtggtggatgttgtaattccgagggactgcagtgtatgaacaccagcacctcctacctgagcaagaccctttttgagattactgtgccactttcgcagggtccaaagcccgtgaccatctcgttcgcaaatcacacctcgtgtaggtgtatgagcaagttggatgtgtaccgccaggtgcactcgatcattaggcggtccctgcctgcgactctgcctcagtgccaggcagcaaacaagacttgtccgaccaattacatgtggaacaaccatatctgtcgctgtcttgctcaagaagatttcatgttttcatccgacgcaggagatgattccaccgatggttttcacgacatttgcggccctaacaaagaacttgacgaagaaacttgccaatgcgtgtgtagagcaggcctccgcccagcctcgtgcggtccacataaagaactggatcgtaactcctgtcaatgtgtgtgcaaaaacaagttgtttccttcgcaatgtggtgctaaccgcgagttcgatgaaaacacgtgtcagtgtgtgtgtaagcggacctgtccccgcaatcaacctctgaatccaggtaaatgtgcatgtgaatgcaccgaaagccctcaaaagtgtctcctgaagggaaagaaattccaccatcaaacttgttcgtgttaccgtcgaccctgcactaaccggcaaaaggcgtgtgaacctggctttagctactccgaggaggtgtgccgctgtgtgccgagctactggaagcgaccacaaatgatgtct

SEQ ID NO: 20938 - DNA, 1260 bp, Artificial Sequence
  Description of Artificial Sequence: Synthetic coding sequence
atgcacctgctcggcttttttagcgtggcttgttcacttctggccgctgcattgttgcctggcccaagagaagctcccgccgcagcagccgcatttgagtccggcctggacctgagtgacgccgaacctgatgctggagaggctaccgcctacgcaagtaaagatctcgaggagcagctcagatcagtctcctccgtcgacgaactgatgacagtgctctaccccgagtattggaagatgtacaagtgccagctgaggaaaggcggatggcagcacaatcgcgagcaggccaatctgaactcaaggacagaagagactatcaagttcgccgccgctcactacaataccgagatcttgaagtcaatcgataacgagtggcgcaagactcagtgcatgcctcgtgaggtatgcatcgacgttggtaaagagtttggtgtcgccaccaacacattcttcaagcccccctgtgtaagcgtgtatcgttgtggcggttgctgtaattccgaaggactgcaatgcatgaacactagtacttcatacctttctaaaactctgttcgaaatcaccgttcccctctcccagggcccaaaacccgtgaccatttcctttgctaatcataccagctgcaggtgtatgtctaagttggacgtctaccgtcaggtgcactcaatcataaggaggtcacttccagctactctgcctcaatgccaggctgccaataagacttgccctaccaactacatgtggaacaatcatatttgcagatgccttgcacaggaggactttatgttctcttccgatgccggtgatgactccaccgatggtttccatgatatctgtggccccaacaaagaattggacgaagagacttgtcagtgcgtctgtcgcgccggcctgcgccccgcttcatgcggcccacataaggagctggaccgtaactcatgccagtgtgtatgcaagaacaaactttttccttcacagtgcggagctaatagagagttcgatgagaatacctgccaatgtgtatgcaagcgcacctgcccaaggaatcagccactcaaccccggaaagtgtgcttgcgaatgcaccgagagtcctcaaaagtgtttgttgaaaggcaagaagttccaccatcaaacttgctcctgctaccgtcgtccctgtaccaatagacagaaggcatgcgaacctggcttttcctattccgaggaggtctgtcgctgcgtaccctcatactggaaacgccctcagatgatgtct

SEQ ID NO: 20939 - DNA, 1260 bp, Artificial Sequence
  Description of Artificial Sequence: Synthetic coding sequence
atgcatctgcttggattcttttcggtcgcctgttccctcctcgccgcagcactcctccctggtcctagagaagcacctgccgcagcagccgcgtttgaatcgggtcttgatttgtccgatgcggaaccagacgcaggtgaggctacggcgtatgcctcaaaggatttggaagaacaacttaggtcggtgtcatccgtggacgagcttatgactgtgctttaccccgagtactggaagatgtacaagtgccaactgcgaaagggaggctggcaacataacagggaacaggcaaacctgaattcgagaaccgaggagactattaagtttgcagcagctcattacaataccgagattctgaagtctatcgacaacgagtggagaaaaactcagtgtatgccacgcgaggtgtgcattgatgtcggtaaagaatttggcgtggccactaacacctttttcaagcccccatgcgtgagcgtgtacagatgtggtggttgttgcaactcggaaggccttcaatgtatgaacaccagcactagctacctctcaaagactttgttcgaaatcaccgtccccctctcgcaaggacccaagcctgtgactatctcattcgctaatcatacctcgtgtagatgtatgtcgaaactggatgtgtatcgacaagtgcactccatcataaggcgaagcctgcctgccactctcccacagtgccaagctgcaaacaagacgtgtcctaccaactacatgtggaacaatcatatatgtcgctgtctcgcccaagaagatttcatgttttcctcagatgcaggagatgacagcaccgacgggtttcacgacatctgtggacctaacaaagaacttgatgaagaaacctgccaatgcgtctgtagggcaggtttgcggcccgcgagctgcggacctcacaaggagctcgatcgcaatagctgtcagtgtgtgtgtaagaataagctgtttccttcacaatgcggtgcaaatcgtgaattcgatgaaaatacttgtcaatgtgtctgtaaacggacctgtcctaggaatcagcccctgaatcccggcaagtgtgcgtgcgagtgcacggagtcgccgcagaaatgtttgcttaagggtaaaaagtttcaccatcagacctgttcatgctaccgtcggccatgcaccaaccgacagaaggcatgtgaaccgggattttcgtactcagaagaagtgtgtaggtgtgtgccttcgtactggaagcgcccacagatgatgtca

SEQ ID NO: 20940 - DNA, 1260 bp, Artificial Sequence
  Description of Artificial Sequence: Synthetic coding sequence
atgcacctcctggggttcttttccgtggcttgctccttactcgccgcggccctgttgccggggcctagagaagcgcccgccgctgcggcagcattcgaatccgggctggatcttagcgatgcggagccagacgccggcgaggctactgcatatgcctcaaaggacctggaagagcagctccggagtgtgtctagcgtggatgagctgatgacagtactgtatccagaatactggaagatgtacaaatgccagttgcgaaaaggcggttggcaacacaacagagaacaggccaatctcaacagtagaaccgaagagactattaagtttgctgcagcccactataatacggaaatcctgaagtcgatagacaacgagtggagaaagacccagtgcatgccacgcgaagtttgtatcgacgtcgggaaagagtttggggtggcgaccaacacctttttcaagcctccctgtgtatcagtttaccgatgcgggggatgttgtaactcagagggtctgcagtgtatgaatactagtacatcttatttgagcaagacactgtttgagataacagtgcctctgtcccagggccccaagcccgtgactataagcttcgccaaccatacatcttgtcgctgcatgagcaagctggacgtgtaccgacaggtgcactcaatcatccgtcggagtctacctgccacgctgcctcagtgccaggctgccaacaaaacttgtccaacgaactacatgtggaacaaccatatctgcagatgtttggcccaggaggatttcatgttttcgtctgacgccggggatgattcgacagatggattccatgatatatgtggccctaataaggagctggatgaagagacctgtcagtgcgtgtgtagggctgggctcaggcctgcctcttgtgggcctcataaggagcttgaccgcaatagctgtcaatgtgtgtgtaagaataaattgtttccatcccagtgcggggccaaccgcgagttcgacgagaacacttgtcaatgtgtttgcaagaggacctgtccaaggaaccagccactaaacccaggaaaatgtgcgtgcgagtgcaccgaaagccctcagaaatgcctcctgaaaggcaagaagtttcaccatcagacgtgtagctgttaccggagaccgtgcacgaatcggcagaaagcctgcgaacccggcttctcctactcagaggaggtatgcagatgtgtgccttcttattggaagcgacctcagatgatgtca

SEQ ID NO: 20941 - DNA, 1260 bp, Artificial Sequence
  Description of Artificial Sequence: Synthetic coding sequence
atgcatctcctcggctttttctcagtcgcatgttcgctgctcgctgccgccctcctgcccggcccgcgtgaagcccccgcagccgctgctgcattcgagtcggggttggatctgagcgatgcagaaccagacgcgggagaggctactgcctacgccagcaaagacctggaggaacaactccggtcggtgtcatcggtggacgagttgatgaccgtgctttacccggaatattggaagatgtacaaatgccagctgcgcaagggagggtggcaacataaccgggagcaagcgaacctcaattcgcgcactgaagagactatcaagttcgccgctgcgcattacaacacggaaatccttaaatcgatcgacaatgaatggagaaagacccaatgtatgcctagggaagtgtgcatcgacgttggcaaggagttcggcgtggctaccaacacgttctttaagccgccgtgcgtgtcggtgtatcggtgcggcgggtgttgtaacagcgaaggcctgcagtgcatgaatacgtccacttcgtatctctccaagacgctttttgaaatcaccgtgcccctgtcccagggtcctaaacctgtcacgattagctttgcaaaccacacttcatgccggtgcatgtccaagctggacgtgtacagacaggtccactccattatcaggaggagtctgccagcgactctgccgcagtgtcaagctgcgaacaaaacttgcccgactaactacatgtggaataaccatatctgccgctgcctggcgcaggaggatttcatgttcagctcggacgccggagacgattcaactgacgggttccacgatatctgcggaccgaacaaagagctcgatgaggaaacctgccaatgtgtgtgccgggccggcctccggcctgccagttgcggaccccacaaagaactggaccgcaattcgtgccaatgcgtgtgtaagaacaaactttttccgagccagtgtggtgcaaatcgcgagttcgacgaaaacacgtgccagtgtgtctgtaagcgcacgtgcccaagaaaccagccgctgaatccaggcaagtgcgcatgcgagtgcactgaatccccgcagaagtgcctccttaagggcaagaagtttcaccaccagacttgttcctgttaccggaggccgtgcactaacagacagaaggcttgcgagccgggtttcagctacagcgaggaagtgtgccggtgcgtgccaagctactggaagcggccacaaatgatgtcc

SEQ ID NO: 20942 - DNA, 1260 bp, Artificial Sequence
  Description of Artificial Sequence: Synthetic coding sequence
atgcacctgctaggcttctttagcgtggcctgtagcctcctcgcagctgcgcttttgccaggaccaagagaggctcctgccgccgcggccgccttcgagagcggattggacctgtccgatgctgaaccagatgccggcgaagccacggcttacgcctcaaaagatttggaagagcagctgcgatctgtcagttccgttgatgaactgatgaccgtcctgtaccccgagtactggaaaatgtacaagtgccagctaagaaaaggcgggtggcagcacaatcgagagcaggccaacctcaactcacggaccgaggagactatcaaatttgcagccgcccattataatacagagatactcaaaagtattgacaatgaatggaggaagacccagtgtatgccaagagaggtgtgtatcgacgtgggaaaggaattcggtgtggcaaccaataccttttttaaacccccttgcgtctctgtgtatagatgtgggggatgttgtaacagtgagggtctacagtgtatgaataccagcaccagctacctttcaaagacgctgttcgaaatcaccgtaccgctgagtcagggccctaagcccgtaacgatcagtttcgcgaaccatacctcttgtcgatgtatgtctaagctggacgtttatcggcaagtacattctattatccgacggtcattgccagccacgctgcctcagtgccaggccgcaaataagacctgccctaccaactacatgtggaacaatcatatctgtagatgtctagcacaggaggactttatgttttctagtgatgcaggcgatgattcaactgacggttttcatgatatctgtggccccaacaaagaactcgacgaggagacatgccagtgtgtttgtcgtgccgggctgagacctgcttcttgcgggccgcataaagaattggatcgaaactcttgtcagtgtgtttgcaagaataaactattcccatctcagtgcggagcaaatagagagtttgatgagaatacctgccagtgtgtctgcaagcgaacctgcccccgaaaccaaccattgaaccctgggaagtgtgcctgcgagtgtactgagagtccacagaaatgtttattgaagggaaagaaatttcaccatcaaacgtgttcttgttacaggaggccttgcactaaccgacaaaaggcttgcgagcccggcttctcttattcggaggaggtctgtagatgcgttccaagctattggaagcgaccccagatgatgtca

SEQ ID NO: 20943 - DNA, 1260 bp, Artificial Sequence
  Description of Artificial Sequence: Synthetic coding sequence
atgcatttactcggctttttttctgttgcctgttcacttttggcagccgctttgttgccgggcccacgtgaagcccccgccgctgccgccgcatttgaatctggcctggacctttccgatgcagaaccagatgccggggaggcaacagcctacgcgtcaaaggaccttgaggagcagcttcgaagtgtgagctctgtggacgagctcatgacggtgttgtacccagagtactggaagatgtacaagtgccagctgaggaagggcggctggcagcacaatcgcgagcaggccaacctgaattctcgaacagaggagacaatcaagttcgccgcagctcactataacactgagattctgaaatcaatagataatgagtggcggaagacacagtgtatgccccgggaagtctgtattgatgttgggaaggaatttggggttgcaaccaacaccttcttcaagcccccttgtgtatcagtgtatcgctgcggggggtgctgtaattctgagggcctgcaatgcatgaacacaagcaccagttatctaagtaagacactgtttgagattacagttccgctgtcccaaggtcctaagccagtcacgatctctttcgcaaatcacaccagctgtcgttgcatgtctaagcttgatgtttatcggcaggtgcattctatcattagacggtcacttccggcgacactcccacagtgccaggcagccaataaaacttgccctacaaactacatgtggaacaaccacatttgtcgctgtctcgctcaggaagatttcatgtttagcagcgatgccggggatgattccacagatggctttcacgacatctgcgggcccaataaggagttagacgaagagacttgccagtgtgtatgcagggccggtcttcggccagcatcctgcggcccccacaaggaactagaccggaattcatgtcagtgcgtgtgtaagaacaaactgttcccttctcagtgcggggcaaacagggaattcgacgaaaacacatgccagtgtgtctgtaagcggacctgcccccggaaccagcctctaaatccgggaaagtgcgcctgtgagtgtaccgaatctcctcagaagtgtctactaaaaggaaaaaagtttcatcaccagacttgcagttgctataggagaccctgcacaaacagacagaaggcctgtgaacctgggttctcttactccgaggaagtgtgtcgttgcgtccccagttactggaaacgaccacaaatgatgtcc

SEQ ID NO: 20944 - DNA, 1260 bp, Artificial Sequence
  Description of Artificial Sequence: Synthetic coding sequence
atgcatctcttgggtttcttcagcgtcgcctgtagtctcctggcggccgcgttactcccaggtccccgggaggcgccagctgctgccgccgcattcgaatcagggctagacttaagcgacgccgagcccgatgcaggtgaagcgaccgcctatgctagcaaggacctggaagaacaactacggagcgtctcaagcgtcgacgagctcatgaccgtgctgtacccagagtattggaagatgtataaatgtcagctccggaaaggagggtggcagcacaaccgggagcaggctaatctgaatagcaggacagaagagactattaagtttgctgctgcccattacaacacggagattttaaagagtatcgacaacgaatggaggaagacccagtgtatgccgcgcgaagtgtgcatagacgtgggtaaagaatttggggtggcaacgaatacgttctttaagccaccctgcgtgtcagtgtatagatgtggaggctgctgcaatagtgaagggctgcagtgtatgaacacctcaacgagctatctctctaaaacactgttcgagataaccgtgcccctgagccagggcccaaagccagtaaccattagcttcgctaatcatacatcctgcagatgtatgtccaaactggacgtgtatcgtcaggttcactctatcattcgccgaagcctcccggccactttacctcaatgccaggccgctaataagacctgcccaacaaactatatgtggaataaccatatttgccgctgccttgcccaggaggacttcatgttttccagcgacgccggagatgacagcacagacggttttcacgacatctgtggaccaaacaaagagctggatgaagaaacctgtcagtgcgtatgtcgggctggcttgagaccggccagttgcgggccccataaggaactggataggaactcgtgccagtgtgtgtgtaagaacaagctgtttcctagccagtgcggggctaatagagaatttgacgagaacacttgccaatgcgtgtgcaaacggacatgtcctcgcaatcagcctctgaatccaggaaaatgcgcgtgtgagtgcactgaatcaccacagaaatgcctgcttaagggtaagaaattccaccatcagacatgctcctgctatagacgtccatgtacaaatcgacagaaagcatgtgagccaggattctcctactctgaggaggtgtgcagatgcgtccccagttactggaagagaccacagatgatgtca

SEQ ID NO: 20945 - DNA, 1260 bp, Artificial Sequence
  Description of Artificial Sequence: Synthetic coding sequence
atgcacttgcttggattcttttctgtggcgtgttccttgctggcagcagccctgctgcccggaccccgagaggccccagcggccgccgccgcatttgaatccgggctggacctctctgatgcagagcctgacgctggggaggccactgcatatgcctccaaagacctggaggaacagcttcgatctgtgagttcagtcgacgaactgatgacagttctgtacccagagtactggaagatgtacaagtgccagctcagaaaggggggctggcaacataaccgagagcaggctaacttgaacagtaggactgaggagacaatcaagttcgctgccgcccattacaatactgaaatactgaaatcaatcgacaatgaatggcgcaaaacccagtgcatgccccgtgaggtgtgtatcgacgtaggtaaggagttcggagtagctacgaatacattttttaagcccccttgtgtaagcgtgtaccggtgcgggggttgctgtaactccgagggcctgcagtgtatgaacacctccacttcctatctgtcaaaaaccctcttcgagatcactgtgccgctctcccagggcccgaagccggtgaccatcagttttgctaaccacacgtcctgccgctgcatgtcaaagctggatgtgtatcggcaggtccactctattatacgtcgatccttaccagcgacactgcctcaatgtcaggcggccaacaaaacatgccccacgaactacatgtggaataatcatatctgtaggtgtctagctcaggaggactttatgttctccagcgatgctggggatgattccaccgacgggttccacgatatctgtgggccaaacaaggaactggacgaggagacgtgccaatgtgtctgtcgtgctggactccgcccagccagttgcggaccacacaaagaactggatcgaaattcatgccagtgtgtgtgcaagaacaagctatttccctcccagtgcggcgccaacagagagttcgatgaaaatacttgtcaatgtgtgtgtaaaaggacatgcccccgcaaccagccactgaaccctgggaagtgcgcttgcgaatgcaccgaatccccccagaagtgtttgctgaaagggaagaaatttcaccaccagacatgttcatgctaccggaggccatgcactaatcgccaaaaggcttgtgagccaggctttagttattccgaggaagtatgtaggtgtgtacctagctactggaaaaggcctcagatgatgagt

SEQ ID NO: 20946 - DNA, 1260 bp, Artificial Sequence
  Description of Artificial Sequence: Synthetic coding sequence
atgcacctgctaggttttttcagcgtcgcctgcagccttctcgccgctgccctcctgcccgggcctcgagaggccccagccgctgccgccgcgttcgagagcggactggacttatcagacgccgaaccagacgctggcgaagccacagcatacgccagcaaggacctggaggaacagctgagaagtgtgtcatccgtcgacgaattgatgaccgttctgtatcccgagtactggaaaatgtacaagtgccagcttcggaagggcgggtggcagcacaaccgggaacaggctaatctgaatagccgaaccgaagagacaattaaattcgctgcggcccactacaataccgagattctcaaatcaattgataatgagtggaggaaaactcagtgtatgccacgagaggtgtgtatcgacgtgggaaaggagttcggcgtggctactaatacattttttaagcctccgtgtgtatcagtgtaccgctgcgggggatgctgcaattccgaaggcctgcaatgcatgaatacttcaaccagttatctttcaaagacgctgttcgaaatcacagtgcctcttagtcagggaccgaagccagtcactatcagtttcgctaatcacacgagctgtcgctgcatgtccaaactggatgtttataggcaagtgcattctatcataaggagaagtctgccagcgacactcccgcagtgccaggccgcaaacaaaacttgccctaccaattacatgtggaacaaccatatctgtcgctgcctcgcccaggaagatttcatgttcagttcagatgccggtgacgactccaccgacggcttccatgacatttgtggccccaataaggagctcgatgaggagacatgccagtgtgtgtgtcgggcaggcctcagacccgcgagctgcgggccccacaaagaactcgaccgtaatagctgccagtgtgtgtgcaagaataaattgttcccatcccaatgcggcgccaatagagagtttgacgagaatacatgccaatgcgtctgcaagaggacttgcccccggaatcagcctctgaatccaggcaagtgcgcctgtgagtgtaccgagtctccacaaaagtgtctactgaaaggcaagaagttccatcatcagacctgctcctgctatcggagaccctgtacaaacaggcagaaagcatgtgaacccggcttctcttatagcgaagaagtgtgtagatgtgtgccctcttattggaaacggccgcagatgatgagt

SEQ ID NO: 20947 - DNA, 1260 bp, Artificial Sequence
  Description of Artificial Sequence: Synthetic coding sequence
atgcacctgctgggcttcttttcggttgcttgctccctgcttgccgccgccttgctccccgggccacgggaagcccctgcggcggccgctgccttcgaatcgggactcgatctctcggacgctgaaccagacgcaggagaagcgactgcctacgcttcgaaagatctcgaagagcagctccgctccgtctcctccgtcgatgaactgatgactgtcctttacccggaatactggaaaatgtataagtgtcaactgagaaagggcgggtggcagcataaccgcgagcaagccaatcttaattcgagaaccgaagagactatcaagttcgcagccgcccattacaataccgaaatcctgaagtctattgacaacgaatggcgcaaaacccaatgcatgcctcgcgaggtgtgcatcgacgtcggaaaggaatttggggtggccaccaacaccttctttaagcccccatgtgtgtcagtctaccgttgcggaggatgctgcaattcggagggactgcagtgcatgaatacctctacctcttacctgtccaagaccctgtttgagatcaccgtgcccctgagtcagggaccgaagccggtcacgatctcgttcgcaaaccatacttcgtgccgctgcatgtcgaaactcgatgtgtatcgccaggtccattcaatcatccgccgctcgctgccggcgaccctgccacaatgccaagcagcgaacaaaacttgccctaccaattacatgtggaacaaccatatctgcagatgcctggcacaagaagatttcatgttctccagcgatgcgggtgatgactccacggatggattccacgacatctgcggccctaacaaagagttggacgaggaaacctgtcaatgcgtgtgtcgggctggcttgcgaccagcgtcatgcggaccgcacaaggaactggatcgcaactcgtgccaatgtgtgtgtaagaacaagctgtttccgtcccaatgcggagccaatagagaattcgatgagaacacttgccagtgcgtgtgtaagaggacctgtccgcggaaccaacctctgaatccaggaaagtgcgcctgcgagtgcactgagtcaccgcagaagtgccttttgaaaggaaaaaagttccaccatcagacctgctcctgctaccgccgcccatgtactaacaggcaaaaggcttgtgagcctggattcagctacagcgaggaggtgtgcagatgcgtcccttcctactggaaacgccctcaaatgatgtcg

SEQ ID NO: 20948 - DNA, 1260 bp, Artificial Sequence
  Description of Artificial Sequence: Synthetic coding sequence
atgcacttattaggatttttttcagtcgcctgttcactcttggccgctgcactgctgcccggaccgagagaagccccagccgctgctgctgcctttgagtccggactagacctgtctgatgcagagcctgatgccggggaagcgactgcttacgctagcaaagatcttgaggagcagctccggtccgtaagttctgtcgacgaattaatgacggtgctgtacccagagtattggaaaatgtacaaatgccagctgcgaaagggtggttggcagcacaaccgggaacaagctaaccttaatagccgtaccgaggaaacgatcaagtttgcagctgcccactacaatacagagattctcaagtccatagacaatgaatggagaaaaacccagtgcatgccacgtgaggtgtgcattgacgttggcaaggagtttggagtcgctaccaacacctttttcaaacccccctgcgttagcgtctacaggtgcggcggatgttgcaacagcgagggcttacaatgcatgaacacgtccacttcctacctgtctaagactttattcgagatcacagtgcctttgtcgcaaggaccgaagccagtaacaatcagtttcgccaaccatactagctgcaggtgtatgagcaagctggacgtctataggcaggtgcactctatcatccgtaggtcactacccgcgacattgcctcagtgccaggcggcgaacaaaacgtgtccaaccaattacatgtggaataaccacatttgccggtgcctggctcaggaagactttatgttctcgagcgatgccggcgacgattctacagatggatttcacgacatctgtggcccaaacaaagaattggacgaagaaacctgccagtgtgtttgtcgagccggtctacgcccagcctcgtgcgggccccacaaggagttggatagaaactcatgccagtgtgtctgcaagaataagctattcccctcccagtgcggggcgaacagggagtttgacgagaacacctgtcagtgtgtctgcaaaaggacttgcccccggaaccagccactgaaccccggcaaatgtgcctgtgaatgtacggagtctccacaaaaatgtctgcttaaaggtaagaaatttcatcaccagacctgttcctgttatcgtcgaccttgcaccaataggcagaaggcttgtgaaccgggtttttcttattctgaggaagtttgcagatgcgtgcccagttattggaaacgtcctcagatgatgagt

SEQ ID NO: 20949 - DNA, 1260 bp, Artificial Sequence
  Description of Artificial Sequence: Synthetic coding sequence
atgcatctgctcggctttttctcggttgcatgttcgctgttggcggctgcactcctgcctgggcctagggaagccccagcagcggcagcagctttcgaatccggattggatctgtctgacgccgaaccagacgcaggagaagctaccgcctacgcatccaaagatcttgaagaacaacttcgttcagtgtccagcgtcgatgaacttatgaccgtgctttaccctgaatactggaagatgtacaagtgccagcttcggaaaggcggctggcaacataaccgcgaacaggccaatctcaattcgcggaccgaagaaaccattaagtttgccgctgctcactacaatacggagatcctcaagtccatagacaatgaatggagaaagactcaatgcatgcctcgcgaagtgtgcattgatgtcggaaaggaatttggtgtggccactaatacctttttcaagcccccttgtgtctcggtctaccggtgtggaggatgttgtaactcggagggtctgcaatgcatgaatacctcgacttcctacctttccaagacgctgtttgaaattactgtgccactttcacaagggcccaagcctgtgaccatttcgtttgcgaaccacacttcgtgcaggtgtatgtccaaacttgatgtgtacagacaggtgcactcaatcatcagacggagccttcctgccaccctgccccaatgtcaggcggcgaacaagacttgcccaactaattacatgtggaacaaccacatttgtcgttgtctcgcacaggaagatttcatgttttccagcgacgcaggcgacgatagcactgatggattccacgacatatgtggacctaacaaggaactcgacgaagaaacttgccaatgtgtgtgtcgcgccggcctccgacctgcatcctgtggaccacataaagaattggatagaaatagctgtcaatgtgtatgtaagaacaagttgttcccgtcgcaatgtggtgccaatcgtgagttcgatgaaaatacttgccagtgtgtgtgtaagcgcacctgcccacgaaaccaaccgctgaacccaggcaagtgcgcctgtgagtgtaccgaatcacctcagaaatgccttcttaaaggaaaaaagtttcatcatcaaacctgttcctgttacagacggccatgtactaatcgccaaaaagcatgtgaacccggattcagttacagcgaagaagtctgtcgttgtgtgccttcctactggaaaagaccacaaatgatgtcc

SEQ ID NO: 20950 - DNA, 1260 bp, Artificial Sequence
  Description of Artificial Sequence: Synthetic coding sequence
atgcaccttctgggatttttctctgtcgcctgctccctgctggcggctgcgctattgcctggacctagggaggcccccgcagctgccgcagctttcgagtccgggttagacctctccgacgctgagcctgatgccggggaggctaccgcatacgccagcaaggacctcgaggagcaactgcgttctgtgtcaagtgttgacgaacttatgaccgtgttataccccgaatattggaaaatgtacaagtgccagctacgcaaggggggatggcagcacaatagggagcaggccaacctcaactctcgcaccgaagaaacaatcaagttcgccgcggcgcattacaacactgagatacttaagtctatcgacaatgaatggcgaaagactcaatgcatgcctcgcgaggtgtgtatcgacgtcggtaaagaatttggagtagccaccaataccttcttcaaaccgccgtgcgtgagtgtataccgctgcggcgggtgctgcaactctgaagggctgcagtgcatgaatacatctacctcatacctctccaagaccttattcgagatcaccgtgccgctgtcccaaggacccaaacccgtcacaattagtttcgccaaccatacaagctgccgctgtatgtctaagctggatgtatacaggcaggtgcacagtatcattcgaaggtcattacccgcgacgctaccacagtgccaggctgctaataaaacatgtccaactaactacatgtggaacaaccatatatgccggtgcttggctcaggaagacttcatgttcagcagcgatgctggggatgactccacagacggttttcacgatatttgcggacctaataaagaattggatgaagaaacctgtcagtgtgtatgtcgcgccggcctgaggcccgcgtcttgcggtcctcacaaagagcttgacagaaatagctgtcagtgcgtgtgcaagaacaagttgttccctagccagtgtggtgctaaccgggagttcgatgaaaatacctgccagtgtgtctgtaagaggacctgcccgaggaatcaaccacttaacccggggaagtgcgcatgtgagtgcacagagtccccccagaaatgtcttctcaaaggcaaaaagtttcaccaccagacttgtagttgctatcgccgaccctgcacaaacagacaaaaagcctgcgaaccagggtttagttactccgaagaagtgtgtaggtgtgtgccttcctattggaaaagacctcaaatgatgtcc

SEQ ID NO: 20951 - DNA, 1260 bp, Artificial Sequence
  Description of Artificial Sequence: Synthetic coding sequence
atgcatttgctggggttcttctctgtggcctgcagcctgctggcggccgcgctcctcccgggaccgcgcgaggccccggcagccgccgctgcttttgaatcgggtcttgacctctccgatgccgagccggatgcaggcgaggccactgcgtacgctagcaaagacttggaagagcagctgcgctccgtgagctcagtcgacgaactgatgaccgtgctgtaccctgagtactggaaaatgtacaaatgccagctccgtaaggggggatggcaacacaacagagaacaggccaacctcaactcgcgcaccgaggaaactattaaattcgccgcagcccactacaacaccgagatcctgaagagcatcgataacgaatggagaaagacgcagtgcatgccgcgcgaagtctgcattgacgtgggaaaggagttcggagtagcgactaataccttcttcaagccgccttgcgtgtcggtgtaccggtgcggaggatgttgcaactccgaaggactccaatgcatgaatacctccacgagctacctctcaaagaccctgtttgagatcaccgtgccactgtcgcaggggccgaagccggtgaccatctcctttgctaaccatacttcgtgccgctgcatgtccaaactcgatgtctacagacaggtgcacagcatcatccgccggagcctgccagcaactctgccccagtgccaggccgcaaataagacctgcccaactaactatatgtggaataatcacatctgtcggtgtctggctcaagaggatttcatgttctcgtcagatgcgggtgacgactctactgacggctttcacgacatctgcggcccgaacaaagaacttgatgaagagacttgccaatgtgtgtgccgggcgggtctgaggcctgcatcgtgtggaccacataaggaattggacagaaactcgtgtcaatgtgtctgtaagaacaagctgttccctagtcagtgtggagcgaatagggaattcgacgagaatacctgccaatgcgtctgcaagcgaacctgccccaggaatcagccgcttaacccaggcaagtgcgcctgcgaatgcactgaatcgccacagaaatgcctgctgaagggcaaaaagttccaccatcaaacgtgctcatgttaccggcgcccatgtactaacagacagaaggcttgcgaacctggattttcctactcagaggaagtttgccggtgcgtgccgtcatactggaagcgcccccagatgatgtcc

SEQ ID NO: 20952 - DNA, 1260 bp, Artificial Sequence
  Description of Artificial Sequence: Synthetic coding sequence
atgcaccttctcggatttttctcagtggcctgctcgttgttggccgctgcactgctcccgggcccgagagaggccccagccgccgccgccgcgtttgaatccggactggacctgagcgacgccgaaccggatgccggagaggccactgcgtacgcgtcgaaggacttggaagaacagctgcggtccgtgtcctccgtggacgagctgatgactgtcctgtatccggaatactggaagatgtacaagtgccagctgcggaaagggggctggcagcataaccgcgaacaggccaatctgaattcccggactgaggaaaccataaagttcgcagccgcccattacaacacggaaattctgaagagcatcgataatgagtggagaaagacccaatgcatgccgcgggaggtgtgtatcgacgtgggcaaagagtttggagtggctaccaacactttcttcaaaccgccgtgcgtgtcggtgtaccggtgcggcggatgctgtaacagcgaaggactccaatgcatgaacactagcaccagctacctctcaaagaccttgtttgaaatcaccgtgcctctgagccaaggcccaaagccggtcaccatctcgttcgccaatcatacctcatgccgctgtatgtcgaagctggacgtgtaccgccaagtgcactccatcatccgccggagcctgccggccaccctcccgcagtgccaagcagccaataagacttgccctaccaactacatgtggaacaatcatatctgccggtgcctcgcccaagaagatttcatgttcagctccgatgcgggcgacgactcgactgatggattccacgacatttgtgggccaaacaaggaactcgatgaagaaacctgccaatgcgtgtgtagggcgggactgaggcctgcctcgtgcggaccacacaaggagctggatcggaattcttgccagtgcgtgtgtaaaaacaaactgttccctagccagtgcggagcaaaccgagaattcgacgaaaatacttgtcagtgcgtgtgcaagcgaacttgtccgcgcaatcagccgctgaatccaggaaaatgcgcttgcgagtgtaccgagtcgccgcagaaatgcctgctcaagggcaagaagttccaccaccaaacttgctcatgctacagacgcccgtgcactaacaggcaaaaggcatgtgagccggggttttcgtactcggaggaggtgtgccgctgcgtgccgtcgtactggaagcgcccgcaaatgatgtcg

SEQ ID NO: 20953 - DNA, 1260 bp, Artificial Sequence
  Description of Artificial Sequence: Synthetic coding sequence
atgcacttgttaggttttttttctgtggcctgctcgctcttggcagctgctcttttgcccggaccgcgtgaagctccggcggcggcggccgctttcgagtccggactggatctcagcgacgcggaaccggacgctggtgaagccactgcttacgcgtcaaaggatcttgaagagcaactaagatcggtctcctccgtcgacgagttgatgaccgttttgtatcccgagtactggaaaatgtataagtgtcagctccgcaaaggcggatggcaacacaaccgagagcaagctaacctaaactcgagaactgaggagacaattaagttcgctgcggctcactacaatacggaaatcttgaaatctattgacaacgaatggcgcaagacacagtgtatgcctcgcgaggtatgtatagacgtggggaaggaattcggtgtggcgacgaatactttctttaagcctccctgcgtctcagtctatagatgcggtgggtgttgcaactctgagggtctacagtgcatgaacacgtccacatcttatctgtctaagactttgtttgaaataacagtgcccctgtcgcagggcccgaagcccgtcaccatcagtttcgctaatcatacctcttgcaggtgtatgagcaaactcgacgtctacaggcaggtccacagcatcatcagacggtcactaccggccacccttccgcaatgccaagcggcgaataaaacttgcccgaccaattacatgtggaacaaccacatttgccggtgcctggcccaggaggactttatgtttagttccgatgctggagacgactctacggatggcttccatgatatttgtggtcctaataaggaactggatgaggaaacctgtcaatgtgtttgcagggctggactccgccctgcaagctgcggcccacataaagaacttgacaggaactcgtgccaatgcgtctgcaaaaataagctgttcccgtcccagtgcggagcgaaccgagaattcgatgagaatacatgtcagtgtgtctgcaagcgcacttgccctagaaaccagccactcaatccaggcaagtgcgcgtgcgagtgtactgagtccccccagaagtgcctactaaaagggaaaaagtttcatcatcagacctgctcctgttatagacggccatgcaccaaccgccagaaggcctgtgaaccaggcttcagctattcagaagaagtctgccggtgcgttcctagctactggaagcgacctcagatgatgtca

SEQ ID NO: 20954 - DNA, 1260 bp, Artificial Sequence
  Description of Artificial Sequence: Synthetic coding sequence
atgcatctgcttggattcttttcagtggcttgcagcctgttggccgcggccctcctgccgggtccacgggaagcaccggcagcggcagctgctttcgagtccggcctggatctgagcgacgccgaaccggacgccggagaggcgaccgcatacgcaagcaaggatctcgaggagcagctgcggagcgtctccagcgtggatgagctgatgacggtgctgtacccggagtactggaagatgtacaaatgccaacttaggaaaggcggctggcagcataatagagagcaagccaacctgaattcccgtaccgaagagactattaagttcgcggcggcacactacaataccgagatccttaagagcatcgataatgaatggcgcaagactcagtgcatgcctcgggaagtgtgcatcgacgtgggaaaggaattcggtgtggccaccaacaccttctttaagccgccgtgcgtgagcgtgtaccggtgcggagggtgctgcaactcagaagggctgcaatgcatgaacaccagcacttcctacctgtccaagactctgttcgagatcactgtgccactctcgcagggacctaagccagtcactatctccttcgcgaaccatacttcgtgccgttgtatgtctaagttggatgtctaccggcaagtccactccatcatccggcgctcgctgccggccactctcccacaatgccaggccgcgaataagacctgtcccacgaattacatgtggaataatcacatctgccgctgccttgcgcaagaagatttcatgttcagctcggatgctggagacgactcaactgacggatttcacgacatttgcggaccgaataaagagctcgacgaggagacgtgccagtgcgtgtgcagagcaggcctccgcccagcctcgtgcggaccacacaaggaactggatagaaattcctgccagtgcgtttgcaagaacaaacttttcccatcgcagtgtggcgcaaatcgggaattcgacgaaaacacttgccagtgcgtctgtaagcgcacctgcccacgcaaccaaccccttaacccgggaaagtgtgcctgcgaatgtactgaatccccccaaaagtgtctcctgaagggaaagaagtttcatcatcagacttgctcctgttaccggcggccttgcaccaatcgccaaaaagcatgcgaaccaggcttctcctactcggaagaagtctgccgatgcgtgccgtcgtactggaagaggccgcaaatgatgtca

SEQ ID NO: 20955 - DNA, 1260 bp, Artificial Sequence
  Description of Artificial Sequence: Synthetic coding sequence
atgcatcttcttggcttcttttccgtcgcgtgttcacttttggcagccgcgctgctgcctggtccacgcgaagcaccagcagcggctgccgcattcgaatcgggacttgatctcagcgatgcggaacctgatgccggtgaagcaaccgcctacgcgagcaaggacttggaggaacagctgcggagcgtgtccagcgtggatgagctgatgaccgtgctttaccctgaatattggaagatgtacaagtgtcaattgagaaagggtggttggcaacataacagagagcaggcaaatttgaatagccgaactgaagagactattaagtttgcagcagcacactataacactgaaattctcaagtcgatcgataacgagtggagaaagacccaatgtatgccacgtgaagtgtgtatcgacgtgggaaaggagttcggagtcgcgactaacacctttttcaagcctccgtgcgtgtcagtgtacagatgtggaggatgctgtaacagcgaaggcctgcagtgtatgaacacgtcgactagctacctgtccaagactctttttgaaattaccgtcccactgtcccaaggtccaaagccagtgaccatatccttcgccaaccatacgagctgtagatgtatgagcaagctcgacgtgtacaggcaagtgcactcaatcatccgaagatcccttccagcaactctgcctcagtgccaggcagccaataagacctgtcctaccaactacatgtggaataaccatatttgtcgttgtcttgcccaggaagatttcatgttctcgtctgacgcaggcgatgattccactgacggatttcatgatatctgcgggccaaacaaagaattggatgaagagacttgtcagtgtgtctgtcgggcagggctcagacctgcatcttgtggaccccataaggaactcgataggaattcgtgccaatgtgtctgtaagaataaactgtttccatcacagtgtggtgcgaaccgagaatttgacgaaaacacctgtcagtgtgtatgtaaaagaacttgtccgcggaatcaaccactcaaccctgggaagtgtgcatgcgaatgcactgagagcccccaaaagtgccttctgaaagggaagaagttccaccatcaaacttgttcgtgttaccggcgaccatgtactaaccgccagaaggcttgcgaaccgggattctcatactcagaagaagtctgtagatgtgtgccttcctattggaaaagaccacagatgatgtcc

SEQ ID NO: 20956 - DNA, 1260 bp, Artificial Sequence
  Description of Artificial Sequence: Synthetic coding sequence
atgcatcttcttggtttcttttcagtggcctgttcactgttggccgcggcacttctgcccggacctagagaagctcccgcagcagcggcagcatttgaaagcgggcttgatctttccgacgccgaacctgacgcaggtgaggcaactgcatacgcatcgaaggatcttgaggaacagttgcgatcggtgtcctccgtcgatgaactgatgacggtcctgtaccctgagtactggaagatgtacaagtgtcaacttaggaagggcggatggcagcacaacagggaacaagccaacctgaattcacgcaccgaagaaaccataaagtttgcagcagcacattacaacaccgagatcctcaaatcaattgacaacgagtggcggaaaactcaatgtatgccgcgagaagtgtgtatcgatgtcggcaaggagtttggtgtggccacgaacacgttctttaaacctccttgcgtcagcgtttaccgatgtggaggctgttgtaacagtgagggactgcagtgtatgaacacctccacttcctacctcagcaagactctctttgagatcacggtcccactgtcccaaggccctaaacctgtgactatatcgtttgcaaatcacacttcatgccggtgtatgagcaagttggacgtgtaccgccaggtccactccatcataagacgcagcctgcctgccactttgccccaatgtcaagcagcaaacaaaacgtgccctaccaactacatgtggaacaaccacatttgtagatgtctggcacaagaggatttcatgttctcatcagatgcaggtgatgatagcaccgatggatttcacgatatttgcggaccaaacaaggagcttgatgaagagacttgtcagtgtgtgtgcagagccggacttaggccggcttcctgtggaccgcataaggaacttgacagaaatagctgtcaatgcgtctgtaagaacaaactgtttccttctcagtgcggagcaaatcgggagttcgacgagaatacttgtcaatgtgtctgcaagcgcacctgcccacgaaatcagccccttaatcctggcaagtgtgcatgtgagtgtaccgaatctccccagaagtgtctgcttaagggaaagaaatttcaccatcaaacttgctcgtgctacagacgtccttgtaccaatagacaaaaggcgtgcgagccaggattctcctacagcgaggaagtgtgtagatgtgtcccatcctattggaaacgacctcaaatgatgagc

SEQ ID NO: 20957 - DNA, 1260 bp, Artificial Sequence
  Description of Artificial Sequence: Synthetic coding sequence
atgcatctgctcggtttcttctccgtggcatgttcgctgttggccgcagccctcctgcccgggcctagagaagctccggccgctgccgccgcgtttgaatcaggcctggatctttccgacgcggaacctgatgcgggagaggcgaccgcatacgcctcgaaggatcttgaggagcagctgcgctccgtctcatccgtcgatgagcttatgacggtgctgtacccagagtattggaagatgtacaagtgccaactgaggaagggaggatggcaacacaaccgcgagcaagcgaatctcaattcgcggaccgaagagacgattaagttcgccgcggcgcattacaacactgaaatcctcaagtccatcgataacgaatggaggaaaacccaatgcatgccgcgagaagtgtgcatcgatgtcggaaaagagttcggagtggccacgaatacctttttcaaaccgccttgcgtctcggtgtaccggtgcggcggatgttgcaacagcgagggcctccagtgcatgaacacctcgacttcctacctgagtaagaccctctttgaaatcactgtgccgctgagccagggcccaaagccagtgactattagcttcgccaaccatacttcatgccggtgcatgtcaaagctggacgtctacagacaggtgcattctatcatccggcgctcactccctgctaccctgcctcagtgccaagccgccaataagacttgcccaacgaactacatgtggaacaatcacatttgtagatgccttgcccaggaagatttcatgttctcgtcagacgcaggagatgattccactgacggcttccatgatatctgcggaccaaataaggaactcgacgaagaaacctgccaatgtgtctgccgggctggactccgccctgcatcatgcggaccgcataaggagctggaccggaattcctgtcagtgtgtgtgcaagaacaagctctttcctagccaatgcggagctaatcgggaatttgacgagaacacttgtcagtgcgtctgcaagaggacctgtccacgaaatcaaccgctgaatccaggtaaatgcgcttgtgaatgcaccgaatccccccaaaagtgcctgttgaagggaaaaaagttccatcaccagacttgctcgtgctaccgtagaccctgtactaaccggcagaaagcgtgcgaaccgggattttcgtactcggaagaggtgtgtagatgcgtcccctcgtactggaaacggccgcaaatgatgtcg

SEQ ID NO: 20958 - DNA, 1260 bp, Artificial Sequence
  Description of Artificial Sequence: Synthetic coding sequence
atgcacctgctcggcttcttttcggtcgcctgctccctccttgcagcagctctcctgcccggaccccgggaagcgccagcagcggccgcggcatttgaatcgggactcgacctgtctgatgcggaacccgacgccggagaggccactgcatacgcgtcgaaggatctggaagagcagctgcggtccgtcagctccgtcgacgaactgatgaccgtgctgtacccggaatactggaagatgtacaaatgtcagctgaggaagggcggttggcaacataacagagaacaggctaacttgaactctcgcactgaagaaaccattaagttcgcggcagcgcattacaatactgagatcttgaaatccattgataacgaatggagaaagacccagtgtatgccgcgcgaggtctgcatcgacgtgggaaaggaattcggagtggcgaccaataccttctttaagccaccgtgtgtgtccgtctaccgatgcggcggatgctgcaattcagaaggattgcaatgtatgaacacttcgacctcctaccttagcaagacgctgttcgaaataactgtgcccctttcgcaaggaccgaaacctgtcaccatctcattcgcaaaccacacttcctgccgctgcatgagcaagctggatgtttaccgccaggtgcactccatcattcggagatccctgccagcgaccctcccgcagtgccaggccgctaacaaaacttgcccgaccaactacatgtggaacaatcacatctgccggtgcctggcccaggaggactttatgttctcctctgacgctggagatgattccactgacggatttcacgacatctgcgggccgaataaggagctcgatgaggaaacctgccaatgcgtgtgtcgcgcaggacttcggccagcgtcttgcggaccacacaaagagctggacagaaattcatgccagtgtgtctgcaagaacaagctgtttccgagccaatgcggagcaaacagagaattcgacgagaatacctgtcagtgcgtctgcaaaaggacctgtccaagaaatcagccactcaatcctggtaagtgcgcctgcgaatgcactgagtcgccacagaagtgcctgctgaagggtaagaaattccatcaccagacgtgctcatgctaccgcaggccgtgtaccaatcgccagaaggcgtgtgaacctggattcagctactccgaagaagtgtgtcgctgcgtcccttcatactggaaaagaccgcagatgatgagc

SEQ ID NO: 20959 - DNA, 1260 bp, Artificial Sequence
  Description of Artificial Sequence: Synthetic coding sequence
atgcatctgcttggcttcttcagcgtggcttgctcactgctcgccgcggcgctgctgcccggacctagagaagcgccggcagccgccgcggcattcgagtccggcctggacctgtccgatgcagagccggacgccggagaagcgactgcctacgcctcaaaggacctggaggagcagctgcggtccgtctccagcgttgatgagctgatgactgtgctctaccccgaatactggaagatgtacaaatgccaactccggaaggggggatggcagcacaatagagaacaggctaatcttaattccagaactgaggaaacgatcaagttcgctgctgcccattacaacactgagatcctgaagagcatcgataacgaatggagaaaaacccagtgcatgccgagggaagtctgtatagacgtcgggaaagaatttggtgtggccactaacacgttctttaagccgccatgcgtgtcggtgtacagatgcggaggatgctgcaattcggaaggactccagtgtatgaacacttccacctcttacctgtcgaaaaccttgtttgagattactgttccgctgtcccagggtccgaagccggtgactatctcgttcgcgaaccacacctcatgtcgatgcatgtccaagctggacgtctatagacaggtccactcaatcatccggcggtcactcccggcaactctccctcaatgccaggctgctaataagacttgccctacgaactacatgtggaataaccatatctgtagatgcctcgcccaggaggatttcatgttttcctcggatgcaggcgacgatagcaccgatggatttcacgatatctgtggaccaaacaaggaactggacgaggaaacctgtcaatgtgtttgtcgggcgggactgcggcctgcaagctgcggaccccacaaggagttggacagaaactcgtgccagtgtgtctgcaagaacaaactgtttccatctcagtgcggggccaacagggaattcgatgaaaacacttgtcaatgcgtttgcaagagaacttgtccacggaatcaaccgctgaatccaggcaagtgtgcgtgcgaatgcaccgaatcgccacaaaaatgcctgctgaagggaaaaaagttccaccaccaaacctgctcctgctaccggcgcccatgcaccaatcgccagaaagcctgcgagccgggattctcgtactccgaggaggtgtgcaggtgcgtgccctcgtactggaagaggccacaaatgatgtca

SEQ ID NO: 20960 - DNA, 1260 bp, Artificial Sequence
  Description of Artificial Sequence: Synthetic coding sequence
atgcatctgctcggattcttctcagtggcatgctcactgctggcagccgccctgctgcccgggccgcgggaggcgcctgctgctgcggctgcatttgagtctggccttgacctgagcgacgcggaaccggatgcaggcgaggccactgcctacgctagcaaggacctcgaagagcagctgcgctcggtgtcgtccgtcgacgagctgatgacggtgctgtacccagagtactggaagatgtacaagtgccaattgcgcaagggaggatggcagcacaatagggagcaggcaaatctcaacagcaggacggaagaaacgatcaagttcgcagctgcacactacaacactgaaatcctgaagtcgattgataacgaatggcgcaagactcaatgtatgccgagagaagtttgtattgatgtcggaaaggaattcggagtggccacgaacacctttttcaagccgccttgcgtgtcagtgtaccgctgcggagggtgttgcaattcagaggggctgcagtgtatgaacacgtccacctcatacctgtccaaaaccctgttcgagattaccgtgcctctgagccagggaccgaaaccggtgaccatcagctttgcaaatcacaccagctgccgctgtatgtctaaactggacgtgtaccgccaggtgcactccatcatccggaggtccctccctgccacccttccgcaatgccaggcagcaaacaagacgtgtccgaccaactacatgtggaataaccacatctgtcgttgtctggcacaggaggactttatgttctcatcggatgccggcgacgattccactgacggatttcatgacatctgcggccctaacaaggaactggacgaagaaacttgtcagtgcgtgtgccgagccggcctgcgccccgcctcgtgtggaccacataaagaactggatcgcaattcatgccaatgcgtatgcaagaataagctcttcccgtcccagtgcggggctaacagagagtttgacgaaaatacttgtcaatgcgtttgcaagcgcacttgcccgcgaaaccaacctctgaatcccggaaaatgcgcgtgtgagtgtactgaatccccacagaagtgcttgttgaagggcaagaaattccatcaccaaacttgctcctgctaccggcggccgtgcaccaaccggcagaaagcctgtgagccgggtttctcctactcggaggaggtctgcagatgcgtcccatcctactggaagcgccctcagatgatgtcc

SEQ ID NO: 20961 - DNA, 1260 bp, Artificial Sequence
  Description of Artificial Sequence: Synthetic coding sequence
atgcacctgcttgggttcttctccgtcgcatgctccctcttagccgcggctctgctgccaggcccgcgggaagccccagctgcggccgctgccttcgaatcgggtctggatctgtccgatgcagaacccgacgctggggaggcaacagcatacgcctcgaaagacctggaagagcagttgcgatccgttagtagtgtggatgagctgatgacagtgctgtatcctgagtactggaagatgtataaatgccagctgcggaagggcggatggcaacataaccgggagcaggccaatcttaacagcagaactgaggaaacaattaaattcgcagctgcccattacaacaccgagatcctgaaaagcatcgacaatgagtggcggaagacccagtgtatgccacgcgaggtctgcatcgacgtgggcaaagagtttggcgtggcaacaaacactttcttcaagccaccctgcgtgtctgtgtatcgttgtggcggttgctgcaattcagagggactgcaatgcatgaacacttcaacatcatacttgtcaaagaccctctttgagatcaccgtccccctgtcccaggggcccaagccagtgactatatcctttgccaatcacacctcctgtcggtgcatgtccaaactggatgtttacagacaggtccactccatcattcgccgttctttgcctgccacactgccacagtgccaagcagcgaataagacatgccctacgaattatatgtggaacaaccacatctgccgatgcctggcacaggaggactttatgttctcatcagatgccggtgacgattccaccgatggctttcacgatatctgcggacctaacaaggagctggatgaagaaacctgccaatgtgtgtgccgggctggcctgaggcccgcctcgtgcggtccccacaaggaactggatcgcaacagttgtcaatgcgtctgcaaaaataaactgttcccttcccagtgtggggcaaatcgagagtttgatgaaaacacatgccagtgcgtatgcaagcgtacttgcccgcgcaaccagccactaaaccctggaaagtgtgcctgcgagtgcactgaatctccacagaagtgtcttcttaaaggtaaaaagtttcaccaccagacctgcagctgttacaggcgcccctgtactaacagacagaaggcatgtgagcctgggttttcatacagcgaagaagtgtgccgctgcgtcccttcgtattggaaaaggcctcaaatgatgagt

SEQ ID NO: 20962 - DNA, 1260 bp, Artificial Sequence
  Description of Artificial Sequence: Synthetic coding sequence
atgcacctgctgggatttttctcggtcgcctgctccctcctggctgcagctctgctgccaggaccgcgggaagctccagcggccgcagccgccttcgagtcaggactcgacctgagtgacgctgagcctgacgcaggagaagccactgcatacgcgtcaaaggatctcgaggagcaactgcgctcagtgtcctccgtggatgagctcatgaccgtgctgtacccagagtactggaagatgtacaagtgccagctgcggaaaggaggctggcaacataacagggaacaggcgaacctcaactcacgcactgaagaaaccatcaaattcgccgcagctcattacaacactgagatcctgaagtcaatcgataacgagtggcgcaagacccaatgcatgccgcgggaagtctgcattgatgtgggaaaagaatttggagtggcaactaacactttctttaaaccgccttgcgtctccgtgtacagatgtggcggctgttgtaactccgaaggtttgcagtgtatgaacaccagcacctcgtatttgtcgaagactctcttcgagatcactgttcctctcagccaggggccgaagccggtgaccatctcattcgctaatcatacctcctgccgctgtatgtcaaagctcgacgtgtaccggcaggtgcatagcatcatccgccgatccctcccggccacgcttcctcaatgccaagccgcgaacaagacctgcccaactaactacatgtggaacaatcacatctgccgctgtctggcgcaggaagatttcatgttcagctccgatgctggagacgattcgaccgacggtttccatgacatctgtggcccaaacaaagagctggatgaggaaacgtgccagtgcgtctgtcgggccggcttgcgcccggcgtcatgcgggccgcataaggagctggatcggaactcctgccagtgcgtgtgcaagaacaagctcttcccatcacagtgcggcgccaacagagagttcgacgagaacacttgtcagtgtgtgtgcaaacgcacctgtccgcggaaccagccgctcaaccctggaaagtgcgcatgcgaatgcactgagtcgccacagaaatgcctgctcaaaggcaagaagttccaccaccagacctgctcctgctaccgccggccctgcactaaccgccagaaagcgtgcgaaccgggtttttcatactctgaggaagtgtgccggtgcgtgccgtcatactggaaaaggcctcagatgatgtcg

SEQ ID NO: 20963 - DNA, 1260 bp, Artificial Sequence
  Description of Artificial Sequence: Synthetic coding sequence
atgcacctgctgggctttttctctgttgcttgttcccttctcgctgccgccctcttgccagggcctcgcgaagccccagccgccgccgcagcatttgagagcggtctggacctgtcagatgccgagcctgacgcaggcgaggcaaccgcatacgcgagcaaggatctcgaggaacaattgcgctccgtttccagcgttgacgaactgatgaccgtgttgtaccctgaatactggaagatgtacaagtgccaattgaggaaaggagggtggcagcacaacagagagcaggctaacctgaacagtcggaccgaggagaccatcaagtttgcggcagctcattataatactgaaatcctcaaaagcatcgacaacgagtggcgtaagacccagtgtatgccacgtgaagtttgcatcgacgtcggcaaagaattcggggtggcaaccaacacattctttaaacccccttgcgttagcgtgtatcgctgcggtgggtgttgtaacagcgagggtcttcagtgtatgaacacatccacctcctatctgtcgaagacgctcttcgagatcaccgtcccattgtctcagggacccaagcctgtcactatctccttcgccaaccacacctcttgccgctgcatgagcaagcttgatgtgtatcgccaggtccattccatcattcgccgcagcctgcctgccacccttccccagtgccaagccgccaataagacatgccccaccaattatatgtggaacaatcatatctgcaggtgcctggctcaggaggacttcatgttctcttcagatgctggcgacgattccaccgacggcttccatgacatctgtgggcctaacaaggaactggacgaagagacctgtcaatgcgtgtgccgtgcagggctgcgacccgcatcttgcggccctcataaggagcttgacaggaactcatgccagtgtgtgtgcaaaaacaaactctttccttcccaatgcggcgccaacagagaattcgatgagaacacatgtcagtgcgtctgtaagcgcacctgtcctcgcaatcaaccactgaacccaggcaaatgtgcctgcgaatgtactgaatcaccccagaagtgcctcctgaaagggaagaaatttcaccatcagacatgtagttgctatcggagaccatgtacgaaccgtcaaaaggcatgcgagcctggattctcctattctgaggaggtttgcaggtgtgttccaagctactggaaacggccccagatgatgagt

SEQ ID NO: 20964 - DNA, 1260 bp, Artificial Sequence
  Description of Artificial Sequence: Synthetic coding sequence
atgcacctccttgggttcttttcggttgcctgctccctgctggctgcagccctcctgccgggaccgcgggaggccccagcggcggcagcggccttcgaatcaggactggacctcagcgatgccgagcctgacgctggcgaagcgactgcgtacgcgagcaaggacctggaagagcagctgcggtccgtgtcatcggtcgacgaactcatgaccgtgctgtacccggagtactggaagatgtacaagtgccagctgaggaagggcgggtggcagcacaaccgcgaacaggcaaacctcaacagccgcaccgaagaaacgatcaagttcgcagccgcccactacaacacggaaatcctcaagagcatcgacaatgaatggagaaaaacgcaatgcatgccgcgggaagtgtgcatcgacgtcggaaaggaattcggtgtggctaccaacactttcttcaagccaccatgcgtctcagtgtatcggtgcggaggatgttgcaactccgaagggctgcagtgcatgaacacttccaccagctacctgagcaaaaccctgttcgagatcactgtcccgttgtcacaaggaccgaaaccggtgaccatctcgttcgccaaccataccagctgtcgctgtatgtcgaagctggatgtgtacagacaggtgcattcaatcatcaggcgctcattgcctgctacgctgccgcagtgccaggctgcgaacaagacttgtccaactaactacatgtggaacaaccacatctgccgctgcctggcccaggaggactttatgtttagctccgatgctggtgatgactccactgacggtttccacgacatctgcggaccgaataaggagctcgatgaggaaacctgtcaatgtgtgtgtcgcgccggactccggccagcttcgtgtggaccacacaaggagctggataggaactcatgtcaatgcgtgtgtaaaaacaagctgttcccctcgcagtgcggagctaacagagaattcgacgaaaatacttgtcagtgtgtgtgcaagcggacctgcccacggaaccagccgcttaatcctgggaagtgcgcatgtgaatgcaccgaatcaccacagaaatgccttctgaagggaaaaaagttccaccatcagacctgctcctgctaccgccgcccttgtacgaataggcaaaaggcctgcgaaccgggtttctcgtactctgaagaagtttgccggtgtgtgccaagctactggaaaagaccacagatgatgagc

SEQ ID NO: 20965 - DNA, 1260 bp, Artificial Sequence
  Description of Artificial Sequence: Synthetic coding sequence
atgcatctgctcggatttttttcagtggcttgctctttgctcgcggcggccttgttacctgggcctagggaagctccagccgccgcggctgcgtttgagagcggtttggatttatccgacgcagagcctgatgcgggtgaagctacagcatacgcctccaaggatttggaggaacagctgcgaagtgtctcctccgtggatgaactgatgacagtgctttacccggagtactggaaaatgtataagtgccaactgaggaaagggggatggcaacataatagggaacaggccaatctcaacagtcgcacggaggaaaccataaagtttgctgcggcacattataacacagaaatactcaaatcaatcgacaacgaatggcggaagacacagtgcatgcctcgggaggtgtgtattgacgtgggaaaggaattcggtgtggcaaccaacacatttttcaaaccaccttgtgtgtcggtgtatcggtgcggaggatgttgcaattctgaagggttgcagtgtatgaatacatctacctcttatctgtctaagaccctgttcgaaataaccgtccctctgagccaggggcctaagcccgtgactatctctttcgccaaccatacaagttgcagatgtatgtcaaagctagacgtctacagacaggtccatagcatcattaggcgctctctgcccgccaccctcccacaatgtcaagctgctaataagacctgtcctacgaattatatgtggaacaaccacatttgccgttgtttagcacaggaagactttatgtttagttcggacgctggagatgactccacagatggctttcacgatatttgtggaccaaataaggagttggacgaggaaacatgtcagtgtgtctgtcgggcaggcctccggccagccagctgcggacctcataaggagctggaccgcaatagctgccaatgcgtatgcaaaaataagctgttcccttcacagtgtggcgctaatagggagtttgacgagaacacctgccagtgtgtttgcaaaaggacttgcccccgcaaccagcccctgaacccgggaaagtgtgcttgcgagtgtactgagtcaccccaaaaatgcttgctgaaaggaaaaaagtttcaccaccaaacttgctcctgctatcgccgcccctgcacgaatcggcaaaaggcatgtgaacccggattttcctactcggaggaagtctgccgctgtgtgccctcttattggaagaggccacagatgatgagc

SEQ ID NO: 20966 - DNA, 1260 bp, Artificial Sequence
  Description of Artificial Sequence: Synthetic coding sequence
atgcatctgttgggctttttctccgtcgcttgtagccttcttgcagccgctcttctgccaggacccagggaggctcctgccgccgccgcggcgtttgagtcagggctcgatctgtcagatgccgagcctgacgcaggtgaagcaaccgcgtacgcctcaaaggatttggaagaacaactcaggtccgtgtccagcgtggatgaactcatgactgtgctttacccagaatactggaaaatgtacaagtgtcagcttcggaaagggggctggcaacataaccgcgagcaggcaaacctgaactcgcgcactgaagagacgatcaaatttgcagcagcccactacaacaccgaaattctcaaatccatcgataacgagtggaggaaaacccaatgtatgccacgggaagtgtgtatcgatgtcggtaaagagttcggagtcgctactaacaccttctttaagcccccgtgtgtgtccgtctaccgttgcggcggatgttgcaatagcgagggacttcaatgtatgaacacctcgacctcctatctgtccaagaccctttttgaaattaccgtgcctctctcgcagggtcctaagccggtgaccatctcattcgcaaatcacacctcgtgccgctgtatgagcaaactcgatgtttaccggcaagtgcactccatcattcggagatcactccctgccactctgcctcaatgtcaagcagcgaacaaaacttgtcctacgaattacatgtggaacaatcacatttgccggtgtctggcacaggaggactttatgttttcgtcggatgcaggagatgatagcaccgacgggtttcacgacatctgcggacccaacaaagaacttgatgaagagacttgtcaatgcgtctgtcgcgcggggcttcgcccagcgtcatgtgggcctcataaggaactggacagaaactcgtgccagtgtgtgtgcaagaacaagctctttccaagccagtgcggagcgaatagagaatttgacgagaatacgtgtcaatgcgtgtgtaagcgcacctgtccacgaaaccagcctcttaaccccgggaaatgtgcgtgcgaatgtaccgagagcccacagaagtgtctccttaaggggaaaaagtttcatcaccagacttgctcatgttacagacggccctgtactaatagacaaaaggcctgtgaacctggcttttcatactccgaggaagtgtgtagatgcgtccctagctattggaagcggccccaaatgatgtcc

SEQ ID NO: 20967 - DNA, 1260 bp, Artificial Sequence
  Description of Artificial Sequence: Synthetic coding sequence
atgcaccttttggggtttttcagcgtcgcctgcagcctccttgcagcagcgcttctgccaggtcctagggaggctccagctgcagcagccgcatttgaatcgggcttggatttgtccgacgcggaacctgacgcaggagaggcgaccgcatatgcatcaaaggaccttgaagagcaactcaggtccgtgagctccgtcgatgaactgatgactgttctctaccccgaatattggaagatgtacaagtgccagcttcgcaaaggagggtggcagcataatagagaacaagcaaacctgaatagcagaaccgaagaaacgatcaaattcgccgctgctcactacaacactgagattctgaaatcgattgataacgagtggcgtaaaacccaatgcatgcctcgcgaagtgtgtattgatgtcggaaaggaattcggagtggcgaccaataccttctttaagcctccatgcgtgtccgtctataggtgtggtggttgttgtaactccgagggactgcagtgtatgaatacttcgacctcctacctgtcgaaaaccttgttcgaaattacggtgcctctgtcacagggccctaaaccagtgactatatcttttgcgaaccacacctcgtgtcggtgcatgtccaagctcgatgtctaccgccaggtgcacagcataatccgacgatctctgcctgccaccctgcctcaatgtcaagccgcaaataagacttgccccaccaattacatgtggaataaccatatttgtagatgtcttgcacaagaggactttatgttttcgtccgatgcaggggacgactcaactgacggatttcatgacatttgcggccctaacaaggaattggatgaagaaacgtgtcaatgcgtctgtcgtgcagggctgcgccctgccagctgcgggccacataaggagcttgatcgtaactcgtgtcagtgtgtgtgtaagaacaagctgttcccatcccagtgtggagcgaatcgggaattcgacgaaaacacctgccaatgcgtgtgtaagagaacctgcccccgcaatcaaccccttaatccgggaaagtgtgcatgtgagtgtaccgaatctcctcaaaagtgtttgcttaaagggaaaaagtttcaccaccagacttgtagctgttaccgccgcccctgtactaatcggcaaaaagcgtgcgagcctgggttttcctactccgaagaagtctgtagatgcgtgcccagctactggaagaggccccaaatgatgtcg

SEQ ID NO: 20968 - DNA, 1260 bp, Artificial Sequence
  Description of Artificial Sequence: Synthetic coding sequence
atgcacctgctgggcttcttcagtgtagcttgtagtctgctcgctgcggcactgttacccggccctagagaagcacctgctgccgcggcggccttcgagagcggcctggacctgagtgacgccgaaccggatgccggcgaagctaccgcttacgcctcaaaggatctagaggaacagcttcgctctgtgtcgtcggtggacgagcttatgaccgtgttgtatcctgaatactggaaaatgtataaatgtcagctacgaaagggaggctggcagcataatcgtgagcaggccaacctgaattctcgaacggaggagacgataaagttcgccgctgcgcactacaacacggaaatattgaagagtatcgataatgaatggaggaaaacccaatgtatgccccgcgaggtgtgcatagatgttggaaaggaatttggcgtcgctaccaatacatttttcaaaccgccctgtgtcagcgtttatcggtgcggcggatgctgtaactcagagggactgcagtgtatgaacacttctacaagctatctcagcaaaacactctttgaaattaccgtgcctttgtcacaagggcctaagcccgttacaatctccttcgcaaatcatacctcttgcagatgtatgagcaaactcgacgtgtacagacaggtgcactctatcattcggcggagccttcccgccacattaccacagtgtcaggccgctaataaaacttgccctaccaattatatgtggaacaatcatatttgtcgatgtttggcccaggaggatttcatgttctcctcagacgccggagacgattctacagatggcttccacgacatatgcggtccgaacaaggaactggatgaggagacgtgccagtgtgtgtgccgtgcgggtcttagacccgcttcttgcggaccccataaggaactggatcgaaacagctgccaatgtgtatgtaaaaacaagcttttcccgtcccaatgcggagccaaccgggaatttgacgaaaacacatgtcagtgtgtttgcaagagaacatgccctagaaaccagcccctgaatcccggaaagtgcgcatgtgaatgcaccgagtctccacagaaatgcctgctgaaggggaaaaagtttcaccaccagacttgctcatgttaccgaagaccctgtaccaaccggcagaaagcttgtgagcccggcttttcttactccgaggaggtgtgtagatgcgtccctagctactggaaacgacctcagatgatgtct

SEQ ID NO: 20969 - DNA, 1260 bp, Artificial Sequence
  Description of Artificial Sequence: Synthetic coding sequence
atgcatcttctgggctttttctccgttgcatgcagccttttggcagcggcactgctgccaggtcctcgtgaggcgccagctgcggctgccgcgttcgagtctggtttggacttgagtgacgcggagccggacgccggcgaagctacagcatatgcgtctaaggacttggaagagcagttgcgcagcgtctcctccgtggacgagctgatgacagttctgtatccggagtattggaagatgtacaagtgccaactgcgcaagggcggctggcagcataaccgcgaacaagccaacctgaactcacgcaccgaggaaactattaaattcgccgcagcacactataataccgagatcttgaagtccattgataatgagtggcgaaagacccagtgcatgccgcgtgaggtatgcatcgacgtgggtaaagaatttggcgttgcaaccaatacttttttcaaaccaccttgcgtgagcgtgtaccgttgcggcggttgttgtaattctgagggtctgcagtgcatgaatacctcaacgtcttacctgagcaaaaccctattcgagatcaccgttcctttgagccagggcccgaagccagttacgatctcctttgcgaatcatacctcctgccgttgcatgagcaagctcgatgtttatcgccaggttcactcgattatacggcgcagtctgccagccacattacctcagtgccaggctgcgaacaaaacctgccctacaaattacatgtggaataatcacatttgccgctgtctggcgcaggaggactttatgttttcgagcgacgccggtgacgattccaccgacggttttcacgatatttgtggccctaataaggagctggacgaagagacatgtcagtgtgtatgccgcgccggactgcgccctgcctcctgcggacctcacaaggagttagatcgtaattcttgtcagtgcgtttgtaaaaacaagttgttcccaagccagtgcggggcgaaccgcgagtttgatgagaacacctgccaatgtgtttgtaagcggacctgcccgcgcaaccaaccactgaaccctgggaaatgcgcttgcgagtgtaccgaaagccctcagaaatgcctgctgaagggcaagaaatttcatcaccaaacgtgtagctgttaccgccgaccatgcaccaaccggcagaaagcctgtgagcctggcttcagctacagcgaagaagtttgcaggtgcgttccaagctattggaagcggccacagatgatgagc

SEQ ID NO: 20970 - DNA, 1260 bp, Artificial Sequence
  Description of Artificial Sequence: Synthetic coding sequence
atgcatctcctgggatttttctcagtggcttgttcgctgctggctgcagcgctgctgcctggtccacgagaggcccctgcagcagccgccgcatttgagtcaggcctcgacctgtccgatgcggaaccggatgctggtgaggcaaccgcgtacgcttccaaagatctggaggagcaactgcggtcggtgtccagcgtggatgaacttatgaccgtgctctaccctgaatactggaagatgtacaagtgccagctgcggaagggaggatggcaacataaccgggaacaggcaaatctgaattcgagaactgaagagactattaagttcgcagctgcacattacaacactgagattctgaaaagcattgacaatgagtggcggaaaacccagtgtatgcccagagaggtgtgtatcgatgtggggaaggagtttggagtggcgacgaacacctttttcaagcccccctgtgtgtcggtgtacaggtgtgggggctgctgtaactcagaaggtctgcaatgtatgaataccagcacgtcctacctttcaaaaacgctctttgaaatcactgtgccactttctcagggaccaaagcctgtcaccatttcgttcgcaaaccacacttcgtgcagatgcatgtcaaagttggatgtgtaccggcaagtgcactccatcattaggagaagcctgcccgccaccctgccccaatgtcaagccgctaacaaaacctgtcctacgaactacatgtggaacaaccatatttgcagatgtcttgcccaagaggatttcatgttctcgagcgacgcaggagatgattcgactgatggatttcacgacatttgcggtcccaacaaagagctcgatgaggagacgtgtcaatgcgtgtgtagggcaggcctcaggcctgcatcctgtggaccacataaggagctggacagaaactcctgtcaatgcgtttgcaaaaacaagttgtttccttctcaatgcggggccaaccgcgaatttgacgaaaatacctgccagtgtgtgtgcaagagaacctgtccgagaaatcagcctctcaaccccggtaagtgtgcatgtgaatgtactgaaagccctcaaaagtgcctgcttaagggcaagaaattccatcaccaaacctgttcgtgttaccgtagaccttgtacgaatagacaaaaggcctgtgaacctggatttagctactcggaggaagtctgcaggtgtgtcccctcctactggaagcggcctcagatgatgtcc

SEQ ID NO: 20971 - DNA, 1260 bp, Artificial Sequence
  Description of Artificial Sequence: Synthetic coding sequence
atgcacctgctcggcttcttttctgtggcctgctccctgctagctgcagctctgcttcctggaccccgggaggctcccgccgcggcagcggcctttgaatccggccttgacctgagcgacgctgaacccgacgccggcgaagccacagcctacgcgagcaaagatctggaagagcagctgaggtccgtttctagcgtggacgagctgatgacagtgctctatccagagtactggaaaatgtacaaatgtcagcttcggaaaggggggtggcagcataacagggaacaggcaaatctgaattccagaacggaggaaactataaaattcgccgccgctcactacaacaccgagatcctcaagtctatagataacgagtggcgcaaaacccagtgtatgccacgcgaggtctgcatagatgtgggaaaagagtttggagtggctaccaataccttctttaaaccaccatgcgtcagcgtttaccggtgtgggggctgctgcaatagtgagggtctacaatgcatgaataccagtactagctacctctccaagaccttattcgagattactgtccctctcagtcagggtccaaagcccgtgacgatctccttcgccaatcatacatcttgcagatgtatgtctaagctggatgtgtataggcaagtgcactccattatcaggcgatcccttcccgccaccctgccacagtgccaggcagctaacaaaacgtgcccaaccaactatatgtggaacaatcacatctgtcggtgtctggctcaggaagatttcatgttttcctccgacgcaggtgatgacagtactgatggcttccacgacatctgcggtcctaataaggaattggatgaggaaacatgtcaatgcgtgtgccgggccggcttgcggcctgcttcctgtggcccacataaagaactcgaccggaatagctgtcagtgcgtctgtaagaataaactgttcccctcacaatgcggggccaatcgcgagttcgatgagaacacgtgtcagtgcgtctgcaagcggacttgtccccgtaatcagccacttaatccgggaaagtgcgcttgcgaatgtaccgagtcccctcagaagtgcctactgaagggaaaaaagttccatcaccagacttgcagctgctatagacggccatgtaccaacaggcagaaggcttgtgagcccgggttcagttactccgaagaggtgtgcaggtgcgtgccgagttattggaaacgaccccagatgatgtca

SEQ ID NO: 20972 - DNA, 1260 bp, Artificial Sequence
  Description of Artificial Sequence: Synthetic coding sequence
atgcacctgttgggcttcttttcagtggcgtgttctctgctggccgccgccttgctgccgggtccgagagaagcaccggctgcagcagccgcgtttgaatcgggacttgacctctcggatgccgagcccgatgcaggcgaggccactgcgtacgcctccaaggacctggaagagcagctgcggtcagtgtcatcggtggacgaactgatgaccgtcctgtaccctgaatactggaagatgtacaaatgccagctcaggaaggggggctggcagcataaccgggagcaggccaacctgaattcaagaactgaagaaaccatcaagttcgccgccgcccactacaatactgaaatcctcaaaagcattgataacgagtggcgtaagactcagtgcatgccgagagaagtgtgcattgacgtgggaaaagaattcggagtggcgaccaatacgtttttcaagccgccttgcgtgagcgtgtaccggtgcggaggttgctgcaattcggaaggactgcagtgcatgaacacgtccacttcatacctgtccaaaactctcttcgagatcaccgtgccactgtcccaaggcccaaagccggtgaccatctccttcgcgaaccatacttcgtgcaggtgtatgtcgaagctcgacgtctaccgccaagtgcacagcatcatccggagaagcctcccggccaccctgccgcaatgccaagcggccaacaagacttgcccaactaattacatgtggaataaccatatctgcagatgtctggctcaggaagatttcatgttttccagcgacgccggagatgactccactgacgggtttcacgatatctgcggcccgaacaaagagttggatgaggagacttgccagtgcgtgtgcagggcaggactcagaccggccagctgtggcccacataaggagctggaccgcaattcatgccaatgtgtctgcaagaataagctcttcccgtcacagtgcggggcaaacagggaatttgatgaaaacacctgccagtgtgtgtgtaagcgcacttgccccaggaatcaaccgctcaacccgggtaagtgcgcgtgcgagtgcaccgaatcaccgcagaagtgcttgctgaagggaaagaagtttcaccaccaaacctgctcgtgttacaggcggccctgcaccaatagacagaaagcgtgtgaacctggattctcatactccgaggaggtgtgccgctgtgtcccaagctactggaagcggcctcagatgatgtcc

SEQ ID NO: 20973 - DNA, 1260 bp, Artificial Sequence
  Description of Artificial Sequence: Synthetic coding sequence
atgcacctgcttgggtttttctctgtggcatgtagccttcttgctgcagctctgctgccagggcccagggaggccccagcagccgccgccgcctttgagagcggactggatctgagtgacgctgagcccgacgcaggtgaggctacagcctatgcttctaaggacttggaggagcaactcaggtctgtgagcagtgtcgatgaactgatgactgtattgtacccggagtactggaagatgtacaagtgccagctgcggaagggcggatggcagcataatcgggaacaggccaaccttaactcaaggaccgaagaaaccatcaaatttgccgccgctcactataacactgaaattctcaaaagcatcgacaacgaatggaggaagactcaatgcatgccgagagaagtgtgtatcgatgttgggaaggaattcggtgtagccacgaatacattctttaagcccccctgcgtcagcgtataccgatgcgggggttgctgtaactccgaagggctgcagtgcatgaacaccagcactagctacctgagtaagacacttttcgagataacagttcctctgtctcagggcccgaagccggtgacaatctcattcgctaaccatacctcttgtaggtgtatgagcaaactggacgtttataggcaggtgcactcaatcatccgacgcagtcttccggccactctgccgcagtgccaggctgcaaacaaaacatgtcccacaaactatatgtggaacaatcacatctgtagatgccttgctcaggaagacttcatgttctcttccgacgctggggacgactccacagatggtttccatgatatttgtgggcctaataaggagctggacgaagagacttgtcaatgtgtttgtagagctggtctcagaccggcctcttgcggaccacacaaggagctcgataggaattcctgccagtgcgtgtgcaagaataagctgttcccgagccagtgcggggccaatcgcgaattcgacgagaatacttgccagtgcgtgtgcaagcgaacttgtcccagaaatcagcccctgaaccccggaaaatgtgcgtgtgaatgcacagaatcacctcagaaatgcctgctgaagggcaaaaagtttcaccatcagacctgctcctgttatagaagaccctgtaccaacaggcagaaggcctgcgaacccggtttcagctatagcgaagaggtatgtcggtgtgttccaagttactggaaaaggcctcagatgatgtct

SEQ ID NO: 20974 - DNA, 1260 bp, Artificial Sequence
  Description of Artificial Sequence: Synthetic coding sequence
atgcatttactaggttttttttcggtagcgtgttcgttattagcggcggcgctattaccgggtccgcgtgaagcgccggcggcggcggcggcgtttgaatcgggtctagatctatcggatgcggaaccggatgcgggtgaagcgacggcgtatgcgtcgaaagatttagaagaacaattacgatcggtatcgtcggttgatgaattaatgacggtattatatccggaatattggaaaatgtataaatgtcaactacgtaaaggtggttggcaacataatcgagaacaagcgaatttaaattcgcgaacggaagaaacgataaaatttgcggcggcgcattataatacggaaatattaaaatcgatagataatgaatggcgaaaaacgcaatgtatgccgcgtgaagtatgtatagatgttggtaaagaatttggtgtagcgacgaatacgttttttaaaccgccgtgtgtatcggtttatcgttgtggtggttgttgtaattcggaaggtctacaatgtatgaatacgtcgacgtcgtatctatcgaaaacgttatttgaaataacggttccgttatcgcaaggtccgaaaccggtaacgatatcgtttgcgaatcatacgtcgtgtcgatgtatgtcgaaattagatgtatatcgtcaagtacattcgataatacgtcgttcgttaccggcgacgttaccgcaatgtcaagcggcgaataaaacgtgtccgacgaattatatgtggaataatcatatatgtcgttgtctagcgcaagaagattttatgttttcgtcggatgcgggtgatgattcgacggatggttttcatgatatatgtggtccgaataaagaactagatgaagaaacgtgtcaatgtgtttgtcgtgcgggtttacgtccggcgtcgtgtggtccgcataaagaattagatcgtaattcgtgtcaatgtgtatgtaaaaataaactatttccgtcgcaatgtggtgcgaatcgtgaatttgatgaaaatacgtgtcaatgtgtttgtaaacgaacgtgtccgcgaaatcaaccgttaaatccgggtaaatgtgcgtgtgaatgtacggaatcgccgcaaaaatgtttactaaaaggtaaaaaatttcatcatcaaacgtgttcgtgttatcgacgaccgtgtacgaatcgacaaaaagcgtgtgaaccgggtttttcgtattcggaagaagtttgtcgatgtgtaccgtcgtattggaaacgaccgcaaatgatgtcg

SEQ ID NO: 20975 - DNA, 1260 bp, Artificial Sequence
  Description of Artificial Sequence: Synthetic coding sequence
atgcatctgttaggcttcttctcagtagcttgctccctgcttgccgctgcccttctccccggcccccgcgaggcgcccgctgcggcagccgcatttgagtctggacttgatctgtccgatgctgaacccgacgccggggaggccaccgcctatgccagcaaggatttagaagaacagttgcgaagcgttagtagcgtcgacgagctgatgacagtactgtacccagagtactggaaaatgtataaatgtcaactgaggaagggaggctggcagcacaatcgagagcaggcgaatctgaattcccgtacggaggagacaattaagttcgctgctgcacactacaacacagagatactcaagagcattgacaatgaatggagaaaaactcagtgcatgcctagagaggtgtgtatcgacgtgggcaaggagtttggcgtcgctactaatacttttttcaaacccccatgtgtgtccgtctacagatgtggcgggtgttgcaactctgagggcctacagtgtatgaatacctccacttcctatctttcgaaaactctcttcgaaattactgtgcccctgtcacaaggacccaaaccggtgacaataagttttgccaaccacactagttgccgctgcatgtccaaactggatgtttaccgccaggtgcattcaataatccggagaagtctgcccgcgactctcccacagtgtcaggcagctaataaaacatgcccaacgaactacatgtggaacaaccacatttgccgttgcttagcccaggaggacttcatgttctcctccgacgctggcgatgactccacagacggatttcatgatatttgtgggcccaacaaggagctggatgaggagacctgccagtgcgtttgtagggccggcctgcgtcccgcctcctgcggccctcacaaagagctagatcgtaatagctgccagtgcgtttgtaaaaacaaactatttccctcccaatgcggtgcgaatagggagtttgatgaaaacacctgccagtgtgtctgcaaacgtacgtgcccccggaatcagcctttgaatccgggtaagtgcgcctgcgaatgtacagagtcaccccaaaagtgtctgttgaaggggaaaaagtttcaccatcaaacctgcagttgttataggcgcccgtgtacaaaccgccagaaagcctgcgaaccagggttttcctacagcgaggaagtgtgtcgatgtgtcccctcttattggaagcgccctcagatgatgtcc

SEQ ID NO: 20976 - DNA, 1260 bp, Artificial Sequence
  Description of Artificial Sequence: Synthetic coding sequence
atgcatttattggggtttttctctgtggcgtgttctttgttagccgccgcccttctgccaggacccagggaggcgcctgccgccgctgctgcgtttgagtccggtttggatttgagcgatgctgagccggacgccggcgaggccacggcttacgctagcaaggacctcgaagagcagctgcgcagtgtttcctcagtcgacgaacttatgacggtcctgtaccctgaatattggaaaatgtataagtgtcagttgcggaagggagggtggcaacataaccgcgagcaggctaacctgaattccaggaccgaagagacaatcaagttcgcagccgctcactacaataccgaaattctcaaatccattgacaatgagtggcggaagacacaatgtatgccacgcgaggtgtgcatcgacgttggtaaggagttcggggtagctactaatacctttttcaagccaccttgcgtttccgtttacaggtgcggaggatgctgtaattcagagggcctgcagtgtatgaatacctctacttcttatctcagcaaaactctgttcgagattacggtgccgctctcacagggacccaagccagttactatttcttttgccaaccacaccagctgccgctgtatgtcaaagctggatgtgtacagacaggtacatagcataatccgcaggtcacttccggcaactcttcctcaatgccaggcagccaacaagacgtgtccaactaactacatgtggaataatcacatatgtaggtgtctggctcaggaagactttatgttttcctcagacgccggtgacgatagcactgacgggtttcacgatatctgcggccctaataaagaattggatgaggagacctgtcagtgtgtgtgcagggctggattgcggcctgctagctgcggtcctcacaaagagctggatcggaactcttgccagtgcgtgtgtaagaataaactattcccttcccaatgtggcgccaacagagagtttgatgaaaacacctgccagtgcgtctgcaagaggacatgccctagaaaccaacctctcaatcccggcaaatgtgcgtgcgagtgcacggagagccctcaaaaatgcctcctgaagggaaagaagtttcatcaccaaacatgttcctgttatcggcgcccatgtacgaatcgacagaaggcctgcgagcccggcttctcctattcagaagaagtgtgcaggtgcgtcccaagttattggaaacggccccagatgatgagc

SEQ ID NO: 20977 - DNA, 1260 bp, Artificial Sequence
  Description of Artificial Sequence: Synthetic coding sequence
atgcatctgctgggattcttttcggtcgcgtgctcactcctggccgccgctctgctcccgggaccacgcgaagcccctgccgccgccgcagcctttgagtcagggctggacctctcggatgcagaaccggatgccggtgaagcgacggcgtacgcttccaaagacctcgaggagcagctgcggtccgtctcgtctgtggacgagctgatgaccgttctctacccagaatattggaagatgtacaagtgccagctgcggaaggggggctggcagcacaatcgggagcaagcgaatcttaattcgagaaccgaggaaactatcaagttcgccgcagcacattacaatactgagatccttaagtcaattgataacgaatggagaaagacccaatgcatgcctcgggaagtgtgcatcgatgtgggtaaggagttcggagtcgctacgaatactttcttcaagcctccctgtgtgtcggtgtaccgctgcggagggtgttgtaattccgaaggtctgcaatgcatgaacacctccacctcttatctgtccaaaaccctcttcgaaatcactgtcccactgtcacagggcccaaaaccggtgactatctcattcgctaatcacacgtcgtgcaggtgtatgagcaagctggacgtttaccggcaggtccattcgattatcagacggagcctgccggccacgctcccgcagtgccaggccgcaaacaagacctgcccgaccaactacatgtggaacaatcatatttgtagatgcctggcacaggaggactttatgttctcatcggacgcgggggatgactctactgatggctttcacgacatctgcgggccaaacaaagagcttgatgaagaaacctgccaatgcgtgtgccgcgctggcctccggccggctagctgcggaccgcacaaggagctggacagaaattcctgccagtgcgtgtgcaagaacaagctgttcccttcgcagtgcggagctaacagagaattcgacgaaaatacctgtcagtgtgtgtgtaaaagaacttgcccgcggaaccaaccactgaatccgggaaagtgcgcttgcgaatgcactgagtcgccacaaaagtgtttgttgaagggaaagaaattccatcatcagacttgttcatgctacagacggccatgcactaaccgccaaaaagcgtgcgaaccgggattttcgtactccgaggaggtgtgtcgttgtgtgccgagctactggaaacgacctcagatgatgtcg

SEQ ID NO: 20978 - DNA, 1260 bp, Artificial Sequence
  Description of Artificial Sequence: Synthetic coding sequence
atgcatctcctgggctttttcagcgtagcatgttcgctccttgcagcagcgctcctgccgggacccagagaggcgcctgctgcagcggcagcctttgaatcaggtcttgatctgtcggatgcggaaccggatgccggagaggcgaccgcatacgcatcgaaagacctggaagaacagctgcgttccgtctcgtcagtggatgagctgatgaccgtgctgtatcctgagtactggaagatgtacaaatgccaacttcgcaagggtggttggcaacataaccgagagcaggcaaatcttaactcgagaactgaagaaactatcaagtttgccgcagcgcactacaataccgagattcttaaaagcattgacaacgaatggaggaaaacccagtgcatgcctagagaagtgtgtatcgatgtcgggaaagaatttggtgtggcaaccaatacctttttcaagcctccctgtgtctcggtctaccgatgcggcggttgctgcaatagcgaaggtctgcagtgcatgaacacgtcgacttcatacctttcaaagaccctgtttgaaattactgtgccgctctcccaaggaccgaagccggtgaccatctcctttgcgaatcacacgtcgtgtaggtgtatgtccaagctcgacgtgtaccggcaggtccatagcataatcagacgttcgcttccagcaacccttccacaatgtcaagcggcaaacaaaacctgcccaaccaactacatgtggaacaaccacatttgtagatgtcttgcacaagaggactttatgtttagctcggatgctggagatgattcgaccgatggtttccatgatatttgtggaccaaacaaagaactggatgaagagacttgtcagtgcgtctgtagagcaggccttcggcccgcatcgtgcggtccgcataaggagctggatcgaaatagctgtcaatgcgtgtgcaaaaacaagctgtttcctagtcaatgtggagcaaaccgagaattcgatgaaaatacctgtcaatgtgtgtgtaaacggacttgcccacggaaccagcctctgaaccctgggaagtgtgcatgcgagtgtactgagtcaccacagaaatgccttcttaagggaaaaaagtttcatcatcagacgtgctcatgttaccgccgcccttgtacgaatcgccaaaaggcatgcgaacccggattctcctactcggaagaagtgtgcaggtgtgttccttcatactggaaacgccctcagatgatgtcc

SEQ ID NO: 20979 - DNA, 1260 bp, Artificial Sequence
  Description of Artificial Sequence: Synthetic coding sequence
atgcacctgctgggattcttttccgtagcctgttcactactggcagccgcgctactgccaggacccagagaagcacccgccgcggccgctgcctttgaatctggactggacctgtcggatgccgagccagacgccggcgaagccacagcttacgcatccaaggatctcgaggagcaacttaggtccgtaagctccgttgacgaactaatgaccgtgctctaccccgagtactggaaaatgtataaatgccagctccgaaagggggggtggcagcacaacagggaacaagctaacctgaacagcaggacagaggagactatcaagtttgcggccgctcattataatactgagattcttaagagcattgataacgaatggcgcaagacgcagtgcatgccacgggaggtgtgcatcgacgtgggcaaggagtttggcgtcgccacaaatactttttttaagccaccgtgtgttagcgtgtatcgatgtggcggctgttgcaattcagaagggctccagtgtatgaatacaagcacgtcttacctcagcaaaacactcttcgaaatcaccgttcccctgtctcagggccccaagcctgtcacgatttcctttgcaaatcacacaagctgtaggtgcatgtcaaaattggatgtgtatcgccaagtccacagcattatcagaagatctctaccagcaacactgcctcaatgccaggcggctaataagacctgtccaactaactacatgtggaacaatcatatctgtcggtgtctggctcaggaggatttcatgtttagttccgacgctggagacgacagcacggacggcttccacgacatctgtgggcctaacaaagaactggatgaagagacatgccaatgtgtatgtcgggctggcctgcgtcccgcatcgtgtggcccacacaaggagcttgataggaattcctgccagtgcgtttgtaaaaacaaactcttcccgtctcaatgtggtgctaaccgtgaatttgacgagaacacttgtcagtgcgtgtgcaagcggacgtgtccaaggaatcagcccctgaatcccggtaagtgcgcctgcgagtgcacagagagccctcagaagtgtctactcaaggggaagaaattccatcaccagacatgttcctgctatcgccgcccatgcactaacagacaaaaggcttgcgaacccgggttttcgtatagcgaggaggtctgtcgctgtgttccatcttattggaaaagaccacaaatgatgtcc

SEQ ID NO: 20980 - DNA, 1260 bp, Artificial Sequence
  Description of Artificial Sequence: Synthetic coding sequence
atgcatctgctaggattcttcagcgtcgcctgtagcctactggccgcggctctcctgcccggaccccgggaagctcccgccgccgcagctgctttcgagtctggcctagacctgagcgatgccgaacccgacgctggcgaagcaacggcctatgcttctaaagatcttgaagagcaacttcgctctgtgagtagcgtggatgagttgatgaccgtgttgtaccctgaatactggaagatgtataaatgccaactgaggaagggaggttggcaacacaaccgggaacaggccaacctcaactctagaacagaggagaccataaagtttgccgctgcacattacaacactgagattctgaagtccatagacaacgaatggagaaaaacacagtgcatgccgcgggaggtgtgtattgatgtgggtaaagagttcggggtggccaccaacactttttttaaaccaccgtgtgtttctgtgtaccgttgcggagggtgctgcaatagcgagggtctgcagtgcatgaacacctcaacttcctatctttccaaaacgctcttcgagatcaccgtcccactatcgcagggtccaaaacccgtgacgatatccttcgctaatcacacttcttgccgatgcatgtccaagctggatgtttaccggcaggtgcacagtatcataaggaggtcattgcccgctactctccctcagtgtcaagccgcgaataagacgtgcccgaccaactacatgtggaacaaccacatttgcagatgcttggcccaggaggatttcatgttttcctcagacgcaggcgatgattccacagacggcttccacgacatttgtggcccgaataaagagctcgacgaagagacatgtcagtgcgtttgtcgagccggcctgcgacccgcaagttgcggtccacacaaggagttagaccggaactcttgccagtgcgtatgcaaaaataaactctttccatcacagtgcggggccaatagggagtttgatgaaaacacgtgccagtgtgtctgtaagcgtacgtgcccacgaaatcaacctctgaacccaggcaagtgcgcctgcgaatgtaccgagagcccccagaagtgtctattgaagggtaaaaaattccaccatcagacatgttcctgttaccgcaggccatgtaccaaccgccagaaggcctgcgagccagggtttagttactcagaagaagtgtgtagatgtgtgccttcttattggaagcggccacaaatgatgagc

SEQ ID NO: 20981 - DNA, 1260 bp, Artificial Sequence
  Description of Artificial Sequence: Synthetic coding sequence
atgcatctgctgggattcttctcagtcgcatgttcactcctcgctgccgctctactacctgggccacgcgaagcaccagccgctgccgccgcattcgagagtggtctcgacttgtccgacgccgagcctgatgctggagaagctaccgcttacgctagtaaggacttggaagaacaactgcgatctgtgtcatccgtagacgagttgatgacggttctgtacccagaatactggaagatgtacaagtgccagcttcgaaaagggggatggcagcacaacagagagcaggcaaatttgaattcaagaactgaggagaccattaagtttgcagccgctcactataatacggaaatccttaagtccatcgacaacgaatggcgtaagactcagtgtatgccccgcgaggtatgcattgatgtgggcaaagagtttggcgtcgccacaaacactttttttaaacccccctgcgtgagcgtgtaccggtgcgggggatgttgtaactcagagggattacagtgcatgaacacttccacttcctatttgtccaaaactctcttcgagataacagtgcctctcagtcaggggccaaaacccgtcaccatctccttcgctaaccatacttcttgcaggtgtatgtctaaattagacgtgtaccgacaggtccactccatcatcaggagatctctacctgccaccctgccccagtgccaggcagctaacaagacttgtcccacaaattacatgtggaacaatcacatatgcagatgtctggctcaggaagattttatgttctcgtccgacgctggagatgactccaccgacggttttcatgacatatgcgggcctaataaagagcttgacgaggagacatgtcagtgcgtttgcagggccggtttaagacctgctagttgtggtccccacaaggagcttgacaggaattcttgtcagtgcgtgtgcaaaaacaagctgttcccctcccagtgtggtgccaaccgggagttcgatgaaaatacatgccagtgtgtttgtaagaggacgtgcccaagaaaccagcccctaaaccccggaaagtgcgcatgcgagtgcacagaatctccccagaagtgtttattgaaaggtaagaagttccaccatcagacctgcagctgctaccgcagaccctgcacaaatcgccaaaaggcctgtgaaccggggttcagttactcagaagaggtgtgcagatgcgtcccgtcttactggaagcggccacagatgatgagc

SEQ ID NO: 20982 - DNA, 1260 bp, Artificial Sequence
  Description of Artificial Sequence: Synthetic coding sequence
atgcacctactaggtttctttagcgtggcatgcagcctcctcgccgccgccctccttcccgggcctcgggaagctcccgccgcggccgccgccttcgaatccggactcgatctgagcgatgccgaacctgacgccggcgaggctactgcctatgcttccaaggacttagaggaacagctcaggtccgtttcctccgtcgacgaacttatgacggtgctgtaccccgagtattggaaaatgtataaatgccagctgagaaaaggtgggtggcagcataaccgagagcaagctaatctgaattctcgcaccgaggaaacaataaaatttgcggccgcccattacaatacggagatactgaagtcaatcgacaacgagtggcgtaaaacgcaatgcatgccccgcgaggtgtgtatagatgttggtaaagagtttggcgttgctactaacaccttcttcaaaccaccctgcgtgtccgtgtataggtgtggcgggtgttgtaacagcgaggggctgcagtgtatgaatactagtactagttatcttagcaagacactctttgagataactgtacccttgtctcaggggccgaaacctgtaacaatctcatttgctaaccacacctcatgccggtgcatgagcaagctggacgtgtaccgccaggtgcactcaatcattaggcggagtctgccagccacacttccacaatgccaggccgcaaacaaaacctgtcccaccaattatatgtggaataatcacatatgccgatgcctggcgcaggaagactttatgttcagctcagatgcaggcgacgactcgaccgatggctttcacgacatatgcgggcctaacaaggagttagacgaggagacctgccagtgcgtatgcagggcgggcctcagaccagcttcctgcggccctcataaggaactggacagaaactcctgccagtgcgtgtgcaaaaataagctctttccgtcacagtgtggcgcaaaccgagaattcgacgaaaacacttgccagtgtgtgtgcaagaggacttgcccccgcaatcagccactgaaccctggcaaatgtgcctgtgagtgtacagagtcacctcagaagtgtttgctcaagggaaaaaaatttcaccatcaaacttgttcttgctacagaagaccttgtaccaatcgccagaaggcctgtgaacctggctttagctactccgaagaggtgtgtaggtgcgtgcccagttactggaaaagaccccagatgatgagc

SEQ ID NO: 20983 - DNA, 1260 bp, Artificial Sequence
  Description of Artificial Sequence: Synthetic coding sequence
atgcacctgctggggttcttttccgtggcatgcagcctcctggcagccgctttgcttcctggaccacgcgaggcgccagcggctgcggcagcgtttgaaagtggtttggacttgtcggatgcagaaccagatgccggggaggccaccgcgtatgcatcgaaggatctggaagagcaactgaggtcggtgtcgagcgtggacgaactgatgactgtgctttaccctgaatactggaagatgtacaagtgccagctcagaaagggcggctggcaacataaccgcgagcaggctaaccttaactcacgcactgaggaaactattaagttcgctgcagcacactacaatactgaaattcttaaaagtatagataacgaatggcgtaagacccaatgcatgcctcgtgaagtttgcatcgatgtgggcaaggagttcggagtggcaactaatacgttctttaagccaccgtgtgttagcgtgtacagatgtgggggttgttgcaattcagagggcctgcaatgcatgaacacttcgacctcctacctctcgaaaacccttttcgaaattaccgtcccactgtctcaaggtccgaagcccgtgacgatatcctttgcaaatcatacctcgtgtcgatgtatgtccaagctcgacgtctacaggcaagtccattccatcattagacgctcgctccctgcaacgcttccacaatgtcaggcagccaacaaaacttgcccaaccaactacatgtggaataatcacatttgcaggtgtcttgcccaagaagatttcatgttttcatcagatgcgggcgatgatagcacggacggttttcacgatatctgtggacctaacaaggagctggacgaagaaacttgtcagtgtgtatgtcgcgcgggacttcgaccggcttcctgcgggcctcataaggagctggatcggaatagttgtcaatgcgtgtgtaagaacaaacttttcccgagccagtgcggagccaaccgggagttcgacgagaacacctgccagtgtgtctgcaagagaacttgccccaggaatcagccactcaatcctggtaagtgtgcatgtgaatgtactgaatctcctcagaaatgcctccttaaaggaaaaaagtttcatcatcagacctgctcgtgctacagacgtccttgtactaaccgacagaaggcgtgtgagcctggattttcctatagcgaagaagtctgtcggtgtgtgccctcctactggaaaaggccccaaatgatgtca

SEQ ID NO: 20984 - DNA, 1260 bp, Artificial Sequence
  Description of Artificial Sequence: Synthetic coding sequence
atgcacctgctgggcttcttctctgtggcctgctcactgctggcggctgctttactacccggacctcgcgaggctccggccgcagcggccgcgttcgagtcgggactcgacctgtccgacgctgaaccggacgctggtgaggctaccgcatatgcttcgaaagacttagaagagcagctgcggtctgttagtagtgtggatgagttaatgacagtgttatacccagagtactggaaaatgtacaagtgtcagctccggaaaggtggatggcaacacaacagagagcaggcgaatttaaatagccggaccgaggaaacgatcaaattcgctgccgcgcactacaataccgaaatactcaagtccattgacaacgagtggcgcaaaacgcaatgcatgcctcgcgaagtctgcatcgacgtgggcaaagagttcggagtcgcaactaacacctttttcaagccaccttgcgtcagcgtgtacaggtgcgggggatgttgtaactctgagggtctccaatgcatgaatacctctacgagttacctgtccaagacactctttgagatcaccgtccctttaagtcaaggcccaaagccagtcacgatctccttcgctaaccacacctcgtgccgatgcatgagtaagctcgatgtgtaccgccaggtgcacagtataatcaggcggtcgctgcctgccactcttccacaatgccaagcagccaacaagacatgccctaccaattacatgtggaataatcacatctgcaggtgcctcgcgcaagaggattttatgttctcttctgatgccggtgacgattctaccgacggtttccatgatatttgcggtcccaacaaagaacttgacgaggaaacatgtcagtgcgtgtgcagggccggcctacgccccgcttcttgcggtccacataaggaactggatcggaattcctgtcagtgtgtgtgcaaaaataagctgtttcccagtcagtgcggtgctaaccgcgagttcgacgaaaacacctgccagtgtgtctgtaagaggacctgcccccggaatcaaccactgaaccctggtaagtgtgcctgtgagtgcacagaaagcccccagaagtgcctgctgaagggaaagaaattccaccatcagacatgctcctgctaccgccgaccctgtaccaaccgacagaaggcttgtgaacccgggtttagttactccgaggaagtttgcaggtgtgtaccctcatactggaagcggccccagatgatgagc

SEQ ID NO: 20985 - DNA, 1260 bp, Artificial Sequence
  Description of Artificial Sequence: Synthetic coding sequence
atgcacctgttaggcttcttttctgtcgcgtgtagtcttttggcggctgcactcctgcctgggccccgggaggctcccgctgcagccgcagcgtttgagtcgggcttggacctttccgacgctgaacctgatgctggggaagccacagcttacgcgtccaaggatctggaagagcagctgcggtctgtgtcttcggttgatgagcttatgaccgttttgtaccctgagtactggaagatgtacaagtgtcaattaagaaaggggggctggcaacacaaccgggaacaggcaaatctcaattcgcgtaccgaggaaaccatcaagtttgctgccgcacattacaacacggagatcctgaagagtattgacaatgaatggcgaaagacacagtgcatgcccagagaagtgtgcatagacgtcgggaaggagtttggagtggcaaccaacactttttttaaaccaccatgcgtaagtgtttaccgctgcggcggatgctgtaattccgaaggcctccaatgtatgaatacctctacatcttacctttccaagaccctctttgagatcaccgtgccacttagccaaggccctaagccggtgacgatatccttcgccaatcacacctcttgccgctgtatgtctaagcttgacgtgtatcgccaggtgcactctattattcgccgcagtttaccagccacactaccacagtgtcaggcggccaacaaaacgtgccctaccaactacatgtggaataatcacatctgccggtgtctcgcccaagaagacttcatgttctcttcagacgccggtgacgactctactgacgggtttcacgatatctgcggacccaacaaggagctcgacgaggaaacctgtcagtgcgtttgtcgggccgggcttcgtccagccagctgtggcccacataaagaattggaccggaatagttgtcagtgcgtctgcaaaaataagctcttcccttcacagtgtggagcaaaccgtgaatttgacgagaatacgtgccaatgcgtgtgcaaacgtacttgcccaagaaaccagcccctgaacccaggaaaatgtgcgtgcgagtgtacagagagcccccagaagtgtttgttaaaggggaaaaagtttcaccaccagacctgctcttgttataggcggccatgcaccaatcgtcaaaaggcctgcgagcccggctttagctactccgaggaggtgtgccggtgcgtgcctagctactggaaacgaccacagatgatgagc

SEQ ID NO: 20986 - DNA, 1260 bp, Artificial Sequence
  Description of Artificial Sequence: Synthetic coding sequence
atgcacctactgggattcttttccgtggcttgttctttgctggctgccgccttgctccctggacctcgggaagcgccagcagctgcggctgcatttgagagcggtctggacttaagtgacgccgagccggatgcaggagaagccacagcttacgcctctaaggatttggaggaacaattgagaagcgtatcatctgtcgatgagcttatgaccgttctttaccccgagtactggaagatgtataagtgccaacttcgcaaggggggttggcagcacaatcgggaacaggcaaatctgaactctcgcacagaagagacaataaagttcgctgccgcacattacaacactgagattctgaaaagtatagataacgagtggcgaaagactcagtgcatgccaagagaggtctgcattgacgtgggaaaggagttcggggttgctaccaacacattttttaagcctccctgcgtgagcgtgtatcgctgtggaggatgttgtaacagcgaaggtcttcagtgtatgaacacaagcaccagctatttgtcgaagaccctatttgagataacggtgccactatcccaggggcctaagcccgtgaccataagttttgcaaaccacaccagctgtagatgtatgtctaagctggatgtatacaggcaagtacatagtatcatccgaaggtctctgcctgccaccttgccccagtgccaagcagctaataagacctgccccaccaattacatgtggaacaaccacatttgtagatgcttggcacaggaagactttatgttttcctctgatgcaggggatgattccacagacggcttccacgatatctgtggccctaacaaagaacttgatgaagagacttgtcagtgcgtttgcagagccggccttaggcccgcatcctgtggcccgcataaagagctggacagaaacagctgtcagtgtgtgtgtaagaataaattgtttccgtctcagtgtggggctaatcgagaattcgacgagaacacgtgccagtgcgtgtgcaaaaggacttgtccaagaaatcaacctctgaaccctgggaaatgtgcttgcgagtgtacagaatccccccagaagtgccttctgaaaggaaagaagtttcatcaccaaacttgtagctgttatcggcggccctgcaccaatcggcagaaggcctgcgagcctgggttctcatatagtgaggaagtatgcaggtgtgtcccttcttactggaagcggccccagatgatgagt

SEQ ID NO: 20987 - DNA, 1260 bp, Artificial Sequence
  Description of Artificial Sequence: Synthetic coding sequence
atgcatttgctgggctttttttccgttgcctgttcgctgctcgcagctgccctgctgccaggcccgcgggaagcaccagctgccgccgctgcttttgagtccggcttggacctttctgacgccgaaccagacgctggcgaagctacggcttacgcctctaaagatctggaagaacagctgcggtcagtgtctagtgttgacgagctcatgactgttctctacccagaatactggaaaatgtacaaatgccaattgagaaagggcggatggcagcataatagggagcaggccaacttaaactcaagaactgaagaaactataaagttcgccgctgcccattacaacactgaaattctaaaatccatcgacaacgaatggaggaaaacccagtgcatgcccagagaggtttgtattgatgtgggtaaagaattcggtgtcgctacaaatacatttttcaaacccccgtgtgtatcagtgtatagatgcggcggctgctgtaactcagagggcttgcagtgtatgaatacgagtaccagctacctgtccaagactctgttcgaaatcacagtacctctgtctcaagggccgaaacccgtcacgatcagctttgctaaccacactagctgccgttgtatgagtaagctcgatgtgtacaggcaggtacactccatcattcggcggagcctgcctgcgaccctgccccagtgccaggcggcaaataagacttgccccacaaattacatgtggaataaccacatatgcagatgcctggcacaggaagacttcatgttcagctctgatgctggggatgattccacagatgggtttcatgatatatgcgggccaaataaggagctcgatgaagagacgtgtcagtgcgtttgtcgagcgggtctgcgccctgcctcttgtggcccgcataaggagctggatcgcaactcttgccagtgtgtttgcaagaataaactgttccccagtcagtgtggcgctaatcgggagtttgacgaaaatacatgccaatgcgtgtgtaaacgtacctgccctagaaatcagccactgaaccccggtaagtgtgcttgcgagtgtaccgagagtccacaaaaatgcttgctaaaaggcaagaagtttcaccaccagacttgttcatgctacaggaggccctgcacgaataggcagaaggcctgcgagcctggcttttcttactccgaagaggtgtgtcgatgcgttcccagttactggaaacgaccacaaatgatgagc

SEQ ID NO: 20988 - DNA, 1260 bp, Artificial Sequence
  Description of Artificial Sequence: Synthetic coding sequence
atgcacttgctgggcttctttagcgtcgcctgctctctgctcgcagcagccctactgcctggtcccagagaggccccagctgcagcagccgcctttgagagcggactggatttatctgacgcggaaccagacgctggcgaagcaacagcctacgccagcaaagacctggaggaacaactgagatcagtctctagtgtcgacgaactcatgaccgtgttgtaccccgagtattggaagatgtataaatgccagctgaggaaaggcggctggcaacacaaccgagaacaagcgaatttgaatagccgtacagaggaaaccattaagtttgccgctgcgcactacaatactgagatcctcaagtctattgacaacgaatggcggaaaacccagtgtatgcctcgcgaggtctgtattgacgtcgggaaggagttcggtgtcgcaacaaatactttctttaaacccccctgtgtgtccgtttatcgctgtggaggatgctgcaactcggagggactgcagtgtatgaacacctctacttcctacctgagtaaaacactatttgagataactgtgccactctctcagggacccaaacctgtgaccatatctttcgctaatcatactagctgcaggtgtatgtctaagttagacgtgtatcggcaggtccactcaatcatcaggcgctctctgcccgcgacacttccccagtgccaggcagcaaacaaaacctgtcccaccaactacatgtggaacaaccatatatgcagatgcttggcccaagaggacttcatgttcagtagtgacgccggcgatgactcgaccgacgggttccatgatatctgcggcccaaataaggaattggacgaggagacatgccagtgtgtctgccgtgctggactgcgtccggcctcctgtggccctcataaggaacttgaccgaaatagctgccagtgcgtgtgtaagaacaaactgttcccttctcagtgcggggccaatagggagtttgatgaaaacacctgccagtgtgtctgtaagaggacatgtcccaggaatcagcctttgaatccaggaaaatgtgcctgcgagtgcacagagtcgccccagaagtgcctgcttaagggaaaaaaatttcaccatcagacttgctcgtgttatagaaggccgtgtactaaccggcagaaggcctgtgagcccggcttcagctacagtgaagaggtgtgcaggtgtgtgcccagctactggaagaggccacagatgatgtct

SEQ ID NO: 20989 - DNA, 1260 bp, Artificial Sequence
  Description of Artificial Sequence: Synthetic coding sequence
atgcatctcttgggattcttcagcgtggcatgctcactgctggcggctgccttgctgccagggccgagagaagcgcccgcggctgcagctgcattcgagtcgggtctggacctgtccgacgccgagccagatgctggagaggcaaccgcatatgcttccaaggatctggaggagcaactgcggagcgtgagctcagttgatgaactcatgaccgtcctgtacccggaatactggaagatgtacaaatgccagctgcggaaagggggatggcagcacaaccgcgagcaagccaatctgaactcgcgcactgaagaaaccatcaagttcgctgctgcccactacaatactgagatcctgaagtcaatcgacaacgaatggcggaaaacccagtgtatgccgcgtgaagtgtgtatcgatgtggggaaggagttcggagtggctaccaacaccttctttaagcctccctgcgtgagcgtgtaccgctgtggcggatgctgtaactcggaggggctccagtgtatgaataccagcacttcctacttgtctaagaccttgttcgagatcacggtgccactttctcaaggaccaaaaccggtcaccatctcctttgcaaaccacacttcgtgccggtgtatgagcaaattggacgtgtaccggcaggtgcactcgattattcgccggtccctccctgccaccctgccacaatgccaggcagcgaataagacctgccctactaactacatgtggaacaatcatatctgccgctgtttggcccaagaagatttcatgttttcatcggatgcgggcgacgactcgactgatggattccatgacatctgcgggccgaacaaggaactcgatgaagaaacttgccagtgtgtgtgccgggcgggtctgcgcccagcgtcgtgcggtccccataaagaactggatcgcaattcctgccaatgcgtctgcaagaataagctcttcccctcgcagtgtggagcgaacagagaatttgacgagaatacgtgccagtgcgtttgcaaaaggacctgccccaggaatcagccgctgaacccaggaaagtgcgcgtgtgaatgcactgaatcccctcagaagtgtctgcttaagggaaagaagttccaccatcagacctgcagctgctatcgccggccgtgcactaaccgacaaaaagcgtgcgagccagggtttagctactcagaggaagtctgccgctgcgtgccatcatactggaaacggccgcagatgatgtcc

SEQ ID NO: 20990 - DNA, 1260 bp, Artificial Sequence
  Description of Artificial Sequence: Synthetic coding sequence
atgcacctgctgggattcttctccgtcgcatgctcgctgcttgctgcggccctgctgccggggcctcgggaagcaccagcggcggcggcggccttcgagagcgggctcgatctgtcggatgcagagccggacgccggagaagcaactgcctacgcgtcgaaagacctggaggagcagctccggtccgtgtcctccgtcgacgaactgatgaccgtgttgtacccagaatactggaagatgtataagtgccagctccggaagggaggatggcagcataaccgggaacaggccaacctgaactcccggacggaagagacgatcaaatttgccgctgcgcattacaatacggagatccttaagagcattgacaatgagtggcgcaagacgcaatgcatgccacgggaggtgtgcatcgacgtgggaaaggaattcggagtggcgaccaacactttcttcaaacccccgtgcgtgtccgtgtatcgctgcgggggatgctgtaactcggaaggcctgcagtgcatgaacacttcaactagctacctgtcaaagactcttttcgagatcaccgtgccgcttagccaagggccgaaaccagtcactatctcatttgctaaccatacttcctgccggtgtatgtcgaagctggacgtgtaccgtcaagttcactccatcatccgcagaagcctgccagcaactctccctcagtgtcaggccgccaacaagacctgcccgaccaactacatgtggaataatcacatctgccgctgtttggcccaggaggacttcatgttctcgtcagatgctggtgatgattcgaccgacggattccatgacatctgtggcccgaataaggagttggacgaggagacttgtcagtgcgtctgcagagccggcctgcgccctgcaagctgtggaccgcacaaggaattggatcgaaactcatgccagtgcgtctgtaaaaacaaactgtttccgtcccagtgtggagcaaaccgagagttcgatgaaaatacctgtcagtgtgtgtgtaagcggacctgcccgcgaaaccaacctctcaacccaggaaagtgcgcgtgcgagtgcaccgaatcgccgcagaaatgtctgctgaaaggaaagaagttccaccaccagacgtgctcttgctacagacggccctgcactaaccgccaaaaagcctgcgaaccaggattttcgtactccgaagaagtgtgccgctgcgtgccttcctactggaaacggccgcaaatgatgagc

SEQ ID NO: 20991 - DNA, 1260 bp, Artificial Sequence
  Description of Artificial Sequence: Synthetic coding sequence
atgcatcttctcggctttttctcagtggcatgctcgcttctggccgcagcactgcttccaggtcctcgggaggcacctgccgcggctgctgcgtttgaatccggactggatctctccgatgcagaaccagacgcaggtgaagccaccgcatacgcctcgaaggaccttgaagaacagctccgttcggtgtccagcgtcgatgagctgatgactgtgctctaccccgagtactggaagatgtataagtgccaacttagaaagggaggatggcaacataatcgcgaacaggcaaatctcaatagccgcacggaagagacgattaagttcgccgccgcacattacaatactgaaattctgaagtcgattgataacgaatggcggaaaacccagtgcatgcctagagaggtctgtattgatgtgggaaaggaatttggggtggccaccaacactttcttcaagcctccctgtgtctccgtgtaccgttgcggggggtgctgcaactcggaaggactgcagtgcatgaacacttcgacttcgtacttgagcaagactctttttgaaatcacggtcccattgtcgcaaggtccaaaaccagtgaccatcagcttcgcaaatcatacgtcgtgcagatgtatgtcaaagctcgacgtgtaccggcaagtgcattcgattattcgtcgttcactccctgcaactctgccccagtgccaggcagcgaacaagacctgtcccactaattacatgtggaacaaccatatctgcaggtgccttgcacaggaagatttcatgttttcgagtgatgcgggtgacgactcgaccgacggctttcacgatatctgtggccccaacaaggaactggacgaggaaacctgtcagtgtgtctgccgtgcaggacttcggcctgcctcctgtgggccacacaaggaacttgaccggaattcgtgccagtgtgtttgtaagaacaaactttttccgtctcaatgtggtgcaaacagggaatttgatgagaacacctgtcaatgcgtgtgtaagcggacctgtccacgcaaccagcctcttaaccctggtaagtgcgcgtgtgaatgtaccgaatctccccagaagtgcctgctgaaggggaaaaagttccaccaccaaacctgttcctgttaccggcgcccttgcaccaacaggcaaaaagcatgtgaaccgggattttcgtactcggaagaagtctgccgatgcgtgccttcatactggaagcgaccacagatgatgagc

SEQ ID NO: 20992 - DNA, 1260 bp, Artificial Sequence
  Description of Artificial Sequence: Synthetic coding sequence
atgcatcttctgggatttttttctgtggcatgctctcttctggccgctgccctgctgccgggacccagagaggcccccgccgccgctgccgcatttgagtctggcctcgatctgtctgatgccgagccagatgctggcgaagctacagcctacgcctctaaggaccttgaagaacaactgaggagtgtatcaagtgtggacgagctgatgactgtcctttatcctgagtactggaagatgtacaagtgtcaactccgcaagggggggtggcaacacaaccgcgaacaagccaacttgaacagtcggaccgaggagacaatcaaattcgctgccgctcactacaacaccgagattctcaaatctatcgacaatgagtggagaaagacccagtgcatgcccagagaggtttgcatcgacgtaggaaaggaatttggcgtggccactaacactttctttaaaccaccttgcgtgtcagtttaccggtgcgggggttgctgcaatagcgaggggctgcagtgcatgaacacgtcaaccagttacctgtccaagactcttttcgagattactgtccccctgtcccagggccccaaacctgtaactatcagcttcgccaatcacacatcctgccgctgcatgtcaaaactcgacgtgtaccgccaggtgcacagcataattaggagatctctgcctgccaccctgcctcagtgtcaggctgccaataaaacctgcccgacaaattatatgtggaacaatcacatctgcaggtgtctcgcccaggaggattttatgttctcttctgatgccggggacgactctacagatggcttccacgatatctgcgggcctaacaaggaactggatgaagagacatgtcaatgtgtctgccgcgctggcctgagaccagcgtcctgtggtcctcacaaggaactggatcggaattcctgccagtgtgtgtgcaagaacaaactgtttcccagtcagtgcggagcgaacagggaatttgacgaaaacacatgccagtgcgtctgtaagcggacgtgcccacgcaaccagcccttgaatcccggaaagtgtgcatgcgagtgcaccgaatccccacaaaaatgtcttctcaagggcaagaaatttcatcatcagacatgcagctgctatcggcgaccttgtacaaacagacaaaaggcttgtgagcccgggttctcatactccgaggaggtgtgcagatgtgtgcccagctactggaagaggccgcagatgatgagt

SEQ ID NO: 20993 - DNA, 1260 bp, Artificial Sequence; identical to SEQ ID NO: 20950
  Description of Artificial Sequence: Synthetic coding sequence

SEQ ID NO: 20994 - DNA, 1260 bp, Artificial Sequence
  Description of Artificial Sequence: Synthetic coding sequence
atgcacctactaggctttttttctgtggcctgctccttgcttgccgcagccctgcttccaggcccacgcgaggcgcccgccgccgcagccgcattcgaatcgggactggatttgagcgacgccgaacccgacgcaggtgaagccacggcgtacgcttctaaggacctcgaggagcagctccgaagtgtgtcgtctgtggatgagctcatgaccgttctatacccagaatattggaagatgtataagtgccaactgcggaagggaggctggcagcacaacagagaacaagcaaatttgaacagtcgtacagaggagacgatcaagttcgccgccgcccactacaacaccgagattttgaaatccatcgataacgaatggcgcaagactcagtgtatgccacgcgaggtgtgcattgatgtcggcaaagagtttggtgtggccacaaacactttcttcaagccaccgtgtgtctccgtgtatcgctgcggcggctgctgcaatagcgagggactacagtgcatgaacacgagcacaagttacctgtcgaagacactgtttgagatcacggtcccgttaagtcagggacctaagccggttacaatcagtttcgccaaccacacctcatgtagatgcatgagtaagctggacgtgtacagacaggtccattcgattatccgccgttcacttcccgcgacgttgccacagtgccaagcggccaacaagacctgtccgaccaattacatgtggaacaaccatatctgccggtgcctggctcaggaagatttcatgttttcctccgacgcgggcgatgactcaaccgatggatttcatgatatctgcggcccaaataaggagctagatgaggagacatgccagtgtgtttgcagggccggcctccgtcccgctagctgcggacctcataaggaacttgaccgtaattcctgtcagtgtgtatgcaagaacaagttgtttcccagccagtgcggcgccaatcgtgaatttgatgagaacacctgtcagtgcgtatgcaagcgcacttgcccacgtaaccagcctctgaatcccgggaagtgtgcgtgcgagtgcaccgaatcaccccagaagtgcttgctgaagggcaagaagttccaccaccagacgtgctcctgctaccgtcgtccgtgcactaaccgccagaaagcctgcgagccgggtttcagttactctgaggaagtatgccggtgcgtcccctcgtactggaagcgcccccagatgatgagt

SEQ ID NO: 20995 - DNA, 1260 bp, Artificial Sequence
  Description of Artificial Sequence: Synthetic coding sequence
atgcatcttttgggattctttagcgtcgcatgtagcctgttggcagctgcactcctgcccggaccccgggaggcccccgccgcagccgcagcctttgaaagtgggctagatttatcggatgcggagcctgatgcaggagaggccaccgcctatgcttctaaagatctcgaggaacagcttcggtctgtgtctagtgtggatgagcttatgacagtgctgtacccagagtactggaaaatgtacaaatgtcaattgcggaaggggggatggcagcataacagagagcaggcgaatttgaactccagaactgaagaaacaattaaattcgctgcggcgcattacaataccgagatccttaagtctattgacaacgagtggaggaagacccagtgcatgcccagggaagtgtgcattgatgtcggcaaagaattcggagtcgctactaataccttttttaaacccccatgcgtgtcagtgtatcgctgtggcgggtgctgtaacagcgagggactgcagtgtatgaacacatctacctcctaccttagcaagaccttgttcgaaatcacagtaccgcttagtcagggcccaaaaccagtgactatcagtttcgcgaaccatacttcttgtcgctgcatgtccaagcttgacgtgtaccgccaggtccactccatcattcggaggagccttcctgctacactgccccagtgccaggcggcaaataagacatgccccacaaattacatgtggaacaatcatatatgccgatgtctcgctcaggaggactttatgttcagctcagacgctggcgatgatagcacagacggattccacgatatctgcgggccaaataaggagctggatgaggagacctgtcagtgtgtgtgtagagcaggcctgcgccctgcctcctgtggcccccataaagagctagatagaaactcttgccagtgtgtgtgtaagaacaagttgttcccctctcagtgtggcgccaaccgggagtttgatgagaacacttgccagtgtgtgtgtaagcgcacctgccctcggaaccagcctctgaaccctggaaaatgcgcttgtgaatgcaccgagtcgccacaaaagtgcttgctgaaaggaaaaaaattccatcaccagacatgctcgtgctacagacggccttgtacgaatcgacagaaggcttgcgagccggggttcagctactctgaggaagtgtgtaggtgcgtgccgtcatactggaaacggcctcaaatgatgtct

SEQ ID NO: 20996 - DNA, 1260 bp, Artificial Sequence
  Description of Artificial Sequence: Synthetic coding sequence
atgcacttgttgggttttttctcagtcgcctgctcgttgctggcagctgctctactccccggccctagagaggccccagccgctgccgccgcattcgaaagtggactcgatctgtcagacgcagaacctgatgccggagaggcgactgcatacgcatcaaaagacctcgaagaacagttgaggtccgtttcatctgtggatgagttgatgactgttttataccccgagtactggaagatgtacaaatgccagttgaggaaagggggatggcagcataaccgtgagcaggccaacttgaattcgaggacagaagagactatcaaattcgctgccgctcattataatactgaaattcttaagagtattgataacgaatggagaaaaacccaatgcatgccgagggaggtttgcatcgacgttggtaaagaatttggtgttgccactaatacgttcttcaagccaccatgtgtgtccgtttatcgatgcggggggtgttgtaactccgaaggattacagtgtatgaatacctctacatcatatctgtctaagacgctatttgaaatcaccgtaccattaagccaaggtcctaagccagttactatcagctttgcaaaccacacaagttgtcgctgtatgagtaaattggacgtctataggcaagtacattccattattcggaggagtttacccgcaaccttgcctcaatgccaagcggcaaataaaacctgtccaacgaactatatgtggaataatcacatttgtcgatgcttagcccaagaagactttatgttctcatctgacgccggggacgatagtaccgatgggttccacgatatctgcggaccaaacaaggagttggatgaagagacctgtcaatgtgtttgtagagctggtctcagacctgccagttgcggtcctcataaggaattggatcgcaattcatgtcaatgcgtgtgcaaaaacaagctctttccttcacaatgtggggcaaacagggagttcgatgaaaatacctgccaatgcgtgtgcaaaaggacctgtccgaggaaccagccactaaatcccggtaagtgcgcttgtgagtgcactgaaagcccgcaaaagtgtctacttaaaggcaaaaagttccatcaccaaacctgctcatgctacaggagaccatgtacgaaccgacaaaaggcatgcgagcctggcttttcctattcagaagaggtttgtcgctgtgtgccatcctactggaagagaccacaaatgatgtct

SEQ ID NO: 20997 - DNA, 1260 bp, Artificial Sequence
  Description of Artificial Sequence: Synthetic coding sequence
atgcatctgttgggcttcttctccgtggcatgttcattgctggccgcggctctgcttcctgggccaagagaggcccccgctgccgctgcggcattcgaaagcggtcttgacttgagcgacgccgagccagatgccggggaagctacggcttacgcttccaaggacttagaagagcagctaaggtcggtctcctcggttgacgagttgatgacggtactatacccagaatattggaaaatgtacaaatgtcagctccggaagggcggatggcagcacaaccgcgagcaggccaatctgaactcacgaacagaggaaactattaaatttgctgccgctcactataacacagaaatcttgaagtccattgataacgagtggagaaaaacccagtgtatgcctcgtgaggtttgcattgacgttggcaaagagttcggagtggctaccaacaccttcttcaaacctccctgcgtgagtgtgtaccgatgtggggggtgctgtaactccgagggcctgcagtgtatgaatacatctacaagctacctgagtaaaacactatttgaaattaccgtccccttgtcccagggcccgaagccggtgacaattagctttgcaaatcatacatcctgtcggtgcatgtccaaattggacgtctataggcaggttcactccatcatcaggcggtctctgccagccactttaccacagtgccaagcagccaataaaacatgcccaactaactacatgtggaacaatcatatttgcagatgtttggcccaggaggactttatgttttcatccgatgcgggcgatgattccactgatggctttcacgatatttgcggacctaacaaggagctggacgaggaaacatgtcaatgtgtctgtagggcaggcttgcgccccgcgtcctgcggtccacacaaggagctagacaggaatagttgccaatgcgtgtgtaaaaataaactgttcccaagtcagtgcggagccaacagggaattcgacgagaacacatgccaatgcgtatgtaaaaggacctgcccaaggaaccagcctctgaaccccgggaagtgtgcctgtgagtgtaccgagtctccgcagaagtgtttgctgaaaggaaaaaagttccaccaccagacttgtagctgctaccggcgcccttgcaccaatcggcaaaaggcttgtgaacccgggttcagttatagcgaggaggtttgtagatgcgtgccgtcctattggaagaggcctcagatgatgtct

SEQ ID NO: 20998 - DNA, 1260 bp, Artificial Sequence
  Description of Artificial Sequence: Synthetic coding sequence
atgcacctcctcggattcttttcggtcgcttgctccctccttgcagccgcgcttcttccggggcctagagaagcaccagccgccgcagccgcttttgagtcaggacttgatctcagcgacgctgaacctgacgcgggggaagccactgcatacgcatccaaggacctcgaagaacaactcaggtccgtgtcaagcgtggatgaacttatgactgtgttgtacccggagtactggaagatgtacaaatgccaactccgcaagggcggatggcagcacaatcgggagcaggcaaacctgaactcgcgtacggaagaaaccatcaagtttgctgcagcgcattacaataccgagattctgaagagcatagacaacgaatggcgtaaaacccagtgtatgccgcgtgaggtctgtattgacgtgggaaaggaatttggggtggcaactaatactttctttaagccgccctgcgtgtctgtgtaccggtgtggaggctgttgcaactcagaaggtttgcaatgtatgaacacctccacctcatacctgtcgaaaactctctttgaaatcactgtccccctgtcgcaaggtcccaagcctgttaccatctccttcgctaatcatacttcctgtcgttgtatgtcgaagttggacgtgtaccggcaggttcactcgattattcgtcgctcgctgccagcaactcttcctcagtgccaagccgccaacaaaacctgtccgacgaactatatgtggaacaaccatatttgtagatgcttggcacaagaagatttcatgtttagctcggatgctggtgacgattcaacggatggtttccatgatatctgtggtccaaataaggagctggatgaagagacttgccaatgtgtgtgccgcgcgggcctgaggccagcaagctgtgggcctcacaaggagcttgatcgcaactcgtgtcagtgtgtctgcaagaataagctgttcccttcgcaatgtggagccaacagggagttcgatgaaaatacgtgtcagtgcgtgtgtaagcggacctgcccacgcaaccagcctctgaatcccggcaaatgtgcatgcgaatgtaccgaaagcccccagaagtgcctgctgaagggcaagaagtttcatcatcaaacttgctcgtgttaccggcggccctgtactaacagacaaaaagcatgtgaacctgggtttagctattccgaagaggtgtgtcggtgtgtcccttcctactggaaaagaccgcagatgatgtca

SEQ ID NO: 20999 - DNA, 1260 bp, Artificial Sequence
  Description of Artificial Sequence: Synthetic coding sequence
atgcacctgctgggatttttctcggtggcatgctcgctgctggccgcggcgctgctgccgggcccgagggaggctccggcagctgcagcagcattcgaatcaggtctggatctctcggacgccgaacccgacgccggagaagcaactgcatacgcctccaaggacctggaggaacagctgagaagcgtgtcgagcgtcgatgaattgatgactgtgctttaccctgagtactggaagatgtacaagtgccagctgcgcaagggcggatggcaacataacagagagcaggccaacctgaacagccggacggaagagactatcaagtttgcagcagcgcattacaacacggagatcctgaagtcgatcgacaacgaatggcgcaagacccagtgcatgccacgcgaagtctgcatcgatgtcggcaaggagtttggtgtggcaaccaatactttcttcaagcccccctgcgtgtcagtctacaggtgcggcggctgctgtaactccgaaggactgcagtgcatgaacacctcaacgtcgtatctttcgaaaaccctgttcgaaatcacggtgccgctctcccaaggacctaagccggtgaccatctccttcgccaaccatacctcatgtcggtgcatgagcaaactggacgtgtacaggcaggtgcactccatcatccgcaggtccctgccagcaactctgccgcaatgccaggccgcgaacaaaacttgcccgactaactacatgtggaataatcatatttgccgctgcctcgcccaagaggacttcatgttctcatccgacgccggcgacgactcgaccgatgggttccacgacatttgcggacccaacaaagaactggacgaagaaacttgccagtgcgtctgccgcgcgggcctccggcctgcatcttgtgggccccataaggagctggatcggaactcgtgccagtgtgtctgtaaaaacaagctgtttccgtcccagtgcggagccaacagagagttcgacgaaaacacctgccagtgcgtgtgcaagagaacttgtccgcgcaatcagccgctcaatccgggcaagtgcgcctgcgaatgcactgaaagcccacaaaagtgcctcctgaaaggcaagaaatttcatcatcagacctgttcctgctaccggcggccgtgcaccaatagacaaaaggcatgtgaacctggattctcatattccgaggaggtgtgccggtgcgtgccatcatactggaagcgcccgcaaatgatgtca

SEQ ID NO: 21000 - DNA, 1260 bp, Artificial Sequence
  Description of Artificial Sequence: Synthetic coding sequence
atgcacttacttggattcttctcagttgcttgtagcttgctagcagctgctttattgccgggacctagagaagcgccagcagctgccgctgcatttgaatctgggcttgatttgtcagatgctgagccagatgctggcgaagcaactgcttatgcatcaaaggacttagaggaacaactcagatcagtgagttcggtcgatgaacttatgaccgtgctttatccggagtattggaaaatgtacaaatgccaactacgaaaaggaggctggcaacacaatcgggaacaggctaacctgaactctcgaactgaggaaacaataaaatttgccgcggcccattacaatactgagattttgaagtcaattgataacgaatggcgaaaaacgcagtgcatgcctcgtgaggtatgcatagatgtgggaaaagaatttggagtcgccacaaacaccttttttaagccaccttgcgtgtcagtatatagatgtggaggttgctgcaactcggaaggactccaatgcatgaatacatctacatcgtatctcagcaagactttgtttgaaattactgtaccattatctcagggtccaaaacctgttactattagttttgcgaaccatacatcgtgccgatgtatgtcaaaacttgatgtttaccgacaggttcactctattataagacgttcactacccgctacacttccacagtgccaagcggccaataaaacgtgcccaacgaactacatgtggaacaatcatatttgtcgctgcttggcccaggaagattttatgttctcctcagatgcaggtgatgacagtactgatggttttcacgacatttgcggcccgaataaggaacttgatgaagagacttgtcaatgcgtgtgccgggcaggtctacgtccagctagttgcggaccacataaagagctcgatcgtaactcttgccagtgtgtttgtaaaaataaactatttccttcacaatgcggtgcaaatcgagaatttgacgagaatacctgtcaatgcgtttgtaaacggacatgcccacgcaaccagccgcttaatccaggaaagtgtgcatgcgagtgcaccgaaagtccacaaaagtgcctgcttaagggaaagaaattccatcaccaaacttgttcttgttacagacgcccgtgtacgaaccgtcaaaaagcttgcgagcccggcttctcgtattctgaagaagtttgccgttgtgtcccatcctattggaaaagaccacaaatgatgtct

SEQ ID NO: 21001 - DNA, 1260 bp, Artificial Sequence
  Description of Artificial Sequence: Synthetic coding sequence
atgcacctgttgggcttcttttccgttgcctgcagtcttctggcagccgcccttctgcccggccctcgagaggcacctgccgccgcagctgcgtttgagtctggtctggatctttccgatgctgagcccgacgccggtgaagctaccgcgtacgcatctaaggacctggaagagcaactgaggagcgttagcagtgttgatgagctgatgactgtgctgtacccggaatactggaagatgtacaagtgccagcttagaaaaggaggctggcagcataacagagaacaagccaatctgaatagccggacagaggagactattaagtttgcagcagcgcactataacacagaaattctgaagagcatcgacaacgagtggaggaaaactcagtgcatgccgcgcgaggtttgcattgacgtggggaaggagttcggagtggccaccaacacttttttcaaacccccctgtgtaagcgtctaccgctgcggtggctgttgcaactcagaggggctccaatgtatgaacaccagtacatcatacctctcaaaaaccctgttcgaaattacagtgcctctgtcacagggtcctaagcccgtcaccatttcctttgctaatcacaccagttgtcggtgcatgagcaaactcgacgtgtatcgccaggtgcactctattatccgccggagtctccctgctacactcccgcaatgccaagccgccaacaaaacatgccccactaattacatgtggaataatcacatatgtaggtgcttggcacaggaggactttatgttttccagtgatgctggggatgacagcaccgacggctttcacgatatatgtggaccgaataaagaactggacgaggaaacttgccagtgtgtctgtagggccgggctgcgccctgcctcctgcgggccccacaaagagctggacaggaactcctgccaatgtgtctgtaaaaataagctcttcccatcccagtgtggggctaaccgagaatttgacgagaatacctgccaatgcgtgtgcaaaagaacttgtccccggaatcaacctctgaaccctgggaagtgcgcctgtgaatgcaccgaatctccccaaaagtgtctgctgaagggcaagaaatttcaccaccagacctgtagttgctatcgacggccttgtaccaacagacagaaggcctgtgagcccgggttctcatactcagaagaggtctgcaggtgcgtgcccagttattggaaacgaccacagatgatgtcc

SEQ ID NO: 21002 - DNA, 1260 bp, Artificial Sequence
  Description of Artificial Sequence: Synthetic coding sequence
atgcacctgctcggttttttttcggttgcctgcagtctacttgcggccgccctcctgccaggccctcgggaggcgcccgccgccgccgctgctttcgagtcaggcctggatctttctgacgcagagccagacgccggcgaagccaccgcctacgcgtccaaggatctggaggaacagcttcggagcgttagttcagtcgacgagcttatgacggtgctataccccgaatactggaagatgtacaagtgtcagttgcggaaaggcggctggcagcataacagggagcaggccaacctgaacagccgtacggaggaaaccatcaaatttgcggccgctcattacaacacggagatcttgaagtcaattgacaacgaatggcgcaagacacagtgtatgccccgcgaggtctgcatcgacgtgggtaaggagtttggcgttgccaccaacaccttcttcaagcctccttgcgtgtctgtctaccgatgcggtggttgttgtaattcggaagggctgcagtgtatgaacacttccacttcatatctcagcaagacactgttcgagatcacggtgccattgagccagggccctaagcccgtgaccatctcattcgctaaccatacctcttgccgctgtatgagcaagcttgacgtttaccgccaggtgcactcgattatccgccggagcctccctgccactctgcctcaatgccaagcggctaacaagacctgccccactaactatatgtggaacaaccacatttgtcgctgccttgcccaggaggatttcatgttctcttcggatgccggagacgattccaccgacggtttccatgatatctgcggccccaacaaggagctcgatgaagagacttgccagtgcgtgtgtcgggctggtcttcgccccgcatcatgcggcccccataaggagctcgaccgtaactcctgccagtgcgtatgcaagaacaaacttttcccctcccagtgcggcgcaaatcgtgaatttgatgaaaatacctgccagtgtgtctgcaaacgtacctgcccacgtaaccagcccctcaaccccggaaagtgtgcatgcgagtgtactgagagcccccagaagtgtctgttgaagggtaagaagtttcatcaccagacctgctcgtgctatcgcagaccttgcaccaataggcagaaggcgtgtgagccgggtttctcatacagcgaagaagtttgccgctgcgttccctcctattggaagagacctcagatgatgagc

SEQ ID NO: 21003 - DNA, 1260 bp, Artificial Sequence
  Description of Artificial Sequence: Synthetic coding sequence
atgcatctgttgggctttttctcggtggcgtgttccctcctggctgcagcacttttgccgggacctcgcgaagcaccggccgctgcggcagcgttcgagtctggactggatctctcggacgctgagcccgatgcgggagaagcaaccgcttacgcttccaaagatctggaggaacaactccgatctgtgagcagcgtggacgaactgatgactgtgctgtacccggagtattggaagatgtacaaatgccagttgagaaagggtggctggcaacacaacagagaacaggcgaatctcaactcccggaccgaggaaaccatcaagtttgcagccgcgcactacaataccgagatcttgaaatcgatcgacaacgagtggaggaaaacgcagtgcatgccgcgcgaggtgtgcattgacgtcggaaaagagttcggggtggccactaacacgttcttcaagccgccatgcgtgtcggtctaccggtgcggagggtgctgcaactcagaagggctgcagtgtatgaataccagcactagttacctgtcgaaaactctgttcgagattaccgtccccctgtcgcagggccccaagcctgtgacgatctccttcgccaaccacacctcctgcaggtgcatgtcaaaattggatgtgtacagacaggtgcattcgatcatccgccgttctcttccagccactctgccccaatgccaggcagcaaataagacgtgtccgactaactacatgtggaacaatcatatttgccgctgtctggcacaagaagatttcatgttttcgtcggacgcaggcgacgattcaactgacgggttccacgacatttgcggaccgaacaaggaactcgatgaagaaacctgtcagtgcgtctgccgcgctggactccgcccggcatcctgcggccctcacaaggagcttgataggaactcgtgtcaatgcgtgtgcaagaataagttgttcccgagccagtgtggagcgaatcgggaattcgacgaaaacacgtgccaatgtgtatgtaagcgcacttgccctcggaaccaacctctgaaccctggtaagtgcgcctgcgagtgcaccgaatccccgcaaaaatgtctcctcaagggaaagaagtttcatcaccagacttgctcttgttacagaaggccgtgtaccaaccggcaaaaagcctgcgaaccaggattctcctactccgaggaggtgtgtcgctgcgtgccgtcctactggaagaggccacagatgatgtcc

SEQ ID NO: 21004 - DNA, 1260 bp, Artificial Sequence
  Description of Artificial Sequence: Synthetic coding sequence
atgcatttactcggtttcttttcagtcgcttgttcactgttggccgcagcactgcttcctggccctcgcgaagcacctgctgctgccgccgcatttgagtcggggttggacctgagtgatgccgagccggacgccggggaggcgacagcatacgcctctaaggatctggaggagcaactgagaagtgtttctagtgtggacgagttaatgaccgtgctgtacccagagtactggaagatgtataagtgccaactgaggaagggaggttggcagcacaatcgcgagcaagctaacctgaactctaggaccgaggagacaataaagtttgccgcagctcattacaacaccgaaatactgaaatcaatcgacaacgagtggcgtaagactcagtgcatgcccagggaggtgtgcattgatgtgggtaaggaattcggagtcgccacaaatactttttttaagcccccctgtgtcagcgtgtacaggtgtgggggctgctgtaattccgagggactgcagtgtatgaacaccagcacatcatatttgagtaagacactgtttgaaataactgttcctttatcacaagggcctaagcccgttacaattagctttgctaaccatacatcctgcaggtgcatgtcaaagctggacgtgtaccgacaagtacacagcattattcggcgctccctgcccgccaccctgccacagtgccaagccgcaaacaagacctgccctaccaattacatgtggaacaaccatatatgccggtgcctggcccaggaagactttatgttctcctctgatgctggggatgattctactgacgggttccatgacatatgcggcccaaacaaggagctggatgaagagacctgccagtgcgtatgtcgggcaggcctgagacctgcctcatgtggaccccataaggagctggataggaattcttgtcaatgtgtgtgtaagaataaattgttcccatcacagtgcggggctaacagggaatttgacgaaaacacttgccagtgcgtgtgtaaaaggacttgtccccggaaccagcccctgaaccccgggaagtgcgcatgtgaatgtaccgaaagcccccaaaaatgtcttttaaaaggtaagaaatttcaccaccagacatgcagctgctacaggaggccatgcaccaaccgccagaaggcttgcgagcctggatttagctacagcgaggaggtctgtaggtgtgtacccagttattggaagcggcctcagatgatgtca

SEQ ID NO: 21005 - DNA, 1260 bp, Artificial Sequence
  Description of Artificial Sequence: Synthetic coding sequence
atgcacctactaggcttcttttcagtggcttgctctctgctcgcggctgcactgctgcccgggcctcgtgaggcccccgccgctgcagcggccttcgagagcggactggatttgtccgacgccgagccagacgccggggaagcaaccgcatatgctagcaaggacctggaagagcagctgcggtcagtgtcatccgtggatgaattaatgaccgtgctgtaccctgaatattggaagatgtacaaatgccagttgcggaagggagggtggcagcacaacagagagcaggctaacttaaactctcgaacagaggagacgataaagtttgcagccgcgcattacaatactgaaattcttaagtctatcgacaatgagtggcggaagacacagtgtatgccacgcgaggtttgtattgatgtcgggaaggagttcggcgtggcgacgaatacattcttcaagcccccatgcgtgtctgtatataggtgtggcgggtgttgtaattctgaggggctgcagtgcatgaatacctccacatcgtacctttccaagactctattcgagattacggttccattgtcccagggaccaaagcccgtaaccatctcctttgccaatcatacatcctgccggtgcatgagtaaactcgatgtttacagacaggtacattccattataagaaggagcttgcctgctactctaccccagtgccaagcagccaataagacctgtcccactaactacatgtggaacaatcatatttgcagatgtctggcgcaggaggattttatgttttcatctgatgcaggggatgactccaccgacggatttcacgatatctgcggccctaacaaagaactggacgaggagacatgtcagtgtgtgtgtcgtgctgggttgcgccctgcttcatgcggtcctcataaggaactggacagaaattcctgccagtgcgtgtgcaagaataagctcttcccctcccaatgtggggccaaccgtgagtttgacgaaaacacctgtcagtgcgtgtgcaagaggacctgtccgcggaaccagccgctcaatcctggaaagtgtgcttgtgagtgtaccgaaagtccccagaagtgtctgctcaaaggcaagaaatttcaccaccagacttgttcctgctatcggcgcccctgtactaaccggcagaaagcatgcgaaccaggattctcttattctgaggaggtgtgcaggtgcgttccctcctattggaagcggccacaaatgatgagc

SEQ ID NO: 21006 - DNA, 1260 bp, Artificial Sequence
  Description of Artificial Sequence: Synthetic coding sequence
atgcacctgctgggattcttttccgttgcttgcagtctcctggcagctgccctgcttcctggcccccgcgaagccccagcggcagcggctgcctttgagagcggtcttgacctctccgatgccgaacccgacgccggtgaggccactgcatacgccagcaaggacctggaggagcaacttcgctccgtatcctccgtggacgaactgatgacggtgctttaccccgagtattggaagatgtacaagtgccaacttcgcaaaggaggttggcagcacaacagggaacaggctaatctgaacagtaggacagaggagacgataaagtttgcagccgcgcactacaacactgaaatcctgaagagcattgacaatgagtggagaaagacgcagtgtatgccccgcgaggtatgtatcgacgtgggaaaggagtttggagtggccaccaataccttcttcaagcctccgtgcgtgtcagtctatcgctgtggcggatgctgcaactcagagggcctgcagtgcatgaacacttccaccagctacctctccaaaacactgttcgaaataacagtacctttgtcacagggccccaaaccagtaacaatcagtttcgccaaccacacaagctgccgctgcatgagcaagctggacgtttacagacaggtacatagcatcatacgccgcagtcttccggcgactctcccgcaatgtcaagctgccaacaaaacgtgccccacaaattacatgtggaacaaccacatctgccgctgtttggcccaggaagacttcatgttctcaagtgatgccggcgatgacagtactgacggtttccatgatatttgtggtcctaataaggaacttgacgaggagacgtgtcagtgcgtgtgtcgcgctggactcaggcctgcgtcatgcggccctcataaggagctcgacaggaactcatgtcaatgcgtctgtaaaaacaagctgtttccatcacaatgtggagcgaatcgcgagttcgatgagaacacgtgtcagtgcgtgtgcaagcgcacctgtccaaggaaccagccactgaacccaggcaaatgcgcatgcgagtgtacagaaagtccgcagaagtgcctgctgaagggcaagaagttccaccaccaaacctgcagctgctacagaagaccatgcaccaacagacagaaggcttgcgagcccggcttcagctactcagaggaagtgtgtagatgtgtcccctcttactggaagaggccccaaatgatgtca

SEQ ID NO: 21007 - DNA, 1260 bp, Artificial Sequence
  Description of Artificial Sequence: Synthetic coding sequence
atgcacctcctgggatttttcagtgttgcttgttcattgcttgctgctgctctgctcccaggcccaagagaggcccccgccgctgccgctgcattcgaatcaggcctcgacctgagcgacgcagagccggatgcaggcgaggccaccgcctatgcttccaaggaccttgaagagcaactgaggtctgtctctagtgtggatgaactcatgaccgtgctttaccccgagtactggaagatgtacaaatgccaactccgcaaaggaggctggcagcacaacagggaacaagcaaaccttaattctaggaccgaagagacaatcaagtttgccgcggcacattacaacaccgaaattttgaagagcatcgataacgaatggaggaagacccagtgcatgcctagggaggtgtgcatcgatgtcgggaaagaatttggggttgcaacaaacacctttttcaaaccaccttgtgtgtcagtgtaccgttgcggggggtgctgcaactcggaaggattgcaatgtatgaacactagtacctcgtacttgagtaagactctctttgaaatcaccgttcctctgagccagggccctaaaccggtaacaatctcctttgccaatcacacaagttgtcgctgcatgtctaagctggatgtttatcgccaagtgcattcgatcatcaggaggagcctgccagctaccctcccacagtgccaagccgcaaacaaaacttgcccaacaaactacatgtggaataatcacatctgcagatgtctcgcacaggaggactttatgttctcgagtgacgcaggggatgacagcacagatggattccacgatatctgtggcccaaacaaagagcttgatgaagagacttgccagtgcgtgtgtcgagctggactcaggccggctagctgtggaccacataaagaacttgatcgcaactcatgccaatgtgtctgcaagaataaactttttccgagccagtgcggagccaatagagagtttgatgaaaacacttgtcagtgcgtgtgcaaaaggacatgtcctagaaaccagccacttaatccgggcaaatgcgcttgcgaatgcaccgagtcaccgcaaaagtgcctgctgaaaggaaaaaagttccatcaccagacttgctcgtgttacaggagaccatgcactaaccggcagaaagcgtgcgaacccggcttctcctacagtgaggaagtgtgccggtgcgtgccaagctactggaagcgccctcaaatgatgagc

SEQ ID NO: 21008 - DNA, 1260 bp, Artificial Sequence
  Description of Artificial Sequence: Synthetic coding sequence
atgcatttacttggattttttagtgttgcttgttcacttttagcagctgctttgcttccaggaccaagagaagcaccagcagctgctgcagcttttgagtcaggattagatctttcagatgcagaaccagatgccggggaggctactgcttatgcatcgaaagatcttgaagaacaattacgaagtgtatcatcagttgatgaattaatgacagtactttatcctgaatattggaaaatgtataagtgtcaacttcgtaagggaggttggcaacataatagagaacaagctaatcttaattcaagaacagaagaaactattaagttcgcagcagctcattataatacagaaattttaaaatcaatagataatgaatggcgtaaaacacaatgtatgccaagagaagtttgtattgatgtaggtaaggaatttggagttgctacaaacacattttttaaaccaccttgtgtttccgtatatagatgtggtggatgttgtaattcagagggattgcaatgtatgaatacaagtacttcttatctttcaaaaacattatttgaaattacagttccattatcacaaggaccaaaaccagttactatttcttttgcaaatcatactagttgtagatgtatgtcaaagttagatgtttatagacaagttcattctataattagaagaagtcttccagctactttaccacaatgtcaagctgcaaataaaacatgtccaacaaattatatgtggaacaatcatatttgtagatgtcttgcacaagaagattttatgtttagtagtgatgcaggagatgattctacagacggattccatgatatatgtggacctaataaggaattagatgaagaaacatgtcaatgtgtttgtagagcaggattaagacctgcttcatgtggaccacataaagaacttgacagaaactcttgtcaatgtgtttgtaaaaataagcttttcccaagccaatgtggtgcaaatagagaattcgatgaaaatacttgtcaatgtgtttgtaaaagaacctgtccaagaaatcaaccacttaatccaggaaaatgtgcatgtgaatgcacagaaagtccacaaaaatgccttcttaaaggtaaaaaattccatcatcaaacttgctcttgttatagaagaccatgtacaaatagacaaaaagcatgtgaaccaggtttttcatattcagaagaagtttgtagatgtgttccatcatattggaagcgtccacaaatgatgagt

SEQ ID NO: 21009 - DNA, 1260 bp, Artificial Sequence
  Description of Artificial Sequence: Synthetic coding sequence
atgcatcttcttggatttttctccgtggcatgttcgctccttgcggcagcactgttgccaggtcctcgcgaagcacccgccgcagccgccgccttcgagtcaggactcgacctgtcagatgcagaacctgatgcaggtgaagcgaccgcatacgcatcgaaagacctggaggagcaacttaggtcagtgtcgtccgttgatgagctgatgactgtgttgtaccctgaatactggaagatgtacaagtgtcagctgcggaaaggagggtggcagcacaacagggaacaagcaaacctgaattcccgtactgaagaaaccatcaaatttgcagcagcacactacaataccgagatacttaaatcaatcgataacgagtggcggaaaacgcaatgcatgccacgggaggtgtgcattgacgtcggaaaagaatttggtgtcgcaaccaacacctttttcaagccgccttgtgtgagcgtctaccggtgcggcggctgttgcaattccgaaggtctgcagtgtatgaacacctcgacttcctacctctcgaaaacgcttttcgagattaccgtcccactctcgcaaggcccgaaaccagtcactatatcgttcgcaaaccatactagctgtaggtgtatgtcaaagttggatgtgtacagacaagtgcattcgattattcggcgctccctcccagcaacgttgccccagtgccaggccgcgaataagacctgcccaactaactacatgtggaataaccacatctgtcgttgcctcgcacaggaagatttcatgttctcaagcgacgccggtgatgactcgactgatggatttcacgatatttgtggaccaaacaaagagcttgatgaggagacttgtcaatgtgtgtgtagagcaggacttcggccggcatcatgtggtcctcacaaggaactggacaggaactcttgccaatgtgtgtgcaagaacaaactgttcccatcccagtgtggcgctaaccgagagtttgacgagaacacctgtcaatgcgtgtgcaagcggacctgtcctagaaaccagcctctcaacccaggaaagtgtgcctgcgagtgtaccgaaagcccgcagaagtgtctcctgaaaggaaaaaagtttcaccatcaaacttgcagctgctacagacgtccgtgtaccaaccggcagaaggcctgtgagcctgggttttcgtacagcgaagaggtgtgccgatgtgtcccctcatactggaaaagaccacaaatgatgtca

SEQ ID NO: 21010 - DNA, 1260 bp, Artificial Sequence
  Description of Artificial Sequence: Synthetic coding sequence
atgcacctgctgggatttttctccgtggcgtgttctctgcttgccgcagccttgctgcctggcccacgcgaggcgccagccgccgcggctgcattcgaatccgggctcgacttgtcggatgcagagcccgacgcaggagaagcaactgcttacgcatccaaggatctggaggagcagcttagatccgtgagctccgtcgatgagttgatgaccgtgctgtatcctgaatactggaaaatgtacaagtgtcaacttcggaaaggtggatggcagcataaccgcgagcaagcgaatctgaactcgcgcactgaagaaactataaagttcgcagcagcacattacaacaccgaaattctcaagtcaattgataacgagtggagaaaaactcagtgtatgccccgcgaagtgtgtattgatgttggcaaggaattcggcgtggcgactaataccttctttaaacccccgtgcgtgagtgtctaccggtgtggaggttgttgtaactcggaagggctgcagtgtatgaataccagcactagctacctttcaaagacgctttttgagatcactgttcccctgtcgcagggtccaaaaccagtcaccatttccttcgcaaaccacacttcctgtcgatgtatgagcaagctggacgtgtaccgccaagtccattcaatcatacggagatccctgcctgctacccttccccagtgtcaggcagctaataagacgtgtcctaccaactacatgtggaacaaccatatatgccgctgtctggctcaagaggacttcatgttttcatcggatgcaggagacgattcgactgatggatttcatgacatttgtggaccgaacaaagaacttgatgaagaaacgtgtcagtgcgtttgtcgagctggacttcggccagcgagctgcggcccacataaggaacttgatcgcaactcctgccagtgtgtgtgcaagaataagctgtttccaagccagtgtggagccaaccgcgaatttgacgagaacacctgccaatgcgtgtgtaaacgcacctgccctagaaatcaaccactgaatccgggtaagtgtgcgtgtgaatgtacggaatcgcctcaaaagtgccttctcaagggaaagaagtttcaccatcaaacttgttcatgctaccgccggccttgtactaatcgacagaaggcctgcgaacccgggttttcgtactcggaagaagtgtgcaggtgcgtccctagctactggaaacgcccgcagatgatgtcc

SEQ ID NO: 21011 - DNA, 1260 bp, Artificial Sequence
  Description of Artificial Sequence: Synthetic coding sequence
atgcatttgctggggtttttcagtgtggcatgcagtctgctggctgctgccttgctaccaggcccaagggaggctcccgccgctgctgccgccttcgagtccggcctggacctctccgacgcagaaccagatgccggcgaagctaccgcctacgcaagcaaggatttagaggagcagcttagatccgtgagtagcgtggacgaactgatgacagtgttatatccagaatactggaaaatgtacaagtgccagctacggaaaggcggctggcagcacaatagagaacaggccaatctaaattcacgcacagaagagactatcaaatttgccgccgctcactacaacaccgagatattaaagagtatagataacgagtggagaaagacacaatgtatgccccgcgaagtctgcatagatgtgggtaaggagttcggtgtggcaaccaacaccttctttaaacccccttgtgttagcgtgtaccggtgcggggggtgttgcaactccgagggactgcaatgcatgaatacctctacctcttacctgagtaagacactgtttgaaataacagtgcctctgtctcaaggacccaaaccagtgacaatcagctttgccaaccatacttcttgtaggtgcatgtccaaactcgatgtttaccggcaggtgcatagtatcataagacgcagtctaccagccacactgcctcaatgtcaggccgccaacaaaacctgcccaactaactatatgtggaacaatcacatctgtcgttgtttagcccaggaggacttcatgttttcatccgacgctggggacgattccaccgatgggttccatgacatttgtggaccaaacaaggagctggacgaagaaacctgccaatgcgtttgtcgcgctgggttgcggcccgcttcttgtgggcctcacaaagagctagatagaaacagttgtcaatgtgtttgtaaaaacaagctcttccctagccaatgtggagccaaccgggaattcgacgaaaatacttgccagtgtgtgtgcaaacgtacttgcccaagaaaccagccacttaatcccggcaagtgtgcctgcgagtgtaccgagtcaccccagaagtgtctgttaaagggcaagaagttccaccatcagacatgttcctgctaccggcgcccatgcaccaatcgccagaaagcttgtgagccgggtttcagttactccgaggaagtgtgccggtgcgtgccttcttactggaagagaccccagatgatgagc

SEQ ID NO: 21012 - DNA, 1260 bp, Artificial Sequence
  Description of Artificial Sequence: Synthetic coding sequence
atgcacctcctcgggttcttctctgtcgcctgtagcctcctagcggcagcattactgccaggccccagggaagcccctgctgcagctgccgcatttgagagtggcctggatctgagcgacgcagaacctgatgccggggaagcaacagcctacgcgtccaaagatttggaggaacaactccgttcagttagttccgtcgatgagctgatgactgttttgtatcccgagtattggaagatgtataagtgtcagcttagaaagggcgggtggcagcataatcgagaacaggccaatctgaatagcagaaccgaggaaacaattaagttcgctgccgcgcactataacaccgaaatacttaagtctattgacaatgagtggcgaaaaacacaatgtatgccacgagaggtgtgcatagacgtgggcaaggaatttggcgtggccactaacacattctttaaacctccttgtgtgagcgtgtatagatgtggcggttgctgcaactctgaagggctgcagtgtatgaacacgtctaccagctatttgtcaaagaccctgtttgaaatcacagtgcctctgagtcaaggtcccaaacctgtaacaatcagcttcgccaatcacacctcgtgtagatgtatgtctaaactggatgtctatagacaagtgcactctatcattcgtagatctctgcctgctacgctcccacaatgtcaggctgcgaacaagacatgcccaaccaattacatgtggaataatcacatttgcaggtgtctggcccaggaagactttatgttttctagcgacgctggtgatgactccacagacgggtttcatgacatttgcggacctaataaagaactcgacgaagagacctgccagtgcgtttgccgagcgggactccgacccgcgtcatgcggaccccataaagagctggaccgcaatagttgccaatgtgtttgtaagaacaagctgtttccctcacaatgtggtgcgaatagagagtttgacgaaaacacttgccagtgtgtttgcaagcgcacttgtcctcgaaaccagccactaaacccagggaaatgtgcctgcgagtgcaccgagtctcctcaaaaatgtctcctgaagggaaaaaagtttcatcaccagacctgtagctgctatcggcgaccgtgcaccaaccgccagaaagcatgcgaaccaggattcagctattctgaggaggtgtgccggtgcgtcccctcctactggaaaagacctcagatgatgagc

SEQ ID NO: 21013 - DNA, 1260 bp, Artificial Sequence
  Description of Artificial Sequence: Synthetic coding sequence
atgcatttacttggcttcttctctgttgcatgttcactgctcgccgccgcactgctgcctgggcccagagaggccccagctgccgcagctgcatttgagagtggacttgatctgagtgacgccgaaccagacgcaggtgaagcaactgcatatgctagcaaggatttggaggagcagttacggtctgtaagttcagtggatgagttaatgactgtcttgtatcccgaatactggaagatgtacaagtgccagctacgaaagggaggttggcagcacaatcgtgaacaggcaaatctgaactcacgcacagaggaaaccattaaattcgccgccgctcactataacaccgagatcctgaagagcatcgacaacgaatggcggaagacacaatgtatgcctcgcgaggtgtgtatcgatgttggcaaagagtttggggtcgctacaaacacattctttaagcccccttgcgtgtctgtttacagatgtggtggatgctgtaactctgagggactccagtgtatgaatacatcgacgtcttacttgtccaaaacccttttcgaaattaccgtcccactgagtcaggggccgaagcccgttactatttctttcgcgaatcacacatcctgccgatgtatgagtaagctggatgtctaccgccaggtgcactccattattagaagatctctacctgccactcttccccagtgccaggcagccaacaagacatgtcccacaaactatatgtggaacaaccacatctgtcggtgcttagcacaagaagattttatgttctccagtgacgccggagacgactcaacggacggcttccacgacatctgcgggccaaataaggaactggacgaggaaacctgccagtgcgtttgtcgcgcgggcttgagacctgcaagctgcggcccccataaagaactggatcgcaattcctgccaatgtgtgtgtaagaataagctgttcccttctcagtgtggtgctaaccgcgaattcgatgaaaacacctgtcagtgtgtatgcaagaggacctgcccaaggaaccagcctctgaaccccggtaaatgcgcttgcgagtgtactgagtcaccacagaaatgccttttgaaaggaaaaaaattccatcaccagacatgttcctgttatcgaagaccatgtaccaatagacagaaggcgtgtgagcccgggttctcttattccgaggaagtgtgccgttgtgtccccagctattggaaacggcctcagatgatgagt

SEQ ID NO: 21014 - DNA, 1260 bp, Artificial Sequence
  Description of Artificial Sequence: Synthetic coding sequence
atgcacctgctgggattcttttcggtggcatgttcgctgcttgcagcagcacttcttccgggtcctagagaggcccctgcggctgcggcagcgtttgaatcgggacttgatctttcagatgctgaacctgatgcaggtgaagccactgcatacgcatccaaggacctggaggaacagcttagatcagtgtcgtcagtggatgaacttatgaccgtcctctaccctgagtactggaaaatgtacaaatgtcagcttagaaagggagggtggcaacacaaccgagagcaggcgaaccttaactccaggaccgaggaaactattaagtttgccgcagcgcattacaatactgaaattctcaagtcaatcgataacgagtggagaaagacccagtgtatgccacgggaagtctgtatagacgtcggtaaagagtttggtgtggccactaacacctttttcaaaccgccttgtgtctccgtgtaccgatgcggaggatgttgtaactccgaaggactgcagtgcatgaatacctccaccagctacttgagcaagactctttttgagatcaccgtgcctctgtcgcaaggaccgaagccagtgactatttccttcgcaaaccacacctcatgcaggtgtatgtccaaattggatgtctaccgccaagtgcattcaataatcagacggtcccttccagccactctgccacaatgccaagcagcaaacaaaacgtgtcctacgaactatatgtggaacaaccacatctgccgatgtctggcacaggaggactttatgttttcgtctgatgcgggtgatgatagcaccgatggttttcatgatatctgtggtcccaacaaggagctggacgaagaaacttgccagtgcgtgtgccgcgccggacttagacctgcatcgtgcggacctcacaaggaactggaccgcaattcatgtcagtgcgtgtgtaagaacaagctgtttccttcccagtgcggtgcaaacagagaattcgacgagaacacgtgccagtgtgtgtgtaagaggacgtgccctcgaaatcaaccgctcaatcctggaaaatgcgcatgtgaatgcacggaaagccctcaaaagtgtctccttaagggaaaaaagttccatcatcaaacctgcagctgctaccgccggccctgcactaacagacagaaggcatgtgaacctgggttcagctactccgaagaggtctgcagatgcgtcccatcttactggaaacgcccccaaatgatgtcg

SEQ ID NO: 21015 - DNA, 1260 bp, Artificial Sequence
  Description of Artificial Sequence: Synthetic coding sequence
atgcacctgcttggtttcttttcggtcgcatgcagcctgctggcagcggcactcctgcccggcccacgggaagcaccagcagctgccgccgcattcgaatcgggactcgatctctccgacgccgaaccggacgcgggagaagccactgcatatgcctcaaaggacttggaagagcaactccgcagcgtgtcctccgtggacgaacttatgactgtgctctacccagaatactggaagatgtacaaatgtcaattgcgcaaggggggatggcaacataatcgcgaacaagcgaatctgaactcaagaaccgaagagactatcaaatttgccgcggctcactacaacaccgagatcttgaagtccattgacaacgaatggagaaagactcagtgcatgccgcgcgaagtgtgtatcgatgtgggaaaagagttcggagtggcgaccaacacttttttcaagcccccatgcgtcagcgtttaccggtgcggaggatgctgcaactcagaggggctgcaatgcatgaacacctcgacttcctaccttagcaagacgctgttcgaaatcacggtgccgctctctcagggcccgaagcccgtgaccatctcgttcgccaaccatacttcttgtagatgcatgagcaaactggatgtgtacaggcaggtccactcgattatcagaagatccctccctgccaccctcccacagtgccaggctgccaataagacgtgccctactaactatatgtggaataatcacatttgcagatgcctggctcaagaggactttatgttctcctcagatgcgggagacgactctactgatggctttcatgacatctgcgggcctaataaggagctcgatgaagaaacctgccagtgcgtgtgtcgcgcgggcctcaggcccgcgtcatgcggaccgcacaaggaattggaccgcaattcgtgccagtgcgtatgcaagaataagctcttcccatcacagtgcggagccaaccgcgaattcgatgagaacacctgccaatgcgtctgcaagaggacctgcccccggaaccagcctctgaacccaggaaagtgcgcctgcgagtgtactgagtcgccccagaagtgcctgctcaagggcaagaaattccaccatcagacgtgcagctgttaccgccggccgtgtactaatagacagaaggcctgtgaaccaggtttctcgtactcggaagaagtgtgccggtgtgtgccgagctactggaaaagacctcagatgatgtcg

SEQ ID NO: 21016 - DNA, 1260 bp, Artificial Sequence
  Description of Artificial Sequence: Synthetic coding sequence
atgcacctactgggcttcttttctgttgcttgctcccttctagcggccgcattgctccccggccccagagaggccccagcagccgccgccgcgtttgagtcggggttggacctgagcgacgcagagccagacgcgggagaggcgacagcatacgcatctaaggacctggaagagcagctcaggtctgtaagctccgttgatgaactgatgactgtattgtatcctgagtattggaagatgtacaaatgccagctccggaaagggggttggcagcataatcgcgaacaggccaatctcaacagtagaactgaagaaactattaaatttgccgccgcacactataacaccgaaattttgaaatccatcgacaacgaatggagaaagacacagtgtatgccgagagaggtatgcatcgacgtgggcaaagagttcggggtcgccaccaacacctttttcaagcctccttgtgttagtgtgtaccggtgtggcggatgttgcaactcggagggcctgcagtgtatgaacactagcacctcttacctgtccaaaaccctgttcgagatcactgttccactgtcccaaggtcccaagccggtgacaatttcattcgccaaccacacttcatgcaggtgtatgagtaagctggatgtttatcgccaggtgcatagtattatacgcagatcattaccggcaaccctgccacagtgtcaggcagcaaataaaacatgccctacaaactatatgtggaacaatcacatttgccggtgcttggctcaggaggactttatgttcagcagtgacgcgggtgatgattctactgatggttttcacgatatttgcggccctaataaagaactggacgaggagacctgccagtgcgtgtgtagggctggactgaggcccgcatcttgcggcccccacaaagagttggacaggaatagctgtcaatgtgtgtgcaaaaataaactattcccctcccagtgcggtgcaaatcgtgagttcgacgagaatacatgtcagtgcgtttgtaagaggacgtgcccaagaaaccaaccactgaaccccggcaaatgtgcatgcgaatgtactgaaagcccccaaaagtgtctgctgaaagggaaaaaattccatcaccagacttgctcatgttatcgacggccttgcaccaatagacagaaggcttgcgagcccggcttctcctactccgaggaggtgtgccgctgcgtgccaagttattggaaacgccctcagatgatgtca

SEQ ID NO: 21017 - DNA, 1260 bp, Artificial Sequence
  Description of Artificial Sequence: Synthetic coding sequence
atgcaccttttagggtttttctccgtagcctgttctctgctggctgccgccctccttcccgggcccagagaagcacccgccgccgccgccgcgttcgagtccgggctggatctgtctgatgctgaacccgacgccggggaggcaacagcctatgcatctaaagatcttgaagagcaactgagatctgtgtcctccgtggatgaactgatgacagtgttatatcccgaatactggaaaatgtataaatgtcagctgcgaaaaggagggtggcagcacaatcgggaacaggctaatttgaattccagaacagaagaaacaattaaatttgccgctgcccattacaatacagaaattctgaaatctatagacaacgaatggcggaaaacacagtgtatgccacgggaagtgtgcatcgacgtagggaaggaattcggagtagcaacaaatacattcttcaaacccccctgtgttagtgtttacaggtgtggagggtgctgtaactctgaagggttacagtgtatgaatactagtacatcctatctctccaaaactctttttgaaataacagtacccctctcccaggggcctaaaccagtgacaatatccttcgccaaccatacttcatgcagatgcatgtcaaaattagacgtttaccggcaggttcattccataatcagacggagtctccctgccacgctgccacagtgtcaggcagccaacaaaacatgccccactaattacatgtggaacaaccacatatgccggtgtctagcacaggaagatttcatgttttcctctgatgctggggatgattccactgatgggttccatgacatttgtggaccaaataaagaactggatgaagaaacttgtcagtgtgtatgccgcgcaggactcagacctgcatcatgtgggccacacaaagagctcgataggaattcttgtcagtgtgtgtgcaaaaacaaactttttccttcccagtgcggagctaatcgagaattcgacgagaacacatgccagtgcgtgtgtaaaagaacatgcccccggaaccagcctctaaatccagggaagtgtgcctgtgagtgcactgaatcaccccagaaatgcctactaaaagggaaaaaattccaccaccagacatgttcttgttataggaggccctgcactaatagacagaaggcctgcgaacctggattctcatatagtgaagaagtatgccggtgtgtgccatcgtattggaaaaggccacagatgatgtca

SEQ ID NO: 21018 - DNA, 1260 bp, Artificial Sequence
  Description of Artificial Sequence: Synthetic coding sequence
atgcatctcctcggattcttctccgtggcctgctcgcttctggccgcggcccttcttcccgggccgcgggaagcaccggccgcggcggccgcatttgaaagcggtttggatttgtcggacgcggaaccagatgcgggtgaagccaccgcctacgcgagcaaggatctggaagaacagttgagatcagtgtcatccgttgacgagctgatgactgtgctgtaccccgagtactggaagatgtataagtgccagcttcggaagggaggatggcaacacaaccgggaacaagcaaatctgaattctcgcaccgaagaaaccattaagttcgcagccgcccattacaataccgaaatcctcaagtcgatcgacaacgagtggcggaaaactcaatgtatgccaagggaagtgtgcatcgatgtgggtaaggagttcggagtggcgactaacacctttttcaagccgccatgtgtgtcagtctacagatgtggaggatgctgcaactccgaaggattgcagtgcatgaacacgtccacttcatacctgtccaagacgctgttcgagatcaccgtgccgctgagccaaggtccaaagcccgttaccatctccttcgcgaatcacacctcctgcagatgcatgtcgaagctggacgtctaccgtcaggtgcactcaatcatcaggagatcgctgcctgccactctcccgcagtgccaagccgctaacaagacttgtccgactaattacatgtggaacaatcatatctgtagatgcctggcgcaagaggatttcatgttctcatccgacgccggagacgattccacggatggtttccacgacatctgcggcccgaacaaagaactcgacgaagagacttgccagtgcgtctgccgcgccggcctgcgcccggcttcctgcggaccgcacaaggagctggaccgtaactcctgtcagtgcgtgtgcaagaacaagctgttcccatcgcagtgcggggctaaccgggaattcgacgaaaacacctgccagtgtgtgtgcaagagaacctgccctagaaaccagcctctgaacccagggaagtgcgcttgcgagtgcaccgaatcgccgcagaagtgccttctgaaaggtaagaagttccaccaccagacctgctcctgctaccggcgcccgtgcactaaccgacagaaggcttgtgaaccaggtttttcgtactcggaggaggtgtgccggtgtgtcccatcctattggaagcgcccgcagatgatgtct

SEQ ID NO: 21019 - DNA, 1260 bp, Artificial Sequence
  Description of Artificial Sequence: Synthetic coding sequence
atgcacttattgggttttttttcagttgcgtgctctcttctggcggctgcactacttcctggacctcgagaagctccggctgctgcagcagcattcgagtcgggtcttgacctgagcgacgctgaacctgacgcaggggaagctacagcgtacgcctctaaagacctggaagaacagcttcgatctgtttcaagcgttgatgaactgatgactgtcctgtatccggagtactggaaaatgtacaagtgccagctgcgcaaagggggatggcaacacaaccgagaacaggctaatctgaattcgcgcacggaagagacaattaaatttgccgcagctcactacaacacggagattttgaaaagcatcgataatgaatggcggaaaacacaatgtatgcctcgggaggtctgtattgatgtcggcaaggagtttggagtcgcgactaacacattcttcaaacctccttgtgtctctgtttatagatgcggtggatgctgtaactctgaaggattgcaatgcatgaatacttccacatcatacttatcaaaaacactctttgaaatcactgtaccgttatcccagggccctaaaccagttacgatttcatttgctaaccatacaagctgccggtgtatgtctaaattggatgtatatagacaagtgcacagcattattcggcgctcactgccggctacccttccacagtgtcaggcggcgaacaagacttgcccaacaaactacatgtggaataatcacatatgccggtgcctggcacaggaggactttatgttctcctctgatgcgggggatgattccaccgacgggttccatgatatttgcggtcccaacaaagaacttgatgaggaaacttgtcaatgtgtctgtcgtgccggcttgagaccagcgtcatgtggacctcataaagagcttgatcgtaacagttgtcaatgtgtttgcaagaataaattgtttccgtctcagtgcggcgcaaatcgtgaattcgacgaaaatacatgtcaatgtgtttgcaagcgaacatgcccgcgtaatcagccgcttaatccgggcaagtgtgcctgtgagtgtacagaatcacctcaaaagtgtcttctaaaaggcaaaaaatttcatcatcaaacgtgtagttgttacagaaggccgtgtacaaatagacagaaagcttgtgaaccaggcttttcttatagcgaggaagtttgccgttgcgtcccatcatattggaaacgtccgcaaatgatgtca

SEQ ID NO: 21020 - DNA, 510 bp, Artificial Sequence
  Description of Artificial Sequence: Synthetic coding sequence
atggatactcgaaataaggcgcaactacttgtgctcctgactctcctgtcagtgctgttttcccagacctcagcatggcccctgtacagggcgcctagcgcacttcgcttgggcgacaggatcccatttgaaggtgctaatgagccagaccaggtctcactgaaggaagatatcgacatgctgcagaatgcccttgctgagaatgacactccttattacgatgtctcaaggaacgccaggcacgctgacggcgtctttacatcagacttttcaaagctactcggccagttatccgcgaaaaaatacctggagagcctgatgggaaagagggtaagtagcaacattagcgaggatccggttcccgtaaaaaggcacagtgatgctgtttttaccgacaactatactcgcctgcggaagcagatggcggtgaaaaagtatctgaactcaatcctaaatggtaagaggagttcagaaggtgaaagccctgattttcctgaagagctggagaag

SEQ ID NO: 21021 - DNA, 510 bp, Artificial Sequence
  Description of Artificial Sequence: Synthetic coding sequence
atggacactagaaataaggcccaactgctggtactactcaccttacttagcgtgttattctcacagaccagtgcatggcccctgtatagagccccatcggccctgcgcctcggcgaccgaattccgttcgagggagccaatgagcccgatcaggtgagccttaaagaggatattgatatgctccaaaacgccctggcggagaacgacacaccatattatgacgtttctcgcaacgcccgccatgcggatggcgtatttacctctgattttagcaaattgctgggtcagttgtccgccaagaaatatctggagagtcttatggggaagcgggtgtcttcaaacatcagcgaagatccagtgcctgtaaaacggcatagcgatgccgtgttcaccgacaactatacccggcttcgtaaacagatggcagtgaagaaatatctgaacagcatcctgaacggtaagcgcagtagcgagggtgagtctccggattttcccgaagagctggagaag

SEQ ID NO: 21022 - DNA, 510 bp, Artificial Sequence
  Description of Artificial Sequence: Synthetic coding sequence
atggacacgcgcaataaggcccaacttctggtactgttgacattgttgtcggtgttgttctcccaaacgagcgcctggcccttgtacagagcgccgtcggcccttagactcggagatcgaattccgttcgaaggagccaatgaaccagaccaggtctccttgaaggaagacattgacatgctgcaaaatgctctggcggagaatgatacgccgtattatgatgttagtcgcaacgctcgccacgccgacggagtattcacatccgatttttctaagctcctggggcagttgagcgccaagaaatatttggaaagcttgatgggcaagcgcgtgagttcaaacataagcgaggacccggtgcctgtgaagcgtcattcggatgccgtgttcacagataactacacacgacttcgtaagcaaatggcagtaaagaagtacctgaatagtatactgaacgggaagcggtcgtcggagggcgagtcaccagatttccccgaagagctggaaaag

SEQ ID NO: 21023 - DNA, 510 bp, Artificial Sequence
  Description of Artificial Sequence: Synthetic coding sequence
atggatactcggaacaaggcccagctccttgtgctcctgactctcctgtcggtgctgttctcccaaacctcagcctggccgctgtaccgcgcacccagtgctctgcgcttgggggaccgcatcccgttcgagggagctaacgagccggatcaagtcagtctcaaggaagatatcgatatgcttcagaacgccctggccgaaaatgacactccttactatgacgtttcgaggaacgcgaggcacgccgatggtgtctttacgtcagatttcagcaaattgctgggtcagctctccgcaaagaaataccttgaatcgctgatgggaaagcgcgtctcttcgaatatctccgaggaccccgtgccggtcaagagacattcagacgctgtgtttaccgacaattacacccggcttcgcaagcagatggcagtgaaaaagtacctcaatagcattctgaacggaaaaagaagttccgaaggcgagtcacctgatttcccggaagagcttgaaaag

SEQ ID NO: 21024 - DNA, 510 bp, Artificial Sequence
  Description of Artificial Sequence: Synthetic coding sequence
atggataccaggaataaggctcagcttctggtccttctgaccttgctgtcggtccttttttcacaaaccagcgcatggccgctgtacagggcacctagcgcactgcggctgggtgaccggatccctttcgaaggtgccaacgagccagatcaagtgtcacttaaagaagatattgacatgctgcaaaacgcgcttgccgagaacgacactccatactacgatgtctcgagaaacgcaaggcacgcggacggcgtgtttacctcagatttcagtaaacttctgggacaactgtcggcaaaaaagtaccttgaatcccttatggggaagagagtctcgtccaacatatccgaagatcctgttccagtgaagcggcatagcgatgctgtgttcactgataactacactcggctgaggaagcaaatggcagtgaagaagtaccttaactcgatcctcaacgggaagcgaagctccgaaggcgagtccccagactttccagaagaacttgagaag

SEQ ID NO: 21025 - DNA, 510 bp, Artificial Sequence
  Description of Artificial Sequence: Synthetic coding sequence
atggatacccggaacaaagcccagttgctcgtgctgctcactctcctgagcgtcttgttctcccaaacgtccgcatggccactgtaccgagcgccgtccgcccttaggctgggagacagaatcccgtttgaaggtgcgaacgaacccgatcaggtcagcctgaaagaggacatcgacatgctgcagaacgctttggcagaaaatgacaccccgtattacgacgtgagcagaaatgcacggcacgccgatggcgtgttcacttccgatttttcgaaactcctcgggcagctgtccgcgaagaagtacctggagtcgcttatgggaaagcgcgtcagcagtaatatctcagaggacccagtgcctgttaagcgccattcggacgccgtgttcaccgacaactacactcgcctgcgcaagcaaatggctgtgaaaaagtaccttaactcaattctgaacggaaagcggtcatcggagggcgaatctcctgatttcccggaagagctggaaaag

SEQ ID NO: 21026 - DNA, 510 bp, Artificial Sequence
  Description of Artificial Sequence: Synthetic coding sequence
atggatactagaaacaaggcacaacttctggtgttgcttacccttctttcggtgcttttctcacaaacttcagcgtggcctctgtacagggccccatcagctctccggcttggagacagaattccatttgaaggtgccaatgaacccgatcaagtcagtctcaaagaggatattgatatgcttcagaacgcactcgcagaaaacgatactccatactacgatgtgtcgaggaacgcaagacacgccgatggagtctttacttccgacttctccaaactgcttggacagctttcagccaagaaataccttgagagccttatgggcaagcgtgtctcaagcaacatatccgaagatccggtccctgtgaaacgacatagcgatgcagtgtttaccgacaactacacccgactgagaaagcaaatggcagttaagaagtatctgaactcaattctcaatggtaaacgctcgtccgaaggagaatcccccgattttccagaggaactggaaaag

SEQ ID NO: 21027 - DNA, 510 bp, Artificial Sequence
  Description of Artificial Sequence: Synthetic coding sequence
atggacacccggaacaaggcccaactgctggtcctccttactctcttgtcagtgcttttcagccagacttcagcgtggccgctctaccgggcaccaagtgcactgagactgggcgatcgtatcccattcgaaggagccaacgagccggaccaagtatccctcaaggaagatatcgatatgctccagaatgccctcgctgaaaatgataccccttattacgatgtttcgcgcaatgctcggcatgcggacggagtctttacctccgatttctcaaaacttctggggcagctgtcagctaagaagtacctggaatccctgatgggtaagcgggtgagctccaacattagcgaggacccggtgcctgtgaagcgccactcggacgccgtgtttactgacaattacactcgactgcgcaaacagatggcagtgaagaagtacttgaacagcatactcaacggcaaaaggtcgtcggaaggagagagcccggactttcccgaggagttggagaag

SEQ ID NO: 21028 - DNA, 510 bp, Artificial Sequence
  Description of Artificial Sequence: Synthetic coding sequence
atggatacaagaaataaagctcagttacttgttcttttaacattattatctgttctattctcccaaactagtgcatggccattgtatagagcaccatcagcattaagattaggtgacagaattccatttgaaggagcaaatgaaccagaccaagtttcacttaaagaagatattgatatgttacaaaatgcattggcagaaaatgacacaccatactatgatgttagtagaaatgctagacatgcagatggggtttttacatctgatttttcaaaattattaggacaacttagtgcaaaaaaatatttagaatctcttatggggaaacgagtatctagtaatatatctgaagatccagtaccagtaaaaagacattctgacgctgtattcacagataattatactcgtttaagaaagcaaatggctgttaaaaaatatcttaattcaattttaaatggaaagagatcctcagaaggagaatcaccagacttccctgaagaattggaaaaa

SEQ ID NO: 21029 - DNA, 510 bp, Artificial Sequence
  Description of Artificial Sequence: Synthetic coding sequence
atggatacgcggaacaaggcgcagttattggttttgctcacattactttcggtcttgttttcacagacttctgcgtggcctctgtatcgggccccttccgcactgcgccttggagaccgcattccgtttgagggcgctaacgaacctgatcaggtaagccttaaagaggacattgatatgttacagaatgctctcgctgagaatgatacaccgtattacgacgtatctcgtaatgctagacatgctgatggtgttttcacgtctgacttttctaagttgcttggacaactgtcagctaagaaatatcttgaatctttaatgggaaagcgggtttcttctaatatttcagaggatccggtcccggtgaaaagacactccgatgcggtctttactgataactatacacgattgagaaaacaaatggcggttaagaaatacctcaattctatcctcaatgggaagagaagcagcgaaggagagagcccggacttcccggaagaacttgaaaaa

SEQ ID NO: 21030 - DNA, 510 bp, Artificial Sequence
  Description of Artificial Sequence: Synthetic coding sequence
atggacacacgaaacaaggcacagctattggtccttctcacacttctgtctgttttattttctcagacgagcgcctggccactatatagggctccctccgccttgcggctcggagatagaatcccttttgaaggcgcaaacgaacctgatcaagttagtttaaaagaggatattgacatgctccagaacgccctcgctgagaacgacaccccatactatgacgtgtcgcgaaacgctcgccacgctgacggggtgtttacaagcgatttttccaaactgctgggtcaactctcagctaagaagtatcttgagtccctgatgggcaaaagggtttccagcaacatttccgaagatcctgtgccagttaagaggcacagcgatgctgtttttactgacaattatacacgcctgcggaaacagatggctgtgaaaaagtacctgaactccatcctgaacgggaaaaggtctagtgagggtgagagtcctgatttcccagaagagttagagaaa

SEQ ID NO: 21031 - DNA, 510 bp, Artificial Sequence
  Description of Artificial Sequence: Synthetic coding sequence
atggacacgcgcaataaggcgcagctcttggtgcttctcactctcctctcggtgcttttttcacaaacctcggcatggcctctgtatcgagccccaagcgcattgaggctgggagatagaatcccgttcgagggcgcaaacgagcccgaccaggtgtcgttgaaggaggatatcgacatgcttcaaaacgcgctggccgaaaatgataccccatactacgacgtgagccggaacgctagacacgcggatggagttttcacttccgatttctctaaactgctgggccagctctccgccaagaaatacctcgagtccctgatgggtaagagagtcagctctaacatctcggaggacccggtcccggtgaagcggcattccgacgccgtttttactgacaattacaccagactgcggaagcagatggcggtgaaaaagtacctgaactccattctcaacgggaaaaggtcgtcggaaggagagtctccggatttcccagaagaattggaaaag

SEQ ID NO: 21032 - DNA, 510 bp, Artificial Sequence
  Description of Artificial Sequence: Synthetic coding sequence
atggatactcgcaataaagcccagctgctggttctgctgacgctactgtccgtcctgttttcacagacctctgcttggcccctctacagagccccctcagccctgcggttgggggataggatacctttcgagggtgccaatgagcctgaccaagtttctcttaaagaggacatcgatatgctgcagaatgcattagccgagaacgatactccctattatgacgtgtcaaggaatgccagacatgcagatggagtcttcacctccgatttctcgaagctcctcgggcagttgtctgccaagaaatacttggaaagccttatgggtaaaagggtgtcctccaatatctccgaagaccctgtgccagtgaaacgccatagcgacgccgtgtttacggacaactatacccgcctccgcaaacagatggccgtgaaaaagtatcttaacagcattctcaacgggaagcgctcttcagagggggaatctcccgattttcccgaagaactggaaaag

SEQ ID NO: 21033 - DNA, 510 bp, Artificial Sequence
  Description of Artificial Sequence: Synthetic coding sequence
atggataccaggaacaaggcccaactcttggtgttgctgacccttctatcggtcctgtttagccagacatccgcttggcccttgtacagggctccctctgcattaaggctgggagataggatccctttcgaaggcgctaacgaaccagaccaggtatccttgaaagaggatattgacatgctacagaacgcccttgccgagaacgataccccttactatgacgtgtcccggaatgcacgccacgctgacggcgtttttactagtgacttttctaaactattaggacagctgagcgccaaaaagtatttggagagccttatggggaagcgagttagctcaaatatttctgaagatcctgtaccagtgaagagacattccgacgctgtgtttaccgataactatacaaggctgaggaaacagatggctgttaagaaatatcttaacagtatcctgaatgggaagagatcgtcggaaggtgaaagccccgattttccagaggaactcgaaaag

SEQ ID NO: 21034 - DNA, 510 bp, Artificial Sequence
  Description of Artificial Sequence: Synthetic coding sequence
atggatacaagaaataaagcgcaattactggtcctgctgactttgttgagcgtgctgttttctcagactagcgcttggcccctttatcgggcaccatcggcgctccggctaggcgatagaatacccttcgaaggagccaatgaaccagatcaggtttctctcaaggaagatatcgatatgctgcagaacgccctggcagaaaacgacacaccatactatgatgtctctcgcaacgcgcggcatgctgatggcgtgtttacttctgattttagcaagcttctggggcaactaagtgccaagaagtacctagagagtctgatgggaaagcgggtgagttccaatatatctgaggaccccgtgccggtcaagaggcattccgatgctgtcttcacagacaattatactcggctgcggaaacagatggcagttaagaagtatttaaacagcatcctgaatggaaagcgaagctctgaaggagagagccccgactttccagaggagttggaaaaa

SEQ ID NO: 21035 - DNA, 510 bp, Artificial Sequence
  Description of Artificial Sequence: Synthetic coding sequence
atggacacccggaataaggcccaacttctcgtgttgctaacactgcttagcgttttgttttcccagacttccgcctggcctctttaccgcgctccgagcgccctgcgtttgggcgataggataccatttgagggcgcgaacgaaccggatcaagtatccttgaaggaagacattgatatgcttcaaaacgccttggctgagaacgataccccatactacgacgtatctcggaatgcaaggcatgcagacggggtgttcacatcagatttttcaaagctgctgggccaactgagcgcgaagaagtaccttgagtctttaatgggaaagcgcgtttctagcaatatctccgaggacccagttccggtaaaacgccactctgacgctgtgttcacagataactacacgcggttgaggaagcagatggcagtaaaaaagtatttaaattctatcttgaacggtaagaggtcaagtgagggtgaatcaccggatttcccagaggagcttgagaag

SEQ ID NO: 21036 - DNA, 510 bp, Artificial Sequence
  Description of Artificial Sequence: Synthetic coding sequence
atggatacgcggaacaaggcacaactgctcgtgctgttgactcttctgagcgtccttttttcgcaaacctcggcctggcccctttaccgagcaccctccgcacttcggcttggcgatagaattccttttgaaggcgctaacgaacccgaccaagtttcactcaaggaggacattgatatgctgcagaacgcgctcgcggagaatgatactccttactatgatgtgtccagaaatgctagacacgccgatggagtgttcacctcagacttctccaagctgcttggacaactctcggcaaagaaataccttgaatcgctcatgggtaagcgggtgtcatccaacattagcgaagatcctgtgcctgttaagcgccacagcgacgcagtgtttaccgacaattacacccgtctgcgcaagcaaatggcagtgaaaaagtaccttaattccatcttgaacggtaaaagatcctctgagggtgaatcacctgacttcccagaagaactcgaaaaa

SEQ ID NO: 21037 - DNA, 510 bp, Artificial Sequence
  Description of Artificial Sequence: Synthetic coding sequence
atggatactcgaaacaaagctcagctgctggtgctgctgactttgctctcagtgcttttctcccagacctcggcatggcccctttatagggcaccctcagcgcttcggcttggcgatcggatcccatttgagggagccaacgagcctgatcaagtgtccctcaaagaagatatcgacatgcttcagaacgcgctggcagagaacgataccccatactacgacgtcagccgcaatgctcgtcacgcagatggagtgttcaccagcgatttttccaaacttctcggtcaactgtcagcgaagaagtacttggaatcacttatgggcaagcgcgtctctagcaacattagcgaagatccggtgcctgttaagcggcattcggacgcagtatttacggataactacacccggcttcggaagcaaatggcggtgaaaaagtatctgaactccatactcaacgggaagcgttcgagcgaaggagaatcacctgattttcccgaagagctggagaag

SEQ ID NO: 21038 - DNA, 510 bp, Artificial Sequence
  Description of Artificial Sequence: Synthetic coding sequence
atggacacccggaataaagcacagctgcttgtgctgctgaccctgctcagcgtgctcttctcccagactagcgcctggccgctgtaccgggctccgtcggccctgcggctgggggaccggattccattcgagggcgccaatgaaccggatcaagtgagcctcaaggaagatatcgatatgctgcagaacgctctcgctgaaaatgacaccccatactacgacgtgagcagaaatgccagacatgccgatggagtgttcacctcggacttcagcaagctgcttggccaactgtcggcaaaaaagtacctggagtccctcatgggcaagcgcgtctcctctaatatctcggaagatccagtgcccgtgaagcgccattccgacgcggtgtttactgacaattacaccagattgcgcaaacagatggccgttaagaagtatctgaattccatcctcaacggaaagcgctccagcgagggagaatcgcccgatttcccggaggagctcgaaaag

SEQ ID NO: 21039 - DNA, 510 bp, Artificial Sequence
  Description of Artificial Sequence: Synthetic coding sequence
atggatactagaaacaaggcccagctgctcgtcctcctgactttgctctcggtgctgttctcgcaaacctctgcctggcccctctacagagcaccttcggcactgaggctcggtgatcggattccatttgagggcgccaacgaacccgaccaagtgagcctgaaagaagatattgacatgctccagaacgcacttgcagagaacgataccccatactacgacgtctcgcggaacgcccgccatgcagatggagtgtttacttctgatttttcgaagttgcttgggcaactgagcgccaaaaagtaccttgaatcccttatggggaagcgcgtttcgtcgaatatctccgaagatcctgtgcctgtcaagagacactcggacgcagtgtttaccgacaattacactagattgcgcaagcagatggcggtcaagaaatacctgaactctatcctgaacggtaagagatcaagcgagggagaatcgcctgactttccggaagaacttgaaaag

SEQ ID NO: 21040 - DNA, 510 bp, Artificial Sequence
  Description of Artificial Sequence: Synthetic coding sequence
atggataccagaaacaaggctcaactgctcgtcctcctaactctgctcagcgtcttgttctcgcagacctccgcctggcccttgtaccgggcccctagcgctttgcgcttgggggaccgcattccatttgagggtgctaacgagcccgaccaggtttcgctgaaagaggacatagacatgctccaaaacgcgctggcggagaatgatacgccctactatgacgtcagtcggaacgctcgccacgctgacggtgtcttcacgagcgacttctccaagctcttgggccaactgtctgccaagaagtacctagaatccctcatgggtaaacgcgtctcctcgaacatctcggaggatcctgtgccggttaagcgccacagcgacgcagtcttcaccgataactacacacggctgcgaaagcagatggccgtcaagaagtacttgaattccatactcaacggaaaacgtagttctgagggtgaatccccagactttcctgaggaacttgagaaa

SEQ ID NO: 21041 - DNA, 510 bp, Artificial Sequence
  Description of Artificial Sequence: Synthetic coding sequence
atggatacaagaaataaagcgcagcttctggtgttgcttaccttgttgtcggttcttttttcgcaaacttctgcttggccactttatagagctccttcggctcttagacttggagatagaattcctttcgaaggagcaaatgagccagatcaagtctccttaaaagaagacatcgatatgctccagaatgctcttgcggagaatgacacaccgtattacgatgtgagtagaaatgctcgacatgctgatggagtatttacatcagattttagtaagctgcttggacaacttagtgcgaaaaaatatctggaatctttgatgggtaagcgtgtctcttctaacatctcagaggatcctgtcccggtgaagagacattctgacgcagtattcacagataattatacaagattacggaaacagatggcagttaagaaatatttgaatagtattcttaatggtaaaagatcatcggagggggaaagtccggactttccagaggagcttgagaaa

SEQ ID NO: 21042 - DNA, 510 bp, Artificial Sequence
  Description of Artificial Sequence: Synthetic coding sequence
atggatacgcggaacaaggcacagctcctggtgctgctaactctgctctcagtcttgttctctcaaacctccgcctggcctctgtatagagcaccatcggcgttgcgcttgggagatcgtatcccgtttgaaggtgccaatgagcctgaccaggtctcactgaaagaagatatcgatatgttgcaaaatgctttagccgaaaacgataccccgtactacgacgttagccgaaatgccaggcacgctgacggggtcttcaccagtgacttctccaaattactgggccagctgagcgcaaaaaagtacctcgaatccctaatgggaaagcgcgttagttcgaacatttccgaggatcctgttcccgtcaagcgtcacagcgatgctgtgttcactgataactacacgaggctgcgaaaacaaatggccgtgaaaaaatatttgaatagcatcctgaatgggaaaaggtctagtgaaggtgagtctccggactttcccgaagaacttgaaaaa

SEQ ID NO: 21043 - DNA, 510 bp, Artificial Sequence
  Description of Artificial Sequence: Synthetic coding sequence
atggacaccaggaacaaagcacagctgttggtcctcctgaccctgctcagcgtgttgttcagccaaacttccgcatggcctctgtacagggcaccttcagcccttcggcttggtgatcgaattccatttgaaggagccaacgaacccgaccaggtgtcgctgaaggaggacattgatatgctccagaacgcgctggcggagaatgacacgccttattacgatgtcagccgcaacgcccggcacgccgatggggtttttactagcgattttagcaaactccttgggcaactcagtgcaaagaagtaccttgaatcccttatggggaaacgcgtgtcgtctaatatctccgaagatccagtgcctgtgaagcgtcattccgatgcggtattcactgataactacacccgactcagaaagcaaatggcagtgaagaagtacctgaactccatactgaacggtaagaggagctccgagggagaatcgcccgattttcctgaagagttggagaag

SEQ ID NO: 21044 - DNA, 510 bp, Artificial Sequence
  Description of Artificial Sequence: Synthetic coding sequence
atggacacccgaaacaaggcgcaactgctggtcttgttgactctgctctcggtgctgttctcccagacctcggcatggcctctgtaccgcgcccccagtgcattgagactcggagatcgcattccgtttgagggagcaaacgaacccgatcaagtatcgctgaaagaagatattgatatgctgcaaaacgctctggccgaaaacgatactccgtactacgatgtgagccgcaatgccagacatgctgacggtgtgtttacttccgatttctccaagctgctcggtcaacttagcgcaaagaagtaccttgaatcgctgatgggaaagcgcgtgtcgagcaatatctccgaggacccagtgcctgtgaagagacattctgacgccgtctttaccgataactacactagacttaggaagcagatggccgtgaaaaagtacctgaattcgattcttaacggcaaaaggtcaagcgagggagaatcaccagacttcccagaagagctggaaaaa

SEQ ID NO: 21045 - DNA, 510 bp, Artificial Sequence
  Description of Artificial Sequence: Synthetic coding sequence
atggacacaaggaataaggctcagctcctggtgttgctcactctactttccgttttattttctcaaacaagcgcctggcctttgtatcgggctccaagcgcgctccggctcggggatagaataccttttgagggggccaatgaaccagaccaggtgtccctgaaggaggatatcgacatgctgcagaatgctctggctgagaacgatacaccttattatgacgtgtcccggaatgcacgacatgctgatggcgtattcacctcggactttagtaagctgctgggccagttgagcgccaagaaatacctcgaatcattaatgggtaagcgggtcagttcaaacattagcgaagatcctgtaccagtgaagagacactctgacgctgtgttcactgacaattatacacgcctgcgaaagcagatggccgtgaaaaagtatttaaattccatcctaaacggaaagcgatcaagtgagggcgaatctcctgattttccagaggagctcgagaag

SEQ ID NO: 21046 - DNA, 510 bp, Artificial Sequence
  Description of Artificial Sequence: Synthetic coding sequence
atggacacccgcaacaaggctcagttactcgtcttacttactctgctgagcgtcctgttcagccagacgagtgcctggccactatatcgcgccccgagcgccctccgcctgggtgacagaattccctttgagggggccaacgagcccgatcaggttagtcttaaggaagatatagacatgctgcagaatgcgcttgcagaaaatgataccccatactacgacgtttcaagaaacgcacgacatgccgacggtgtgttcaccagtgactttagtaaactccttggtcagctcagtgctaagaaatatctggagtctctaatgggcaagagagtaagctcaaacattagcgaagatccagtgcccgtcaagaggcatagcgacgcagtcttcaccgataattacaccaggctgcgcaagcagatggccgttaagaagtacctcaattcaattctcaacggaaagcggtcttccgagggggagtcacccgacttcccagaagagttggaaaaa

SEQ ID NO: 21047 - DNA, 510 bp, Artificial Sequence
  Description of Artificial Sequence: Synthetic coding sequence
atggacactcgcaataaggcgcagctgctcgtgctgttgaccctgctgagcgtgctgttctctcaaacctcagcttggccgctctaccgcgccccgtccgctttgcgcttgggggaccgcatccctttcgaaggagccaacgagccggaccaggtttccctcaaagaggacattgatatgctgcagaacgcgctcgcagaaaacgacacgccgtactatgatgtgtcccgcaatgcacggcacgccgacggtgtctttacctcggatttcagcaagttgctgggccaactctctgcgaagaagtacctcgagtcgctcatgggaaaacgcgtgtcgtcgaacatctccgaggacccagttcccgtcaaacggcattcagacgccgtctttacggataactacacccggctgcggaagcaaatggccgtgaaaaagtatctgaactccatccttaatggcaagaggtcgtccgaaggagaatcccccgatttcccagaggagctggagaaa

SEQ ID NO: 21048 - DNA, 510 bp, Artificial Sequence
  Description of Artificial Sequence: Synthetic coding sequence
atggacactcggaacaaggcccaactgctggtactcctgacccttttaagcgtactcttttcacagacatctgcttggcctctgtaccgcgctccctcagccctgagattgggcgataggatcccttttgagggggccaatgagcctgaccaggtttccttgaaggaggacatcgacatgttgcagaatgccctggccgagaacgacacgccgtattacgacgtatctcgcaacgcaaggcatgccgacggagtgttcacatcagacttcagcaagctgctggggcagctttcagctaaaaaatatctcgagtccctcatgggaaagcgtgtgtcatccaatatatccgaggacccggtcccagtgaagcggcacagcgatgccgtgttcacagataactacacaagattgaggaagcagatggcagtgaaaaagtatctcaactccatactcaatggcaaaagatcctctgagggtgagtctccagatttccctgaagagctcgaaaag

SEQ ID NO: 21049 - DNA, 510 bp, Artificial Sequence
  Description of Artificial Sequence: Synthetic coding sequence
atggacacccgcaataaagctcagcttttggtgctgctgactctgctgagcgtgctcttctcccaaacttccgcctggccgttgtatcgcgctccgtctgccctccggctgggtgaccggatcccgttcgaaggggcaaatgagcctgatcaggtgtcgctcaaggaagatatcgacatgctgcaaaacgccctggctgagaatgatactccttactacgacgtgtccaggaacgcacgccatgcggatggggtttttacttcagatttcagcaaacttctggggcagttgagtgctaagaagtaccttgaatctcttatgggaaagcgggtgtcgtcaaacatctcggaggacccagtcccagtgaagagacactccgatgcagtgtttaccgacaattacaccaggctcaggaagcaaatggccgtgaagaaatacttgaactccatcctcaatggaaagcggtccagcgaaggcgagagcccagatttccctgaagagctcgaaaaa

SEQ ID NO: 21050 - DNA, 510 bp, Artificial Sequence
  Description of Artificial Sequence: Synthetic coding sequence
atggatactagaaataaagcacagctgctcgtgcttttgacactgcttagtgttttatttagccagacttccgcctggccattgtacagggcgccttcggcccttagactgggagaccgcattccattcgaaggagctaatgagccagatcaggtgtcacttaaagaggacattgacatgttacagaatgcgctcgctgagaatgatacgccctattacgacgtaagcaggaacgccagacacgccgacggcgtatttacttcagacttttccaaactgctcggccagctgagcgcgaaaaaatacctggagtcactgatgggtaaacgggtgagctccaatatcagcgaagatcccgtgcctgtgaaacggcactccgacgccgtgtttaccgataattataccaggctgcgcaaacagatggcggtaaaaaagtaccttaactctatcctcaatggtaaacgcagttccgaaggagagagccccgacttccctgaagaattggagaag

SEQ ID NO: 21051 - DNA, 510 bp, Artificial Sequence
  Description of Artificial Sequence: Synthetic coding sequence
atggatacccgtaacaaagcccagctgttggtgctcctcaccctgctttcggtccttttctctcaaacttccgcgtggcctctgtaccgcgccccaagcgcactccgcctcggagatcggatccccttcgaaggcgccaatgaaccggaccaggtgagcctgaaagaggatatcgacatgctccagaacgcccttgcagagaatgataccccgtattatgacgtgtcgcgcaatgcgcgccatgctgatggagttttcacctcagacttctccaaactgctcggacaactgtcggctaaaaagtacctggaatcgttgatgggaaagagagtgagttcgaacatttccgaggaccctgtacctgtcaagcggcattcagacgccgtgtttaccgataactacaccagactccgcaaacagatggcggtgaagaagtacctcaattccatcctgaacgggaagaggtcgagcgagggcgaatcgccagacttccccgaagagctggaaaag

SEQ ID NO: 21052 - DNA, 510 bp, Artificial Sequence
  Description of Artificial Sequence: Synthetic coding sequence
atggacactagaaacaaggcccagctgctcgtgcttctgactttactgtcagttcttttttcacagacctccgcctggccattatacagagcccccagcgcgttacggctgggcgacagaatcccgttcgagggggcgaacgagcccgatcaagtgagcttgaaagaagatattgacatgctgcagaatgctcttgccgaaaatgacacgccctactacgatgtatcacgaaatgcccgccacgcagacggagtcttcacatccgatttctctaagcttttaggacagttgtcagctaagaaatacctggagagccttatgggtaagcgagtgagctctaacataagcgaggaccccgtgcccgtgaagaggcattccgatgccgtttttaccgataactatactcgcctcagaaaacaaatggctgtgaagaagtacttgaacagcatactcaatgggaagcgcagcagtgagggtgagtcaccagatttccccgaggaactggagaaa

SEQ ID NO: 21053 - DNA, 510 bp, Artificial Sequence
  Description of Artificial Sequence: Synthetic coding sequence
atggataccagaaataaggcgcaactgcttgtcctcctcactcttctgtccgtcctcttttcccaaacgtcagcatggccactctatagagcaccttcagcgctccgtctgggtgatcgcattcctttcgagggagccaacgaacctgatcaagtgtcgcttaaggaagatatcgacatgctccagaacgcactcgcagaaaacgatactccttactacgatgtgtctcgcaacgcacgccatgcggacggggtgtttactagcgatttctctaagctgcttgggcagctttcagccaagaagtacctggaatccctgatggggaaacgcgtgtcgtccaacatttcagaggaccccgtgcccgtgaagagacactccgatgcggtgttcaccgacaactatacccgactgcggaagcagatggcagtcaaaaagtacctcaactcgattcttaatggtaagaggtcgtcagagggagaatcccctgatttcccggaggaattggagaag

SEQ ID NO: 21054 - DNA, 510 bp, Artificial Sequence
  Description of Artificial Sequence: Synthetic coding sequence
atggatacccggaacaaagcccagctgttggtgttgctgacactgcttagcgtgttgttcagccagacgtctgcatggccactttacagggcaccgagcgccttgcggctgggggacagaatccccttcgaaggtgccaacgaaccagaccaggttagcctcaaagaggacatcgacatgcttcaaaatgccctggcggaaaatgatactccctactatgatgtgagtaggaacgctagacatgctgacggtgtctttacaagtgatttttcgaaactgttaggccagttgtccgccaagaagtatttggagtccctgatggggaagcgtgtctcctcgaacatttccgaggacccagttcccgtaaaacggcatagcgatgctgtttttacagacaattacactagactgagaaaacagatggctgtcaagaaatacctgaatagcatcctgaacgggaagaggtccagcgagggcgaatcacctgatttcccagaggagcttgaaaaa

SEQ ID NO: 21055 - DNA, 510 bp, Artificial Sequence
  Description of Artificial Sequence: Synthetic coding sequence
atggatactaggaataaggcccagctgctggtcctccttaccttgctgtctgtcttgttctcacagacatctgcgtggccgctctacagagccccaagtgcactgaggctgggtgatcgaatcccattcgagggagccaatgagccagatcaggtttccctgaaggaggatatcgacatgctgcagaacgccctggcagagaacgataccccctactatgatgtgagccgaaatgcacgccatgctgatggggtattcacatccgactttagcaaactccttgggcagctctccgctaagaaataccttgagtctctgatgggcaaacgcgtgagcagcaacatctccgaggatcctgtccctgttaaacgccatagcgatgcagtctttacagataattatacacgccttaggaaacaaatggctgtgaaaaagtatctcaactcaattttgaacgggaaaaggagtagcgaaggtgagtcacccgattttccagaggaactggagaag

SEQ ID NO: 21056 - DNA, 510 bp, Artificial Sequence
  Description of Artificial Sequence: Synthetic coding sequence
atggatacaaggaacaaggctcagctacttgttctgctaactttgctctctgtgttgttttctcagacttccgcctggcctctttatagggcaccctcagctctgcgactcggagataggattccattcgaaggagccaatgaacccgatcaggtttctttgaaagaggatatcgatatgctacagaacgccctggccgaaaatgacactccttactatgatgtttctagaaatgctaggcatgctgacggggtctttacatccgatttctctaaacttctagggcagcttagtgccaaaaaatatcttgaatcattaatggggaaacgagtgtctagtaatatctctgaggatccagtccccgtaaaaaggcattctgatgccgtctttacagataattacacacgcctcaggaagcagatggcagtcaaaaagtacctaaactccattctcaacgggaaaagaagttccgaaggagaatcaccagactttcccgaagaactagaaaaa

SEQ ID NO: 21057 - DNA, 510 bp, Artificial Sequence
  Description of Artificial Sequence: Synthetic coding sequence
atggacacgcggaataaggctcagctgctcgtactcctgacgttgcttagcgtgctgttcagccagacatctgcatggccactttatcgagctccctccgcacttcggttgggggatagaattcccttcgaaggtgctaacgagccagatcaggtatctctgaaggaggacatagatatgttgcagaacgccttggcagagaacgatacaccatactacgatgtgtcacggaatgcaaggcacgcggatggagtgttcacttccgacttctctaagcttcttgggcaactgagtgccaagaagtacctcgagagtctcatgggaaaaagggtcagttctaatatctctgaagatccggtcccagtgaaaaggcactctgacgctgtcttcacagataattatacccgattgagaaaacagatggcggtcaagaaatatttgaacagcatactgaatggcaaacgctcatccgaaggtgagagtccggattttcctgaagaactggaaaag

SEQ ID NO: 21058 - DNA, 510 bp, Artificial Sequence
  Description of Artificial Sequence: Synthetic coding sequence
atggacacccgcaacaaggcccaactgctggtgttgctcaccctgctgtcagtgcttttttcccagacttcggcctggcccttgtaccgagccccgtcggccctgaggctgggagacagaatcccgttcgaaggggcaaatgagccagaccaagtctccctgaaggaagatatagacatgctgcaaaacgccttggcggaaaacgatactccgtactacgatgtttcacgaaatgctaggcatgcggatggcgtgttcacctccgacttctcaaaactcctgggtcagttgtcggcgaagaagtacctggaatccctcatgggaaagagagtgtcgtccaacatctccgaggatccggtgcctgtcaaaaggcactccgacgcagtctttaccgataactacactcggctgcgcaagcagatggctgtaaagaaatatctcaattcgattctcaacggaaaacggtccagcgaaggggagtcgccagacttcccagaggagttggaaaag

SEQ ID NO: 21059 - DNA, 510 bp, Artificial Sequence
  Description of Artificial Sequence: Synthetic coding sequence
atggacactcggaacaaagcccagcttctggtgctactgacactgctctcagtactcttctcccagacaagtgcttggcctctctatcgcgcacccagcgcgctgcggctgggtgacagaatccccttcgagggtgctaacgaacctgatcaagtgtccctgaaagaggatatcgacatgctccagaatgccctagctgaaaacgacacaccgtactatgatgtaagccgtaacgcccggcacgctgacggcgtcttcaccagtgacttctcgaagctgttaggccagctgtctgccaaaaagtatttggaatccctgatgggcaaacgggtttcatccaacatttctgaggatcctgtgcccgttaagcgccatagcgacgccgtgtttacagataactatacaaggctgagaaagcaaatggccgtaaaaaagtacctgaatagcatcctgaacggtaaacgaagcagtgagggggagtcacccgacttcccagaggaactcgagaag

SEQ ID NO: 21060 - DNA, 510 bp, Artificial Sequence
  Description of Artificial Sequence: Synthetic coding sequence
atggacacccgcaacaaagcccagctgctggtcctgttgacgctcctttcggtgcttttctcacagacttctgcatggccgctctacagagcgccgtcggccctgaggctgggagatcgcatcccattcgaaggcgctaatgaacctgaccaggtcagcctcaaggaggatatcgacatgctgcagaacgcgctggccgagaacgacaccccgtactatgacgtgtccaggaacgctcgccacgctgatggggtgtttacctcggacttctcgaagttgctcggacaactctcagcgaagaaataccttgaatccctgatgggaaagagggtgagtagtaacatcagcgaggatcccgtccctgtcaagcgccatagcgatgccgtgttcactgacaattacactcggttgcgaaaacaaatggccgtgaaaaagtacttgaatagcattctgaacggtaagcggagcagcgaaggcgaaagtccggattttccagaggaactcgaaaag

SEQ ID NO: 21061 - DNA, 510 bp, Artificial Sequence
  Description of Artificial Sequence: Synthetic coding sequence
atggataccagaaacaaggcccagctgcttgtgctccttaccctgctgtccgtgctgttttcacaaacttccgcgtggccactctacagggcaccttcggcccttcgattgggcgatcggatcccatttgagggagcaaatgagccggatcaagtctcgctgaaagaggatattgatatgctgcaaaacgcactcgcagagaacgacactccttactacgacgtgtccagaaatgctagacacgcagatggagtgttcaccagcgatttctcgaagttgctgggacaactgtcggcaaagaaataccttgaatccctgatgggcaaaagagtgtcctcgaacatttcagaggaccctgtcccagtgaaacgccatagcgatgcagtgtttaccgacaattacactcgacttaggaaacagatggcagttaagaagtatcttaacagcattctgaatggtaagaggtcaagcgaaggggaatcgcctgattttccagaagagctggaaaag

SEQ ID NO: 21062 - DNA, 510 bp, Artificial Sequence
  Description of Artificial Sequence: Synthetic coding sequence
atggatacaagaaacaaagcccagctgctggttctgcttacgctcttgagcgtgcttttttcccagacgagcgcctggcccctgtatcgggcgccttctgctctcaggctgggtgaccggatccctttcgagggtgctaatgagcctgatcaggtgtctctgaaggaggatattgacatgctccagaatgcccttgccgaaaatgatacgccctattatgatgtgtcccggaatgcaagacacgcggacggcgtgtttacaagcgacttcagcaagctccttggccagctcagcgctaagaaatatctggagagcttaatgggcaagcgcgtctcctccaatatctctgaggaccctgtaccagtcaagaggcactcagacgctgtttttaccgataattacacacggctgcgtaagcagatggcagtcaaaaaatatctgaactcgatcttgaatgggaaacggtccagtgagggggagagccctgattttccggaggaacttgagaaa

SEQ ID NO: 21063 - DNA, 510 bp, Artificial Sequence
  Description of Artificial Sequence: Synthetic coding sequence
atggatacccgtaataaagcacagctgcttgttctgctgactctgctgtccgtgctgttctcccaaacatcagcctggccattgtaccgtgctcctagcgcattgagacttggcgaccgtattccctttgagggcgccaacgagcccgatcaggtcagcctgaaagaagatatcgacatgttgcagaatgccctcgcagagaatgacaccccctactatgatgtcagccgtaatgccaggcacgctgacggcgttttcacaagcgacttcagcaaactgttgggtcagctgagcgccaagaagtacctggagagccttatgggaaagagggtgagctcaaatatctccgaagacccagtacctgttaagaggcactcagatgctgtgttcacagataattatactcgtctgaggaaacagatggccgtcaagaagtacctgaacagcattttgaatggcaagcgttccagcgaaggtgaatcccctgacttccctgaggagctggagaag

SEQ ID NO: 21064 - DNA, 510 bp, Artificial Sequence
  Description of Artificial Sequence: Synthetic coding sequence
atggacacccgaaataaggcacagctgctcgtactgctgactcttctgtccgttctcttttcccaaacttctgcctggcccctttacagagccccctctgcgctacgactcggagaccgaatcccctttgagggcgctaatgagcctgatcaggtgagcttgaaagaagatatagatatgcttcagaacgcgctcgccgaaaatgatacaccctactatgacgtgtctcgcaatgctcgccatgctgatggcgtgttcacctctgacttttccaaactgctggggcagctttccgctaaaaagtacttagaatccttaatggggaagagagtgtccagcaacattagcgaggaccccgtaccggtcaaacggcactctgatgctgtgttcacagataattacacacggctgaggaagcaaatggccgtgaagaagtacctcaactcaattctgaacggaaaacgttcgtctgagggggaatctccagacttccctgaggagctcgaaaaa

SEQ ID NO: 21065 - DNA, 510 bp, Artificial Sequence
  Description of Artificial Sequence: Synthetic coding sequence
atggacactaggaacaaggctcagcttttggtgctgctgaccctcctgtcggttttgttcagccaaacctccgcatggccgctttaccgcgcaccctctgccctgcggcttggggaccgcattccgttcgaaggagccaatgaaccggaccaggtgtcactgaaagaggacatcgacatgctgcagaatgccctggctgaaaatgatactccatactacgacgtatcccgaaacgcgagacacgctgatggagtgttcacttcggattttagcaagctcttgggccaactctccgcgaagaagtacctggagtcactgatgggcaagagagtgtcatcgaacatcagtgaggacccggtgcctgtgaagcgccattcagacgcggtgtttaccgataactacacgcgtctgcggaaacagatggccgtcaagaagtatttgaactcgatcctcaacggaaaacgctcctctgaaggagaatcaccagacttccctgaggagctcgaaaaa

SEQ ID NO: 21066 - DNA, 510 bp, Artificial Sequence
  Description of Artificial Sequence: Synthetic coding sequence
atggatacgagaaacaaagctcagctgttggtgctgcttacgcttctgagcgtgctgttcagccaaactagtgcatggcccctgtaccgggccccgtctgcactgaggctgggcgataggatacccttcgaaggggccaacgagccagatcaggtgtcattgaaggaggacatcgacatgctgcagaacgctcttgccgaaaatgatactccgtactacgatgtgagccggaatgctcgtcacgccgatggggtgtttacgagtgacttttcaaaactgcttgggcagctgagcgccaaaaaatacctggagtccctgatgggaaaacgtgtcagttctaatatcagtgaggacccagtgcccgtaaaaaggcattctgatgccgtgtttacggacaattataccagactgcgaaagcagatggccgtgaaaaagtacctgaactccatactgaacggtaagcgctctagcgagggtgagtccccggactttcccgaggagttagagaag

SEQ ID NO: 21067 - DNA, 510 bp, Artificial Sequence
  Description of Artificial Sequence: Synthetic coding sequence
atggataccagaaataaggcacagttgctggtgcttcttaccctcctttcggtgcttttctcgcaaacttcggcgtggccgctgtaccgggcaccttcagcattgcggcttggggaccggattccgtttgaaggtgcaaacgagcctgaccaagtgtcccttaaggaagatattgatatgctgcaaaatgcgcttgcagaaaacgataccccttactacgacgtgtcgcggaacgcgcgccacgcagacggcgtgtttaccagtgacttctcgaaactcctggggcagttgtcagctaaaaagtaccttgaatcactcatgggcaagagagtgtcctcaaacattagcgaagatcctgtgccagtgaagcggcatagcgacgccgtctttactgataactatacgagactgcgaaaacagatggcagtcaagaaatacctgaattcgatactgaacggaaaacggtcgagcgagggagaatcgccagattttccagaggaactcgagaaa

SEQ ID NO: 21068 - DNA, 510 bp, Artificial Sequence
  Description of Artificial Sequence: Synthetic coding sequence
atggacactaggaacaaagctcagctgctcgtccttctcactctgctatccgtcctttttagccagacatccgcttggccattatacagagccccttccgccctgaggcttggggatcgaatacctttcgagggcgctaacgagcctgaccaagtttccctgaaagaggacatcgacatgctgcaaaacgccctggccgaaaacgacaccccatattacgatgtttcccggaacgccaggcacgccgacggagtgttcacctccgattttagcaaactgctggggcagctctcggcgaaaaaatacctcgagtcccttatgggcaagcgagtgtcttccaacatctctgaagaccctgtacccgttaagaggcacagcgatgccgtatttactgacaattacacgaggctgcgcaaacagatggctgtgaaaaagtacctcaactcaatattgaacggaaaacgcagtagcgagggcgaaagtccagactttcccgaagagctagaaaag

SEQ ID NO: 21069 - DNA, 510 bp, Artificial Sequence
  Description of Artificial Sequence: Synthetic coding sequence
atggatacccgaaataaggcccagttgcttgtgctgctgacccttctctccgtgcttttttcacaaacgtcagcttggccactttaccgggcccctagcgctttgcgtcttggagatcgtattccgttcgagggggccaacgaaccagaccaggtgtcccttaaggaggacattgatatgctgcaaaacgcgcttgccgaaaacgatactccttactatgatgtgtctcgaaatgcgagacatgctgacggcgtgtttactagcgacttctcaaagctcctggggcagctctctgccaagaagtaccttgaatcgttgatgggaaagcgtgtctcgtcgaacatcagcgaggaccctgtgccagttaagagacactccgatgcggtctttaccgacaattacaccagactgagaaaacaaatggcagtcaaaaagtacctgaactcgattctgaatggtaaaaggtcctccgaaggtgaatcacccgattttcccgaagagctggagaag

SEQ ID NO: 21070 - DNA, 510 bp, Artificial Sequence
  Description of Artificial Sequence: Synthetic coding sequence
atggacacccgaaataaggcgcaactactcgttctgcttactcttcttagcgttctgttctctcaaacaagtgcctggcctttgtaccgggcaccttccgcacttcggttgggtgacagaattccttttgagggggcaaacgaacctgaccaggtgagcctcaaggaggacatagatatgctgcaaaatgccctggccgagaacgatacaccctattatgatgtgtcgcggaacgcgaggcacgctgacggagtcttcaccagcgactttagtaagttgctgggacagttgagtgcgaagaagtacctggagagtcttatgggcaagagggtttctagtaatatttccgaagaccccgtcccggttaaacgccactcggacgcggttttcaccgataattacaccaggctaaggaaacagatggccgtgaagaagtacctgaactccatcctgaacggcaagcgcagctctgaaggtgaaagcccagatttccctgaggagcttgagaaa

SEQ ID NO: 21071 - DNA, 510 bp, Artificial Sequence
  Description of Artificial Sequence: Synthetic coding sequence
atggatactcgcaataaggcccaattactggttctgcttaccctgctgagcgtcctgttttcgcagactagtgcctggcccctgtaccgagcccccagcgcgctgagactgggggatcggattccgttcgagggcgccaacgagccagatcaggtgtctcttaaggaggatatcgatatgctgcagaatgctctggcggaaaatgacacaccatattatgacgtgtccaggaatgcaaggcatgcggacggggtattcacaagcgatttttctaagttgctcggacagctctctgcaaagaagtatctcgagagtctgatgggtaaacgcgtcagctcaaacatctccgaggaccccgtgcccgtcaagagacatagtgatgccgtcttcaccgacaactacaccaggttaaggaaacaaatggctgtgaagaagtatctgaatagtatcctaaatggtaagcggagctctgaaggcgaaagtccagattttcctgaggagttggaaaag

SEQ ID NO: 21072 - DNA, 510 bp, Artificial Sequence
  Description of Artificial Sequence: Synthetic coding sequence
atggatactcgcaacaaagcccaactcttggtgcttctcaccctgctctcggtgctgttctcacagaccagcgcatggccgttgtaccgcgccccctcggccctgcggctgggagacagaatcccgttcgagggtgcgaacgagccagaccaggtgtcgcttaaggaggatatcgatatgcttcagaacgccctggccgagaacgatactccgtactacgacgtctcgagaaatgcccggcacgcggatggagtctttacctcggacttctcgaagctgctgggccaactgtcagcgaagaaatacctcgagagcctgatgggtaagcgggtgtcctccaacatctccgaggaccccgtgccggtaaagcgccactccgacgccgtctttactgataactacactagactgcggaaacaaatggctgtgaagaagtacctgaacagcattctcaatggcaaaaggagcagcgagggagagtcccccgacttcccggaagagctggagaag

SEQ ID NO: 21073 - DNA, 510 bp, Artificial Sequence
  Description of Artificial Sequence: Synthetic coding sequence
atggacacacgcaacaaggcccagctcctggtgctgctgaccctgctgtctgtactcttttcccaaacgagcgcttggcctctgtatagagctccctccgcccttagactcggagacaggataccttttgagggagcaaacgaacccgatcaggtatcactgaaggaagacattgatatgctgcagaacgctctcgctgagaatgacaccccctattacgacgtttctagaaatgctaggcacgcagacggcgtgtttacatccgacttcagcaagctgttgggtcaattgtccgctaagaagtatcttgagagccttatgggcaagagggtctcctctaatattagtgaagatccagtgccagtcaaaagacatagcgacgccgtttttaccgataactacactagattgcgcaagcagatggccgtcaagaagtacttgaattccatccttaacggcaaaagatctagcgagggcgagtccccagactttccggaggaactcgaaaag

SEQ ID NO: 21074 - DNA, 510 bp, Artificial Sequence
  Description of Artificial Sequence: Synthetic coding sequence
atggataccaggaataaagcccagctcctggtcctcttgactctgctgagtgttctgttctcccagacctccgcttggccgctctaccgcgcgcctagtgccctgagacttggcgatagaattcccttcgagggggccaatgaacccgaccaggtcagtctgaaagaggacatcgacatgctgcaaaatgctctcgccgagaacgatacaccgtattacgacgtgagtaggaacgccaggcatgcggacggggtgttcacatctgatttctccaagctgctcggccagctgagcgctaagaagtacttggagagccttatgggcaaacgcgtctcatcaaacatctcagaggatcccgtccctgtcaaacgccactcagacgccgtatttacggacaattacactcgcctgagaaaacagatggccgtgaagaagtacctgaattcaatcctgaacggcaagcggtcaagcgagggagaatctcccgactttcccgaggaactcgagaaa

SEQ ID NO: 21075 - DNA, 510 bp, Artificial Sequence
  Description of Artificial Sequence: Synthetic coding sequence
atggacacccggaacaaggcgcaactgcttgtcctgttgactctgctgtcagtcttgttctcccagacctcggcctggcccctttacagagcaccttcggccctgcgcctcggagatcgcataccatttgaaggagctaacgaaccggaccaagtgtcgctcaaagaagatatcgacatgctgcaaaacgcccttgcagaaaacgacaccccttactacgacgtgtcaagaaatgcacgacacgcagatggcgtctttacgtctgatttttctaaactgcttggtcaactgtcggcaaagaaatacctcgaatcgttgatgggcaagcgcgtgtccagcaacattagtgaagatcctgtcccagtgaaacggcattcggatgcagtgttcaccgataactacaccaggctcaggaaacagatggccgtgaagaaatacctgaattccattctgaacggcaagcgatcgtcagagggggaatcgcccgatttccctgaggagctcgagaag

SEQ ID NO: 21076 - DNA, 510 bp, Artificial Sequence
  Description of Artificial Sequence: Synthetic coding sequence
atggatacccggaataaagcacagctgctcgtgctgttgactctcctctcggtgctgttttcccagacttcagcctggccactgtaccgcgcaccgtcggcactgcggctcggcgatcggattcccttcgagggcgctaatgaaccagaccaggtgtcgctcaaggaggatattgacatgctccaaaatgccctggccgagaacgacactccgtactacgacgtgtcgcgcaacgcacgacatgcagacggcgtgttcacctctgacttcagcaagctgctgggtcagctgtccgcgaagaagtacctggaatccctcatggggaagcgcgtgtcgtcaaacatctccgaagatcctgtcccagttaagcgccactcggatgcggtgttcactgacaactacaccagactcaggaaacagatggccgtgaaaaagtacctgaactcgatcctcaacggaaagaggtcaagcgagggtgaatcccctgacttcccagaagaactggaaaaa

SEQ ID NO: 21077 - DNA, 510 bp, Artificial Sequence
  Description of Artificial Sequence: Synthetic coding sequence
atggacacacgtaataaagcacagcttttggtgctgcttacactgctgagtgtactgttttctcagacaagcgcttggcccttatatagggcaccaagcgccttaaggctgggggacaggattccgttcgaaggggcgaatgagcccgaccaggtctcgctgaaggaagacattgacatgctacagaacgctctcgctgagaacgacacgccgtattacgacgtaagtcgcaacgctcgccatgctgacggggtgttcacttccgatttctccaagctgctcggacaactgtctgccaagaaatatctggagtcgttgatgggcaaacgcgtgtctagtaacatatccgaggaccccgtcccagtcaagcggcattctgacgcagtattcacagacaactacactcggttaaggaagcagatggctgtgaagaagtacctgaatagtatcctgaatggtaagaggtcctcagagggtgaatcaccagacttcccagaggaattggagaag

SEQ ID NO: 21078 - DNA, 510 bp, Artificial Sequence
  Description of Artificial Sequence: Synthetic coding sequence
atggacacacgcaataaggcccaactactggtacttctaacgttattgtctgtactttttagccagacatcagcttggcctctttaccgggctccatctgccttgagacttggtgatcggattcccttcgaaggagcgaacgagcccgaccaagtgtcattgaaagaagatatagatatgttgcagaatgctctcgccgagaatgatactccttattatgatgttagtcgtaatgctcgacatgcagatggtgtttttactagcgatttttctaaattgttgggtcaactctcagctaaaaaatacctggagtcacttatgggtaagagagtatcatccaatataagtgaagatcctgtgcctgtgaaaaggcatagcgacgctgtatttactgataactacactcgtcttaggaaacagatggccgttaaaaaatacttgaatagcattctcaacggtaaaaggagttcagagggagagtcacctgacttcccagaggaacttgaaaag

SEQ ID NO: 21079 - DNA, 510 bp, Artificial Sequence
  Description of Artificial Sequence: Synthetic coding sequence
atggacaccagaaacaaagcccaattgttggtgctgctcaccctcctgagcgtccttttctcccagacttcggcctggccactgtacagggccccatccgccctccgacttggtgacaggattccttttgaaggggctaacgagccggaccaagtcagcctcaaggaagatatcgacatgctgcaaaacgctctggctgaaaatgataccccctactacgatgtctcgcggaacgcacggcatgccgatggagtgttcacctcggatttttccaagttgcttggacagctgagtgccaaaaagtatctggagtcgctcatggggaagagagtgtcatccaacatctcggaggacccggtgccggttaagagacactcggacgcagttttcacggacaattacactcgtttgagaaagcagatggcagtgaagaagtacctcaattccatcttgaatggaaaacgcagcagcgaaggagagtcgccggacttcccggaagaacttgagaag

SEQ ID NO: 21080 - DNA, 510 bp, Artificial Sequence
  Description of Artificial Sequence: Synthetic coding sequence
atggacacacgtaataaggcacagcttctagtgctgctcaccctgctcagcgtcctgttctcccagactagcgcatggcccctgtatcgcgccccctctgccttgaggctcggagacaggataccgtttgagggtgcgaatgaaccggaccaggtttctttgaaggaggatatcgacatgctccagaatgcgttggctgagaacgatactccctactacgacgtttcaagaaatgccagacacgctgatggagtatttacatccgatttctccaagctacttggacaattgtctgctaagaaatacctggaaagcctgatgggaaaaagggtgagttcaaatatcagcgaagaccctgtgcccgtgaaacgccactctgatgcagtgtttaccgataattatacacgtttaagaaagcagatggccgtcaagaaatatctcaacagtattctgaacggcaaacgtagcagcgagggtgaaagtcccgacttcccagaagaactggaaaag

SEQ ID NO: 21081 - DNA, 510 bp, Artificial Sequence
  Description of Artificial Sequence: Synthetic coding sequence
atggacactaggaacaaggctcagctacttgtgctcttaactctcctcagcgtcctgtttagccaaacatcagcgtggccactgtaccgcgccccatcggctctgcggctaggcgacaggattccatttgaaggcgctaatgagcccgatcaggtatcactcaaggaggacatcgatatgttgcagaatgcactcgccgagaatgacactccctattatgatgttagtcgcaacgcccgacacgctgatggggttttcacaagcgattttagcaaactcctcggacagttgtctgcgaaaaagtacctcgagagtctgatgggtaaacgggtgtctagtaacattagtgaggaccctgtcccggtgaaacggcatagcgacgccgtgtttaccgataattatacacggctaagaaaacagatggccgtgaaaaaatacctgaactccatcctgaacggaaaaaggagctccgagggcgagtcacctgactttcccgaagagcttgagaag

SEQ ID NO: 21082 - DNA, 510 bp, Artificial Sequence
  Description of Artificial Sequence: Synthetic coding sequence
atggacaccagaaacaaggcccagttgttggtgctcctaaccctgttgagtgttcttttctcccagacctccgcctggcccctgtatcgagctccctctgctttgcgcctcggagatcgtatccccttcgagggcgctaatgagcccgaccaggtgtccctgaaagaagatatcgatatgttgcaaaatgcgctggccgagaacgacaccccctactatgatgtgagccggaatgctagacacgctgacggggtgtttacctcagacttctcaaagctccttgggcagctttcggcaaagaagtatcttgagtcccttatgggcaagagggtttcatctaacattagcgaagacccagtgcccgtcaaacgtcacagtgatgctgtgttcactgacaactatacccgccttaggaagcagatggctgtaaaaaagtacttaaattctattttgaatgggaaacggagctccgagggcgagtcgcccgactttccagaagaattggaaaaa

SEQ ID NO: 21083 - DNA, 510 bp, Artificial Sequence
  Description of Artificial Sequence: Synthetic coding sequence
atggatacgcgcaataaagcacagttgctggtgctgttgaccctgctgagcgtgctgttcagccagactagtgcatggcctctgtaccgcgctccatctgccctgcgtctgggggaccgaatcccattcgaaggcgcgaatgagcctgaccaggttagcttgaaagaagacatcgatatgctgcagaacgctctggccgagaatgacaccccctactatgatgtgagccgcaacgctagacacgcggatggcgttttcacttctgatttctctaagctgctgggccagttaagcgccaagaaatacttagaaagcctgatgggtaaaagagtgtcgagcaacatcagcgaggacccagtgccggtcaagcgccacagcgacgccgttttcaccgataattacaccagactccgtaagcagatggccgtgaaaaagtatttgaatagtattcttaacggaaagcgtagctcggagggagaaagcccagactttccagaagagcttgagaag

SEQ ID NO: 21084 - DNA, 510 bp, Artificial Sequence
  Description of Artificial Sequence: Synthetic coding sequence
atggacactcggaacaaggcacagctcctcgtcttgctgacccttctgtcagtcctgttttcgcagacttcagcctggccactgtacagagcccctagtgctctgagacttggggatcgtattcccttcgaaggtgcaaatgagcctgatcaagtgtcgcttaaagaggacattgatatgcttcaaaacgcgcttgcagagaatgataccccatactacgacgtgtcgaggaatgcacggcatgcggacggagtgttcacctcagatttttccaaacttctgggacaactttccgctaagaagtaccttgagtcattgatgggaaaacgtgtctcatcgaacattagcgaggatccagtgccagtgaaacgtcactctgatgctgtttttaccgataactataccaggctcagaaagcagatggcagtgaagaagtacctgaattcaattctgaacgggaagcggagctccgagggtgaatccccggatttccctgaggagctggaaaag

SEQ ID NO: 21085 - DNA, 510 bp, Artificial Sequence
  Description of Artificial Sequence: Synthetic coding sequence
atggatacccgcaacaaggcacagttgctggtgctccttactctgctgtcggtgctgttctcgcagaccagcgcatggccgctgtaccgcgctccatccgctctgcgactcggagatcgcatcccgtttgaaggagccaatgagccggatcaggtgtcgctgaaggaagatattgacatgctccagaatgcccttgctgagaacgacactccctactacgatgtgtcccggaatgcaagacatgcggacggggtctttacctcggatttctccaagctgctgggacaactgtcagccaagaagtacctggagtcccttatggggaagcgcgtgagctcaaacatctccgaggacccggtgcctgtgaagaggcactcggacgctgttttcacggacaattacactaggctgagaaagcagatggctgtgaagaagtacctcaactccatcctcaacgggaagcggtcctccgagggcgaatcaccggacttcccagaggaactcgaaaag

SEQ ID NO: 21086 - DNA, 510 bp, Artificial Sequence
  Description of Artificial Sequence: Synthetic coding sequence
atggatacgcgaaataaagcgcaactattagtactattaacgttactatcggttctattttcgcaaacgtcggcgtggccgctatatcgagcgccgtcggcgttacgtctaggtgatcgtataccgtttgaaggtgcgaatgaaccggatcaagtatcgctaaaagaagatatagatatgttacaaaatgcgctagcggaaaatgatacgccgtattatgatgtttcgcgaaatgcgcgacatgcggatggtgtttttacgtcggatttttcgaaactattaggtcaattatcggcgaaaaaatatttagaatcgttaatgggtaaacgagtatcgtcgaatatatcggaagatccggttccggttaaacgtcattcggatgcggtatttacggataattatacgcgtttacgtaaacaaatggcggtaaaaaaatatttaaattcgatattaaatggtaaacgatcgtcggaaggtgaatcgccggattttccggaagaactagaaaaa

SEQ ID NO: 21087 - DNA, 510 bp, Artificial Sequence
  Description of Artificial Sequence: Synthetic coding sequence
atggacactcgcaacaaggcccagcttctggtgctgttgaccctcctcagcgtcctgttctcccagactagcgcctggccactgtaccgcgccccatcggccctcaggctgggcgaccggatcccgttcgaaggtgcgaatgagcctgaccaggtatcactcaaagaggacatcgacatgctgcagaacgcgctggcggagaatgatactccttactacgacgtctcgcgcaacgcgcgccatgcagatggcgtgttcacttccgacttttcaaagctgcttggccaactctccgccaagaagtacttggaatccctcatgggtaagagagtgtcaagcaatatctccgaagatcctgtcccagtgaaacgccactccgatgcagtgttcaccgacaactacaccagacttcgaaaacaaatggccgtgaagaagtacctgaattcgatcttgaacggaaagagatccagcgaaggagaatccccggactttccggaggaactggagaag

SEQ ID NO: 21088 - DNA, 510 bp, Artificial Sequence
  Description of Artificial Sequence: Synthetic coding sequence
atggatactaggaacaaggcacaactccttgtattactcacactactcagtgtgcttttttctcagacatcggcttggccactatatagagcccctagtgctctaaggctcggggataggatacctttcgaaggggccaatgaacctgatcaggtctcactaaaagaagatattgatatgctccagaacgccttagcagaaaacgatacaccatattatgatgtttctaggaacgccaggcatgccgatggggttttcacatccgatttctccaaactcctgggacagctcagtgctaaaaaatatctagagagtctcatggggaaacgggtaagttctaacatatccgaggatcctgttccagtgaaacgccattccgatgccgtgtttactgataactatacacgactccgcaaacaaatggcggtaaaaaaatatctcaactccatacttaacggaaaacggtcatctgagggagaatcacctgatttcccagaggagcttgaaaaa

SEQ ID NO: 21089 - DNA, 510 bp, Artificial Sequence
  Description of Artificial Sequence: Synthetic coding sequence
atggacacccgtaacaaagcccagctgttggtgctcctgactcttctgagcgtccttttttcccagaccagcgcatggcctctttacagagctccttcggcgctcaggctgggtgacagaattccattcgaaggcgctaacgaacctgatcaagtgagcctcaaggaagatattgacatgcttcaaaatgcgctggcggagaacgatactccatactatgatgtgtcccgaaacgctcgacatgcggatggtgtattcacctctgattttagcaagctgctcggacaactgagcgcaaaaaagtacctcgaatcgctgatgggcaagcgggtgtcctccaatatcagcgaagatcctgtccctgtcaaaagacactccgatgcagtgttcactgataactacactagacttcgcaagcaaatggccgtgaagaaatacttgaactccattctgaacgggaagcggtcgtcggagggagaatcacccgatttccccgaagaactggagaaa

SEQ ID NO: 21090 - DNA, 510 bp, Artificial Sequence
  Description of Artificial Sequence: Synthetic coding sequence
atggatacgcggaacaaggcccagctgctggtgttattgacactgctgagcgtgttattcagccagactagcgcctggccactgtatcgggcccccagtgcactgagactgggagatcgaatacccttcgagggggccaacgagcccgatcaagtctccttgaaggaggacattgatatgttgcagaatgcactggccgagaatgacacaccctattatgacgtttctaggaatgcacgccatgctgacggagtatttacctcggacttcagcaagttgttaggacagttaagtgcgaagaaatatctggagtctcttatgggcaaacgggtttccagcaatataagtgaagacccagtccctgttaaacggcatagtgacgctgtgtttacagacaactatactaggttaagaaagcaaatggcagtgaaaaaatacttgaactctatcctaaatggcaaacgttctagcgagggtgaatccccagacttccccgaagaactggaaaaa

SEQ ID NO: 21091 - DNA, 510 bp, Artificial Sequence
  Description of Artificial Sequence: Synthetic coding sequence
atggatacaaggaataaagctcagctccttgtgctgttaactttactcagcgtgctgttcagccagacatcagcatggcccctttaccgagcaccctccgcgttacgacttggggaccgtattcccttcgaaggggccaacgaaccagatcaggtatcattgaaagaggatattgacatgctgcagaacgctctcgctgaaaacgataccccatattacgatgtgtctcgaaatgctagacatgccgacggggtgtttacctctgatttctccaaactactcggccagctgagtgcaaagaagtaccttgagtctttgatggggaagagagtgtcttcaaatatcagcgaagatccagtgccagtgaaacggcatagcgatgctgtgtttaccgacaactatacccgactccggaagcagatggccgtaaaaaagtaccttaattcgatcttaaacggcaaaaggtcatctgaaggcgagtcgcctgatttccccgaggagctggaaaag

SEQ ID NO: 21092 - DNA, 510 bp, Artificial Sequence
  Description of Artificial Sequence: Synthetic coding sequence
atggataccaggaataaggcccaactcctggtgctgctgactctgctgagcgtgttattctcgcagacctccgcttggcccctttacagggcgccctcagccttgagattgggtgacagaatccccttcgaaggtgccaatgagcccgaccaagtgagcctcaaggaggatatagacatgcttcagaatgctcttgccgagaatgacactccctactacgacgtgtcccggaatgcccgccatgctgatggcgtctttacaagtgactttagcaaactgttggggcagctcagcgcgaagaagtaccttgaaagccttatggggaaacgagtgtcgagtaacatcagtgaggaccctgttcctgtgaaaaggcattccgatgcagtattcacagataattacacgcggctgcgcaagcagatggcagttaaaaaatatctgaatagtattctgaacggcaagcgcagttcagagggggaatcacccgactttccagaagaactggagaag

SEQ ID NO: 21093 - DNA, 510 bp, Artificial Sequence
  Description of Artificial Sequence: Synthetic coding sequence
atggacacacgcaataaagctcaattgctggtcctgttgacacttttgagtgtactcttttcccagacaagtgcctggcccctataccgcgcgccctctgctttacgccttggagataggatcccctttgagggagcaaatgagcccgatcaggttagcctgaaagaggacatcgacatgcttcaaaatgcgctggcggaaaacgataccccctactatgatgtatcgcggaatgctcgccatgctgatggagtattcacgtccgacttttccaagctgctcggccagctgtcagcgaaaaagtatcttgaaagcctcatgggaaagcgagtctcgtccaatatctcggaagatccagtaccagtaaagcgacactccgatgctgttttcactgataattacactcggctcagaaaacagatggcggtgaaaaagtatttaaattctatcctgaacggcaagcgctcatctgaaggcgaatccccagacttcccagaagaactggaaaag

SEQ ID NO: 21094 - DNA, 510 bp, Artificial Sequence
  Description of Artificial Sequence: Synthetic coding sequence
atggatacacgcaataaggctcagctgcttgtgctcctgaccttactgtctgtgctgttcagtcaaacctcagcctggccactgtatagggcaccatctgccttgagactgggagatcgcataccatttgaaggagccaatgagccagaccaggtctccctgaaagaggatattgacatgctccaaaatgctcttgcagagaacgatactccttactatgatgtcagtagaaacgcacggcatgcagatggcgtcttcaccagcgatttttcaaagctgctcggacagctaagtgctaaaaaatacctggagtctctgatgggtaagagagtgtcctccaacatcagcgaggaccctgtgcccgtgaagcgccacagtgatgctgttttcaccgacaactacactcgcttacggaagcagatggcagtgaagaagtatctgaattctatcctgaacggaaagcgaagttctgaaggcgagagccctgatttccctgaagaattagaaaag

SEQ ID NO: 21095 - DNA, 510 bp, Artificial Sequence
  Description of Artificial Sequence: Synthetic coding sequence
atggatacgaggaataaagctcagctgctggttctcttgacgctgctgtccgtgctcttttcacagacttcagcctggcctctctaccgggctccatccgctctgagactgggggatcgcatcccttttgagggggcaaatgagcccgatcaggtgagtctcaaggaggacatcgatatgctgcagaacgccctcgctgaaaacgataccccttattacgatgtttctagaaacgcacgacacgccgatggagtgttcacgagtgattttagcaagctgctggggcagctcagcgcaaagaaataccttgaatccttgatgggtaagagggtgtctagcaatatttcagaggatccggtccccgtcaaaaggcactcagacgctgtctttaccgacaactacaccagacttagaaaacagatggcagtgaaaaaatatctgaacagcattctcaacgggaagaggtcctcagaaggcgaatcacctgactttccagaagagctggagaag

SEQ ID NO: 21096 - DNA, 510 bp, Artificial Sequence
  Description of Artificial Sequence: Synthetic coding sequence
atggacacccggaataaagcacagctgcttgtcctgctgaccctccttagcgtgcttttcagccagaccagcgcatggcctctctaccgggccccatcagcacttagacttggtgatcggatcccttttgaaggagctaacgagcctgatcaggtgtccctcaaggaagatatcgatatgctgcaaaatgcgctcgcagaaaacgatactccttactacgacgtctcgagaaatgcgcggcatgcagacggggtgtttacctcagacttttcgaagttgctgggccaactctccgccaaaaagtacctcgaatcccttatgggtaagagagtgtcgtcaaacatctcagaagatccagtgcccgtcaaaaggcactcagatgcagtgtttacggacaactatacccgcctgcgcaagcaaatggcagtcaagaaataccttaatagtatccttaacggtaagcgaagctcggaaggagagtccccggattttcccgaagaacttgaaaag

SEQ ID NO: 21097 - DNA, 510 bp, Artificial Sequence
  Description of Artificial Sequence: Synthetic coding sequence
atggacacccgcaacaaagcccagctgcttgtgctgctgacccttctttctgtcctgttctcgcaaactagcgcttggccactttacagagccccctccgcactcagactgggcgatagaatcccctttgaaggcgctaatgaaccggaccaggtcagccttaaagaagatattgacatgctacaaaacgctctggcagaaaacgataccccctactatgatgttagccgcaatgctagacatgcagatggagtcttcacaagcgattttagtaagctgctgggccagctgagcgctaaaaagtacctggagagtctgatgggcaagcgggtcagtagcaatatcagcgaggacccagttcctgtgaagcgccatagcgacgcggtatttacagacaattacacacgattgagaaagcagatggccgtgaagaagtaccttaactccatcctgaacggcaagcggagcagcgaaggagagagccctgacttcccagaggaattggagaag

SEQ ID NO: 21098 - DNA, 510 bp, Artificial Sequence
  Description of Artificial Sequence: Synthetic coding sequence
atggacactcgtaataaagcccaactattggtgttattgaccttgctttccgtgctcttttcgcaaaccagcgcctggcccctttatagggcaccctccgcactgcgtttaggggaccgcatcccattcgagggtgccaacgagccagatcaagtgtccctcaaggaggacatagatatgttgcagaacgccctggctgaaaatgacaccccctactatgacgtgtctcgcaacgcaagacacgcagacggcgtctttacttccgatttttctaagcttttgggccagctatccgcgaagaagtacctcgagtcactcatgggcaagagagtgtcctctaatatttccgaggatcccgtacccgtcaaaagacactctgatgcagtttttaccgataactatacccgattacgtaaacagatggcagtcaagaagtacctaaacagcatacttaatggaaagcgatctagcgagggtgagtccccagatttcccagaagagctggagaaa

SEQ ID NO: 21099 - DNA, 510 bp, Artificial Sequence
  Description of Artificial Sequence: Synthetic coding sequence
atggatacgcgcaacaaggcccagctgctcgtgttgctcacccttctgagcgtgcttttctcgcagacttcggcatggcctctttaccgagctccctcagcgcttcggctgggtgatcgcattcctttcgaaggcgcaaacgaacctgaccaagtgtcccttaaggaggacatagacatgttgcaaaatgcacttgctgaaaatgataccccttactacgacgttagcaggaatgctcgacatgcagacggagtctttacctcggatttttcgaaactgctcgggcaactgagcgcaaagaagtaccttgaatcactcatgggtaagcgtgtctcatcaaatatctcggaagatcctgtgccagtgaagcgacattcggatgcagtgtttactgacaactatactcgtttgcgaaaacagatggccgtgaagaaatacctgaactctatccttaacggaaagcgttcatctgagggagaatcgccagattttccagaggagctggagaaa

SEQ ID NO: 21100 - DNA, 510 bp, Artificial Sequence
  Description of Artificial Sequence: Synthetic coding sequence
atggacacccggaataaggcccagctgcttgtcctcctgactctgctgtcagtcctcttctcccagacttccgcctggccgctctaccgcgcaccttcagcgctgagactcggggatcgcattccgttcgagggcgccaacgagcctgaccaagtgtcgctgaaggaagatatcgacatgcttcagaatgcgctggcagagaacgacactccgtactacgatgtgagccgcaatgcccggcacgcagacggcgtgttcacttcggacttctccaaactgctgggtcaattgtctgccaagaagtatttggagtccctgatgggaaagcgcgtgtcatccaacatcagcgaggacccggtgccggtgaagcgacactccgacgcggtgtttaccgacaattacactcgcctcaggaaacagatggcagtgaagaagtacttgaactccatcctgaatggtaagagaagctcagagggtgaatcaccagattttcctgaagaactcgaaaaa

SEQ ID NO: 21101 - DNA, 510 bp, Artificial Sequence
  Description of Artificial Sequence: Synthetic coding sequence
atggacaccagaaataaggcacagctcctggtcctcctgactctcctctcggtcctgttcagtcaaactagcgcgtggccgttgtaccgtgccccgtcagccttgcgactgggagacagaatcccattcgagggggctaacgagccggatcaggtgagcttgaaggaagatatcgacatgctgcaaaacgcattggcagaaaacgatacgccctactacgatgtgtcccgcaacgcaagacacgccgacggcgtgtttacctccgatttcagcaaactcttgggccagctctcagccaaaaagtacctggaatcgctgatgggaaaacgcgtgagttccaatatctctgaggacccggttcctgttaagaggcattcggacgctgtgttcactgacaactatacccggctgaggaagcagatggcggtgaagaaatacctgaacagcatacttaatggaaagcgctcctcggagggtgaaagcccagacttccctgaagagttggaaaaa

SEQ ID NO: 21102 - DNA, 510 bp, Artificial Sequence; identical to SEQ ID NO: 21081
  Description of Artificial Sequence: Synthetic coding sequence

SEQ ID NO: 21103 - DNA, 510 bp, Artificial Sequence
  Description of Artificial Sequence: Synthetic coding sequence
atggatacccgaaacaaggctcagctcctggttctcctgacgttgttgtcagtcctcttttcgcagacctcggcatggccactgtaccgcgcccctagcgctcttcgactgggagatagaatccctttcgagggtgccaacgagccagaccaagtcagcttgaaggaagatatcgatatgctccagaacgcattggcggaaaatgacaccccctactacgacgtgtcacggaacgcccgccatgccgatggcgtgttcacctccgacttctcaaagctgctgggccaactgtcggccaagaagtatctggagtccctgatgggcaaacgcgtgtcgagtaatatctcggaggatccggtgccggtgaagagacacagcgacgccgtgttcacggacaactacacgcggctgcgcaagcagatggcggtaaagaagtacctgaacagcatcctcaatggaaagcgctcctccgaaggcgagagcccagactttccggaagaactggaaaag

SEQ ID NO: 21104 - DNA, 510 bp, Artificial Sequence
  Description of Artificial Sequence: Synthetic coding sequence
atggacactcgcaacaaggctcagctgctggtcctgcttacattactgtctgtgttgttctctcagacttctgcctggccactgtaccgagccccatccgcccttcgcctcggagaccggatcccttttgagggggctaatgaaccagatcaagtcagcctaaaggaggacatcgacatgctgcagaatgcactggccgagaacgacaccccctattacgacgtgtcaaggaacgcacgacatgccgacggcgtgttcacttcagatttcagtaagcttttggggcagctgagtgctaagaaatatctcgagtctcttatgggaaagcgcgtatctagtaatattagtgaagatccggttccagtcaagagacattctgatgcagtctttactgacaactatactagactcaggaagcagatggcagtgaaaaagtacctgaatagtattctgaacggcaagagatcctccgagggggagtccccagacttccccgaagagctagaaaaa

SEQ ID NO: 21105 - DNA, 510 bp, Artificial Sequence
  Description of Artificial Sequence: Synthetic coding sequence
atggataccagaaacaaggctcagctgctcgtgttgttgacgctccttagcgtccttttttcccaaacctcagcatggcctttgtatagagcaccgtccgcactgagactcggggatcggatacctttcgaaggtgcaaacgagcccgatcaagtctcactgaaggaggacatcgatatgctgcagaatgcacttgccgaaaacgataccccctactacgatgtgtcgcgaaatgctcgccatgctgatggagtctttacgtcggacttttcgaagctgctgggacaactgtcagcgaaaaagtacctcgaatcgcttatgggtaagagagtgagctcgaacatctccgaggaccctgttcctgtcaaaaggcacagcgacgcggtgtttactgacaactacactaggcttcggaagcagatggccgtgaaaaagtatcttaactccattcttaatgggaaacgatcctcagaaggcgaatcgccagacttcccggaggaactggagaag

SEQ ID NO: 21106 - DNA, 510 bp, Artificial Sequence
  Description of Artificial Sequence: Synthetic coding sequence
atggacacccgaaacaaggcccagctacttgttttgttaactctcctctccgtcttgtttagtcaaacaagtgcctggcccctttacagagccccatccgcactgagactaggagaccggattccatttgagggtgccaacgagcccgaccaagtctctctgaaggaagacattgacatgctgcaaaacgcgctggccgagaatgacacaccctactacgatgtgagtcgaaacgcacgtcacgcggacggcgtgtttacttccgacttttccaagttgctggggcagctttcggctaagaaatatctggagtccctgatgggaaaaagagtgagctcaaacatttctgaagatccagttcccgtaaagaggcacagcgatgcggtgtttacagacaactatacacgcttgaggaaacagatggcggtgaaaaagtacctgaattccatcctcaatggaaagcggtcaagcgaaggcgaaagccctgacttcccggaggagttggaaaaa

SEQ ID NO: 21107 - DNA, 273 bp, Artificial Sequence
  Description of Artificial Sequence: Synthetic coding sequence
atgtcagctgcggataagcgggcacaccacaatgcccttgaacgcaagagaagggaccacatcaaggacagcttccattcgctccgcgactccgtcccgtccctccaaggagaaaaagcgagcagagcgcagatcttggacaaggcaactgagtacatccagtacatgcggcgaaagaaccacacccatcagcaggatattgacgatctgaagcgccaaaacgccctgctggagcaacaggtgcgcgctctggaaaaagcccggtcgtcagcc

SEQ ID NO: 21108 - DNA, 273 bp, Artificial Sequence
  Description of Artificial Sequence: Synthetic coding sequence
atgtcagcggcagacaagagagcccaccataacgcgctcgaaagaaagagacgagatcacataaaggactcctttcatagccttagggattcggtcccttcgcttcaaggagagaaggcctcacgtgctcaaattctcgataaagcaactgagtacattcagtacatgaggcgcaagaaccatacccatcaacaggacatcgatgatctgaagcggcaaaatgcactgttggaacagcaggtgcgggcactggaaaaagcacgcagctccgcc

SEQ ID NO: 21109 - DNA, 273 bp, Artificial Sequence
  Description of Artificial Sequence: Synthetic coding sequence
atgagcgcagccgacaagcgagcccaccacaacgcgctggaacgcaaacgcagagatcacatcaaggacagcttccactcgctgcgggactcggtgccgtcccttcaaggagaaaaggcgtcaagagctcaaatcctcgacaaggcaaccgagtacatccagtacatgaggcggaagaatcatactcatcagcaagacattgatgatctcaagcgccagaacgcgctgctggaacagcaggtccgcgctttggagaaagcccggtcctcagcc

SEQ ID NO: 21110 - DNA, 273 bp, Artificial Sequence
  Description of Artificial Sequence: Synthetic coding sequence
atgagcgcagccgataagcgcgcacatcataatgcattggaaagaaagcggagagatcacattaaggactcctttcactcactccgcgattcggtgccttcgctgcaaggagagaaagcgtcccgtgcccaaatacttgacaaggcaaccgagtacatccaatacatgaggagaaagaaccatactcatcagcaagatattgatgacctcaaacggcagaacgcacttctggaacagcaggtccgagcgctggaaaaggccaggtcaagcgct

SEQ ID NO: 21111 - DNA, 1317 bp, Artificial Sequence
  Description of Artificial Sequence: Synthetic coding sequence
atgccccttaacgtatccttcacaaatagaaactacgacttagactatgatagcgtccagccatatttctattgtgatgaggaagaaaacttctatcaacagcagcagcagagcgagttgcagcccccagctccaagcgaggatatttggaaaaagtttgaactgttgcctactcctcccctctccccttctaggaggagcggattgtgctcgccaagctacgtggctgttacacctttctccctcaggggagacaacgatggagggggaggaagtttcagcactgccgatcagttagagatggtgactgagctgctgggtggagacatggtgaaccagtcattcatttgcgaccctgacgacgaaacattcatcaaaaacatcatcattcaggattgtatgtggtctggattttccgccgcagccaaactggtaagcgaaaaactggctagttaccaggccgctaggaaagacagcgggtctcctaaccccgccagaggacactcagtttgctccacatcgtccctctacctacaggacctgagcgcagctgcgtccgagtgcattgatcctagtgtggtctttccatacccacttaacgacagttcatcccctaaaagctgcgcaagccaggactcctcagcattcagtccttcaagcgatagcctgctttcttccacggagagtagcccacaaggatctcctgagcccctggtccttcatgaggagacacctcctaccacatcttctgattcggaggaggaacaggaggatgaggaggaaatcgacgttgtgagcgtggagaagcgccaggccccaggaaaacgcagcgagagtggtagccctagcgcaggtggacattcaaaaccccctcacagtccactggttcttaaaaggtgtcatgtgtccacccatcaacataactatgccgctcctcccagcacccggaaagattacccagctgcaaaacgggtgaagctcgattccgtcagggtgttgcgtcaaatcagcaataacaggaagtgcactagtcctaggagcagcgacacagaagaaaacgtcaagaggcgcacacacaacgtactggagagacaaagacgtaatgaactcaagaggtccttttttgctttacgagaccagattcctgagctggaaaacaatgagaaagctcctaaagtggttattctcaagaaggccacagcttacatcttatccgtccaggcagaggagcagaaattgatctctgaggaagatctgcttaggaagcggagggaacaattaaaacacaagctcgagcaactgcggaatagctgcgct

SEQ ID NO: 21112 - DNA, 1317 bp, Artificial Sequence; identical to SEQ ID NO: 21111
  Description of Artificial Sequence: Synthetic coding sequence

SEQ ID NO: 21113 - DNA, 1317 bp, Artificial Sequence
  Description of Artificial Sequence: Synthetic coding sequence
atgcctctcaacgtgagtttcacaaataggaactacgatctcgattacgatagcgttcagccttatttctactgcgatgaggaggaaaatttctaccagcagcagcagcaatcagaactgcagccaccggctccgtctgaagatatctggaagaaattcgagctcctgcctacacctccactcagccctagcaggagaagtggtctatgttctccctcatacgtggctgttaccccttttagtttgcgcggcgacaacgacggaggaggtggatcattcagcaccgcagatcaacttgagatggtcactgagctgctcggcggcgatatggtgaatcagtcgtttatctgtgatcccgatgacgagacgttcatcaaaaatattattattcaggattgtatgtggagcggattctctgctgccgccaaactcgtgagcgagaaacttgcctcatatcaggccgcaaggaaggattccgggagccccaaccctgctcggggacatagtgtgtgctctacctcctcgctgtacttgcaagacctgtcagctgctgccagtgagtgtatcgacccatcagtggtgttcccataccctctgaacgactcctctagcccgaagagctgcgcctcccaagacagtagcgcattctccccaagcagtgacagccttctgagcagtacagagagcagccctcaggggtcaccagagccactcgttctccatgaggagactccccctaccacatctagcgactccgaagaagaacaggaagatgaagaagaaatcgacgtggtatcggtggagaagcgccaggcacccggtaaaaggtccgagagtggatcacccagcgctggaggacactctaagccaccacatagccccttggtcttgaaacgctgccacgtcagcacccatcagcacaattacgccgctcctccttcgacaagaaaggattaccctgctgctaaacgggtcaaactggatagcgtcagggtcctcaggcagatatccaacaacagaaaatgcaccagcccaaggagttctgatacagaagaaaacgttaagaggaggactcacaacgtcctggaacggcaacgccgaaatgaactgaagaggtcattttttgccttaagggaccagatccctgagctggagaataacgaaaaagccccaaaggtggtgattttgaagaaggctacagcctacatcctgagcgtccaagccgaggagcagaaactgatctccgaggaggatctgctcaggaaacgaagggagcagttgaaacacaaattggaacaattgagaaactcctgtgcc

SEQ ID NO: 21114 - DNA, 1317 bp, Artificial Sequence; identical to SEQ ID NO: 21113
  Description of Artificial Sequence: Synthetic coding sequence

SEQ ID NO: 21115 - DNA, 1317 bp, Artificial Sequence
  Description of Artificial Sequence: Synthetic coding sequence
atgccgctgaatgtgtcattcacgaaccgtaattatgacctggactacgactcggtgcaaccatacttctactgcgatgaagaggaaaacttctaccaacagcagcaacaatccgagctgcaaccgccggcaccgtcagaggatatctggaagaagttcgagctgctgccgaccccaccactcagcccatccagacggagcggcctgtgctctccgtcatacgtggccgtgacgccattctccctgcggggagacaacgatggagggggaggttcctttagtaccgcagaccagctcgaaatggtcactgagcttctcggaggagacatggtgaaccagtcctttatctgcgacccggatgacgaaaccttcatcaagaatatcatcattcaagactgtatgtggtctggtttctcagctgccgcgaagctcgtaagcgagaagctggcctcataccaggccgcccggaaggactcgggatctcccaatcctgcgagaggacattccgtctgctctacttcgtctctctaccttcaggatctctccgcggccgcatcggaatgcattgatccaagcgtggtgtttccgtaccctctgaatgactcgagctcgcctaaaagctgtgcgtcacaagactcgagtgcctttagcccttctagcgattcgctgctctcatccactgaaagctcgccccagggatcaccagagcctctggtgctgcacgaggagactccccccaccacttcgagcgactcagaggaagaacaggaagatgaggaagaaatcgacgttgtgtccgtcgagaagcgtcaggcgcccggaaagcgctccgaaagcggcagcccatccgcgggaggccacagcaagcctccgcactcaccgttggtgctgaagcgctgtcacgttagcacgcaccagcacaactacgccgcgccaccgtcgacccgaaaggattacccagccgcgaaacgcgtgaaattggacagcgtgcgggtgctgcgccagatctccaataaccgcaagtgcacttcaccacggtcatccgataccgaggaaaatgtgaagcgccggactcacaacgtcctggaaaggcagcgcagaaatgaactcaagcgcagcttcttcgcactccgcgatcagatcccagagctggagaataacgagaaagcgcctaaggtcgtcatcctgaaaaaagcaaccgcctacatcctgtccgtccaggccgaggaacaaaaactcatctcggaggaggacctcctccgcaagcggcgggagcagctgaaacataagctcgaacaactccgcaactcatgcgcg

SEQ ID NO: 21116 - DNA, 1317 bp, Artificial Sequence; identical to SEQ ID NO: 21115
  Description of Artificial Sequence: Synthetic coding sequence

SEQ ID NO: 21117 - DNA, 1317 bp, Artificial Sequence
  Description of Artificial Sequence: Synthetic coding sequence
atgccgcttaatgtttcgtttacgaaccgcaactatgaccttgactacgactctgtccagccgtacttctactgcgatgaggaagaaaacttctatcagcagcaacagcagtctgagctccagccacccgcccccagtgaggacatttggaaaaagtttgagctgcttccaacccctcccctaagtccctcgaggcgtagcggactgtgttctccgtcctatgtggctgtcactccattcagtctacggggcgataatgatgggggcggcggatctttctcgaccgccgaccagctggagatggtgaccgagttgctaggtggtgatatggtcaaccaatcattcatctgcgaccccgatgacgaaaccttcatcaagaacatcattatccaagactgtatgtggagcggtttctccgctgctgcaaagctcgtttccgaaaaattggcttcttaccaggctgcccgaaaggactccggctcccctaaccccgctcgtggtcattcggtgtgttctacttcctctttgtacctccaggacttgtctgccgcggcatctgagtgcatcgatcccagcgtggttttcccgtaccctctgaacgattctagcagccccaaatcctgcgcgtcgcaagactcatccgcgttctctccctcctcagacagcctgctctccagcaccgagtcgtcgccccaaggttcgcccgagcccctcgtattgcatgaagagacaccccccaccacctcctcagattccgaggaggagcaagaggacgaagaggaaattgacgtggtgagcgttgagaagcgccaggcgcctggtaagcggtctgagtcgggctcccctagcgctgggggtcattccaagcccccccactcgcccctcgtgttgaaacgctgccatgtttccacccaccagcacaactacgccgcgcctccttccaccagaaaagattacccggccgccaagcgtgtcaagctggactccgtgcgggtgctccgacagatttccaataaccgcaagtgcacttccccacgttcctctgacaccgaagaaaacgtgaagcgccgcactcacaacgtcctggagagacaacggcgtaatgagctgaagcggtcgttctttgctctgcgtgatcagattccggagcttgagaacaacgagaaggcccctaaagtcgtgatcctcaagaaggccaccgcttatattctttccgtccaggccgaggagcaaaagctgatttcagaggaagatctccttcgcaagcgccgcgagcagctaaagcacaagctggaacaactccgcaactcttgcgct

SEQ ID NO: 21118 - DNA, 1317 bp, Artificial Sequence; identical to SEQ ID NO: 21117
  Description of Artificial Sequence: Synthetic coding sequence

SEQ ID NO: 21119 - DNA, 1317 bp, Artificial Sequence
  Description of Artificial Sequence: Synthetic coding sequence
atgccactgaacgtctcctttactaatcgaaattatgacctggactatgattccgtccagccttatttttactgcgatgaggaagaaaacttttatcagcaacagcaacagtccgagcttcagcctcccgccccgtccgaagatatatggaagaaatttgagctgctgcccaccccaccgctctcacccagcagacgctcagggctctgcagccctagttacgtggccgtgaccccgtttagtctgcgcggcgataatgacggcgggggcggatccttctcgacagctgatcagctcgagatggttacagagctcctgggcggggacatggtgaaccagtctttcatctgtgacccagacgatgagaccttcattaaaaacatcattatccaggactgcatgtggagcggctttagcgccgctgccaagttagtcagcgagaagctggcctcctaccaggcagcacgcaaagatagtggctcccccaatcccgctagaggtcattccgtttgttctacctcctcactctatctgcaggacctaagcgcagcggcttctgagtgcattgaccccagtgtcgtgttcccttatccactgaatgactcctcttcccctaagtcatgtgcgtctcaagattcctccgctttctcaccatcttcagactctctcctctccagcaccgagagttcaccacaggggagtcccgaaccattagtgctgcacgaagaaacacctccaacgacctcctctgattctgaagaggagcaggaagatgaagaggagattgacgtagtgtctgtggaaaaacggcaggctcctggcaagaggtctgagagcggttcaccttctgcaggcggccactctaagcccccgcactcacctctcgtcttgaagcgatgccacgtgagcactcaccagcacaattatgctgccccgccttctacccggaaggactacccagccgccaaaagggttaagctggacagcgttcgggtgctgcgccagatttcaaataaccggaagtgtaccagtccccgatcttccgataccgaggaaaatgtgaagcgccgtacacataatgtcttagagcggcagcgccgcaacgagctaaagcgctccttctttgccctgcgcgaccagattcccgaactcgagaataacgagaaggcacctaaagtcgtcatcctgaaaaaggccacagcctatatattgagtgtccaggctgaggagcagaaacttatctcggaagaggatttactgagaaagaggcgggaacagctgaagcataagcttgagcagctgcgcaactcctgtgca

SEQ ID NO: 21120 - DNA, 1317 bp, Artificial Sequence; identical to SEQ ID NO: 21119
  Description of Artificial Sequence: Synthetic coding sequence

SEQ ID NO: 21121 - DNA, 1317 bp, Artificial Sequence
  Description of Artificial Sequence: Synthetic coding sequence
atgccacttaacgtgtcctttaccaatcggaattacgatctggattatgatagcgtgcagccctacttctattgtgacgaggaggaaaacttctatcagcaacagcaacagtccgaacttcaacctcctgctccatcagaagatatctggaaaaagtttgaactgttgcccaccccaccactttcaccatcacgtcggtcgggcctttgtagcccttcgtacgtggcggtgacccctttttcgctgagaggtgacaatgatggcggcggcgggtcgttttctaccgcagaccagcttgagatggtgaccgaacttctgggcggagatatggtcaatcagagcttcatttgcgatccagatgatgaaactttcatcaagaacatcataatacaagactgtatgtggtcagggttttccgccgccgcaaaactcgtgtccgaaaagctcgcaagctaccaggctgccaggaaggacagcggcagccctaatccggcccgagggcatagcgtctgttccacctcatccctctatcttcaggatctgtccgcggcagcgtccgaatgtattgacccttcggtggtgtttccctaccctttgaacgactcttcctcccctaagtcctgtgctagccaagacagctcggcgttctctccttcctcagattcgctgctcagcagcactgaaagctccccccaaggttccccagaaccactggtactccatgaagagactcctcctactactagctcggactcggaggaagaacaggaagatgaagaagaaattgatgtcgtgtcggtggagaaacggcaagcaccaggaaaaagatcggaatccggatcaccatcggctggaggtcactcgaagccgccacactccccacttgtcctgaagcggtgccatgtgagcacccatcagcacaactacgcagcaccccccagcactcgcaaggattacccagccgccaagcgggtgaagctggacagcgtccgagttcttcgccaaatctctaacaacagaaagtgtactagccccaggagctcagataccgaagagaacgtcaaacgaagaacccacaatgtcctggagagacagagaagaaatgagttgaaacgcagcttttttgcacttcgcgatcaaatacccgagcttgaaaacaacgaaaaggcacctaaagtggtcatattgaagaaagcgactgcgtacatcctctcggtccaagcagaggagcaaaagctcatcagcgaggaggaccttctcaggaagagacgggaacagcttaaacataaactcgaacaactcaggaacagttgtgca

SEQ ID NO: 21122 - DNA, 1317 bp, Artificial Sequence; identical to SEQ ID NO: 21121
  Description of Artificial Sequence: Synthetic coding sequence

SEQ ID NO: 21123 - DNA, 1317 bp, Artificial Sequence
  Description of Artificial Sequence: Synthetic coding sequence
atgcctctgaacgtgtcgttcaccaataggaattatgaccttgactacgacagtgtccagccatatttttactgcgatgaggaggaaaacttctatcagcagcagcagcagtcagaacttcaaccaccagctccaagcgaggacatttggaagaagtttgagttgctgcctacacctcctctcagtccatcaaggcggtcggggctgtgtagcccttcatacgtggcagtaacacccttcagcctcaggggggataatgatggaggaggtggttctttttctacggcggatcaactggaaatggtcaccgagctacttggcggagatatggtgaatcagtcattcatatgcgacccagatgacgagacttttattaaaaacatcatcattcaggattgcatgtggagtggtttctctgcagcggccaagctggtgtcagagaagctggctagctaccaagccgcgaggaaagacagcggttcacctaacccggcacgaggccactcagtgtgcagcacttcttcgctgtacctccaggacctttccgcagcggcgagcgagtgtatcgacccttccgtggtcttcccttaccctcttaacgactctagtagccctaaatcctgcgcctcgcaggactcttctgccttcagtccgtcttctgactccctcttgtcttctacggaaagctcaccccaagggtcccccgagcccctagtgctacacgaggagactcccccgaccaccagttctgatagcgaggaagagcaagaggacgaagaggagatcgacgtggttagcgttgagaagaggcaggctcctgggaagcgatcggaaagcgggtctcctagcgccggcggacattcaaagccaccccatagcccgctggtacttaagaggtgtcacgtttccactcatcagcataactacgcagctccacctagcacccgcaaggattatcctgctgctaaaagggtgaagctggattctgtacgggtgttgcggcagatatccaacaacagaaagtgtacaagccctagaagcagcgacaccgaagagaatgtgaagaggcgcacacacaacgtacttgaacggcagcggaggaatgaacttaaacgctcctttttcgctctgagagaccaaatccccgagctggaaaacaatgaaaaggctcctaaagttgtaattctaaaaaaggcaacagcttatatcctttctgtccaggcggaggagcagaagctgatttctgaggaggatctgttgcgcaagaggagagaacaactgaaacataaactggagcagctgcgtaattcttgtgct

SEQ ID NO: 21124 - DNA, 1317 bp, Artificial Sequence; identical to SEQ ID NO: 21123
  Description of Artificial Sequence: Synthetic coding sequence

SEQ ID NO: 21125 - DNA, 1317 bp, Artificial Sequence
  Description of Artificial Sequence: Synthetic coding sequence
atgccacttaacgtgtcctttaccaatagaaactacgatcttgactacgactcagtgcagccatacttctactgtgacgaggaagaaaacttctaccaacagcaacagcagtcggaactccaacctcctgcgccatccgaagatatctggaagaaattcgagctcctcccaactcctcccctttcgcctagcaggagatcgggactgtgtagcccctcatatgtggcagtcactccattttcgcttagaggggacaacgacggaggaggcggatctttctccaccgccgaccagcttgagatggtgactgaactgttgggtggggatatggtcaaccagagcttcatctgcgaccccgatgacgaaacctttatcaagaacattatcattcaagattgtatgtggtcaggttttagcgccgcagcaaagctggtgtcagagaaacttgcaagctaccaggcagcgagaaaggacagcggatcgccaaatccagctaggggtcattccgtgtgttcaacttcgagcctctaccttcaagacctttcagcagcggcatccgaatgcatcgacccttctgtggttttcccttaccccctgaacgattcctctagccctaaatcctgcgcaagccaagactcctccgctttttcgccttcgtcagactcgctgctgagctcaaccgaatcctccccccagggatctcccgagcctcttgtgctgcatgaagaaaccccacctaccactagttccgactcagaggaggagcaggaggacgaggaagagattgacgtagtgtccgtggaaaagaggcaagctcccgggaaaaggagcgagtcgggatcgccatcagcgggtggccacagtaaacctccacactcgcctctggtcttgaaaagatgtcatgtgtcgacccatcagcacaattacgcggcacctccttccacccgcaaggactacccagcagccaaacgtgttaagctggattccgttcgggtgctccgccaaatatcgaacaaccggaagtgtacttcaccaagatcctcggataccgaagaaaacgtcaagagacgcacccacaacgtcctggagaggcagcggcgaaatgaactgaagcgctccttctttgcacttcgagatcaaattcctgaactggagaacaacgaaaaggcgcctaaggtggtcatactcaagaaggccactgcatacatcctcagcgtgcaggctgaagaacagaagctcattagcgaggaggatttgttgaggaaacgacgcgaacaacttaagcataagctggaacagctgagaaacagctgtgcg

SEQ ID NO: 21126 - DNA, 1317 bp, Artificial Sequence; identical to SEQ ID NO: 21125
  Description of Artificial Sequence: Synthetic coding sequence

SEQ ID NO: 21127 - DNA, 1317 bp, Artificial Sequence
  Description of Artificial Sequence: Synthetic coding sequence
atgccactgaacgtctcctttactaacagaaactatgatctggactacgacagcgtgcagccatatttctattgtgacgaggaggagaacttttatcaacaacagcaacaaagcgaactgcagccccccgcccctagtgaggacatatggaaaaagtttgagctgctccctacaccacctctgtctcctagcaggagaagcggcttatgtagcccatcttacgtggctgttaccccatttagcctcagaggtgacaatgacggcggcggcggctctttctctaccgcagatcagctggagatggtcacagaactgctcggtggcgacatggtcaaccagagctttatttgtgacccagatgatgaaaccttcatcaagaacattattatccaggactgtatgtggagcgggtttagtgcagccgccaagctcgtgagcgagaagctcgcttcctaccaggccgccaggaaagatagcggcagccccaacccagcccggggacattcagtgtgtagcaccagttctctatatttacaggacctcagcgcagctgcctccgagtgcatagacccatctgtcgtttttccctacccattgaatgacagctcaagccctaagagttgcgcttctcaggattcaagcgctttcagtccctcttcagactccttgctgtcatccacagaatctagtcctcaggggagccctgaaccactggtgctccacgaggagacccctccaactaccagttccgactctgaagaagagcaggaagacgaagaagagatagatgtggttagcgtggaaaaacggcaagccccaggcaagcgtagcgaatcaggttcccccagtgctggaggtcatagcaagcccccacattcacccctggtgctaaaacgatgccatgttagcactcaccaacataattatgccgcccctcccagtacccgaaaggattatcctgcagctaagagagtcaaattagatagcgtccgggtgctcagacagatatctaacaatcggaagtgtacaagcccccggagttctgataccgaggagaacgtgaagagacgtacacataatgttctagagcgtcagcggaggaacgaactcaaaagatcatttttcgctctgcgggaccaaatccctgagcttgaaaacaatgagaaagcacccaaggtggtcattcttaagaaagccaccgcctatattctgtccgttcaggccgaggaacaaaaactgatcagtgaagaagacctattgcgcaaaagacgcgaacagctgaaacacaagctggagcagctgcgaaactcatgtgca

SEQ ID NO: 21128 - DNA, 1317 bp, Artificial Sequence; identical to SEQ ID NO: 21127
  Description of Artificial Sequence: Synthetic coding sequence

SEQ ID NO: 21129 - DNA, 1317 bp, Artificial Sequence
  Description of Artificial Sequence: Synthetic coding sequence
atgcctctcaacgtgtcgtttactaatcgtaactacgatctcgattacgattcggtgcagccatacttttactgtgatgaggaagagaacttttaccagcaacagcaacaaagcgaactgcagcccccagcgccatcagaagatatatggaaaaagtttgaactgcttcctacgcccccactgtccccatccagacgctccggtctttgttccccttcgtacgtggcagtgaccccattctcgctgcggggcgacaatgatggaggcggaggttccttctcgaccgccgatcagcttgagatggtgactgaacttctggggggagatatggtgaatcaatctttcatatgtgatccagatgatgaaacttttatcaagaacatcattatccaagattgtatgtggtcaggattttcggcggcagccaagctcgtgtcggagaagctggcctcataccaagcggcccggaaggattcgggatcgcccaaccctgcgcgtggtcatagcgtgtgctcaacctcatctctgtacctccaggatcttagcgccgcagcatccgaatgtattgacccttcagtcgtgtttccctaccccctgaatgattcctcctcaccaaaatcgtgtgcctcccaggattccagcgcattttcgccgtcctcagatagcctgctgtcatcgacggaatcgtcacctcagggctcccctgagccactcgtccttcacgaagaaacccctccaactacttcgtcggattcggaagaggagcaagaggacgaggaggaaatcgatgtcgtgagcgtggaaaagaggcaggcaccaggaaagcgttcggaatctggatcgccgtccgcagggggccactccaagccgccacactcaccactcgtgttgaagagatgtcatgtgtcgacccatcagcacaactacgctgcacccccctcgaccagaaaggattacccggcagcaaagagagtcaaacttgacagcgtccgcgtgcttcgccaaatatccaataacagaaagtgtacctcacctcggtcctcagacaccgaagagaatgtcaagagaagaactcacaacgtgcttgagagacagcggagaaacgaacttaaacggtccttttttgctctgcgcgaccagataccggaacttgaaaacaatgagaaggcgcctaaagtcgtgatacttaagaaggcgactgcatacattctgtccgtccaggcagaagagcaaaagctgatttccgaggaagatctcctgagaaagcgaagggaacaactgaagcataaacttgaacaactcagaaacagctgtgca

SEQ ID NO: 21130 - DNA, 1317 bp, Artificial Sequence; identical to SEQ ID NO: 21129
  Description of Artificial Sequence: Synthetic coding sequence

SEQ ID NO: 21131 - DNA, 1317 bp, Artificial Sequence
  Description of Artificial Sequence: Synthetic coding sequence
atgcctcttaatgtctcattcaccaaccgtaactacgaccttgattacgatagcgtgcagccttacttttactgcgatgaggaagaaaacttttaccagcaacaacagcaatcggaactgcagccaccagcaccttcagaggacatctggaagaagtttgaacttctgccaactcctcctctcagcccctcaagaagatcaggattgtgttcgccttcgtacgtggcggtcaccccattttcccttcgaggagataatgacggtggcggaggatccttttcaaccgcggaccaacttgaaatggtcactgagctgttgggtggagatatggtgaaccaatccttcatttgcgaccccgacgatgagacgttcatcaaaaacattatcatccaagattgtatgtggtcaggattttctgcagccgctaaacttgtgagcgagaaactcgcaagctaccaagcagcccgcaaagattcgggaagccccaatccagcaagaggtcattcggtgtgttcaacttcatccttgtacctgcaggatctttcggccgcagcgagcgagtgtatcgacccatcggtggtgtttccttaccctctcaatgactcctcgtcgcctaaatcatgcgcatcgcaagactccagcgcctttagcccatcctcagattcgctcctttcgtccaccgagagctcaccacaggggtcgccagagccccttgtgctgcatgaagaaactccgcctacgaccagcagcgattcagaagaagaacaagaggacgaagaagaaattgacgtggtatcggtggaaaagcgccaagcaccaggcaagcgatcagagagcgggtcgccgtcggcaggcggtcactccaagcctcctcattcgccgctcgtcctgaagagatgtcacgtgagcactcaccaacacaattacgcggcacctccttcaacccgaaaggactaccccgccgccaaaagagtgaaattggactccgtgcgcgtcctcagacagatttcaaacaacaggaagtgtacctccccaagatcaagcgatactgaagaaaacgttaaaagaagaacccataacgtgctggaacggcaacggcggaatgagctgaagaggtcgtttttcgcacttcgggatcaaattccagagcttgagaacaacgaaaaggccccgaaggtggtgattcttaagaaagcaactgcatatatcctgtcagtgcaggccgaagaacaaaagctgataagcgaagaagatctgcttagaaagcgccgagaacagcttaaacacaaacttgagcagttgaggaactcgtgtgcc

SEQ ID NO: 21132 - DNA, 1317 bp, Artificial Sequence; identical to SEQ ID NO: 21131
  Description of Artificial Sequence: Synthetic coding sequence

SEQ ID NO: 21133 - DNA, 1317 bp, Artificial Sequence
  Description of Artificial Sequence: Synthetic coding sequence
atgcctcttaatgtatcctttacgaaccgtaactacgatctggactacgattcggtgcagccttacttttactgtgatgaagaagagaatttctaccagcaacaacaacagtcggagcttcaaccacccgccccctcggaggacatttggaagaagttcgaactgcttcctaccccacctctctcgccatcccgccgatctgggctctgttcaccaagctacgtggcggtgactccattcagccttagaggagacaacgacggagggggcgggagcttttccaccgccgatcaacttgaaatggtgactgagcttctggggggagatatggtcaatcaatccttcatctgtgatcctgatgatgaaactttcatcaagaatatcatcattcaagattgtatgtggtcaggcttttctgcggcagcaaagctcgtgagcgaaaagctggcgtcgtaccaggcggcgaggaaggactcgggatcgccaaacccagccagagggcattccgtgtgctcaactagctcactgtaccttcaggatctgtccgcggcagcaagcgagtgcatcgaccctagcgtggtctttccttacccattgaatgattcctcaagcccaaaatcgtgcgccagccaggattcctctgccttttcaccaagctctgattcccttttgagctctaccgagtctagcccgcaggggtcacctgaaccacttgtcttgcatgaagaaactcctcctactacctcctccgatagcgaggaagaacaggaggacgaggaagaaatagacgtggtttcagtggaaaagaggcaagcacctgggaagcgaagcgaatcaggctcaccgtcggcgggtggtcattccaagccaccacactcgccactggtcttgaaaaggtgtcatgtgtccacgcaccagcacaactatgcagcccctccctcgacgcggaaggactaccctgccgcaaagcgggtcaaactcgactccgttcgcgtgcttaggcaaatttcaaacaatcgcaagtgtacttcgccgcgatcctccgacactgaggaaaatgtcaagcgcaggacccacaacgtgcttgaaagacagagacggaacgagctgaaaagatcgttttttgcgctgagagatcaaattcccgagctcgaaaacaacgagaaggcacccaaagtggtgattctcaagaaagcaaccgcatacattctctcagttcaagcagaggaacaaaagctcatatcggaagaagatctcctccgtaaacgtcgggagcaactgaaacataagctcgaacagcttagaaactcgtgtgcg

SEQ ID NO: 21134 - DNA, 1317 bp, Artificial Sequence; identical to SEQ ID NO: 21133
  Description of Artificial Sequence: Synthetic coding sequence

SEQ ID NO: 21135 - DNA, 1317 bp, Artificial Sequence
  Description of Artificial Sequence: Synthetic coding sequence
atgcctctgaatgtgagcttcaccaaccgcaattatgatttggattatgactccgtgcaaccatacttctattgcgatgaagaagagaatttctaccagcagcagcagcagtcagaattgcagcctccagctcccagcgaggacatatggaaaaagttcgagctcctgccgaccccccctctgagtcccagcagacggagtgggctttgcagcccctcctatgtagccgttaccccctttagtctgcgaggagataatgacggcggggggggcagtttttctactgcagaccaactagaaatggtgacggagcttctgggaggcgacatggtcaatcagagcttcatatgtgaccccgatgatgagacatttatcaagaacatcatcatccaagactgtatgtggtcaggcttcagtgctgccgccaagctcgtctccgagaaacttgctagctatcaggctgctcgaaaagattccggcagccctaatcctgcccgtggccattccgtttgtagcacatccagcctctacctgcaggatctctctgctgcagcctctgagtgcatcgacccatcggtcgtgttcccctaccccctaaatgacagcagctcacccaagtcctgtgcgtctcaggactctagcgcctttagtccttcttccgacagcctgctctcctcgaccgaatcatctcctcaggggtcaccagaacccctggtgctgcacgaggagacacccccaacaactagcagtgactctgaggaggagcaggaagatgaagaggagatcgacgttgtgtcagtggagaagagacaagctcctggaaagaggagtgagtcagggagcccttcagcgggggggcactccaaacctccacacagccctctggttctcaaacgctgccacgtgtctacgcatcagcataattatgctgcccccccttccacacggaaagactatcctgctgctaagcgagtgaagctagattccgtgcgggtcctccggcaaatttccaataataggaaatgcactagccccaggagtagcgataccgaagagaacgtgaagcgcagaacccacaatgtcttggagcggcaacgccgaaatgaactcaaacggtccttctttgctctgagggaccagattccagagctcgaaaacaatgaaaaagccccaaaagtcgtaatcctgaaaaaggctacagcttatatcctgtcggtgcaggccgaggagcagaagttgatatccgaggaagacctgctgaggaaaaggagggaacaactgaagcacaaattggaacagctgcggaatagttgtgct

SEQ ID NO: 21136 - DNA, 1317 bp, Artificial Sequence; identical to SEQ ID NO: 21135
  Description of Artificial Sequence: Synthetic coding sequence

SEQ ID NO: 21137 - DNA, 1317 bp, Artificial Sequence
  Description of Artificial Sequence: Synthetic coding sequence
atgccactgaatgtgagttttacaaatagaaattacgatttagattatgactctgtgcaaccatatttctactgcgacgaggaagaaaatttctaccaacagcagcagcagtccgagctccaacctcctgcaccctccgaagatatctggaagaagtttgagctgctgcccaccccgcctctgtccccttcccgccgctctggcctgtgctcccctagttacgtcgccgttacacccttttctctgcgcggggataatgacgggggggggggctccttctccacagccgatcaactggagatggtcaccgaattgctcggaggggacatggtgaaccagagttttatatgcgatccagatgacgagacgtttatcaaaaacatcataatccaggactgtatgtggtctgggttctccgcggccgcaaaactggtctccgaaaagttagcttcataccaggcggcgagaaaggatagtgggtctcctaaccccgctaggggccactccgtatgcagcacatcctcgctctatttgcaggacctttccgccgctgcttccgaatgtattgatccatctgttgtgttcccttacccacttaatgactcttccagtcctaaatcgtgcgcaagtcaggatagctccgctttttctcccagctccgattcactgttatctagcaccgaatcctccccacagggttccccagagccgctggtcttgcatgaggaaaccccacccaccaccagcagcgatagtgaggaggaacaagaggacgaggaggagattgacgtagtgtcggtagagaaacgccaggcacccggcaagcgctccgagtcaggaagccctagtgctggcgggcattcaaagcccccgcacagcccgttggtgctgaagaggtgtcacgtgtccacacaccagcacaactacgccgcaccccccagcacacgtaaagactacccagctgctaaaagggtcaagctggactccgtccgagtgcttaggcaaatttcgaacaatagaaagtgtacaagcccacggagttctgacaccgaagagaacgtcaagagacgtacccacaacgtgctggagagacagaggcggaacgaactgaagcgttcattcttcgcgctgagggaccagatacctgaattggagaacaacgagaaggctcctaaggtggtgatactcaagaaggccaccgcctacatcctctcggtgcaggctgaagagcagaagcttatcagtgaagaagaccttctgcggaagcgtcgcgaacagttgaaacataagcttgaacagcttagaaattcatgtgcc

SEQ ID NO: 21138 - DNA, 1317 bp, Artificial Sequence; identical to SEQ ID NO: 21137
  Description of Artificial Sequence: Synthetic coding sequence

SEQ ID NO: 21139 - DNA, 1317 bp, Artificial Sequence
  Description of Artificial Sequence: Synthetic coding sequence
atgcccttgaatgttagctttactaatcgcaattacgacctggactacgactccgttcaaccctacttttactgtgacgaggaggaaaacttttaccaacaacagcagcaatcggaactccaacccccagcaccttcagaagatatttggaagaagtttgaacttctgccgactccgccgctgtccccttcgagacgttccgggctttgctcgccttcttacgtggcagtcacccccttttcacttcggggcgataacgatggaggcggtggatccttttcgaccgcggatcagttggaaatggtgaccgaacttctcgggggtgatatggtgaaccagtcattcatatgtgatccagacgatgaaaccttcatcaagaacatcatcatccaggactgtatgtggagcggattcagcgcagccgcgaaacttgtcagcgaaaagttggcaagctatcaagcagcgagaaaggattcggggagccctaacccagctcgcggacatagcgtctgttcaacctcgagcctctaccttcaagatctgagcgctgcggcatccgagtgtatcgatccatcagtggttttcccttaccctcttaatgattcctcgagccccaagtcgtgcgcaagccaagatagctcggcattctcaccttcaagcgactccctgctgtcctcgaccgagtcatcgcctcagggctcccctgaaccgttggtcctgcatgaggaaactcctcccactacctcatcggacagcgaggaagaacaagaggatgaagaagaaattgatgtggtgtcagtggaaaagagacaggcacccggcaaacgcagcgagtccggttctccatcagcaggtggacattcaaagcccccacactcgccattggtgcttaaaagatgtcacgtctcaacccatcaacataactacgcagcaccaccttcgacgaggaaggactacccagcagccaagagagtgaaactcgattcggttcgcgtgctcagacagatttcgaacaatcgcaaatgcactagccctaggtcatcggacactgaggaaaacgtgaaacgaagaacgcacaacgtgctggagcgacaacggcgtaacgagctgaagcggtcgttttttgcactccgagatcaaatacctgaattggaaaacaatgagaaggcgccaaaagtggtcatactcaaaaaggcaaccgcatatatcctgtcagtgcaggcagaagaacagaagctcatttctgaagaagatctgcttcgcaagcgaagggagcaacttaaacacaagctggagcagcttagaaattcgtgcgca

SEQ ID NO: 21140 - DNA, 1317 bp, Artificial Sequence; identical to SEQ ID NO: 21139
  Description of Artificial Sequence: Synthetic coding sequence

SEQ ID NO: 21141 - DNA, 1317 bp, Artificial Sequence
  Description of Artificial Sequence: Synthetic coding sequence
atgccgctgaacgtgtcattcactaaccggaattacgatctcgactacgactctgtgcaaccgtacttctactgtgacgaagaagagaatttctaccagcaacagcagcagtccgaacttcagccgcctgcaccctcagaggatatctggaagaagttcgagctgctcccaactccgccgctgagcccgtcgcggcggtcgggcctctgctcgccttcatacgtggccgtcaccccgttcagcctgagaggcgacaacgacggaggaggcggatccttctccactgccgaccaactggagatggtaactgaactgcttgggggagacatggtgaaccaatcgttcatctgcgacccagacgacgagacttttatcaagaacatcataatccaagactgtatgtggagcgggttttccgctgcggccaagctggtgtcggagaaactggcgtcctatcaggctgcccgaaaggactccggatcaccgaacccagcgcggggacactcagtgtgctcgacttcctcgctctacctgcaggatctctcggcggccgcaagcgagtgtattgatccttccgtggtgttcccgtaccccttgaacgatagctcgtcgccgaaatcatgcgcttcccaagattcaagcgccttctcaccgtcgtcagattccttgttgagcagcaccgagagttcgccgcagggatcaccagaaccactggtgctgcacgaggaaactccgccaactacctcgtccgattccgaggaggagcaggaagatgaggaagagatcgacgtggtcagcgtggagaagcgtcaggcaccagggaagcgctcagaatcgggttcaccatccgcgggcggccactctaaaccgcctcactctccccttgtcctcaagaggtgccatgtctccacgcaccagcacaactacgccgccccgccaagcactcgcaaagactacccggccgccaaaagagtgaagctggattcggtgagagtcctccgtcagatttccaataaccgcaagtgcactagcccacgctcctccgataccgaggaaaatgtgaagcgcagaacccacaacgtgctcgagcgacaacgccgaaacgaacttaaacgctccttcttcgccctgagggaccaaattccagaactcgaaaacaacgaaaaagcgcctaaggtggtgatcctgaagaaggctaccgcttacatcctctcggtgcaggctgaggaacagaaactcattagcgaagaggacctgctgaggaaaagacgtgagcagttgaagcataagctggaacagctgaggaattcatgcgcg

SEQ ID NO: 21142 - DNA, 1317 bp, Artificial Sequence; identical to SEQ ID NO: 21141
  Description of Artificial Sequence: Synthetic coding sequence

SEQ ID NO: 21143 - DNA, 1317 bp, Artificial Sequence
  Description of Artificial Sequence: Synthetic coding sequence
atgcccttaaacgtgtcttttactaaccgtaattacgaccttgactacgattccgtacagccttacttttactgcgacgaagaagagaatttctaccagcagcagcagcagtccgaactgcagccgcctgctccatcagaggatatttggaaaaagttcgagttgttgccaaccccccccctctcgcccagcagaaggtctggcctatgcagtccatcctatgtggccgtgactcccttcagcttgaggggcgataacgatggcggagggggaagcttttctaccgctgaccagctcgagatggtgaccgagctgctgggcggagatatggtgaaccagagcttcatctgcgatcccgacgacgagacgttcatcaaaaacataattatacaggactgcatgtggtcaggattttctgccgcggcgaaacttgtctccgaaaaacttgccagctatcaggctgcacggaaggattccggaagtcccaatccagctcgggggcatagtgtgtgcagcacgagctctctctacctgcaagatctgagtgccgccgcctccgagtgcatcgacccttctgtagtattcccctacccactgaatgattctagtagccctaagtcttgtgctagtcaagatagttccgccttctctcctagcagcgactccttactcagtagtacggaaagctcaccacagggctccccagaaccgctcgtcctgcatgaagagacccctccgacaacaagctcagacagtgaggaggagcaggaggatgaggaagaaatcgacgtcgtctctgtcgagaagcgccaggcgcccgggaaacgaagcgaatctggatctccatccgccggtgggcacagcaagcctccccactcacctttggtcctgaagaggtgtcatgtctccactcaccagcacaactatgccgcgcctccatctaccagaaaagattacccagcagccaagcgagtcaagctggactccgtcagagtgctgcgacaaatttccaataaccgaaagtgtactagcccccgctccagcgacacagaggagaatgtaaaaaggagaacgcacaacgtgttggaaagacaaagacgaaatgagttgaagcgatctttcttcgcacttagagatcagattccggagttggaaaataacgaaaaagctcccaaagtggtaatcttaaaaaaggcaaccgcatacattctaagtgtgcaggccgaagagcagaagcttattagcgaggaagacttgcttaggaaacgacgagagcagctgaagcacaaacttgaacaactcaggaactcgtgtgca

SEQ ID NO: 21144 - DNA, 1317 bp, Artificial Sequence; identical to SEQ ID NO: 21143
  Description of Artificial Sequence: Synthetic coding sequence

SEQ ID NO: 21145 - DNA, 1317 bp, Artificial Sequence
  Description of Artificial Sequence: Synthetic coding sequence
atgccactgaacgtgtcattcactaaccgcaactacgacttggattacgattccgtgcagccgtacttctactgtgacgaggaggaaaacttttaccaacagcaacagcaatcagagttgcagcctccggccccatcggaggatatctggaaaaagtttgagctgctgccgactccgccccttagcccttcacgccgctcagggctctgctccccgtcatacgtggcggtgaccccgttcagcctccgcggggacaacgacgggggtggaggctcgttcagcactgctgaccaacttgaaatggtcaccgaactgctcggaggagatatggtgaatcagtcgtttatctgtgatccggacgatgaaaccttcatcaagaacatcatcatccaagattgcatgtggagcggcttctcggccgcagcaaaacttgtgtcggaaaagctggctagctaccaggcggcacggaaagactctggaagcccaaacccagctcggggacactcagtgtgttccactagtagcctgtacttgcaggacctctcggccgccgccagcgaatgtatagatcctagcgtggtctttccgtaccccctgaacgactcttcgagtcctaagagctgcgccagccaagactcgtccgcgttttcgccgtcgtccgacagcctgctctcttcgaccgaaagcagcccacaggggtcccctgagccactcgtcctccacgaagaaaccccgcccactacttcctccgattcggaagaggagcaggaggacgaagaggagatcgatgttgtctcggtggaaaagaggcaggcccctggcaagcggtcggagtccggatcgcctagcgcgggcggacacagcaagcccccacatagcccactggtcctcaaaagatgccatgtgtccacccaccaacacaattacgctgcacctccgtcgacccgcaaagactaccctgccgcaaagcgcgtcaagctcgattcggtgcgcgtccttcgccagatctcaaataaccggaaatgtacttcacctagaagctcggacactgaagaaaacgtcaagcgtagaactcataacgttctggagagacagcgccgcaacgaactgaagcggtcattctttgccctgcgtgaccaaatcccggaactggagaataatgagaaggctcctaaagtggtgattctcaaaaaggcgactgcatatatcctgtcagtgcaagcggaagaacagaaacttattagcgaagaggacttgctgcggaaacgcagagagcagctcaagcacaaactcgagcagctccggaacagctgtgcg

SEQ ID NO: 21146 - DNA, 1317 bp, Artificial Sequence; identical to SEQ ID NO: 21145
  Description of Artificial Sequence: Synthetic coding sequence

SEQ ID NO: 21147 - DNA, 1317 bp, Artificial Sequence
  Description of Artificial Sequence: Synthetic coding sequence
atgccactcaacgtgtccttcaccaaccggaactacgacctggactacgactcggttcagccctatttctattgcgatgaggaagagaacttttaccagcaacagcagcagtcggagctccaacctccagccccttcagaggacatctggaagaagtttgagttgctcccgactccgccgttgtcgccctcgcgcaggagcggactgtgttcgccatcatacgtcgcggtcaccccgttttccctccgcggagataacgatggaggcgggggatccttctccaccgccgaccagctggagatggtgaccgagctcttgggcggagacatggtgaatcaatcgttcatctgcgacccggacgacgaaaccttcatcaagaatatcatcatccaggactgcatgtggtccggattctccgccgcagccaaactcgtctccgaaaaactggcgtcgtaccaggccgcgcggaaagatagcggttccccgaaccccgcgcgaggccactccgtgtgctcgacctcgtcactgtacctccaagacttgagcgcggccgccagcgagtgtatcgacccctcggtcgtctttccatacccactgaatgactcgtcatccccgaagtcatgcgcttcacaagattcaagcgcattctcaccctcgtcagactccttgctcagcagcactgaatcatcgccacaaggatcgccggaaccgctggtgctgcatgaagaaactcctccgacgacttccagcgatagcgaagaggaacaagaagatgaagaggaaatcgacgtggtgtcagtcgagaaacgccaggcaccgggcaagaggagcgagtcaggatcgccctccgctggagggcattcgaagcctccgcactccccgctggtcctgaaacgctgccacgtgtcgactcatcagcacaactacgccgcaccccctagcaccagaaaggactaccctgccgccaagcgggtgaagctggatagcgttagagtgctgcgccagatctcgaataaccgcaagtgcacctccccgcgctctagcgatactgaagaaaatgtgaagcgaagaacgcataacgtgctggaacgccagcgcagaaacgaactgaagcgttcctttttcgccctgcgtgaccagattcccgagctggagaataatgagaaagctcccaaggttgtcatcttgaagaaggcgaccgcctacatcctgtcggtgcaagccgaggaacaaaaacttataagcgaggaagatcttctgagaaagagacgcgaacaactgaagcacaagctggaacaactgcggaactcctgtgcc

SEQ ID NO: 21148 - DNA, 1317 bp, Artificial Sequence; identical to SEQ ID NO: 21147
  Description of Artificial Sequence: Synthetic coding sequence

SEQ ID NO: 21149 - DNA, 1317 bp, Artificial Sequence
  Description of Artificial Sequence: Synthetic coding sequence
atgcctctcaacgtgagtttcacgaaccgcaactacgacctggactatgactccgtccaaccgtacttttattgcgacgaggaggaaaacttttaccaacagcagcagcagtcggagctgcaacccccggcaccatcggaggacatatggaagaagttcgaacttctgcccacgccgcctctctcgcccagcaggcgtagtggactgtgctccccatcctacgttgccgtgacccccttctccctgcgtggagacaatgatggaggtggtggatccttcagcacggctgatcaattggagatggtcactgagctcctgggcggagacatggtgaatcagagctttatctgcgatccagatgatgagaccttcattaagaatatcatcatccaggattgcatgtggagcggatttagcgctgcggctaaactggtgtcggaaaagttggcgtcctatcaagctgctcggaaagattcaggaagtccgaaccccgcccgtggacactccgtttgcagcacatcctccttgtacctgcaagacttgtctgcagcagcatccgagtgcatcgaccccagcgtcgtgtttccgtatcccctgaacgactccagtagtcccaagagctgcgcgagtcaggattcctccgcattttcgccgtcatcggattcactcttgagcagtaccgagtccagcccacagggcagccccgagccgctggtgctgcatgaggagacgccacctaccacctcctcagattctgaggaggaacaggaggatgaagaggagatagacgtggtgtctgtggagaaacgccaagcccccggaaagcggagtgaatccggaagtccgtccgctggaggacactcgaagcccccccacagccccttggtgctcaagcgctgccacgtttccacccaccagcataactatgccgcccccccttcaacgaggaaagattacccagccgccaaacgcgtgaagcttgacagcgtgcgcgtgctgcggcagatctcgaacaaccgtaagtgcacgtcaccccgctcatctgataccgaagagaacgtaaagagacggacacacaacgtgttggagcgacaacggcgtaacgagctgaagaggagtttcttcgctctgcgggatcagatcccggagctggagaataatgaaaaagcgccgaaagtggtgatcctgaagaaagccacggcttacattctgtcggtgcaggcggaggagcagaagttgatttccgaagaggatctactacgtaagcgtcgagaacagctaaagcacaaactggagcagctgcggaactcttgcgcg

SEQ ID NO: 21150 - DNA, 1317 bp, Artificial Sequence; identical to SEQ ID NO: 21149
  Description of Artificial Sequence: Synthetic coding sequence

SEQ ID NO: 21151 - DNA, 1317 bp, Artificial Sequence
  Description of Artificial Sequence: Synthetic coding sequence
atgccattgaatgtgtcctttaccaaccgcaattacgatttggactacgatagcgttcaaccttatttttactgcgacgaggaagagaatttctaccagcaacaacagcagtccgagctgcagcctccagcaccgtccgaggatatatggaagaagtttgaactgcttccgacaccgccattgagtccgagtcgcaggtcaggactgtgctctccatcttatgtggcagtgaccccgttctctttgaggggtgacaatgacggaggaggtggttctttcagcaccgcagatcaactggagatggtgactgaacttctgggcggtgacatggtcaaccagtccttcatctgcgatcctgacgatgaaacctttattaagaacattatcattcaggactgcatgtggtccggcttttccgcagcggctaaactggtctctgagaagctggcctcctaccaagcagcaagaaaggatagtggctctccaaaccccgcgcgcggacattctgtctgtagcacctctagcctctatctgcaagacctgagcgccgcagcgtcagagtgtatcgacccttctgttgtattcccttatcccctgaatgactcatcatcccccaagagctgcgcaagccaagactccagcgcattcagcccaagttcagatagtcttctgagcagcacagagtcttcaccgcaaggctcccccgagcctttggtgctccatgaggagacccctccaacgacgtcttcagactccgaagaagagcaggaggatgaggaggagattgacgtggttagtgtagagaaaaggcaggccccgggcaagaggagtgagtctggtagcccgtccgccggcggacacagcaaacctccccactccccactcgtgctgaagaggtgccacgtcagcactcaccagcataactacgcggccccaccctctacaaggaaagactatccggcagctaagcgcgtcaagctcgactccgttagggtgctgagacagattagtaacaatcgcaagtgtacctcaccaagaagttccgatactgaagagaatgtgaagcgcagaacccacaacgtgctcgaaagacaacgcaggaacgaattgaagcgctctttctttgccctcagggatcaaatcccagaacttgaaaacaacgagaaggcaccaaaggtggttatactcaagaaggccaccgcatacatactcagcgtgcaggcagaggagcagaagttgatcagcgaggaggatctgctcagaaaaaggagggagcagctgaaacacaagctcgaacagctgaggaattcctgcgct

SEQ ID NO: 21152 - DNA, 1317 bp, Artificial Sequence; identical to SEQ ID NO: 21151
  Description of Artificial Sequence: Synthetic coding sequence

SEQ ID NO: 21153 - DNA, 1317 bp, Artificial Sequence
  Description of Artificial Sequence: Synthetic coding sequence
atgccacttaacgtctccttcaccaatagaaattacgaccttgattatgattccgtgcaaccgtacttttactgtgatgaggaggaaaacttttaccagcagcaacagcaatctgagctgcaacctccagcaccttccgaagatatttggaaaaagtttgaactgctcccaactcctccgcttagccctagccggaggagcggactgtgctccccctcgtacgtggcggtgacgccattctcgcttagaggagataacgacggtgggggtggatcgttttcgaccgccgatcaattggaaatggtcacggaactccttggcggagatatggtaaaccaatccttcatttgtgatcctgatgatgagactttcataaagaatatcattatacaagattgtatgtggtccggcttttccgcagcggcaaagctggtgagcgagaagttggcatcgtaccaggccgcaaggaaggatagcggtagcccgaatcccgcacgcggccattcagtgtgctcaacctcatcactgtacttgcaggatctttctgcagcagcttcggaatgtatcgacccctctgtcgtatttccatacccattgaacgattcgtcgagccccaaatcgtgtgcatcgcaggacagcagcgcattttcaccttcatcggattcgctcctttcgtcaaccgaatcatccccacaaggatcgcctgagccgcttgtccttcatgaagagactccacctaccacttcgtctgactctgaggaagaacaagaagatgaagaagaaattgacgtggtgtccgtggaaaagcgccaagctccaggaaagaggtctgaatccggatcacctagcgccgggggccatagcaagcctccgcattcccctctggtcttgaaacggtgccacgtttccacccaccagcacaattacgcggcaccaccaagcacgcgcaaagattacccagcagccaagcgggtgaagctggactcggtgagagtgctcaggcaaatcagcaacaatcgaaaatgcacgtcgcctcggtcaagtgacaccgaggagaacgtcaagaggcggacccataacgtcctggagaggcagcgacgtaatgagcttaagagatcgttctttgcacttagagatcagattcccgaactggaaaacaacgaaaaggcacctaaagtcgtcattcttaagaaggcaactgcatacatcctctccgtccaagctgaagaacaaaagctcatatcggaggaagatctccttcgcaaaaggagagaacagctgaaacacaaactggaacaacttcgtaactcctgtgca

SEQ ID NO: 21154 - DNA, 1317 bp, Artificial Sequence; identical to SEQ ID NO: 21153
  Description of Artificial Sequence: Synthetic coding sequence

SEQ ID NO: 21155 - DNA, 1317 bp, Artificial Sequence
  Description of Artificial Sequence: Synthetic coding sequence
atgcccctcaatgtgagcttcaccaatagaaattacgatctagactacgattccgtccagccctacttctattgtgacgaagaagagaacttctatcagcagcagcaacagtccgagctccagcctcccgcaccatcagaggatatatggaagaagttcgaactgctcccaaccccccctctgagccccagtcgacgcagcggtctatgctcgccttcatatgtggcggtgaccccgttcagtctgcgaggcgacaatgacgggggaggtggttcattttctaccgcagatcagctggagatggtgactgagcttttagggggtgacatggttaaccagtctttcatttgtgaccccgatgatgaaacctttattaaaaatatcataatccaagattgcatgtggagcgggtttagcgcagctgcgaaactcgtgagcgagaagctagcatcgtatcaggctgcacggaaggatagtggctctcccaacccggctcgagggcacagcgtgtgcagtaccagttccctttacttgcaagacctgtcagccgcggctagcgagtgtatcgaccccagcgttgtcttcccttatccactcaatgacagttcatctcccaagtcgtgcgcttcacaggattccagcgcgttctctccaagcagcgattctcttctttccagtacagaatcttcacctcagggcagcccagagccccttgtcctgcatgaggagacgcctcccaccacctccagcgactcagaggaagagcaggaggacgaagaagagatcgacgtagtcagcgtagaaaaacgccaggcgccgggcaaaaggagtgagtcaggtagtccgtctgccggcggccatagtaaacccccacatagccccctggtcctgaagagatgccatgtaagtacccaccaacataattacgcggcccccccgagcactcggaaagactacccggctgcaaagcgtgtgaaactagattcagtacgtgttcttcgacaaatctccaacaacagaaagtgcacaagccctcgatcgtctgataccgaggaaaacgtcaagcgcaggacgcacaacgttttggaacgccagcgcaggaatgagcttaaaaggtccttctttgcgctacgagaccagattccagaactcgaaaataatgaaaaggcccctaaagtcgttatactgaaaaaggccaccgcttatattctgtccgtgcaggcggaagagcaaaagcttatcagcgaggaagacttgctgcgcaagaggcgggaacagcttaaacataagctcgagcagttgaggaatagctgcgcg

SEQ ID NO: 21156 - DNA, 1317 bp, Artificial Sequence; identical to SEQ ID NO: 21155
  Description of Artificial Sequence: Synthetic coding sequence

SEQ ID NO: 21157 - DNA, 1317 bp, Artificial Sequence
  Description of Artificial Sequence: Synthetic coding sequence
atgcctctgaacgtatcattcacaaatagaaactacgatctcgattacgacagcgtccagccgtacttttattgcgatgaagaagagaatttttatcagcagcaacagcaatcagagttgcagccgccggccccctcggaagatatatggaagaagtttgagctattgccaacaccccctctgtctccgtctcggcgatcaggtctctgttcaccatcttacgttgccgtcacgccttttagcctgcgcggcgataatgacgggggcggaggctcattcagcactgcagatcagcttgaaatggtcaccgaactcctcggaggcgacatggtcaatcagagctttatttgcgatcctgatgatgagacatttattaaaaacattatcattcaggactgcatgtggtcgggttttagcgcggcggcaaaactggttagcgaaaaattagcgtcttaccaagctgcccgaaaagattcgggctcacctaatcctgcgcggggtcacagcgtgtgttcgacttctagcctctatcttcaagacctgtcggccgccgcttccgagtgtatcgaccctagcgtggtttttccgtaccccttaaacgactcaagctcaccgaaatcatgcgcgtctcaggactctagcgccttttcaccttctagcgattcccttctttcctcaaccgagtcgtcaccgcaaggatctcctgaaccgctagtattgcacgaggaaacgccaccgacaacgagctcggactccgaggaagagcaggaagatgaggaagaaatagatgtcgtgagcgtcgagaagagacaagcgccgggtaaacgctcagagagtgggtccccctctgccggaggccattcaaagccgccgcatagtccgcttgtattaaagcgttgtcatgtgagcacgcatcaacacaattacgctgcccctccgtcaactcgtaaagactacccagctgccaaacgcgtgaaacttgattcagtacgcgtcctgagacagatcagtaacaatcggaagtgcacatctccgcgctctagtgatacggaggaaaatgtgaagcgccggacgcataatgttttagagcgtcaaagacgaaacgaacttaagcgttcgtttttcgctcttcgagatcagatcccggaactggagaacaacgagaaagcgccgaaagtcgtaatcctgaagaaagcaacagcgtacatcctctccgtccaagcagaggaacaaaaacttatatctgaagaggatttattacgcaaacgaagagaacagcttaagcataaacttgaacagttaagaaattcttgtgcg

SEQ ID NO: 21158 - DNA, 1317 bp, Artificial Sequence; identical to SEQ ID NO: 21157
  Description of Artificial Sequence: Synthetic coding sequence

SEQ ID NO: 21159 - DNA, 1317 bp, Artificial Sequence
  Description of Artificial Sequence: Synthetic coding sequence
atgcccctgaatgtgtcatttactaaccggaattacgatctggactacgactccgtgcagccatatttctattgtgatgaagaagagaacttttaccagcagcagcagcaaagtgagttacaaccacctgccccaagtgaggacatctggaaaaagttcgaactcctgccaacaccacctctttcacccagccggcgttctggactttgttcaccctcctacgtggccgtgactcccttttcactcagaggcgataacgatggcgggggaggctcattctctactgcagaccagcttgaaatggtgaccgagttactaggcggggacatggtgaaccagtcattcatctgcgacccggatgacgaaacctttatcaagaacatcatcattcaagattgcatgtggagcggtttctccgctgccgcgaagttagtgtcagagaagctggcaagctatcaggcagcccgcaaggattctggcagtccaaatcctgcccgtgggcactcggtttgctctaccagttcgctctaccttcaggatttgtccgccgccgcctcggaatgcattgaccctagcgtagtcttcccctacccactgaacgatagcagcagcccgaagtcatgtgccagccaggattcatccgcattctctccatccagcgatagcctcctatccagcacagagtcatctccccagggctcccctgagcctctagtgctgcatgaggaaacccctcctaccaccagctcggattccgaagaagagcaagaggacgaagaagaaatagatgtggtctctgtcgaaaagcggcaagcccccggcaaacgaagcgaaagcggatcaccatcagcgggcggtcactccaagccaccgcactcacccttggtgctgaaaaggtgtcatgtctctacccatcagcacaactacgctgcgcccccctctacaagaaaagattaccctgccgcaaagcgggtaaaactagatagtgtgagggttttacgccagatctccaataataggaagtgcacttccccacgcagcagtgacacagaggaaaatgtgaagcgacggacacataacgtgctggaacgtcagcgtcgcaacgagctcaaacgctcattctttgcgctgagggaccagattccagagctcgagaacaacgagaaagcccctaaggtggtcattttgaaaaaggccacagcatacatcctgagtgtccaggccgaagagcaaaaattgatctccgaagaagatctgctgagaaagcgtagagaacagcttaaacataagctcgagcagttgaggaattcctgtgca

SEQ ID NO: 21160 - DNA, 1317 bp, Artificial Sequence; identical to SEQ ID NO: 21159
  Description of Artificial Sequence: Synthetic coding sequence

SEQ ID NO: 21161 - DNA, 1317 bp, Artificial Sequence
  Description of Artificial Sequence: Synthetic coding sequence
atgccattgaacgtctcttttaccaatcgaaactacgatctcgattatgattcggtccagccttacttctattgcgatgaggaggagaacttctatcagcagcagcagcagtccgagctgcagccgcccgccccatctgaggatatttggaagaaatttgagcttctcccaactcccccactgagcccctctcggcgctccggactgtgcagccccagttatgtggccgtaacacccttttctttgcggggagacaacgacggcggcggcggcagtttttcaaccgccgaccagctagaaatggttaccgagctcctcgggggggacatggtcaaccagagcttcatttgtgacccagacgacgaaacctttatcaagaacatcatcatacaggattgtatgtggtctggcttcagtgctgcggccaagctagtgagcgagaaactcgcttcctatcaggcggcaaggaaagactccggctccccgaatcctgcgcgcgggcacagcgtgtgctccacaagctctctgtacttgcaggatctgtcggccgcagcttccgaatgtatagaccccagcgtggttttcccctaccctctgaacgacagtagctccccaaaaagttgtgccagccaggactccagtgcattctccccttccagcgactcactcttatcatccaccgagagctctccgcaggggtctcctgagcccctagtgttgcatgaagaaaccccgcccacaacttcttctgactcagaagaggagcaggaggatgaggaagagatcgacgtggtgagtgtcgaaaaacggcaggctcctggaaagcgtagtgaatcaggatccccgagcgccggaggccactcaaagccgccacactctcctttggtgttaaaacgctgtcacgtctccacccaccagcacaactacgccgcgccccccagcacccggaaagattatcccgcggcaaagcgagtgaaactggacagcgtccgtgtgctgaggcagatcagcaataacaggaaatgcacaagcccgcgctcaagtgacacagaggagaacgtaaagcgacgcacccacaacgtgttggagaggcagcgcagaaatgaactgaagcgtagcttcttcgcactgagggatcagatccccgaactcgaaaataacgagaaggcaccaaaagtcgtcatcctgaaaaaagccactgcctatattttgagcgtccaagcggaagagcagaagctaatttcagaggaagacttacttagaaagcgccgcgaacagctcaaacataaactggagcaacttaggaattcgtgcgcc

SEQ ID NO: 21162 - DNA, 1317 bp, Artificial Sequence; identical to SEQ ID NO: 21161
  Description of Artificial Sequence: Synthetic coding sequence

SEQ ID NO: 21163 - DNA, 1317 bp, Artificial Sequence
  Description of Artificial Sequence: Synthetic coding sequence
atgcccttgaatgtgtcctttacgaatagaaattacgatctggattacgactcggtgcagccttacttctactgcgatgaggaagagaatttctatcagcaacagcaacagtccgagttgcagccgcccgcgccctctgaggacatttggaaaaagtttgagctattgcccaccccaccattgagtccttctcgacggtccggactgtgcagtccctcatatgttgcggtgactcctttttcactccggggagataacgatggcgggggggggagcttttcaacagctgatcagttggaaatggtgactgaactgctgggtggcgacatggtgaatcagtccttcatctgtgatcctgatgacgagacctttattaaaaacatcatcatccaggactgcatgtggtcagggttcagtgctgcagccaagctggtctctgagaagttagcaagctatcaggcagctaggaaggactccgggtccccgaatcccgctagaggacactctgtctgctctacgtcttcactgtatttgcaggacctctctgccgccgcttcagaatgcatagaccccagcgtggtcttcccctatccactgaacgactcttcatcacccaagtcctgcgccagccaggattcatctgctttctccccctcctctgattccttgctctccagcactgagtctagtccccagggctcacctgaacccctggtgctccacgaggaaacaccacctactacctcatccgatagtgaggaggaacaggaagatgaggaggagattgacgtggtaagcgtcgaaaaacgacaggctcccgggaagcgttctgaatcaggcagcccctcagcaggtggccactcaaaacccccacatagtccacttgtgctcaaacggtgtcacgtgtctacacaccagcacaactacgcagcccccccttctactaggaaggattaccccgctgcgaaacgggtgaaactcgactctgtcagggttcttaggcagataagcaataatcgtaagtgtacatcccctaggagcagtgacaccgaagagaatgtaaagaggcggactcacaatgtgctggagagacaacgccgcaatgagctgaagcgtagcttttttgcattgagagaccagatccctgaactggaaaacaatgagaaagcccccaaggttgtcatcctcaagaaagcaaccgcctatatcttgtctgtgcaagctgaggagcagaagctaatctccgaagaagatctgctcaggaagcgcagagagcagctgaaacataagctggaacagcttaggaactcatgcgcc

SEQ ID NO: 21164 - DNA, 1317 bp, Artificial Sequence; identical to SEQ ID NO: 21163
  Description of Artificial Sequence: Synthetic coding sequence

SEQ ID NO: 21165 - DNA, 1317 bp, Artificial Sequence
  Description of Artificial Sequence: Synthetic coding sequence
atgccacttaatgttagcttcacgaaccggaactatgacctcgattatgactcagtgcagccgtatttttactgtgatgaggaggagaacttttaccagcagcaacagcagtctgaactgcaacccccagctcctagtgaggatatctggaagaagttcgagctcttgcccacaccaccgctctctccttcacgcagatcagggctttgtagccccagctatgtggcagttactcctttctctctgcggggggataatgacggcgggggaggaagcttttctacggctgaccaactcgagatggtcaccgagctcctggggggagatatggtgaaccagagcttcatttgtgacccagacgacgagacctttatcaaaaacatcataattcaggactgtatgtggtctggattttctgccgcagccaaattggtttctgagaagctagcctcctatcaggccgcgaggaaggattctggatctcctaatcctgccagagggcactccgtgtgttccacttcaagtctctatcttcaggacctgagtgccgccgcctcagaatgtatcgatccaagcgtggtatttccataccccctgaacgactccagctcacccaaatcatgcgcctcccaagactcctcagccttctccccctcaagcgacagtttactgtcttctaccgaatccagtccacaaggttctcccgaacccttagtccttcacgaagagacacccccaaccactagtagcgattcagaggaagagcaggaagacgaggaagagatcgacgtggtaagtgtggagaaaaggcaggcccctgggaagagatccgagagcggctctccatcagctgggggccattccaagcccccccacagccccctcgtgctgaagaggtgccatgtctccacccatcagcacaactatgctgccccaccttcaacacggaaggactaccccgccgccaagagggttaagctagattcggttcgcgttcttaggcagattagcaataatcggaagtgtaccagtcctcgatcaagcgatacagaggaaaatgtcaagcgcagaactcacaacgtccttgaaaggcagcggagaaatgaattgaagagaagcttcttcgccttgcgagatcaaatacctgagttagagaataacgagaaggcacctaaggtggtgattctcaagaaagctaccgcatacatcctaagtgtgcaggctgaggaacagaaacttatctcagaagaggacctactcaggaaacggcgggagcagctgaaacataaactggagcaacttcgcaactcgtgcgcc

SEQ ID NO: 21166 - DNA, 1317 bp, Artificial Sequence; identical to SEQ ID NO: 21165
  Description of Artificial Sequence: Synthetic coding sequence

SEQ ID NO: 21167 - DNA, 1317 bp, Artificial Sequence
  Description of Artificial Sequence: Synthetic coding sequence
atgccgcttaacgtctcattcaccaaccgcaactacgacctggattacgattctgtgcaaccatacttctactgcgacgaggaagaaaacttttaccagcagcagcaacagtcggaactccagccacctgcaccgagcgaagatatctggaagaagttcgagttgctcccgaccccgccgctgagcccatcacgcagaagtggactctgctcaccgtcatacgtggcagtgactcccttttcgctgcgcggagacaatgacgggggcggtggatccttctccactgcggaccagctggaaatggtcacggagttgctgggaggagacatggtgaaccaatcctttatctgcgatccggacgacgagacgttcataaagaacataatcatccaagactgcatgtggagcgggttctcggccgcggctaaattggtgtccgaaaagctcgcctcctaccaagctgccaggaaagactcgggatccccaaatcctgctcggggtcatagtgtgtgctcgacttcatcactgtatctgcaagacctctcagcggccgccagcgaatgtattgacccctcggtggtatttccttacccgctgaacgattcatccagtccgaaatcgtgtgcgtcacaagactcatctgccttctccccatcctccgactcactgctcagcagcactgaatcctcgccgcaggggagcccagaacccctcgtgctgcacgaagaaaccccacctacgacctcctccgattcggaagaggagcaggaggatgaggaggaaattgatgtggtgagcgttgaaaagcgccaggctccgggcaagcggtcagagtccggctctccgtccgcaggaggacactccaagcccccgcactccccgctcgtgctcaagcggtgtcatgtctctacccatcaacacaattatgcggcgccaccgtccacccgcaaagattaccctgctgcaaaacgagtgaaacttgactctgtgcgggtcctcaggcaaatctctaacaaccgcaagtgcacctcgcctagaagctcggacactgaggaaaatgttaagcgcaggactcataatgtgctggagcggcagcgtaggaacgagttgaagcggtctttcttcgcactgcgggatcagatcccagaactggaaaacaacgaaaaggcccccaaggtcgtgatcctgaaaaaggctaccgcttacatcctctcggtccaagccgaggagcagaagctgatctcggaggaggatctgctgaggaaaagacgcgaacagcttaagcacaagctggagcagctccgcaattcctgcgcg

SEQ ID NO: 21168 - DNA, 1317 bp, Artificial Sequence; identical to SEQ ID NO: 21167
  Description of Artificial Sequence: Synthetic coding sequence

SEQ ID NO: 21169 - DNA, 1317 bp, Artificial Sequence
  Description of Artificial Sequence: Synthetic coding sequence
atgccactaaatgtgtcctttacgaatagaaactatgatctggattacgattccgttcagccctacttctactgtgacgaagaagaaaacttttaccagcagcagcaacagtctgaactacagccacccgctccaagcgaggacatctggaagaagtttgagctgctgcccacacctcccctctccccaagccggaggagcgggctttgcagcccatcatacgtagctgtcactccgtttagcctgaggggcgacaacgacggaggagggggatcatttagtaccgccgatcagctcgaaatggtaacggagctgttaggtggggacatggttaatcagagctttatctgcgatcccgatgacgagacctttatcaaaaacataataattcaggactgcatgtggtctggcttcagcgctgccgcaaaactggtgagcgagaagctcgcctcgtatcaggccgcccgcaaagacagtgggtccccaaaccctgctcgtgggcactcagtgtgctcaacgagttccttatatctgcaggacctgagcgccgctgccagcgaatgcattgacccttccgttgtgttcccataccccctgaacgacagttccagtcccaagtcatgcgcctcccaggactcctccgcctttagcccgagcagtgacagcctgttgagcagtaccgagtcaagcccccagggaagtccagaacccctcgtacttcatgaggagacccctcctactacaagtagtgacagcgaggaagagcaggaagacgaggaagaaattgatgtagtgagtgttgaaaaaaggcaggctcccggtaaacggtccgaaagtgggtctccttctgctggcggacatagcaaacctcctcactctcccctggtccttaagcgctgtcacgtttccacacatcaacataattacgccgcgccccccagtaccaggaaagactacccggccgctaaacgggtgaagctggattccgtgcgcgtgctgcggcagatctccaacaataggaagtgtacatctcctcgatcttccgacactgaagagaacgttaaaaggcggacacataatgttttggaaagacagagaagaaatgagctgaagcgatctttcttcgccctccgggaccagatccctgagctagaaaataacgagaaggctccaaaagtggtcatcctgaaaaaagctaccgcctatatcttaagcgtgcaggccgaggaacagaagcttataagcgaggaagacttgctgaggaagcggcgtgaacagctgaagcacaagttggagcagctgcgcaactcatgtgcc

SEQ ID NO: 21170 - DNA, 1317 bp, Artificial Sequence; identical to SEQ ID NO: 21169
  Description of Artificial Sequence: Synthetic coding sequence

SEQ ID NO: 21171 - DNA, 1317 bp, Artificial Sequence
  Description of Artificial Sequence: Synthetic coding sequence
atgcctctgaacgtgtccttcaccaaccgcaattatgacctggattatgatagcgtacagccttacttttactgtgacgaggaagagaacttctaccagcagcagcaacagtccgagttacagccaccggcaccaagtgaggacatatggaaaaagtttgagctactgcccaccccacccttgagccctagtaggaggtccggcctgtgcagtccgtcctatgttgccgtcaccccatttagtctccgcggagataacgatggcggtgggggtagcttctcaacagctgatcagctagaaatggtcaccgagctgttggggggtgatatggtgaaccagtcattcatttgtgatcctgatgacgagacctttatcaaaaacatcatcattcaggactgtatgtggtctggcttctctgctgccgctaagctcgtatccgagaagcttgcctcttatcaggctgcaagaaaagattctggctcccccaacccagcacggggacactcagtgtgctcaacctccagcctataccttcaggatctctccgccgccgcctccgagtgcatcgatcccagcgtggttttcccttatccgttaaacgattctagttcccccaaaagctgcgcaagtcaggatagctctgccttttcgccaagttccgattcactgctgagcagtacagagtcttctccgcagggctctcccgaacctcttgtactgcacgaggagaccccacccaccaccagcagtgactctgaggaggagcaggaggacgaagaagaaatagacgtggtctccgtggagaaacggcaggcaccaggaaagagaagcgaatctggttcaccttctgccggtggtcattcaaagccacctcattccccactggtcctgaaaagatgtcacgtttccactcaccagcataactacgccgctccgcctagcactagaaaggactaccccgccgctaaaagggtcaagctcgacagcgtccgggttctgcgacaaatctctaacaacaggaagtgtacaagcccacgctcatctgacacagaagaaaacgtgaagaggcgcacacataacgtcttggagcgccagcggcgtaacgaacttaagcgtagctttttcgcactgcgcgatcaaatccctgagctcgaaaacaatgagaaggcccctaaagttgtcattctcaagaaagccacagcttatatattgagcgtccaggcagaggagcagaagctgatatctgaagaagacctgctgcgtaaacgacgcgagcagctcaagcacaagctggagcaactaagaaattcctgcgcc

SEQ ID NO: 21172 - DNA, 1317 bp, Artificial Sequence; identical to SEQ ID NO: 21171
  Description of Artificial Sequence: Synthetic coding sequence

SEQ ID NO: 21173 - DNA, 1317 bp, Artificial Sequence
  Description of Artificial Sequence: Synthetic coding sequence
atgcctttgaatgtttcatttaccaaccgcaattatgatctcgattacgacagcgtgcagccttacttttattgtgacgaggaggaaaatttttatcagcaacagcagcagtccgagctgcagcctccagcaccctccgaggatatatggaagaagttcgagctgttgcctacccctcctttatccccgtcacggagatccggtctatgctcccccagctacgtggcagtcaccccattctctcttaggggggacaatgacggagggggcggcagcttctcaactgcagatcagctcgagatggtgacggaactgctaggtggggatatggtgaaccagtccttcatttgtgatccggacgatgaaaccttcataaagaacatcatcatccaggattgcatgtggagtggtttttctgccgctgccaagctggtgtctgaaaaactcgcgagctaccaggccgcccggaaggactctggctcccccaatcccgctcgaggacattccgtctgtagcacctcttccctttatctacaagacctcagtgcagccgcctcagagtgtatcgacccctccgtcgtgttcccttaccctttgaacgactcctcaagtccgaaatcctgcgctagccaggactcctccgccttcagccccagctcggacagcttgctcagttccacagaaagctcaccccagggaagcccggagccactggtgctccacgaggaaacaccacccacaacctcttctgactcggaggaggagcaggaggatgaggaagagatcgatgtcgtctccgtcgagaaacgacaagcaccaggcaagcgatccgaatccggctctccttctgcaggggggcattcgaagcccccccactcccctttagtgctgaagaggtgccatgtttcaacacaccagcacaattatgctgccccaccaagcactcgaaaggactatccagctgcaaagcgggtaaagctggacagtgtaagggtcctcaggcagatctcgaataaccgcaagtgtacctcccccaggtcctccgacactgaagaaaacgtgaagcggcgaactcacaacgtcctcgagagacagcggaggaatgaactgaaaagaagtttttttgcactgagagaccagataccggaattagaaaataacgaaaaggcccccaaagtggtaatcctaaaaaaggccaccgcgtacattctaagtgtccaggctgaagagcagaagctgattagcgaagaggacctgcttcgtaaacgcagagaacagttgaaacacaagctggaacagctgagaaactcttgcgca

SEQ ID NO: 21174 - DNA, 1317 bp, Artificial Sequence; identical to SEQ ID NO: 21173
  Description of Artificial Sequence: Synthetic coding sequence

SEQ ID NO: 21175 - DNA, 1317 bp, Artificial Sequence
  Description of Artificial Sequence: Synthetic coding sequence
atgcctctgaatgtgtcctttactaataggaattatgatctggactacgactcggtacagccgtacttttattgtgacgaagaagaaaacttttaccagcagcagcagcagagtgagcttcagccgccagctcctagtgaggacatatggaaaaagttcgagctgcttcctacgcccccactaagcccttctcgacgaagcggtctgtgctctcctagctatgtggcggtcactcccttctcactccgtggagacaacgatgggggaggcggatccttctctacagccgaccagttggagatggttactgagctattgggcggggatatggtgaatcagtcttttatttgcgatcctgacgatgagactttcatcaagaacataataattcaggactgtatgtggagcggattttctgccgccgccaaactggtgtctgaaaagctcgcatcctaccaggctgcgcgcaaggattctggttctcccaatcctgcgagagggcatagcgtgtgcagcacaagctctctttatctgcaagacttaagcgccgccgcttcagaatgtattgatcccagtgtagtgttcccgtatcctctgaatgattcctcctcacctaaatcatgcgctagtcaagactcttctgcattttctccctcctctgactccttactgtcttctaccgagagcagtccacaggggtcccctgagccacttgtgttacatgaggaaacacccccaaccaccagctctgatagcgaggaggaacaagaagatgaggaggagatagatgtggtgtctgtcgagaaaagacaagcgcctggcaagcgttctgagtccggctcccctagtgccgggggccacagtaagcccccccactcaccattggtgctaaaacgatgccacgtctccacccaccaacataattacgcagcccctcctagtacacggaaagattatcccgcagccaagcgagttaagctggactcagtgcgggtgctgcgtcagatctccaacaacagaaaatgcacctcaccgagatcctcagacacagaggagaatgtaaagcgccgtacacacaacgtgctggaaagacagcgcagaaacgagctgaagcgatcattcttcgcattacgcgaccagataccggaacttgaaaataatgaaaaggctcctaaggtcgtcatcctaaaaaaggctaccgcctatattctgtccgtgcaagccgaggagcagaagctcatatccgaggaggacctgttacggaagcggcgggagcagctgaaacacaaactggagcagctgagaaatagttgtgca

SEQ ID NO: 21176 - DNA, 1317 bp, Artificial Sequence; identical to SEQ ID NO: 21175
  Description of Artificial Sequence: Synthetic coding sequence

SEQ ID NO: 21177 - DNA, 1317 bp, Artificial Sequence
  Description of Artificial Sequence: Synthetic coding sequence
atgccattgaacgtgagctttaccaacaggaactacgaccttgactacgatagcgttcaaccatacttttactgcgatgaagaagagaacttctaccagcaacagcaacagagcgagcttcagccccctgcgcccagcgaggatatctggaaaaagtttgagcttctcccgacgcctccactctcgccttcgcggagatcaggactttgttcacctagctacgtcgccgtgacgccattttcattgaggggggacaacgacgggggaggtggtagcttcagcactgctgaccagcttgaaatggtgaccgaactcctgggcggggatatggtgaatcagagcttcatatgcgaccctgatgatgaaactttcataaagaatatcataattcaagactgcatgtggtcgggattctcggcagctgcaaaacttgtctcagaaaagctcgcaagctatcaagccgcgcggaaggacagtgggtcgcctaatcctgcgcgtggccattcagtgtgttcaacttcctccctttacttgcaagatctgtccgcagccgcctcggagtgtatcgatccttcagtggtgtttccatatcccctgaacgatagttcgtcccctaagtcatgtgccagtcaagattcgtccgctttttccccctctagcgattcacttctgtcctccaccgaatcgagccctcagggatcgcctgaaccgttggtgctccatgaagaaaccccgcctactactagcagcgacagcgaggaggaacaggaagatgaggaggaaatagatgtcgtgtcggtggagaaacggcaagcaccaggtaagcggtcggaatcaggtagcccatccgcaggaggacattccaagccaccgcattccccacttgtgctgaagcgctgtcacgtgtccacccatcagcacaactacgccgccccaccgtccacccgaaaggattacccagctgcgaagagagtgaagctcgattccgtgcgagtcctgcgccaaattagcaataatcgtaaatgcacctctcctcggtcatccgacaccgaagagaacgtgaaacggcgcacccacaatgtacttgaacggcaaaggcgcaacgaactgaagagaagttttttcgcactgcgcgaccagatcccagaactggaaaacaacgagaaggcccccaaagtcgtgattctgaagaaggcaactgcttacattttgtcggtgcaggcggaagagcaaaagctcatttccgaagaggatctgcttagaaagagacgggagcaactgaagcacaaattggaacagcttagaaacagctgtgca

SEQ ID NO: 21178 - DNA, 1317 bp, Artificial Sequence; identical to SEQ ID NO: 21177
  Description of Artificial Sequence: Synthetic coding sequence

SEQ ID NO: 21179 - DNA, 1317 bp, Artificial Sequence
  Description of Artificial Sequence: Synthetic coding sequence
atgccgcttaacgtgtccttcactaacagaaactacgacctggattatgattctgtccagccgtacttctactgcgacgaggaggagaacttctaccagcagcaacagcaatccgagctgcaacctccagcgccatctgaagatatttggaagaagtttgaactgctgccgactccgcctctcagcccatcgcgccgctcgggcctctgctcaccgtcgtacgtggcggtgacccctttctcgctccggggagacaatgatggcggtggtggatcctttagcaccgcagatcagctggaaatggtgaccgagcttcttgggggagacatggtaaaccaatccttcatctgtgacccagacgatgaaacgttcatcaagaacatcatcatccaggactgcatgtggagcggtttctccgcggccgccaagctggtgtcagaaaaactggcctcctaccaggcagctcgcaaggattcgggatcccctaatccagcccggggacattcagtctgcagtacgtcatcgctgtacctccaggacttgtcggcggccgctagcgagtgcatcgaccccagtgtggtgttcccatatcctctcaacgatagctcgtcacccaagtcgtgtgcatcgcaagattcctcggcgttctctccctcctcggattctctcctttcctccactgagtcgtcgccacagggctcgcccgaacctctggtcctgcacgaggaaaccccaccgacgacttcgtcggactctgaagaagaacaagaagatgaggaagaaatcgacgtggtgtcggtggagaagcgccaagctccggggaagaggagcgaatcgggatcgccttcagccgggggccacagcaagccaccgcactcgccactggtgctcaaaagatgtcatgtgtccacccaccagcacaattacgcagccccgccttcgacgcgcaaagattacccggcagccaagcgggtcaaattggactcggtgagagtcctgcggcagatcagcaacaatcgaaagtgcacttcgcccagaagctccgacaccgaagaaaacgtgaaacggagaacccacaacgtcctggagcgacagcggcgaaacgaactgaagcggagcttcttcgccctgcgcgaccagatccctgaactcgagaacaatgagaaagccccgaaggtcgtgatcctcaagaaggccactgcctacatcctgtccgtgcaagccgaggaacaaaaactcatctcagaggaggatctcctccgaaaaaggcgcgaacaactcaagcataagctggagcaactcaggaattcgtgcgcg

SEQ ID NO: 21180 - DNA, 1317 bp, Artificial Sequence; identical to SEQ ID NO: 21179
  Description of Artificial Sequence: Synthetic coding sequence

SEQ ID NO: 21181 - DNA, 1317 bp, Artificial Sequence
  Description of Artificial Sequence: Synthetic coding sequence
atgccactcaacgtgtccttcactaatagaaattacgatcttgactacgattcggtgcagccttacttttactgtgacgaagaagagaacttctaccagcagcaacagcagagcgaactgcagccgcccgcaccttcagaagatatctggaagaagtttgagctccttcctactcccccgctgagcccttcgcggagatccggcctctgttcaccaagctacgtggcagtgactcctttctcattgcggggtgataatgatggaggcggtggatcttttagcactgcggaccagcttgaaatggtgactgagctcctggggggtgatatggtgaatcagtcattcatctgcgatcctgatgatgaaaccttcattaagaacatcataatccaagactgtatgtggtcaggattcagcgcggcggccaagctcgtctcggagaagctggcatcctaccaagcagcccggaaggactcaggatccccaaatccggcgagaggacattcggtgtgcagcacctcctcgctctatcttcaagatctgagtgcagccgcatcagaatgcattgacccatcggtggtgtttccgtatcctctcaatgactcaagctcgcccaaatcctgcgcatcccaagactcgtctgcattttccccttccagcgactcccttctttcgagcaccgagagctcaccccaggggtcaccagaaccactggttctccacgaagaaacgccccctactacttcttcagattcagaggaagagcaggaagatgaagaagaaattgatgtggtgtcggtcgaaaagaggcaggcaccagggaagcggagtgaaagcggatcgccttcagcaggaggccactccaagcctcctcattcgccccttgtcctgaaaagatgccatgtgagcacccatcaacataactacgcagcccctccttcgacccgcaaagattacccagcagctaagcgcgtgaaactggactccgtcagggtgttgagacagatctcaaacaacagaaagtgcaccagccctaggagctcggatactgaggaaaacgtgaagcgcaggacccacaacgtgctggagcgacaacggcggaacgaactgaaacgttcatttttcgccctccgtgaccaaattcccgagctcgaaaacaacgaaaaggcaccaaaggtcgtcattctcaaaaaagcaactgcatacattctgagcgtgcaggcagaggaacagaaactcatctccgaggaagatctgcttagaaagaggcgggaacagcttaagcataagctggaacaactgagaaactcctgcgca

SEQ ID NO: 21182 - DNA, 1317 bp, Artificial Sequence; identical to SEQ ID NO: 21181
  Description of Artificial Sequence: Synthetic coding sequence

SEQ ID NO: 21183 - DNA, 1317 bp, Artificial Sequence
  Description of Artificial Sequence: Synthetic coding sequence
atgcctctcaacgtgtcctttactaataggaattatgacttggactacgattctgtgcagccatacttctactgcgatgaggaagagaacttctaccagcaacagcaacagtctgaactccaacccccagctccttcagaggacatctggaagaagttcgagctcctgccgactcccccgctgtcgccaagccgtaggtcaggactttgcagcccatcgtacgtagcagtgacgccgttctccctgcgcggggacaatgatgggggcggaggcagtttttcaaccgctgaccagttggagatggtgaccgaactgctcggaggagatatggtcaaccaaagtttcatctgcgatccggacgatgagactttcatcaagaacatcattatccaggattgcatgtggtcaggattttccgcggcggctaagctcgtgagtgagaaactggctagctaccaggcggcgcggaaggactcgggatcccccaatccagcgcgcggacactcagtctgttcgacgagctcattgtatctgcaagacctttccgccgccgcatcggagtgcattgatccctcggtggtttttccgtacccgctgaacgactcgtcctcaccaaagagctgcgcttcccaggactcgtcggccttcagtccgtcgtctgactcgctgctgtcatccacggaatcaagcccccaagggtcccctgaaccgctggtcctgcatgaagaaactccccctaccacttccagcgactcggaagaggaacaagaagatgaagaggaaattgacgtggtgtccgtggaaaagaggcaggctccgggtaagcgatccgagtcaggtagcccttccgcaggcggtcactccaagccgccccactccccgctcgttctgaaacgctgtcatgtgagcacccatcagcataactacgcagcaccgccctcgactagaaaggactacccagccgcaaagagggtcaaactggattcggtgagagtgctccgccaaatctctaacaaccgcaagtgtacttcgcctcgctcgtccgatacggaggaaaatgtgaagcggagaactcacaatgtcctcgagcggcaaagacgcaatgaactgaaaaggtcattcttcgcgctgcgggaccagatccccgagctcgaaaacaatgaaaaggcgcctaaagtcgtgatcttgaagaaggcaaccgcctacatcttgtccgtgcaggcagaggaacagaaactcatcagcgaagaggatcttcttcggaagagacgcgagcaactgaaacacaaactcgagcagctgcggaactcctgcgcg

SEQ ID NO: 21184 - DNA, 1317 bp, Artificial Sequence; identical to SEQ ID NO: 21183
  Description of Artificial Sequence: Synthetic coding sequence

SEQ ID NO: 21185 - DNA, 1317 bp, Artificial Sequence
  Description of Artificial Sequence: Synthetic coding sequence
atgccgctcaacgtctcttttaccaaccggaactacgatctggattacgactccgtgcagccttatttctattgcgacgaggaagaaaacttctatcagcagcagcagcagagtgagctccagcccccagcaccctctgaggatatttggaagaagtttgagctgcttccaacgccacctctgtccccatcacgcaggagtggcttgtgtagccctagctatgtggcggtcaccccctttagtctgcggggcgataatgacggggggggtggtagttttagtaccgctgaccaattggagatggtcactgagctcctcggcggcgacatggtgaaccagtccttcatatgcgacccggacgacgaaacttttatcaagaatatcattatacaggactgtatgtggtcaggcttctctgctgccgccaagttggtgagtgaaaagctggcctcttatcaggccgccaggaaggactctggctcacccaaccccgcgagaggccatagcgtgtgcagcaccagtagcttgtacctgcaggatttgagcgccgccgcgtcagagtgtatcgatccttctgttgtcttcccgtacccactgaatgacagttcgagccccaagtcctgtgccagccaggactcctcagccttttcaccttccagtgactccctgctttcaagcacggagtcatcgccccagggctctcctgagccactagtcctccacgaagagacaccgcctaccacaagcagcgattctgaggaggagcaggaggatgaggaggagatcgacgtggtgtctgtggaaaaacgacaggcacccggcaagaggagtgagtccggttctcccagtgctggcggacactctaaaccaccacatagccccctagtactgaaaagatgtcacgtctcaacccatcagcataattatgccgcgccacccagcactagaaaagattatccagccgctaaaagagtgaagctagatagtgtccgggtgttgcgtcaaataagcaataatcgtaagtgtacaagtccaagaagctctgacaccgaggagaacgttaagaggcgtacccataatgtgctggagaggcagaggagaaacgaactcaaaagatctttctttgctcttagggaccagatccccgagctagagaataatgagaaggccccgaaggttgtgattctaaagaaggccaccgcttatatcctgtctgtccaggcggaagaacagaagttgataagcgaggaagacctgttgcgcaagcgcagagaacagttaaagcacaagctagagcagctgagaaactcctgcgcc

SEQ ID NO: 21186 - DNA, 1317 bp, Artificial Sequence; identical to SEQ ID NO: 21185
  Description of Artificial Sequence: Synthetic coding sequence

SEQ ID NO: 21187 - DNA, 1317 bp, Artificial Sequence
  Description of Artificial Sequence: Synthetic coding sequence
atgcctcttaacgtctcattcacaaatagaaactacgatcttgactacgattcagtgcaaccatacttctattgtgacgaagaagaaaatttttatcaacaacagcagcagtccgagctgcaaccacctgcgcctagcgaggacatttggaagaaatttgaactgctacccaccccgccactctctccctcacgtcgttctggactgtgttcaccttcctatgtagctgtcactcccttttcactgcgcggggataacgacggggggggaggcagcttctcaaccgccgaccagttagagatggtgacagagctcctcgggggcgatatggtaaaccagagctttatttgtgacccagacgacgagacctttatcaagaatatcataatccaggactgtatgtggtcaggattcagcgcggccgccaaattggtatccgagaaattggcctcataccaggctgcaaggaaggactcaggttcacccaacccggcccgagggcattcggtctgcagcacctcgtccctatatcttcaggatctttccgcggcggcctcagaatgtattgatccatccgtggtatttccatatccacttaacgatagtagcagcccaaaatcatgtgcatcccaggattccagcgcattcagccccagttccgattcactgctgtcttccacagagagctccccgcagggctctcccgagcctctggttcttcatgaggaaacaccgcccactacctcttccgactcagaggaagagcaggaggatgaggaagagatagacgtcgtctctgtggagaaacggcaggctcctggcaaacgttccgagtcaggaagcccttcagcaggcgggcacagtaagccgccacattctcctcttgtgctaaagcgttgtcacgtctctacccaccagcataactacgcagcaccacccagcacacgaaaggattatcccgccgcgaagcgtgttaaattggacagtgtccgagttttaaggcagatatccaataaccgcaagtgcacctccccgcggtcatcagatacggaggagaacgtgaagaggagaactcacaacgtgcttgagaggcagaggcgtaatgagcttaagcgctcgttctttgcactgcgggatcagatccctgaattggagaataacgaaaaggcccccaaggtcgtcatcttgaaaaaggccacggcatatattttgagcgtccaggcggaggagcagaagttaatctctgaggaggacttattgcggaaacgcagggagcaactcaaacataagctggagcagctgaggaattcatgtgct

SEQ ID NO: 21188 - DNA, 1317 bp, Artificial Sequence; identical to SEQ ID NO: 21187
  Description of Artificial Sequence: Synthetic coding sequence

SEQ ID NO: 21189 - DNA, 1317 bp, Artificial Sequence
  Description of Artificial Sequence: Synthetic coding sequence
atgcctctgaacgtctcttttacgaatagaaattacgacttggattacgattcggtgcagccctatttctactgcgatgaagaggaaaacttttaccagcagcagcaacaatcagagcttcagcctccagccccttccgaagatatttggaaaaagtttgagctgctcccaactccacctctgtcccctagccggagatcgggactctgctcaccatcctacgtggccgtgactcctttttcgctgcggggtgataacgatgggggtggaggctcgttttcaactgccgaccagctggaaatggtgactgaactcctgggcggagacatggtgaatcagtccttcatatgtgatcccgacgacgagactttcatcaaaaacatcatcatccaggactgcatgtggtccggatttagcgccgccgcaaagctggtttccgagaagctggcctcgtaccaagcggcacgaaaggactcgggttcccccaacccggctcgtgggcattcagtctgttccaccagctccctgtacctgcaagatctgtccgcagccgcaagcgagtgcattgatccatcggttgtgttcccataccccctcaacgactcttcttcccctaaatcatgtgcatcccaagactcatccgccttttcaccgtcgtctgatagcctcctgtcatcgacggaatcctcgccccagggttcccctgaaccgcttgtccttcacgaagagactccgccaaccacctcctcggattcggaggaagagcaagaggatgaggaagagatagacgtggtttcggtggaaaagcgccaagcacccggaaagaggtcggaatcaggatcgccctccgctgggggtcattcgaagcctccacactccccactcgtcttgaagcgatgtcatgtgagcacccatcagcataactacgcggccccaccgtccacccgaaaagattatccagcagccaaaagagtgaagctggattcggtcagggtgttgagacagattagcaacaaccgcaaatgtacctctccccgtagcagtgataccgaggaaaacgtgaagcggagaacgcataatgtgcttgaacggcaacgcaggaatgaactgaagcggagcttcttcgctctcagagatcagattcctgagttggagaataacgaaaaggcccctaaggtggtcatcctgaagaaggcgaccgcttacatcctctcggtacaagctgaagaacagaagctgatatcggaggaggaccttcttcgtaagcgacgagagcagcttaaacacaagctcgagcaactgcggaactcctgtgca

SEQ ID NO: 21190 - DNA, 1317 bp, Artificial Sequence; identical to SEQ ID NO: 21189
  Description of Artificial Sequence: Synthetic coding sequence

SEQ ID NO: 21191 - DNA, 1317 bp, Artificial Sequence
  Description of Artificial Sequence: Synthetic coding sequence
atgcctctgaacgtaagtttcaccaataggaactatgatttggactacgattccgtgcagccttacttttattgcgatgaagaagagaatttttaccagcagcaacaacagagtgaattacaaccaccggctccatctgaggatatttggaagaagttcgagcttcttcctactccccctttgagtccatccaggcggagcggtctttgctctccctcttatgttgctgttacgccattttcccttaggggggataatgatggtggaggagggagtttctcaactgcagatcaactcgaaatggttacagaattattggggggagacatggttaatcaaagctttatttgtgatccagatgatgagacctttataaaaaacattattattcaagattgtatgtggtcagggttctctgctgctgctaagctcgttagcgagaagctggcgtcctatcaagctgctcgcaaggattcgggctcccctaaccctgctcgcggtcacagcgtctgtagtacatcttcactataccttcaggatctgtcagctgctgcatcagagtgtatcgatccgtccgtggttttcccctaccctctgaacgattcatcctcaccgaagtcctgtgcatcccaagattcctctgctttttctccatccagtgatagcttgctttcttctaccgagtccagcccacaaggctcacctgaaccattggttctccatgaagagacaccacctacaactagttctgattccgaagaggagcaggaggacgaagaggagatcgatgttgtttccgttgaaaagcgtcaggctccaggtaagagaagcgagagcggttcccctagtgctggtggccattcaaaacctccacattcccctctcgttttgaagcgatgccatgttagcactcaccagcataattacgcagctcctccatcgacacgtaaggattacccagctgcaaagagggtcaagttggatagtgtgagagtcttgaggcaaatttctaataaccgtaagtgtacttccccacgtagttcagataccgaagaaaacgtaaagagaaggacacataacgtgttggaaaggcagcgacgaaatgagttgaaaaggagcttcttcgcccttagggatcaaattcctgagctcgagaataatgaaaaggccccaaaagtggtcattttaaagaaggcgactgcttacattctctcagtacaggcagaggaacaaaaacttatatcggaagaggatctcctccgaaaaaggcgagaacaattgaagcataaactcgagcaacttcgtaattcatgcgca

SEQ ID NO: 21192 - DNA, 1317 bp, Artificial Sequence; identical to SEQ ID NO: 21191
  Description of Artificial Sequence: Synthetic coding sequence

SEQ ID NO: 21193 - DNA, 1317 bp, Artificial Sequence
  Description of Artificial Sequence: Synthetic coding sequence
atgccactgaacgtgagctttaccaaccgcaattacgacctcgactatgactctgtccagccatacttttattgtgatgaggaggagaatttttaccagcaacaacaacagtctgagctgcagcctcctgctcccagcgaggatatctggaaaaagttcgaactgctgcctactccccccctgtctccgagccgccgcagcggcctgtgttcacctagctatgtggccgttactcctttctctctgcgaggcgataacgatggtgggggtggttctttttcgacggctgaccagctggaaatggtgacggagttattggggggtgacatggttaaccagagcttcatttgcgatccggatgatgaaaccttcatcaagaatattatcatccaggattgtatgtggagcgggttctctgctgcggccaagctggtatcagaaaaactggcgagctaccaagcagcgcgcaaggattccggttcgccgaacccggcccgtgggcacagcgtgtgtagcacgagctcactgtacctgcaagatctgtcagccgcagccagcgagtgtatcgatccgagcgtggtttttccatatcctctgaatgacagtagcagcccgaagtcctgtgcgagccaggattctagcgctttttctccgagcagcgattccttgttgtctagcactgaatcatcaccgcagggctctcctgagccgctggtcctacacgaagagacccctcctaccacgtcttcggatagcgaggaagagcaggaagacgaggaggaaatcgatgttgttagcgtggagaagcggcaggcgcccggaaagcgctccgagtcaggcagcccaagcgctggcggtcattctaaacccccgcactctccactggttctgaagcgctgccatgtgtccacccaccaacacaactatgccgctcctccgtccactcgcaaggattatcccgccgctaaacgagttaaactggatagcgtgcgggtcctgcgtcaaatctctaataatcgcaagtgtaccagcccacgcagcagcgacacggaggagaacgtgaaaagaaggacgcataacgttcttgaacgtcaacggcgcaatgaattaaaaagatccttcttcgcgctgcgggatcaaattccggagttggagaacaatgagaaagcaccaaaggtcgttatcttgaagaaggccacggcatacattctcagcgtgcaagctgaggaacagaagctgatctccgaagaggatctcctgcgcaaacgacgcgaacagctcaaacataagctggaacaattacgaaattcttgcgcc

SEQ ID NO: 21194 - DNA, 1317 bp, Artificial Sequence; identical to SEQ ID NO: 21193
  Description of Artificial Sequence: Synthetic coding sequence

SEQ ID NO: 21195 - DNA, 1317 bp, Artificial Sequence
  Description of Artificial Sequence: Synthetic coding sequence
atgcccttgaatgtgtcgttcacgaacagaaactacgacctcgattacgattcggtgcaaccatacttctattgcgacgaagaagaaaacttctaccaacagcagcagcaaagcgagctgcagccgcctgccccaagcgaggacatctggaagaagttcgaactccttcctactcctcccctgtcccccagccggcgcagcggactctgctcgccctcctacgtggcagtcactccgttttcactgagaggagataatgacggagggggcggctcattttccactgccgaccagttggagatggtcaccgaacttttgggtggtgacatggtgaatcagtccttcatctgcgaccctgatgacgaaaccttcatcaaaaacatcatcatccaggactgtatgtggagcgggttctccgcggccgcgaagctcgtctccgaaaagctggcctcgtaccaggctgccaggaaggactcaggaagccctaacccggcccgcggacactccgtgtgctcgacttcatccctgtacctccaggatctgtcagcagccgcaagcgaatgcatcgatccaagcgtcgtctttccttacccactcaacgattcaagctctccaaagtcctgtgccagccaggactcgtcagccttctcgccgtcatccgatagccttctttcctccacggaatccagcccgcagggatccccggaaccgctggtgctccatgaggagactccgccaactacctcctcggatagcgaggaggaacaggaggacgaagaggagatcgacgtggtgagcgtcgagaaacggcaggcgcctggcaaacgatcggaatccgggtccccttcagccggtggacacagcaagcctccgcacagcccactggtcctcaagcggtgccacgtgtccacccatcaacacaattacgcggctcccccgtcgaccagaaaagactaccctgctgcaaagcgcgtcaagctcgatagcgtgagggtgctcagacagatctcgaataaccgcaaatgtaccagcccgcggtccagcgataccgaggaaaatgtgaagcgccggactcacaatgtcctggagagacagaggcggaatgagctgaaaaggtcgttcttcgccttgcgcgaccaaataccagaacttgagaataacgagaaagcgccaaaggtcgtgatcctgaaaaaggcgaccgcgtacatcttgtctgtccaggccgaggaacagaagctgatctcggaagaagatttgctgcggaagagacgggagcaacttaagcacaagctggaacaactgcgcaattcatgcgct

SEQ ID NO: 21196 - DNA, 1317 bp, Artificial Sequence; identical to SEQ ID NO: 21195
  Description of Artificial Sequence: Synthetic coding sequence

SEQ ID NO: 21197 - DNA, 1317 bp, Artificial Sequence
  Description of Artificial Sequence: Synthetic coding sequence
atgcctttgaatgtgtcattcactaacagaaactacgatcttgattacgattctgtgcaaccttacttttactgcgacgaagaagaaaacttctaccagcagcaacagcagtccgaactgcaaccgccagccccctccgaggatatctggaaaaagttcgagctgctgccgactccacccctcagcccgtcgcggcgctcgggattgtgctcgcccagctacgtggccgtgactccgttctccctgcgcggagacaatgacggtggaggagggtcgttttccaccgctgatcaactggagatggtgacggagctcctcggaggcgacatggtcaatcagagcttcatatgtgacccagacgatgagacttttatcaaaaacatcatcattcaagattgcatgtggtcgggattttccgcagcggcgaagctcgttagcgaaaagctcgcatcctatcaagccgccagaaaggactccggatcacctaacccggcgcgcggacactcggtctgcagcacttcttccctctacttgcaagacctgtccgcagcagcttcggaatgcatcgacccgtccgtggtgttcccttaccctctgaatgactcttcctcaccaaaatcgtgcgcgtcccaggactcttcggcattctcgccgtcaagcgatagcctgctctcgtccaccgaaagctccccgcaaggctcgccggagccgctggtcctccacgaggaaaccccacctactacttcgtcagactccgaggaagaacaggaagatgaggaagaaattgacgtcgtgtcagtggagaagcggcaggcccctggtaaacgatccgaatcggggagcccatcggctggcggacactcaaaacctccgcattcaccgctcgttctgaaacgctgccacgtctccactcatcagcacaattatgcggcgccaccgtccacccggaaggattacccggctgcaaagcgggtgaagctcgattcagtccgcgtccttaggcagatttcgaacaaccgaaagtgtacctcccctcggagctcagacaccgaagagaacgtgaagaggcgcactcacaacgtgcttgagcgccagcggagaaacgaactgaagcgctccttcttcgcgttgagggaccagattcctgagttggaaaacaacgaaaaggccccgaaagtggtcatcctcaagaaagccaccgcttacatcttgagcgtgcaggccgaggagcaaaagctgatctctgaggaagatttgctcaggaaaagaagggaacaactgaaacataagctcgaacagttgcgtaatagctgcgct

SEQ ID NO: 21198 - DNA, 1317 bp, Artificial Sequence; identical to SEQ ID NO: 21197
  Description of Artificial Sequence: Synthetic coding sequence

SEQ ID NO: 21199 - DNA, 1317 bp, Artificial Sequence
  Description of Artificial Sequence: Synthetic coding sequence
atgccactgaatgtgtcattcacgaatcgcaactacgatttggattacgacagcgttcagccctatttttactgcgacgaagaggaaaatttctatcagcagcaacaacagagcgagctgcaacctccggctccgagtgaggacatctggaaaaaattcgaattgctacccacaccccccctgtctccctcacgaagaagcggtctgtgttccccatcctatgtggccgtaaccccctttagtctgcggggagataacgatgggggcggagggtcgttctccacagcggaccaactggagatggtgactgagctcctaggcggcgacatggtgaatcagtccttcatctgtgacccagacgatgagactttcatcaagaatatcataattcaggattgtatgtggagtggctttagcgccgctgccaaactggtgtcagagaaattggcctcctaccaggctgctcggaaagatagcgggtccccaaatccagctcgtggccattcagtatgctcgacctctagtctctacctccaggacctgtctgcggctgcctctgaatgcatagacccctccgtggttttcccataccccctgaacgactcgtcatcacctaagtcttgcgcttcacaggactcatccgcatttagtccatcatctgactcactgttgagcagcacagagagcagtcctcaggggagtcctgagcctttggtgcttcacgaggagacgccacccactactagctccgatagtgaggaggaacaggaagacgaggaagagatcgacgtggtgagcgtggaaaagcggcaggcacccgggaagagaagcgagtccggtagcccatctgcagggggccattctaagccccctcattctcctctggtcttgaagcgctgtcacgtttccacgcatcagcataactacgcagcacctccgagcactagaaaagattaccctgctgcaaagcgcgttaaacttgacagtgttagggtcctaaggcagatttccaataataggaaatgcacgagccccagaagcagcgacactgaagaaaacgttaagaggaggactcataatgtgttggagaggcagagacgaaacgagctgaaacgtagcttcttcgctcttagggaccaaataccagagctcgaaaacaatgaaaaagccccaaaggttgtgatcttaaagaaggccacggcctatatattgagcgttcaagcagaagaacagaagctgataagcgaggaggacctgcttagaaaacgccgtgaacagcttaagcataaactggagcagctccgcaactcatgcgct

SEQ ID NO: 21200 - DNA, 1317 bp, Artificial Sequence; identical to SEQ ID NO: 21199
  Description of Artificial Sequence: Synthetic coding sequence

SEQ ID NO: 21201 - DNA, 1317 bp, Artificial Sequence
  Description of Artificial Sequence: Synthetic coding sequence
atgcccctgaacgtaagttttacaaaccggaattatgatttagactatgactctgtgcagccctacttctattgtgacgaggaggagaatttctaccaacagcagcagcagagcgagctccaacctcccgcgcccagcgaagacatttggaaaaaattcgaattgctgcctactccaccactttctccatcaagacggtcaggcctgtgctccccctcatacgtggccgtgaccccttttagtctgcgtggggacaacgacggcggtggcgggagcttctcaacagcggatcagttagagatggtaacagagttgttgggcggagacatggtgaatcaaagttttatatgcgatcctgacgatgagacatttatcaaaaacatcattatacaggactgcatgtggtcagggttctctgccgcagcaaaactcgtgagcgaaaaattggcaagctaccaagcagcccggaaggatagtggatcccctaatccggccagaggccattctgtgtgttcaacctctagcttatatcttcaagatctcagcgccgccgcctcagagtgcatcgaccctagtgtggtcttcccctatccgttgaacgattcatcctctcccaagtcatgcgcctcgcaggattctagcgccttctctcctagcagtgattccttattatctagcacggaatcatctcctcaggggagcccggagcccctggtgctccacgaagagacacctcccacgacctcatccgatagcgaggaggagcaggaggatgaggaagagatcgacgtcgtctctgtggagaagagacaagccccaggcaagcggtctgaaagcggcagcccctcagcgggcgggcattcaaaacccccacactcaccattggtcctcaagagatgtcatgtcagtacacaccagcacaactatgcagctccaccctcgacaaggaaagactatccagctgccaaaagggtgaaactggattctgtccgggtactgcggcagatttctaataacaggaaatgcactagccctaggtcctctgacacggaggagaacgtcaagaggagaactcacaacgtgctggaacgacagagaaggaatgagcttaagagatcctttttcgcactgagggaccagataccagaactcgagaataacgagaaagcacctaaggtggtgatcttgaagaaagcaactgcttacattctttctgtccaggcagaagagcagaagctgatcagcgaggaggatctgctgcggaaaagacgcgagcagctgaaacacaaactagagcagttgcgcaatagctgcgcc

SEQ ID NO: 21202 - DNA, 1317 bp, Artificial Sequence; identical to SEQ ID NO: 21201
  Description of Artificial Sequence: Synthetic coding sequence

SEQ ID NO: 21203 - DNA, 1317 bp, Artificial Sequence
  Description of Artificial Sequence: Synthetic coding sequence
atgcctttgaacgtttctttcactaacagaaattacgatttggactacgattctgtacagccctatttctactgtgacgaagaagaaaatttctaccagcagcagcagcagtccgaactgcagcctccagctccatcggaagatatttggaaaaaattcgagctactgcccactccccctctgtcaccttcaaggagatccggactctgttcaccctcatatgtcgctgtgactcctttctctttacgcggggacaacgatggaggaggggggagtttctctacagctgatcagctcgaaatggtaactgaactgctcgggggggatatggtgaaccagtcctttatatgcgatcccgacgatgagacattcataaaaaacatcataattcaggactgtatgtggtccgggttttctgctgcagcaaaactggtctcagaaaaattagccagttatcaggctgcgagaaaagattctggaagtcccaatcccgccagggggcattcagtgtgttctacatcctcactttatctacaggatctaagtgctgcagcctccgaatgtattgaccctagtgtagtgttcccttaccctctaaacgatagttcctccccaaaatcttgtgcttcccaggattctagtgcattctcacctagtagtgatagtttattatcaagtactgaaagttcaccccaggggagtcccgaacccctggtgctacacgaagaaactcctccaacaactagttcagattctgaggaggaacaggaagacgaagaggaaatagatgtggtgtccgtcgagaaaaggcaggctcctgggaagcgctctgaatctgggtcaccctcagcaggaggacactccaaacccccacattcccctctggttctcaaacgatgtcatgtatctactcatcagcataattatgctgcccctccctcaacaagaaaagattacccagccgccaaaagggtgaaactcgactccgtgagagtcctgaggcagatatcaaataatcgaaaatgtacatcccccagatcctcggatacagaagaaaatgtcaaacgacgaactcataatgtgttggagaggcagcggagaaatgagctgaagcgctcatttttcgcactccgagatcagattcctgaactggaaaataacgagaaagcacctaaagttgttatcctcaaaaaagccacagcctacatattatcagtccaggccgaagaacagaaacttatctctgaagaagacctcttacgaaaacgaagggaacagctaaaacacaaactcgaacagctgagaaacagttgcgct

SEQ ID NO: 21204 - DNA, 1317 bp, Artificial Sequence; identical to SEQ ID NO: 21203
  Description of Artificial Sequence: Synthetic coding sequence

SEQ ID NO: 21205 - DNA, 1317 bp, Artificial Sequence
  Description of Artificial Sequence: Synthetic coding sequence
atgcctctgaatgtgagcttcaccaataggaactacgacctcgattacgattctgtccagccttacttttactgtgacgaggaagagaatttctaccagcaacaacaacaatctgagctgcagccccccgccccctcggaagatatttggaagaaattcgaacttcttcctacgcccccactgagccctagcagaagaagcgggctctgtagccctagctacgtggcagtcaccccgttttcccttcgcggggacaatgatggtggcggtggatcattttccaccgcagatcagctggaaatggtgaccgagcttcttggtggtgacatggtgaaccaatcattcatctgcgacccagatgatgaaaccttcattaagaatatcattattcaggattgtatgtggtcagggttttcagccgcagccaagctggtgagcgaaaaactggcatcataccaagcagcacgaaaagattcgggatcaccaaatcccgcgagaggacattccgtgtgctccacgagctccctctatcttcaggacttgtcggccgcagcgagtgagtgcatagacccttcggttgtgtttccataccctttgaacgattcgtcgagccctaaatcctgcgcgtcgcaggattcgtcagctttctctccttcatcggattcgctcctctccagcaccgaatcgtctccacaagggtcacccgaacctcttgtgctgcatgaagaaacccctcctaccacgtcctccgattccgaagaggaacaggaagatgaagaagaaatcgacgtggtgtcagtcgagaagcgccaagcacctggaaaaagatcggaaagcggatcgccttcggctgggggccattcaaaacctccacacagccccctcgtgctgaagcggtgtcacgtgtcaacccatcaacacaactatgcagcaccaccttcgacgagaaaagattaccccgccgcaaagagagtgaagctcgattcggtgagggtgctgaggcaaatttcgaacaacagaaaatgtacgtccccgagatcatcggatactgaggaaaacgtcaaacgccggactcataacgtgcttgagaggcaacgccgcaatgagctgaagcgatcattctttgcgctgagggaccagatccctgagcttgagaacaacgaaaaggcgcctaaggtcgtgattctgaagaaggctaccgcatatatcctgagcgtgcaggccgaagaacagaagctcatcagcgaggaagatctcctgaggaaacggagagaacagctgaagcacaaattggaacagcttcgaaattcatgtgca

SEQ ID NO: 21206 - DNA, 1317 bp, Artificial Sequence; identical to SEQ ID NO: 21205
  Description of Artificial Sequence: Synthetic coding sequence

SEQ ID NO: 21207 - DNA, 1317 bp, Artificial Sequence
  Description of Artificial Sequence: Synthetic coding sequence
atgcccctgaatgtctccttcaccaaccgtaactacgatctggattacgactccgtgcagccgtatttttattgcgacgaggaagagaacttttatcagcagcaacaacagagcgaattgcagccccccgctccctccgaggacatttggaagaagtttgagctgctgcccacccctccattgtccccctcgcggaggtcggggctgtgtagcccttcatacgtggcagtgactcctttctctttgaggggggataacgacggaggaggagggtcattctccaccgcggaccagttagaaatggtaaccgagttactgggcggtgacatggtcaaccagagcttcatctgcgacccggatgatgaaaccttcataaaaaatataatcattcaggactgtatgtggtctgggttctcggcggctgccaagctggtctctgaaaagctcgcaagctaccaggccgctagaaaggactccgggtcaccaaatccggctcggggccattcagtgtgctcgactagttccctgtacctgcaggacctgagcgccgccgcttctgagtgcatcgatcctagtgtggtttttccttaccccctgaacgacagcagcagccccaaatcatgtgctagccaggattcttcggccttttctccaagctccgattccttgctctcttctacggagtcttccccacaaggctctcccgagccactggtactgcacgaggaaaccccccccaccacctcgagcgactctgaagaagagcaggaagacgaagaagaaattgatgtggtgtccgtggagaagaggcaggcgccgggtaagcggtccgagtccggatccccatctgccggtggacattctaagccccctcattcacccctcgtactgaaacgttgccacgtgtcaacccaccagcataactatgcagcgcccccctccactaggaaggattatcctgcagctaaacgtgttaagttagatagcgttagggtactccgacagatttcgaataataggaaatgtacctccccacgatcatccgatacggaggagaatgttaagcgaaggacgcataatgttctggagaggcagagaagaaacgagctgaagagaagcttcttcgcactgcgtgatcagatcccggaactggagaataacgagaaggcacctaaagtcgtaatattaaaaaaggcaactgcatacatcctgtccgtgcaggccgaggaacagaagctcatcagtgaagaagacctgctacggaaaagacgagagcagctaaaacataagctggagcagctgagaaatagttgcgca

SEQ ID NO: 21208 - DNA, 1317 bp, Artificial Sequence; identical to SEQ ID NO: 21207
  Description of Artificial Sequence: Synthetic coding sequence

SEQ ID NO: 21209 - DNA, 1317 bp, Artificial Sequence
  Description of Artificial Sequence: Synthetic coding sequence
atgccgttaaatgtttcgtttacgaatcgtaattatgatttagattatgattcggttcaaccgtatttttattgtgatgaagaagaaaatttttatcaacaacaacaacaatcggaactacaaccgccggcgccgtcggaagatatatggaaaaaatttgaactattaccgacgccgccgctatcgccgtcgcgtcgatcgggtttatgttcgccgtcgtatgtagcggttacgccgttttcgttacgtggtgataatgatggtggtggtggttcgttttcgacggcggatcaattagaaatggttacggaactactaggtggtgatatggtaaatcaatcgtttatatgtgatccggatgatgaaacgtttataaaaaatataataatacaagattgtatgtggtcgggtttttcggcggcggcgaaattagtttcggaaaaactagcgtcgtatcaagcggcgcgaaaagattcgggttcgccgaatccggcgcgtggtcattcggtttgttcgacgtcgtcgctatatctacaagatttatcggcggcggcgtcggaatgtatagatccgtcggtagtatttccgtatccgctaaatgattcgtcgtcgccgaaatcgtgtgcgtcgcaagattcgtcggcgttttcgccgtcgtcggattcgttactatcgtcgacggaatcgtcgccgcaaggttcgccggaaccgctagtattacatgaagaaacgccgccgacgacgtcgtcggattcggaagaagaacaagaagatgaagaagaaatagatgtagtatcggttgaaaaacgacaagcgccgggtaaacgttcggaatcgggttcgccgtcggcgggtggtcattcgaaaccgccgcattcgccgttagtattaaaacgatgtcatgtatcgacgcatcaacataattatgcggcgccgccgtcgacgcgaaaagattatccggcggcgaaacgagtaaaattagattcggttcgtgttctacgacaaatatcgaataatcgaaaatgtacgtcgccgcgttcgtcggatacggaagaaaatgttaaacgacgtacgcataatgttctagaacgacaacgtcgaaatgaactaaaacgttcgttttttgcgttacgtgatcaaataccggaactagaaaataatgaaaaagcgccgaaagttgtaatattaaaaaaagcgacggcgtatatactatcggtacaagcggaagaacaaaaactaatatcggaagaagatctactacgaaaacgtcgagaacaattaaaacataaactagaacaactacgtaattcgtgtgcg

SEQ ID NO: 21210 - DNA, 1317 bp, Artificial Sequence; identical to SEQ ID NO: 21209
  Description of Artificial Sequence: Synthetic coding sequence

SEQ ID NO: 21211 - DNA, 1317 bp, Artificial Sequence
  Description of Artificial Sequence: Synthetic coding sequence
atgcctcttaacgtgagtttcacaaacaggaattatgatctcgattacgattctgtacagccctatttttattgcgatgaggaggagaatttctatcagcaacagcagcagtcggaactacagccaccagccccctccgaagatatttggaaaaaatttgaattactgccaactccacctcttagtccatcaagacgctctgggttatgcagtccatcctatgtagctgtgacaccattttctctcagaggggataacgatggaggaggagggtctttttccacagcagatcagctggaaatggtgactgaactgctaggaggagacatggtcaatcagtcttttatatgtgatcccgatgacgaaacattcatcaaaaacatcatcatacaggattgtatgtggtctggattttccgccgctgcaaaactagtctctgaaaaactggcaagttaccaggctgccaggaaagatagtggatccccaaatccagcgcgggggcattccgtttgttcaacttcttccctctatctccaggatctcagtgctgcagcatctgaatgtatcgatccctctgttgtcttcccttatccacttaatgatagttcctctccaaaatcttgtgcctcccaggatagttctgcattttccccttcttctgattctctactatccagtacagaatcgtcaccacaaggatcgccagaacctcttgttctccatgaggaaactcctccgactactagttccgattctgaagaggagcaggaggatgaggaagaaatcgatgtggtctctgtagagaagcgccaggcccccgggaaacggtctgaatctgggagtccatctgctggggggcattctaaaccccctcattctccactcgtgctcaaacgatgccatgtttctacacaccagcataattacgctgctcctccatccacaaggaaagactacccagccgctaaaagagtgaaactcgattctgtacgcgttttgaggcagataagtaacaatcggaagtgtacatctccacggtctagtgacactgaagaaaatgtgaaacggcggactcacaatgtccttgaaagacaacggaggaatgagttaaaacgctcgttttttgccctaagagatcagattcccgagctcgaaaataatgaaaaagcacctaaagtggtcatattgaaaaaagccacagcatatattctgagtgttcaggccgaagaacagaagcttataagtgaggaagacttgctcaggaaaaggcgagaacaactgaaacataaactcgagcaactaaggaactcctgtgct

SEQ ID NO: 21212 - DNA, 1317 bp, Artificial Sequence; identical to SEQ ID NO: 21211
  Description of Artificial Sequence: Synthetic coding sequence

SEQ ID NO: 21213 - DNA, 1317 bp, Artificial Sequence
  Description of Artificial Sequence: Synthetic coding sequence
atgccgctgaacgtcagctttaccaacagaaattacgacctcgactatgactcagtgcagccttacttctactgcgacgaggaggaaaatttttaccagcaacagcaacagtccgagctccaaccacccgcacccagtgaggacatatggaagaagtttgagctcctgcctacccctcccctctctccaagcagaagatctgggttgtgttcacccagttacgtggccgtgactccattttctctgcgcggagataacgatggtgggggcgggtccttttccaccgctgaccaactggagatggtcacagagttgctcggtggcgatatggttaatcagtccttcatctgcgaccccgacgatgaaaccttcatcaagaacatcataatccaggactgtatgtggtccggcttctctgcagctgcgaagctcgtgtctgagaaactggcttcataccaggctgctcgcaaggactccggctcaccaaatccagcgcggggtcactctgtatgctctaccagcagtttgtatttgcaagacctgtctgcagcggcaagtgagtgtatcgatccctccgtggttttcccatacccacttaatgacagcagcagcccgaagtcctgtgcctcccaggatagtagtgccttctctccatcttccgattctctcctgtccagtaccgagagctctcctcaaggcagccctgaacctttggtactgcatgaggagacaccaccaacaacttcatctgacagcgaagaggagcaggaggacgaggaagagatagacgtagtcagcgtggagaagaggcaggcaccgggtaagcgatctgagtccggttcaccgagcgccggcgggcatagcaaaccgccacacagcccccttgtgttgaagcggtgccacgtttccacgcaccagcataattatgccgcgccaccaagtacacggaaagattaccccgcagctaaaagggtgaagctcgatagtgtgcgggttctccggcagatctccaacaaccggaaatgcacaagcccccgctcaagtgacactgaggagaatgtaaagcgcaggacacacaacgtgctcgagcgccagagacggaatgaactgaagaggtctttctttgcgcttcgcgatcagattcctgagctggagaataatgaaaaggctccaaaggtcgtcatattgaagaaagctacagcctacatcctcagcgtccaggcagaagagcaaaagctgatcagtgaggaagaccttctgcgcaaacggcgcgaacagctcaagcacaagctggaacagctgcgcaatagctgcgca

SEQ ID NO: 21214 - DNA, 1317 bp, Artificial Sequence; identical to SEQ ID NO: 21213
  Description of Artificial Sequence: Synthetic coding sequence

SEQ ID NO: 21215 - DNA, 1317 bp, Artificial Sequence
  Description of Artificial Sequence: Synthetic coding sequence
atgccgctcaacgtgtctttcactaatagaaactacgatcttgattacgactccgtgcagccatacttttactgtgatgaggaagagaacttttatcaacagcagcagcaaagcgaactccagcctcctgccccatccgaagatatctggaagaaatttgaattgctgcctacgccacctctctcaccctccagacgcagcggcctgtgtagccccagctatgtggcagtcactccattctcgttgcggggggataacgatggaggtggcggttccttttcgaccgcagaccagttggagatggttaccgagctgctgggaggagacatggtgaaccaatcgtttatctgcgatccggatgacgaaaccttcatcaagaatatcatcatccaggattgtatgtggtcggggttcagcgcagccgctaaacttgtgtcagaaaagctggcatcatatcaagccgcaagaaaggattcgggaagcccaaacccagcacgcgggcattcggtgtgctcaacctcgtctctttatcttcaagatctctcggcggcagcctcggaatgtattgatccgtccgtggtgtttccgtaccctctgaacgattccagcagccctaagtcatgcgcatcgcaagattcctcggccttctccccctcatcggactcacttctttcctcgaccgagtcctctccccaaggatccccagaaccactggtcctgcacgaagaaaccccacctactacctcgtcagattcagaagaggagcaagaggacgaagaggaaatcgatgtggtgtcagtggaaaagcggcaagcaccagggaagagatcggagtcgggttcaccatcggctggaggccatagcaaacctcctcattcgcctttggtcctgaagcgctgtcacgttagcacgcatcaacacaattacgcagctcctccctcgactcgaaaagattaccctgccgcgaaaagagtgaaactcgactccgtgcgcgtgctcaggcaaatttcaaacaacaggaaatgcacttcaccccgttcgagcgataccgaagaaaatgtgaaaagaaggacccacaacgtgctggaacggcagcggagaaacgaacttaagcgctcatttttcgcccttcgagatcagattcccgaacttgagaataatgagaaagcaccaaaggtcgttatactcaagaaggctactgcatacattctgtcggtccaggcagaagaacagaagctgattagcgaagaggatctcctccgtaagcggagagaacaacttaaacacaagctcgagcaactcagaaattcatgtgcc

SEQ ID NO: 21216 - DNA, 1317 bp, Artificial Sequence; identical to SEQ ID NO: 21215
  Description of Artificial Sequence: Synthetic coding sequence

SEQ ID NO: 21217 - DNA, 1317 bp, Artificial Sequence
  Description of Artificial Sequence: Synthetic coding sequence
atgccactgaatgtgtcgttcactaacagaaactacgaccttgactacgattccgtccaaccttacttttactgcgacgaggaagaaaacttttaccaacagcagcaacagagtgaattgcagcctccggctcctagcgaggatatttggaagaaattcgaactgttgccaaccccgccgctgagtccaagcagacgctcgggactgtgctccccgtcgtacgttgccgtgaccccgttctccctgcgcggggataacgacggaggcggaggatccttctcgaccgcggatcaactggagatggtaactgaactcctgggtggggatatggtgaaccagagcttcatttgcgacccggatgacgagactttcatcaagaacatcattatccaggactgtatgtggagtggattctcggccgcggctaagctggtatctgaaaaactggcctcgtaccaagccgcaagaaaggattcggggagcccgaacccagcgcgcgggcattcagtgtgctccaccagctcactgtacctgcaagacttgtccgctgctgcgtctgaatgcatcgatccatcagtggtgttcccgtacccgcttaacgactcatcttcaccgaagtcttgtgcatcgcaggacagcagcgcattcagcccgtctagcgactcgctgctgtcaagcaccgagagctccccgcaggggtcgccagaacccttggtgcttcatgaagaaacgccgccgacgacttcatcagactcagaagaggaacaggaggatgaggaagagatcgatgtggtttcggtcgaaaagcgccaggcgccagggaagcgctcggagagcggatccccctcggcaggaggccactcgaagccgcctcactccccgctcgtgctcaaacgctgccacgtctcaacccaccaacacaattatgccgccccgccatcgacccgcaaagattaccccgcagccaagcgggtgaagctcgacagcgtgcgcgtgcttcgccaaatcagcaataatcggaagtgtacttcgccaaggtcgtcggacaccgaggaaaatgtgaagcggagaactcacaatgtgctcgagcgtcagcggcgcaatgaactgaaaagatctttctttgccctcagagatcagatcccggagctggaaaacaacgaaaaggccccgaaggtggtgatcctgaaaaaggcgaccgcttacatcctgagcgtgcaagcggaagagcagaagttgatctcggaggaggacctcctgcggaagagaagggagcaactcaagcataagctggagcagctccggaactcatgcgcg

SEQ ID NO: 21218 - DNA, 1317 bp, Artificial Sequence; identical to SEQ ID NO: 21217
  Description of Artificial Sequence: Synthetic coding sequence

SEQ ID NO: 21219 - DNA, 1317 bp, Artificial Sequence
  Description of Artificial Sequence: Synthetic coding sequence
atgcctctgaacgtgtcgtttactaatagaaactatgaccttgactacgacagcgtccaaccgtacttctactgcgacgaagaagagaacttctaccagcagcaacagcaatccgaactgcagccaccagcgccctcagaagatatctggaagaaatttgagctgctgccgaccccgcctctgtcaccctccagacgatctggactgtgttcgccttcctacgtggccgtcaccccgttctcgctgagaggcgacaacgacggaggcggcgggtcgttcagcaccgctgaccagctcgagatggtcacggagttgctcggaggagacatggtgaatcagtcatttatctgcgacccggatgacgaaactttcattaagaacattatcatccaagattgcatgtggtcggggttcagcgcggccgccaagctggtgtcagaaaagttggcgagctaccaggcagcccggaaagacagcggatcgccgaacccggcgaggggccatagcgtctgctcaacttcatcgctctacctgcaagacctcagcgcagctgcctcggagtgcatcgacccttccgtggttttcccctacccgctgaacgattcctccagcccgaaatcctgcgccagccaggacagctccgcattttccccgtcgtccgatagcctcctgtcctcaaccgaatcgtcgccacagggatcgccagaacctctggtgctgcatgaggaaactccaccgaccacgtccagtgattcggaggaagagcaggaagatgaggaggaaatcgatgtcgtgagcgtcgagaagagacaggccccgggaaagcggtccgagtccggtagtccatcagcgggtggacattcaaagcctccacattccccactcgtgctcaaacggtgccacgtgtccactcaccaacacaattacgccgctccgccatcgacccgtaaggactaccccgcagcgaagcgcgttaagctggattcggtgcgggtgctccggcaaatttcgaacaatcggaagtgtacttcgccccgctcctcagataccgaagagaatgtgaaacgcaggactcacaacgtgctggaacgccagcgccgcaacgagcttaagagatcattcttcgctttgcgcgaccaaatcccggagctcgaaaacaatgaaaaagcacctaaggtcgtgatcctcaagaaagccaccgcctacatccttagcgtgcaggccgaagaacaaaaactgatcagcgaggaagatctgctgcgaaagcgcagggaacagctgaagcacaagttggagcagcttcggaattcttgtgct

SEQ ID NO: 21220 - DNA, 1317 bp, Artificial Sequence; identical to SEQ ID NO: 21219
  Description of Artificial Sequence: Synthetic coding sequence

SEQ ID NO: 21221 - DNA, 1317 bp, Artificial Sequence
  Description of Artificial Sequence: Synthetic coding sequence
atgccactgaacgtttcgttcactaatcggaactacgacctggattacgattccgtccaaccgtacttttactgtgatgaggaggaaaacttctaccaacagcagcagcagtccgagctccagccgcccgccccgagcgaggacatctggaagaaattcgaactgttgccaaccccacctctttcaccgtcgcggcgctcgggcttgtgctcgccttcttacgtggccgtcactccgttctcgctgcggggcgacaacgatggtggtggtggttccttttcaaccgccgaccagctcgaaatggtgactgagctgctcggaggagatatggtcaatcaatcgttcatttgcgatccggacgacgagactttcatcaagaacattatcattcaagactgcatgtggtccggattttccgcggccgcgaaactggtgagcgagaaactggcgtcctaccaggcggcaagaaaggactccggatccccgaatccggcaaggggacactccgtgtgtagcacttcatccttgtacctgcaggacctgagcgccgcggcaagtgaatgcattgacccatctgtggtctttccgtaccctctgaacgactcctcgagcccaaaaagctgtgcctcccaggattcatcggctttctcaccgtcatcggactcccttctgtcctccaccgaaagctcaccgcagggatcccccgagccactcgtgctccatgaggaaactccgcctacgaccagcagcgactcggaagaagagcaggaggacgaggaagaaatcgacgtggtgtccgtcgaaaagaggcaggccccgggtaagagatcggagtctggctcaccgagcgctggaggccatagcaagccgccacacagcccactggtgctcaagcgctgccacgtgtcgactcaccagcacaattacgccgccccacctagcactcggaaggactacccggcagccaaacgggtcaaactggattcggtcagggtgctgcggcagatctctaacaatcgcaaatgcacctccccgcggtcgagcgatactgaagaaaacgtgaagcgccgcactcacaacgtcctggagcgccagcggcgcaacgaactgaagcgcagctttttcgctctgcgcgaccagatcccggagctggaaaacaatgaaaaggcaccaaaagtcgtgatccttaagaaggccactgcttacattttgtccgtgcaggcggaggaacagaagctgatcagcgaagaggaccttctgcgcaagcgccgagagcaacttaagcacaagttggagcagctgcgcaactcgtgcgcg

SEQ ID NO: 21222 - DNA, 1317 bp, Artificial Sequence; identical to SEQ ID NO: 21221
  Description of Artificial Sequence: Synthetic coding sequence

SEQ ID NO: 21223 - DNA, 1317 bp, Artificial Sequence
  Description of Artificial Sequence: Synthetic coding sequence
atgcccctgaacgtctcttttacgaataggaactatgacctggactatgattctgtgcagccttacttctactgtgacgaggaagaaaatttttaccagcagcagcaacagtcagaactccagccccctgctccttctgaagatatctggaaaaagttcgaactgctgcctaccccgccgctgtcgccatctcgacgcagcggtctgtgttcacccagctatgtcgccgtgacccctttcagtctgaggggagataatgacgggggcggcgggtctttttccactgcggaccagctggaaatggttactgaactgctgggcggcgacatggtgaaccagagcttcatctgcgaccccgacgacgagacatttataaagaacattattatacaagattgtatgtggtccgggttctccgccgcggcgaagctggtgtcagaaaaactggcctcctaccaagctgctaggaaggacagcggctctccaaacccagctagaggtcactccgtgtgctcgacctcatctctgtacctgcaggatctctccgcggccgcaagtgaatgcattgatcccagtgtggtgttcccctatcccctcaacgacagcagctcacctaaaagttgcgccagccaagattcctcagcgtttagtccttcctccgacagcctactttcatccactgagagcagtcctcagggttcaccagaacccctcgtgctccatgaggaaaccccccccactacaagttctgattccgaggaagagcaggaggatgaagaggaaattgatgtggtgtctgtggagaagcgtcaggcacccgggaaaaggagtgagtcaggaagtccatctgccggcggccatagcaagcctccccacagtcctttagtcctgaagcgatgccatgtgtctacacaccagcacaattacgctgctccacctagcactagaaaggattatcccgctgccaagcgcgtcaagctagattctgtgagggtgctgaggcagatttcaaataacagaaaatgcacaagccccaggtcatccgacaccgaagaaaacgtcaaacggcgcacacataatgtcctggagaggcagcgacgtaatgagttgaaaagaagcttctttgccctgcgtgaccaaatcccagaactggagaataacgagaaggctccaaaagtcgtgatcctgaaaaaggccaccgcttacatcctgagcgtccaggcggaagagcagaagctgatctcagaggaggatttgttgcgaaagcgaagggagcaattaaaacataaactagaacagttgcgaaacagctgcgca

SEQ ID NO: 21224 - DNA, 1317 bp, Artificial Sequence; identical to SEQ ID NO: 21223
  Description of Artificial Sequence: Synthetic coding sequence

SEQ ID NO: 21225 - DNA, 1317 bp, Artificial Sequence
  Description of Artificial Sequence: Synthetic coding sequence
atgcccctcaatgtcagcttcactaatcgcaattacgatctggattacgactcggtgcagccttacttttactgcgatgaagaagaaaacttctatcaacagcagcaacagtccgaactgcagccgccggccccatcagaggacatctggaaaaagtttgaactcctgccgactccacccctgtcgccctcacggcggagcgggctgtgctccccatcctacgtggccgtcactcctttctcgttgcgcggagacaatgatgggggaggcggatcattctcgacggcagatcagctggaaatggttaccgagctgctgggcggtgatatggtgaaccagtcctttatctgcgatcctgacgacgaaaccttcattaagaacataatcatccaagactgcatgtggagcggattctccgcagcggcaaagctcgtgagtgaaaagctggcgtcgtaccaagccgcccggaaggactccggaagcccgaacccagcacggggacattcagtgtgtagcaccagttcattgtatcttcaagacctctccgccgccgcgtcggagtgcattgacccatccgtggttttcccataccctcttaacgactcatccagccccaaatcctgtgcctcccaagactcctcagctttctcgcctagtagcgatagcttgctgtcgagtacggaatcgtccccacagggatcaccagaaccgctggtgctccacgaggaaactccaccgaccacctcttcggattcggaagaagagcaggaggatgaagaggagatagacgtcgtcagcgtcgagaaaagacaggcacccgggaaacgcagcgagtcgggctccccgtctgccggtggccacagcaagccaccgcattccccgctggtgctgaaacggtgccatgtgagcactcaccagcacaattacgccgcgcctccgtccactcgcaaggactaccctgcagctaagcgagtcaagctcgattccgtgcgggtgcttcgccagatctctaacaatcggaaatgcacttccccacgcagcagcgacactgaagagaatgtgaaacgcagaacccataacgtgcttgagcggcagcgccggaacgaactcaagagatcgtttttcgccctccgcgaccagatccctgaacttgaaaacaacgagaaagccccgaaggtggtgatcctgaagaaggcgaccgcctacatcctctccgtccaggcggaggagcagaaactgatctcggaggaggatctcctgcgcaagaggcgcgagcaactgaaacacaagctggagcaactgcggaacagctgtgcc

SEQ ID NO: 21226 - DNA, 1317 bp, Artificial Sequence; identical to SEQ ID NO: 21225
  Description of Artificial Sequence: Synthetic coding sequence

SEQ ID NO: 21227 - DNA, 1317 bp, Artificial Sequence
  Description of Artificial Sequence: Synthetic coding sequence
atgccactcaacgtgtcgttcaccaatcgcaactacgatcttgattacgattccgtgcaaccttacttttactgtgacgaggaggagaacttttaccaacaacagcaacagtcagaattgcagcctccggcaccttcagaagatatttggaagaagtttgaactccttcccactcccccactgtccccatcaagaagatccggactttgttcgcctagctacgtggcagtgacccctttcagcctgagaggagacaacgatggaggcgggggtagcttttctactgcagatcaacttgaaatggtgaccgagcttctcggaggagatatggtcaaccagtcatttatctgtgatccagatgacgaaactttcataaagaacatcattattcaagattgtatgtggagcggtttctcggcagctgcgaagctggtgtccgagaaactcgcatcgtatcaagcagcgcgcaaggatagtggtagccccaaccctgcacgcggacactccgtgtgttcaacctcgtcactgtaccttcaggatctgagcgcagctgcctcggaatgtatcgatccttccgttgtgtttccttaccccctcaacgactcatcctcgccgaagagctgtgcatcccaagattcgtccgcgttctcgccctcatcggattcccttctgtcatcaactgagagttcccctcaagggtcacccgaacccctggtgctgcacgaggaaactcctccaactactagctcagattcggaggaggagcaagaggacgaagaagaaatcgacgtggtgtcagtggaaaagagacaggcaccaggtaagcgctcagaaagcggatccccttcggccggaggacactccaaaccgcctcattccccgcttgtgctgaaacggtgccatgtgtccactcaccaacacaattacgcagctccaccttcgacccgtaaggattaccctgcagcaaaacgcgttaagctggattccgtccgagtgcttcggcaaattagcaacaatcgaaaatgtaccagcccgcgctcgtccgataccgaggagaatgtgaaaaggaggactcataatgtgcttgagagacagcgcagaaatgagctgaagcggtcattcttcgcactgcgtgatcagattcctgaactggaaaacaacgagaaggcgccaaaggtcgtgatcctgaagaaggcaaccgcctacattctctcagtgcaggccgaagaacaaaagttgatttcggaagaagatcttttgaggaaaagaagggaacagcttaaacacaagctcgaacagcttcgaaacagctgtgca

SEQ ID NO: 21228 - DNA, 1317 bp, Artificial Sequence; identical to SEQ ID NO: 21227
  Description of Artificial Sequence: Synthetic coding sequence

SEQ ID NO: 21229 - DNA, 1317 bp, Artificial Sequence
  Description of Artificial Sequence: Synthetic coding sequence
atgccactaaacgtctcctttacaaataggaactacgacctcgattatgattcagtgcaaccgtacttttattgcgatgaggaggaaaatttttaccaacagcagcagcaatccgagctgcagccccctgccccatccgaggatatctggaagaaatttgagctcctgcctacaccgccactgtcccccagtaggcgctctgggttatgctctccatcttatgtcgccgtcactcctttttcacttagaggcgacaacgatggcggtgggggttctttttcaaccgcggatcagcttgaaatggtcaccgaattattgggcggggacatggttaaccaatctttcatctgcgaccctgacgacgagaccttcataaaaaatattatcatccaggattgtatgtggagcggcttctcagcagccgccaaactggtgtcagaaaagcttgcctcttaccaagctgcgagaaaggattcgggaagtcccaatcccgcacggggtcactccgtatgttccacttcatctctgtatctacaggatttgagcgctgcggcttccgagtgcatcgaccccagtgtcgtttttccgtaccctctgaacgattccagcagcccaaagagttgtgcaagccaggatagctctgccttcagcccaagctccgattctcttctgagcagcactgagtcatcccctcagggttccccagagcctctggtgcttcatgaggagactccccctactacttcgtccgactccgaggaggaacaggaagatgaggaagaaattgatgtggtatccgtggagaagagacaggctccgggcaagcggtcagaatctggaagcccatcagcaggaggtcacagcaaacccccgcacagccccctggtgctcaaaagatgccatgtctctacacaccagcataattacgccgcgccgcctagcacccggaaggattaccctgctgccaagagggtcaagctggatagtgttcgcgttctcaggcaaatctccaacaataggaaatgtacatcaccccggtcaagcgatacagaggagaatgtaaaacggagaacccataatgtgttggaacggcaacgtcgaaatgagcttaagcggtcctttttcgcgttgcgcgatcagatcccagaacttgaaaacaacgagaaagcccctaaggtggtgatcctaaagaaggcaaccgcatatattctctccgtccaggcggaggagcagaagctgatctctgaggaggacctccttcgcaagcgccgagagcagttaaagcataagttggaacagctccgaaattcatgcgcc

SEQ ID NO: 21230 - DNA, 1317 bp, Artificial Sequence; identical to SEQ ID NO: 21229
  Description of Artificial Sequence: Synthetic coding sequence

SEQ ID NO: 21231 - DNA, 1317 bp, Artificial Sequence
  Description of Artificial Sequence: Synthetic coding sequence
atgccactcaatgtgtccttcaccaaccgcaactacgacttggattacgatagcgtgcagccttacttctactgtgatgaggaggaaaacttttatcaacagcagcagcaatccgaactccaaccacccgccccttcggaagatatctggaagaagtttgagcttctgccgaccccaccgctttcaccttcgagaaggtccggtttgtgttccccttcatacgtcgcagtgaccccgtttagcctccgcggagacaatgatggaggaggaggatcatttagcacggcagaccagcttgagatggtgaccgagctccttggaggtgacatggtgaatcagtcgttcatttgtgatcccgacgacgaaactttcatcaagaatatcattatccaagactgcatgtggtcgggattctccgccgcagccaagctcgtgtcggaaaagctggcgtcctaccaggccgccagaaaagactccggatcaccaaaccctgcacgcgggcatagcgtttgcagcacctccagcctgtacctccaggacctgagtgcggctgctagcgaatgcatcgatccctccgtcgtattcccgtaccccctgaacgattcctcctccccgaagtcgtgcgcctcacaagatagttccgcattctccccgtcatccgactccctgctgtcgtcgaccgagtcgtcaccgcagggatcgccagagccactggtccttcatgaagaaaccccgcccactacctcgtctgactccgaagaagaacaggaagatgaggaagagatcgacgtcgtctccgtcgagaaacggcaagcgccaggcaaacgctctgagtcaggtagcccgtccgccggaggccactcaaagccgccacactcacctctggtgctgaagcgctgccatgtgtcaactcatcagcacaactacgccgctccaccgtcgactaggaaggactacccagccgctaagagggtgaaacttgattcggtgagggtgctgcgccagatctcgaacaatcgcaaatgcactagcccccggagctcagacactgaggaaaacgtgaagcggcggacccacaacgtgttggagaggcagcggcgcaatgaactgaagaggtctttcttcgctctgcgagatcaaatccccgaactggagaacaatgagaaagcacctaaggtggtcatcctcaaaaaggctactgcctacatcctgtcggtgcaagcggaagagcaaaaacttatcagcgaggaggatctgctgcgcaagagaagagagcagcttaaacacaagctggaacaactgcggaattcttgtgcg

SEQ ID NO: 21232 - DNA, 1317 bp, Artificial Sequence; identical to SEQ ID NO: 21231
  Description of Artificial Sequence: Synthetic coding sequence

SEQ ID NO: 21233 - DNA, 1317 bp, Artificial Sequence
  Description of Artificial Sequence: Synthetic coding sequence
atgcccctgaatgtgtctttcacaaacaggaattatgatctggactatgactcagtgcagccttacttctattgcgacgaagaagagaacttttatcagcaacagcagcagtccgaactccagccccccgctccttccgaggacatatggaaaaagttcgagctgcttcctactccgcctctgtcacctagccgaagaagcgggctgtgctctccatcttacgtggcagtcacacctttctcactgagaggggataatgatgggggtgggggatctttcagcaccgccgatcagctcgagatggtgacagaattgttgggtggcgatatggttaatcaaagttttatttgtgacccagatgatgagacgtttataaagaacatcattattcaggactgcatgtggtctggcttcagcgccgctgcaaagttggtttcagagaaactggcaagctaccaggccgcaaggaaggattctggatcacctaaccccgctcgaggtcactcagtttgcagtacgtctagtctctatttgcaggacctgtccgcagctgcttctgagtgtatagatcccagcgtggtttttccttaccccttgaacgacagtagcagcccaaagagctgcgcctctcaagacagctccgccttctccccaagttcagactctctgttgtcctctactgaaagctcaccacagggaagcccagagcctctggtactgcacgaggaaactccgcctactactagtagcgattccgaagaggaacaagaagatgaggaagagattgacgttgtctctgtggaaaagaggcaggcaccgggcaagaggtccgagtcaggttccccatcagccggggggcatagtaaacctcctcatagtcctttggtcctcaagagatgccatgtgagcactcaccagcacaattatgccgctcctccctcaacccgaaaggactatccagccgctaaacgggtcaaactggacagcgtgagagtcctgcggcagatttccaacaaccggaagtgcacgtcacccaggtccagcgataccgaggaaaacgttaaacgccggacccataatgtgctggagcggcagcgcaggaatgagctgaagaggtctttcttcgcattgagagaccaaatcccagaactggaaaataatgagaaggcacctaaggttgtgatccttaagaaagccaccgcttacatcttgtctgtgcaggctgaggagcaaaaactgatttcagaggaggacttgctcaggaagaggagggaacaactgaaacataaactcgaacagctgcggaatagctgtgca

SEQ ID NO: 21234 - DNA, 1317 bp, Artificial Sequence; identical to SEQ ID NO: 21233
  Description of Artificial Sequence: Synthetic coding sequence

SEQ ID NO: 21235 - DNA, 1317 bp, Artificial Sequence
  Description of Artificial Sequence: Synthetic coding sequence
atgccactcaacgtaagctttacaaacaggaactacgaccttgattacgatagcgtacagccatatttttattgtgacgaggaagagaacttctaccagcagcagcagcagtctgagctccaacccccagctccttcagaggatatctggaagaagttcgagcttctgcctacccccccactgtctcctagtcgtagatctggactgtgttccccttcatacgtcgccgtcactccatttagcttgcgcggtgacaacgatggcggtggtggcagctttagtactgctgatcagctggagatggtaacagagctgctgggcggtgacatggttaatcaatcatttatatgtgatcccgacgacgagacattcatcaagaacatcatcatccaggattgcatgtggtctggcttctcagccgctgcaaaactggtgagtgagaagcttgcctcataccaggcagcaaggaaggacagcggcagccctaaccccgccagaggtcattctgtgtgttctacatcatcattgtacctgcaagatctgtcagctgccgcaagcgagtgcatcgacccttctgtggtgtttccctaccctctcaacgactcatcatcccccaaatcctgcgccagccaggactctagtgcttttagccctagttccgactccctgctgagctccaccgagtcatcaccacagggtagtccagagcctctcgtcctgcacgaggagacaccaccaaccacaagctctgacagtgaagaagagcaggaggatgaggaagaaatagacgtggtcagcgtggaaaagaggcaggccccaggaaaaagatctgaatctggatccccaagcgctggcggacactctaagccccctcactctccccttgtattgaagcgttgtcatgtttccacccatcagcacaactatgctgctcccccttcaactagaaaggactatcctgcagccaagagagtcaagctggactcagtgcgtgtgctcaggcagatatctaacaacagaaagtgtacatctccacgtagtagcgacacagaggaaaacgtgaaacgccgcacacacaacgtgctggagcgccaacgccgcaatgagctgaaacgctccttctttgccctgcgcgaccaaattccagaactggaaaacaacgagaaagctcccaaggtagtcattttgaaaaaggctactgcctatatcttgtcagttcaagcagaggagcagaaacttatttccgaggaggacttgctcaggaagaggagggaacagcttaagcataagctcgaacagctgaggaactcatgcgcc

SEQ ID NO: 21236 - DNA, 1317 bp, Artificial Sequence; identical to SEQ ID NO: 21235
  Description of Artificial Sequence: Synthetic coding sequence

SEQ ID NO: 21237 - DNA, 1317 bp, Artificial Sequence
  Description of Artificial Sequence: Synthetic coding sequence
atgccgctgaacgttagctttactaacagaaactacgacctggactacgacagcgtgcagccatacttttactgtgacgaagaggaaaacttttaccagcagcagcaacagtccgaactgcaacccccagccccttcagaagatatctggaaaaagtttgaactcctgccgaccccaccgctgtcccccagccggagaagcgggctgtgttccccatcctacgtcgcggtcactccgttctccctcagaggagataatgacggaggaggcggatccttttcaactgcagaccaactggaaatggtgaccgagctcctgggcggggacatggtgaaccaatcgtttatctgcgacccggatgatgaaacgttcatcaagaacataatcattcaggactgcatgtggtcaggattctcggcggcggcaaagctggtgtcggagaagctcgcatcctaccaggccgcccggaaggatagcggctcgccgaaccccgcaaggggtcattcagtgtgctcaactagctccctctatctccaggatctgagcgcggctgctagcgagtgcatcgacccatcggtggtctttccgtaccctctcaatgactcctcctcgcctaagtcgtgcgccagccaggactcatcagcgttctcgccgtcatccgactccttgctcagctcgactgagtcctcaccacagggtagcccagagccactggtgctccatgaagaaaccccgccaaccaccagctcggactccgaggaagagcaagaggacgaggaggaaatcgatgttgtctccgtggaaaagcgccaggccccaggaaagagaagcgaatccggatctccatcggcaggtggccattcaaaaccgccccactcccccctggttctgaagcgatgtcatgtgtctacccaccaacacaactacgccgcgcccccgtcgacccggaaggattaccccgcggcaaagagagtcaagctggactcggtgcgggtgctgcgccaaatctccaacaataggaagtgtacctccccccggtcctcggacactgaggaaaacgtgaagcggcgcactcacaacgtcctcgaaagacagcgccgcaatgagctcaaacggtcgttctttgccctccgcgaccagatccctgagcttgagaataacgaaaaggctccgaaagtggtgatcctgaagaaagcgactgcatacatcctcagcgtgcaagccgaagagcagaaactcatttccgaagaagatctgctgcgcaaacggagggagcaactgaagcacaaattggagcaactgcgcaactcgtgcgct

SEQ ID NO: 21238 - DNA, 1317 bp, Artificial Sequence; identical to SEQ ID NO: 21237
  Description of Artificial Sequence: Synthetic coding sequence

SEQ ID NO: 21239 - DNA, 1317 bp, Artificial Sequence
  Description of Artificial Sequence: Synthetic coding sequence
atgcccctcaatgtcagcttcacgaaccgcaactatgacttagattatgacagcgtccaaccatatttctactgcgacgaggaggagaatttctaccaacagcagcagcagagtgagctgcagcctccagctccaagcgaagatatttggaaaaaattcgaactactgccgactcccccattgagcccatcccgacggtcaggattgtgtagtccatcctacgtggctgtgacccctttctctcttcgaggggacaacgatggagggggagggtcattctccaccgccgaccagcttgaaatggtgacggagctgcttgggggggatatggtcaatcaatcattcatttgtgaccctgacgatgagacctttatcaagaatattatcatacaggactgtatgtggagcgggtttagcgcagcggcaaagctggtctcagaaaaattggcctcctatcaggcagctcgtaaagatagcggtagcccaaatcccgccagaggacattcagtgtgtagcacgagttccctgtacctccaagatctgagcgcagctgcttctgagtgtatcgacccaagcgtggtctttccgtaccccctgaatgattcctcatcacctaaatcttgcgccagccaggactcaagcgctttctccccgtcatcggacagtctcctgagctccacagaatcgtccccccaaggtagcccagagcccttggtcttgcacgaggagactcctcccaccacatcttctgactctgaggaggagcaggaagacgaagaggaaatcgatgtcgtgagcgtggagaaaaggcaggcccccgggaagcggagcgaaagtgggtcaccatccgccggtgggcactccaagccaccccattcgcctttggtgctgaaacggtgtcatgtttctacgcaccagcacaattacgccgctcctcccagtacgagaaaggattaccccgctgccaagagggtgaaactggacagtgtaagagttttgagacagatctccaacaacagaaaatgcaccagccctaggtcctctgacacagaggagaacgtgaagcgccgcacccataatgtgctggagcggcagcgtagaaatgagctgaagcggtcttttttcgccttgagagaccaaatccccgaactcgaaaacaatgagaaggctcccaaagttgtgatcctgaagaaggcaacagcctatatcctaagtgtgcaggcggaggaacaaaaattaatctctgaggaagacctgcttcggaagagaagagaacagctcaaacacaagctggaacagctgagaaattcctgcgca

SEQ ID NO: 21240 - DNA, 1317 bp, Artificial Sequence; identical to SEQ ID NO: 21239
  Description of Artificial Sequence: Synthetic coding sequence

SEQ ID NO: 21241 - DNA, 1317 bp, Artificial Sequence
  Description of Artificial Sequence: Synthetic coding sequence
atgccacttaacgtgtccttcactaaccgcaactatgacctggactatgactccgtgcaaccttacttctattgtgatgaggaggagaacttctatcagcagcagcaacagtcagaacttcaaccaccggccccctcagaagacatctggaaaaagttcgaattgctcccaaccccccccctgagtccttctagacgctcagggctgtgctcccccagttacgtcgcggtgacccccttttcacttcggggcgataacgacgggggcggagggagcttcagcactgccgaccagctggagatggtcacagagctgctggggggagacatggtaaatcagtcgtttatttgcgacccggatgatgagacattcataaagaacatcatcatccaggattgcatgtggtctggcttcagcgcagccgccaagctggtgtctgagaagctagcatcataccaggccgcgcggaaagattccggatcacccaatccagctcgtggtcatagcgtttgcagcacttcctcactctaccttcaggatctcagcgctgctgcttctgagtgcattgatccgtccgtggtgtttccttatccacttaacgacagttcaagccctaaatcctgtgcgtcccaagatagttctgccttctcaccaagcagtgattctctgctgagcagcacggagagctctcctcaggggtcccccgagccattggttctgcacgaagagacgccccccacaacatcctctgattcggaagaagaacaagaggacgaagaggaaatcgacgttgtgtccgttgaaaaaagacaggcccctggaaaaaggtcggagagcggttctccatccgccggagggcacagcaagccaccgcatagccccttagtactgaaaaggtgtcacgtgtctacccaccagcataattatgccgcgccgccctcaacacgaaaggactatccggcggctaaacgggtgaagcttgatagcgttcgggtcctgcgacaaattagcaacaaccggaaatgtactagcccccgatcatcggacaccgaagaaaacgtgaagagaaggacacataacgtgctcgaaagacagaggcggaatgagctcaagagatccttttttgctttgagggatcagatacccgaacttgagaacaatgagaaggcacctaaggttgtgatcctgaaaaaagcaacagcttacatccttagcgtccaggccgaggagcagaaactcatctcagaggaagatcttctgagaaagagaagggaacagcttaaacacaaacttgagcagttacggaacagttgcgca

SEQ ID NO: 21242 - DNA, 1317 bp, Artificial Sequence; identical to SEQ ID NO: 21241
  Description of Artificial Sequence: Synthetic coding sequence

SEQ ID NO: 21243 - DNA, 1317 bp, Artificial Sequence
  Description of Artificial Sequence: Synthetic coding sequence
atgcctctcaacgtcagttttactaatcggaattacgacctggattacgacagcgtgcaaccttacttctactgcgacgaggaggaaaatttttatcaacagcagcagcagtctgaactccagcccccagccccctccgaagacatttggaaaaaattcgagctgttaccaacacctcccctctctccgagccgccggtccgggctgtgcagtccgtcctacgtggccgttacgcctttctctctccggggtgacaatgacggcggaggcggaagtttctctacagccgatcaactggaaatggtgaccgaactgttgggaggtgacatggtcaaccagagctttatctgcgatccagacgacgagacctttatcaagaatattataattcaggactgtatgtggtccggtttttcagcggcagctaagttggtgagcgagaagctcgccagctatcaggcggctcgtaaggactccggttcaccgaatcccgcacgtggccacagcgtctgttctacctcctctctgtacttgcaggacctgtccgccgctgcaagcgagtgcatcgacccaagcgttgtgttcccttatccattgaacgacagctctagccccaagtcctgcgccagtcaagactcctcagcattttcaccatcctcggatagcctgctgtcttccaccgaaagctcaccacaaggctcaccagagcccctggttctgcacgaagagactccacctactacaagctccgattccgaggaggagcaggaggatgaggaggaaattgacgtggtgtcagtggagaaaagacaggccccgggaaagcgatccgagagcggatcccccagtgctggtggacatagtaaacccccccattccccactggtcctgaagagatgtcacgtttctacccatcagcacaactatgcggcgcccccttctacacgcaaagattatcccgccgccaaacgagtgaagctcgattcagtgcgcgtgctgaggcagataagtaacaaccgcaagtgtacatcacctcggtccagcgatactgaggagaacgttaagcggaggactcacaatgtgctggaacgtcagcgacgaaatgagctgaagaggtcatttttcgccctgcgggaccagatcccagagctagagaacaacgagaaggcccccaaagttgtgatcctcaagaaggctacggcgtacatcctgtccgtccaggctgaggaacagaaattgatttccgaggaggacctcctgaggaagcgccgagagcagctgaagcacaagttagagcagcttcgtaactcatgcgca

SEQ ID NO: 21244 - DNA, 1317 bp, Artificial Sequence; identical to SEQ ID NO: 21243
  Description of Artificial Sequence: Synthetic coding sequence

SEQ ID NO: 21245 - DNA, 1317 bp, Artificial Sequence
  Description of Artificial Sequence: Synthetic coding sequence
atgcctttgaacgtgtcgttcactaataggaactatgacctggattacgactcagtgcagccgtacttctactgcgatgaggaagagaacttctaccagcaacagcagcaatcagaacttcagcctccggcgccgtcggaggatatctggaagaaattcgagttgctgccgacgccgccgctcagcccgagccgccggtcaggcctctgctccccaagctacgtggcagtgaccccgttctccctcagaggagacaatgacggaggagggggctcctttagcactgccgaccaactggagatggtgactgagctgctgggaggagacatggtgaaccagtccttcatctgcgatccggacgacgaaactttcatcaagaacatcatcatccaagattgcatgtggagcggattttctgcagcagctaaattggtgtcagagaaactcgcctcatatcaggcagccagaaaggactcgggcagccccaacccggccagaggacactcagtgtgcagcacttcgtcgctgtacctgcaagacctgtccgccgcagcttcggagtgcatcgaccctagcgtggtgtttccataccccttgaacgactcgtccagcccaaagtcgtgtgcgtcccaggacagctccgccttcagcccgtcctcggacagcctcctgtcatcgaccgagtcctcgccacaggggtccccggagccgctcgtcctgcacgaagaaaccccgccaacgacttccagtgatagcgaggaggaacaggaagatgaggaagaaatcgatgtggtttccgtggaaaagagacaggctcctggaaagcgctcggagtcgggaagcccgagcgccggaggacatagcaaaccgccccactctcctctggtcctgaaacggtgtcacgtctccacccaccagcacaactacgccgccccgccctcgactcggaaggactacccggccgcaaaacgggtgaagttggacagcgtccgggtgctccgccaaatctcaaacaacagaaaatgtacctcacctcgctcatccgacacggaagagaatgtgaaaaggaggacccataatgtccttgaacggcagcgccgcaacgaactgaagcggagctttttcgcgcttcgggaccagatcccagaactggagaataacgaaaaggccccgaaggtggtcatcttgaagaaggccacggcttacatcctttcagtgcaagctgaggaacagaaactgatctccgaagaggacctcctcagaaagcggcgcgagcaactgaagcacaagctggaacagcttagaaattcgtgcgca

SEQ ID NO: 21246 - DNA, 1317 bp, Artificial Sequence; identical to SEQ ID NO: 21245
  Description of Artificial Sequence: Synthetic coding sequence

SEQ ID NO: 21247 - DNA, 1317 bp, Artificial Sequence
  Description of Artificial Sequence: Synthetic coding sequence
atgcctctgaacgtgtcatttacaaataggaactacgacctcgattacgacagtgttcaaccatatttttactgcgacgaagaagagaacttctatcagcaacagcagcagagcgagctgcagccacctgctccatccgaggatatctggaagaaatttgagctcctaccaacacctcccctgagcccgtctagacggagcggcctctgctccccctcttacgtcgctgtgacgcctttcagtctccgaggagataatgatggagggggcgggtctttcagtactgctgaccagttagaaatggtgactgagctccttggcggggacatggtcaatcagagcttcatctgcgacccagacgatgagacttttatcaagaatatcattatccaagattgtatgtggtccggtttcagtgcagctgctaagctcgtttctgagaaactagcttcctaccaagccgcgagaaaggacagtgggtcacctaacccagctcgggggcactctgtttgtagcacgagcagcctctatctgcaagatctgtctgctgcggccagcgagtgcatagatccatcggttgtcttcccctacccactgaatgacagtagtagtcccaagtcctgcgcaagtcaggactctagcgcattctcaccaagttctgacagcctgctgagctccaccgagtcctccccacagggatcacctgagcctctcgtgctgcacgaggaaacccctcccacaacatcctccgattctgaggaggaacaggaggacgaggaggaaattgacgtcgtgtccgtggagaaacggcaggcaccagggaagcgatctgaatctggctccccctccgcagggggtcattccaagcctccgcactcccccctggtcctaaagcggtgtcatgtatctacccatcaacacaactatgccgctccccctagcacccggaaagactatcctgcggcaaagcgggtgaagctggattctgtgcgtgtgctgcgccagatcagtaacaaccgcaagtgcacgtctccaagaagttccgatactgaggagaacgtgaaacgacgaactcacaacgtcctagagcggcagcgacggaatgaactaaagaggtccttttttgctctgagagaccagatccctgagctggaaaacaacgagaaggctcccaaagtcgtcatcctgaagaaggctaccgcatacattttgtcagtgcaggcggaggagcaaaaactgatctccgaggaagacttgcttaggaagcgtcgtgaacagcttaagcataagcttgagcagctccgtaactcctgcgcc

SEQ ID NO: 21248 - DNA, 1317 bp, Artificial Sequence; identical to SEQ ID NO: 21247
  Description of Artificial Sequence: Synthetic coding sequence

SEQ ID NO: 21249 - DNA, 1317 bp, Artificial Sequence; identical to SEQ ID NO: 21229
  Description of Artificial Sequence: Synthetic coding sequence

SEQ ID NO: 21250 - DNA, 1317 bp, Artificial Sequence; identical to SEQ ID NO: 21229
  Description of Artificial Sequence: Synthetic coding sequence

SEQ ID NO: 21251 - DNA, 1317 bp, Artificial Sequence
  Description of Artificial Sequence: Synthetic coding sequence
atgccacttaatgtatcttttacaaacaggaactacgatctggactacgattccgtccagccctacttttactgtgatgaggaagaaaatttttaccagcagcagcagcagagcgaacttcagcctccagccccaagcgaagatatatggaaaaaatttgagctgctgcccacaccccctctctctccttctaggcgcagcggactgtgctctcccagctacgtcgcagtgactcccttcagtcttcggggggacaacgacggcggaggggggtctttcagcacagccgaccagctcgagatggtgacagagctgctcggaggcgatatggtcaatcagtcctttatttgcgatcccgatgatgaaacatttattaaaaacatcataatccaagactgcatgtggtccgggttctctgctgcggcgaaattggtgtcagagaaacttgcgtcctatcaagcagccaggaaggacagcggtagcccaaatccagctagaggtcattctgtctgcagcacgagctctctgtacctgcaagatctgtccgcagccgcttcagaatgtatcgaccccagtgtggtgtttccttacccgcttaatgactcatcgtcaccaaaatcatgcgcatcacaggattcctcagcctttagcccttcatccgattcgctgctctcaagcactgagtcgagtccccaaggaagccccgaaccactcgtcctgcacgaagagacacccccaacaacttctagtgatagtgaggaagagcaggaagacgaggaggaaatcgatgtggtttccgtggaaaagcggcaggcccctggtaagagatctgagagcggtagcccatcagcaggcggtcatagcaagccgccgcactccccactcgtgttgaagcgctgtcatgtgagcactcaccagcataattatgccgcacctccaagtacacggaaggactatcccgctgcgaagcgcgtcaagctagactccgtccgggtactgaggcagatttcaaacaaccggaagtgtactagccccaggagtagcgacacggaagagaacgtgaagagacgaacacataacgtgttagagcgccagcgcagaaacgaactgaaacgatcattttttgctctgagggaccaaatccccgagctggaaaataatgagaaggcacctaaagtggtcatactgaagaaagcaaccgcgtacatactgtctgtccaggccgaggaacaaaaactcatctccgaagaagatctgctgcggaagcgacgcgagcagctgaagcacaaacttgaacagttgaggaattcatgtgcg

SEQ ID NO: 21252 - DNA, 1317 bp, Artificial Sequence; identical to SEQ ID NO: 21251
  Description of Artificial Sequence: Synthetic coding sequence

SEQ ID NO: 21253 - DNA, 1317 bp, Artificial Sequence
  Description of Artificial Sequence: Synthetic coding sequence
atgccactgaacgtgtccttcaccaacaggaactacgacctggattacgattcagtgcagccgtacttctactgcgatgaagaagagaatttctaccaacaacagcagcagtcggaactccagccgccggccccgtcagaggacatctggaagaagtttgaacttctgccgactccgcccttgagcccgtccaggcgctccggcctgtgctccccgtcctacgtggctgttaccccgttttctctgcgcggagacaacgacggaggtggtgggtccttctccactgccgaccagttggaaatggtgactgagctccttggaggagatatggtgaatcagagcttcatctgcgacccggatgatgaaaccttcatcaaaaacatcatcatccaggattgcatgtggtctggcttcagcgcagccgcgaaactggtgagtgaaaaacttgcttcataccaggctgcccggaaggactcgggatccccgaatcccgcccgcggacactccgtctgctcgacctcgtcgctctacctgcaggatctgtcagcagcggcctcggaatgcatcgacccctctgtcgtctttccgtacccgttgaatgattcaagctcgccgaaaagctgcgcctcacaggattcttcagcgttcagcccttcatcagactcgttgctgagctccactgaatcgagcccgcagggatcgccggagcctctggtcctccacgaggaaactccgccaacgacctcatcggacagcgaagaagagcaagaggacgaggaagaaatcgatgtggtatcggtggagaagagacaggcccctgggaagcgcagcgaatcgggatctccttccgcaggaggccattcgaagcctcctcattcaccgctggtgctgaagcgctgccacgtgtccactcaccaacacaactacgcggcgcccccatcgactagaaaggactatcctgccgcaaagagagtgaaactcgactcagtgagggtcctccgccaaatctcgaataatcgcaaatgtacctcaccgcgctcatcagatacggaggagaacgtgaaacgccgcacccacaatgtcttggagcgccagagacggaacgagctcaagcggtcgttcttcgcgctgcgcgaccagatcccggagttggaaaacaatgaaaaggcaccaaaagtcgtgatcctcaagaaagcaacggcctatattctcagcgtgcaagcggaggaacagaagctgatctccgaagaggacctcctgcgcaagagacgcgaacaactgaagcacaaactcgagcagctgagaaactcgtgtgca

SEQ ID NO: 21254 - DNA, 1317 bp, Artificial Sequence; identical to SEQ ID NO: 21253
  Description of Artificial Sequence: Synthetic coding sequence

SEQ ID NO: 21255 - DNA, 1317 bp, Artificial Sequence
  Description of Artificial Sequence: Synthetic coding sequence
atgccactgaatgtgagcttcactaacagaaactacgacctggattacgactcggtgcagccttacttttactgtgatgaagaggagaacttctatcagcaacaacaacaatcagagctgcaaccacctgcgcccagcgaggatatctggaagaaatttgaacttctgcctaccccgccactgtcaccaagccgcaggtcgggactctgttcaccttcgtacgtggcagtcacgcctttttcccttcgcggagataatgatggtgggggtgggtcgttctctactgccgatcaattggaaatggtgactgagcttttgggaggagatatggtgaaccaatcgttcatctgtgatcctgacgatgaaactttcataaagaacatcatcattcaagactgcatgtggtcgggatttagcgcagcagctaaacttgtctccgaaaagttggcgagctatcaggcagctagaaaggattccggttcgcctaatcctgctagggggcactcagtgtgttcgacttccagcctttacctgcaagatctgagcgcagccgctagcgaatgcatagacccatccgtggtgttcccatacccgctgaatgattcctcatcaccaaaatcgtgcgcatcacaggattccagcgctttcagcccatcgtcggactcgcttcttagctccactgaatcgtcccctcaaggctcgcctgaaccgcttgtgcttcacgaggagactcccccaaccacctcctcggactcggaagaagagcaggaggatgaagaagaaattgatgttgtgtcggtggagaagcggcaggctccgggaaagaggtcagaatcgggatccccaagcgcgggtggtcatagcaagcccccgcattcaccactggtgctcaagcgatgtcatgtctcgactcatcaacataactacgcagccccgcccagtaccagaaaagattaccctgccgcaaagagggtgaaactggactcagtcagagtgctgagacaaatttctaataacagaaaatgtacctcgcctcgttccagcgatactgaagaaaacgtgaagagaaggacgcataacgtgcttgaaagacagcgcagaaatgaattgaaacggagcttctttgcacttagagatcaaatacccgaactggaaaacaatgaaaaggccccgaaggtagtgattctgaaaaaggcgaccgcctacatactgtcggtccaagcagaagagcaaaaactgattagcgaagaagatctgctgcgtaagcgcagagaacagcttaagcataagctcgaacagctccggaattcgtgcgca

SEQ ID NO: 21256 - DNA, 1317 bp, Artificial Sequence; identical to SEQ ID NO: 21255
  Description of Artificial Sequence: Synthetic coding sequence

SEQ ID NO: 21257 - DNA, 1317 bp, Artificial Sequence
  Description of Artificial Sequence: Synthetic coding sequence
atgcccctgaatgtctcttttaccaatcgaaattacgatcttgactacgactccgttcagccctacttctattgtgatgaggaagagaatttctatcagcagcagcaacagtctgagctacagccgccagccccttcagaggacatctggaagaagttcgaactgctgcctacacccccgctatcaccttctcgcagatcaggcctatgtagcccctcctacgtagccgttaccccctttagcttgcgcggcgacaatgacggcggcggaggaagcttctccaccgctgatcagctagagatggtgacagagctgctgggtggggacatggtgaatcagtccttcatttgcgatcccgacgatgaaacctttatcaagaatattattattcaggattgtatgtggagcgggttcagcgctgccgccaagctggtttccgaaaagctcgccagttaccaggccgccaggaaggattcaggtagtcccaatccggcacgggggcacagcgtatgtagcacttcttctctgtatcttcaggatctgagcgccgcagcttcggaatgtatcgatccctccgtggtgttcccctatccactcaacgattccagtagccccaaatcctgtgcgtctcaggattctagcgccttcagcccgtcttccgacagcttactctctagtactgaaagtagcccacaggggagtcctgagccgctggtgctgcacgaagagaccccccccacaacatcttccgactccgaggaggagcaggaggatgaagaggaaatcgacgtggtcagtgtggagaaacgacaggcccctggaaagcggtccgagtcgggatctccttccgcagggggacacagcaagccccctcactcccccctggtgctcaaacgatgtcacgtcagcactcatcagcacaattatgctgccccccctagcaccaggaaagattaccccgccgccaagagggtgaagctggactctgttagggtcctacggcagatcagcaataatcgaaaatgcacttctcctcggagcagtgacacggaggagaacgtgaaaaggagaacccacaatgtcctcgagcgccaaaggcggaatgagctcaaaagatcattctttgcacttcgcgaccagattcctgagctcgagaacaacgaaaaggccccaaaagtcgtgattctgaaaaaggctaccgcatacatattgagcgtgcaggccgaggagcagaagctgatttccgaggaagacctgctcaggaagcggcgcgaacagctcaagcataagctagaacagcttaggaattcgtgcgct

SEQ ID NO: 21258 - DNA, 1317 bp, Artificial Sequence; identical to SEQ ID NO: 21257
  Description of Artificial Sequence: Synthetic coding sequence

SEQ ID NO: 21259 - DNA, 1317 bp, Artificial Sequence
  Description of Artificial Sequence: Synthetic coding sequence
atgccacttaatgttagctttactaacagaaattacgatcttgattacgactcggtccagccatacttttactgtgatgaagaggaaaatttttatcaacaacaacagcaatctgaattacagccaccggcaccttcagaggatatttggaaaaaattcgagttgctgccaacgccaccattgtcgccaagtcgtcgatcaggactctgctctccatcatacgttgctgtgactccattttctttgcgtggagataatgatgggggcggaggatcattctccacagcggaccaactcgaaatggtcacagagttgttgggtggagatatggttaaccaatcttttatttgtgatccggatgatgaaactttcattaagaatatcatcattcaagattgtatgtggtcgggcttttcagctgccgccaagcttgtttctgaaaaacttgcctcttatcaggcagcacgaaaagatagcggatctccaaacccggccaggggacattcagtatgttctacgagctccctttatttacaagatttgtccgctgcggcatccgagtgcattgatccgagcgttgtgtttccgtatcctcttaacgattcaagcagtcctaaatcgtgcgcgtctcaggattcctcagcattctccccctcatcagattcattactttcaagcacggagtcatcacctcaggggtcaccggaacctttggttcttcatgaggagactccacctaccactagctctgattcggaagaggaacaagaagatgaggaagaaatagatgttgttagcgtcgagaaacgacaggcaccaggtaagcgatctgagtctgggtcaccatccgcgggaggacattcaaagccgccacattctccgctcgtactcaaaaggtgtcacgtgtcaacgcatcagcataattacgccgctccaccatcgactagaaaagactacccggctgctaagagagtcaagctagattcagttcgagtgttaagacaaatttccaataaccgtaagtgcacttctccacgtagttctgatactgaagaaaatgtgaaacgacgtacccacaatgtcctcgaacgtcagcgccgaaatgagttgaaacgttctttctttgctctaagggatcaaataccagaacttgaaaataatgagaaagcaccgaaggttgtgattctgaaaaaggctactgcctacatcttgagcgttcaggctgaggaacaaaagctaattagcgaagaggatctacttagaaagagaagggaacaacttaagcacaaacttgaacaacttcgaaatagctgtgct

SEQ ID NO: 21260 - DNA, 1317 bp, Artificial Sequence; identical to SEQ ID NO: 21259
  Description of Artificial Sequence: Synthetic coding sequence

SEQ ID NO: 21261 - DNA, 1317 bp, Artificial Sequence
  Description of Artificial Sequence: Synthetic coding sequence
atgccactgaacgtgtcgttcaccaaccgcaattacgatctcgactacgattcggtccagccttacttttactgtgacgaggaggagaacttttaccaacagcagcaacagagcgagctccagcctcctgccccgtcggaagatatctggaagaagttcgaactgctgcctactccgccattgagcccatcgcggcggagcggactgtgtagcccctcatacgttgccgtgaccccgttctccctccggggggacaacgatgggggaggcggatccttttccaccgcggaccaactcgaaatggtgaccgaactgcttggaggtgatatggtcaatcagtcgttcatctgcgacccagatgatgaaactttcatcaagaatatcattatccaagactgcatgtggtcaggattcagcgccgccgcaaagctggtgtccgagaagctggcttcctaccaagcagcgcggaaggactcgggatcaccgaacccagcgcgcggacattccgtttgtagcacctcgtcattgtacttgcaagacctctcggcggctgcctcggaatgcatcgatccttctgtcgtgtttccgtacccgttgaatgattcctccagcccaaaatcctgcgcctcgcaggacagctcagcattctcgccaagcagcgatagcttgctgagctcgacggaatcaagccctcaggggtccccagaaccgttggtgctgcacgaggaaacccctcctaccacttcctcggattcagaggaagaacaggaagatgaagaagagattgatgtggtgtccgtggaaaaacgccaggcgccaggcaagaggtcggaatcggggagcccaagcgcagggggccactcgaagccaccgcattcgccgctcgtgctgaagcgctgccacgtgagcactcaccaacacaattacgcggcccctcccagtaccagaaaagactaccccgcggcgaagagagtgaagctggattccgtccgcgtcttgcggcaaatctcgaacaatcggaagtgcaccagcccccgcagctcagataccgaggagaacgtgaagcgcagaactcataacgtcttggagcggcagaggagaaacgaactgaagcgctcattctttgcactccgcgaccagattccggagttggagaacaacgagaaggccccgaaggtggtcatcctgaaaaaggccaccgcttacatcctgagcgtccaggccgaggaacaaaagctgatctccgaggaggatctgctgcgcaagagacgcgaacagctgaaacacaagctcgagcaactcaggaactcttgcgcc

SEQ ID NO: 21262 - DNA, 1317 bp, Artificial Sequence; identical to SEQ ID NO: 21261
  Description of Artificial Sequence: Synthetic coding sequence

SEQ ID NO: 21263 - DNA, 1317 bp, Artificial Sequence
  Description of Artificial Sequence: Synthetic coding sequence
atgcccctcaatgtctcttttacgaataggaactacgacctcgactatgactcagttcaaccatatttctactgtgacgaggaggagaatttctaccagcagcaacagcagtccgagctccagccacccgctccatccgaagatatatggaaaaaattcgagctcttgcccacacctccactttctcccagcaggcggagtggcctctgcagcccatcctatgtcgccgttacaccctttagccttagaggagataatgacggaggaggtggtagcttcagtactgccgatcaactggaaatggtgactgagcttctcggcggagatatggtgaaccaaagctttatttgtgatcccgacgacgaaacattcattaagaatatcatcatacaggattgtatgtggtccggatttagcgccgcagctaagttggtgagcgagaaactcgcctcttatcaggccgcgcggaaagactccggatctccaaaccctgcaagaggacattcagtttgcagtacaagctcactgtatctccaggaccttagcgcagcagcgtcagagtgtatcgacccatccgttgtattcccataccccctcaatgattccagttctcccaaatcttgcgcttcccaggactcttcagcctttagcccgtcctcagactcactcctgagcagtaccgaaagtagcccccagggcagcccggagccgctggtgctgcacgaggaaactccccccactactagctctgatagcgaagaggagcaggaggatgaggaggagatcgacgtagtgtcagtagagaagcggcaggctccaggaaagcgcagcgaatcaggatcaccttccgcaggtggccactcaaagccgcctcattcccccctggtgctgaagcgatgtcacgtgagtacacaccagcataactacgctgctccgccctccactcggaaggactaccccgccgcaaagcgagttaagctcgattccgtgagggtccttaggcagatctccaataaccggaaatgcacctccccgcgcagttctgacaccgaggagaacgtgaagaggcggacccacaatgtcttggaacgccagcgacgcaatgagctcaagaggtccttttttgctctgcgcgaccagatccctgaactggagaataacgagaaagctcccaaggtggtaatcctgaagaaagctacagcatatattctgtccgtacaagccgaggagcaaaagctgatctctgaggaagacctgctgcgcaaacgacgcgagcagctcaaacataaactcgaacagttgcggaactcttgtgct

SEQ ID NO: 21264 - DNA, 1317 bp, Artificial Sequence; identical to SEQ ID NO: 21263
  Description of Artificial Sequence: Synthetic coding sequence

SEQ ID NO: 21265 - DNA, 1317 bp, Artificial Sequence
  Description of Artificial Sequence: Synthetic coding sequence
atgcctctcaacgtatccttcaccaaccgtaattacgatttggattatgacagtgttcaaccgtatttttattgcgacgaggaggagaacttttatcaacaacaacaacaaagtgaattgcaacctcccgctcccagtgaagatatttggaaaaagttcgagttgctgcccacaccgccgctgtctcccagtcgcagaagtggcttatgctctccatcttatgtagccgttaccccgttctcgcttcgcggagataacgatggagggggcgggtcgttctcgactgccgaccaactcgagatggtcaccgagctgttgggaggcgatatggtgaaccaatccttcatctgcgaccccgacgatgagaccttcattaaaaacattatcattcaggattgcatgtggtctggattttcggccgcggcgaagttagtgagcgaaaaattagcctcgtatcaggctgcacgcaaagatagtggtagcccaaatccagctaggggccattcagtctgcagcacgagttccctatatctgcaagatctctccgctgctgcgagtgaatgtatcgatccaagtgtagtgttcccctacccgctcaacgactcgtcgtcacctaagagttgcgcctcgcaggacagcagcgcattctcgccgagttcagatagccttttaagttcgactgaatcttcgccacaaggatctcctgagcccctggttctccacgaggaaacaccccctaccacttctagcgactcggaggaagagcaggaagatgaggaggagatcgatgtagtaagcgtagagaaacgacaagcgccggggaaacgcagtgaaagtggttcgccaagcgctggcggacatagcaagcccccccactcccctctggttctcaagcgctgccacgtgtccacccaccagcacaactacgccgcgcctccgagtactcggaaggattacccagctgccaaacgggtaaaactagatagcgtccgggttcttcgccaaatttcaaacaatcgcaagtgtacgtctccacgctcgtcggacactgaggaaaatgtgaaacgccgaacacataatgttctcgagcgtcagcgacgaaacgagctgaagcgcagcttcttcgcattgcgcgatcaaatccctgaactcgaaaacaatgagaaggcccctaaagttgtcattttaaaaaaagccactgcttatatattgtctgtccaagctgaagagcagaagctgatcagtgaggaggacctcctgcggaagcgaagagaacagcttaagcacaaattggagcaacttcgtaactcctgcgcc

SEQ ID NO: 21266 - DNA, 1317 bp, Artificial Sequence; identical to SEQ ID NO: 21265
  Description of Artificial Sequence: Synthetic coding sequence

SEQ ID NO: 21267 - DNA, 1317 bp, Artificial Sequence
  Description of Artificial Sequence: Synthetic coding sequence
atgcctcttaatgtatcttttactaatcgtaattatgaccttgattatgattcagttcaaccatatttttattgtgatgaggaagagaatttctatcaacaacaacaacaatcagaacttcaaccacctgcaccatcggaagatatttggaaaaaatttgaattattaccaacacctccattatccccatcaagaagatcaggattatgttcaccatcttacgttgcagttacaccattttcattaagaggagataatgatggaggaggaggatcattttcaactgctgatcaattagaaatggtaactgaattattaggaggtgatatggttaatcaaagtttcatctgtgatcctgatgacgaaacatttatcaaaaatattattattcaagactgtatgtggtcaggattttctgctgcagctaaattagtatcagaaaaattagcatcatatcaagctgctcgtaaagactcaggaagtccaaatcctgcaagaggacattctgtttgttcaacttcttctctttatcttcaagatttatctgctgctgcatcagaatgtattgatccatcagtagtttttccttatcctttaaatgatagttcatcaccaaaatcatgtgcttcacaagactcttctgctttctctccatcatcagacagtttactttctagtactgaaagttcaccacaaggatcaccagaacctttagttcttcatgaagaaactccaccaactacatcatcagattctgaagaagagcaagaagatgaagaagaaattgacgttgtttcagttgaaaaaagacaggcacctggaaaaagatctgaatcaggaagtccttctgcaggtggacattcaaaacctccacactcaccattagttttaaaaagatgtcatgtttctactcatcaacataactatgcagctccaccatctacaagaaaggattatccagctgctaaaagagttaaattagattctgtaagagttcttagacaaattagtaataatagaaaatgtacatctccaaggtcatcagatactgaagaaaatgttaaacgaagaacacataatgtattagagcgacagagaagaaacgaattgaaaagatcatttttcgcccttcgagatcaaattcctgaattagaaaataatgaaaaggctccaaaggttgttattttaaaaaaagcaactgcttatattctttcagtacaagcagaagaacaaaaattaatttctgaagaagatttattaagaaaacgaagggaacaacttaaacataaattagaacagctaagaaacagttgtgca

SEQ ID NO: 21268 - DNA, 1317 bp, Artificial Sequence; identical to SEQ ID NO: 21267
  Description of Artificial Sequence: Synthetic coding sequence

SEQ ID NO: 21269 - DNA, 1317 bp, Artificial Sequence
  Description of Artificial Sequence: Synthetic coding sequence
atgccactcaacgtctcatttaccaaccgcaattacgatctcgattacgattcggtccaaccatacttctactgtgacgaagaagaaaacttttaccagcaacaacaacaatccgagctccaacctcctgcaccatcagaggacatctggaagaaatttgagctgttgcctaccccgcctctttcgcctagcagacggtcaggtctttgttcaccttcgtacgttgctgtcacgcccttttcgcttcgtggagataacgatggaggtgggggttcattcagcaccgcagaccagctggagatggtgactgaacttcttggtggtgatatggtgaatcagagctttatctgtgaccctgatgatgaaacctttatcaagaacattatcattcaggactgtatgtggtcggggttctccgcagcagcaaagctcgtgtcggagaaacttgccagctaccaagcagcacggaaagactcgggttcccctaatccagcacgtggtcatagcgtctgctcgacgtcatccctttaccttcaagatctgtcggcggcggcatctgaatgtattgatccatcggtggtctttccgtaccctctgaacgacagctcctccccaaagagctgcgcatcgcaggactcctcggcatttagcccttcatcggattccctgctttcctcgactgaaagcagcccacaaggatcgccagaacctcttgtgcttcacgaagaaacccctcctaccacctcgtcggacagcgaggaggagcaagaagatgaagaagaaattgacgtggtgtcggtggaaaagcgccaagcccctggaaagagatctgaatccggcagcccatccgccggaggtcattccaagccacctcatagtccattggtgctgaagaggtgtcacgttagcacccatcaacacaattacgctgctcctccttctacgcggaaagattaccctgccgccaagcgggtgaaactggactcggtgagagtgctccggcagattagcaacaataggaagtgtacctcacctagatcctcggataccgaagagaacgtgaaaagaagaacgcacaacgtgctggaacggcaacgcaggaatgaacttaaaagatctttcttcgccctgcgtgatcagatccccgagcttgaaaacaacgaaaaggcacccaaggtggtgatcttgaagaaggccactgcatacatcctttccgtgcaggcagaagagcaaaaacttatttcggaagaggacctgctgcggaagaggcgagagcaacttaagcataagctggaacaactgagaaactcctgtgcg

SEQ ID NO: 21270 - DNA, 1317 bp, Artificial Sequence; identical to SEQ ID NO: 21269
  Description of Artificial Sequence: Synthetic coding sequence

SEQ ID NO: 21271 - DNA, 1317 bp, Artificial Sequence
  Description of Artificial Sequence: Synthetic coding sequence
atgcctctgaacgtgtcttttaccaatagaaattatgatctagattacgattctgtgcagccatacttctactgtgatgaagaggagaatttctaccagcagcagcagcagtcagagctacagccgccggcaccttctgaggatatttggaagaaatttgagctgctgcccacaccccctctcagtccgtctcgtcgcagcgggctatgctctccctcctacgtcgcagtgactcccttttcccttcgaggtgacaatgacggggggggcggatcattctccactgccgaccagctggaaatggtgactgagttgctgggaggtgatatggtgaaccagagttttatctgtgaccccgatgacgaaaccttcataaaaaacattattatccaggattgcatgtggtccggcttctcagcagcggcgaagttagtgtccgagaagttggcaagctaccaggccgcgcgtaaggattcgggaagccctaatcccgccagagggcattccgtgtgctcaacctccagcctgtacctgcaggatctttccgctgctgccagtgaatgcattgatccctccgtggtgtttccttacccactgaatgactcttcttctccgaaatcatgtgctagccaagacagcagcgcatttagcccatcttcagactccctcctttcctctaccgagtcctccccccaagggagcccagagccactagtgttgcatgaagagacaccacccaccactagttccgattctgaggaagagcaggaggacgaggaagagatagacgtggtcagtgttgaaaaacggcaggcaccaggaaagcgctcagagagtggttctccgtccgccggggggcactccaaacctcctcattctccccttgtattgaaacgctgtcacgtgtctacacaccagcataattatgcggcccccccatctacgagaaaagattaccccgcggcgaagcgggtgaagctcgatagcgttcgcgtcttgaggcagattagcaataatcggaagtgcacgtctcctcggtccagcgacactgaggaaaacgtgaaacgacgcactcacaacgttctggagaggcagcggcgcaatgagttaaagcgatccttcttcgcactccgcgaccagatcccagagttggaaaataacgaaaaggccccaaaggtagtcattctgaagaaggccactgcctacattctgtctgtacaggccgaggaacaaaagttgatttcggaggaagacctgctacgcaagcgcagagagcaactgaagcacaagctggagcaactgcggaattcttgcgcc

SEQ ID NO: 21272 - DNA, 1317 bp, Artificial Sequence; identical to SEQ ID NO: 21271
  Description of Artificial Sequence: Synthetic coding sequence

SEQ ID NO: 21273 - DNA, 1317 bp, Artificial Sequence
  Description of Artificial Sequence: Synthetic coding sequence
atgccacttaacgtatcatttactaaccggaattacgacttggactatgattcggtacagccatatttctattgtgatgaggaggagaacttctaccagcaacagcagcagagcgagctgcagccaccggctcccagcgaagatatctggaagaagtttgaactacttcccacccctcccctgtctcctagccggcggagcggcctgtgcagccctagctatgtggcagtcacccccttctctttgcggggggacaacgacgggggaggtggctcttttagtaccgcagaccagctcgagatggtgaccgagttgctcggaggtgacatggtgaatcagtcatttatttgtgaccccgacgacgaaactttcattaagaatatcattatacaggactgcatgtggtccggcttttccgctgctgccaagctggtttctgaaaaactggcaagttatcaagccgccagaaaagattccggaagtcctaatcccgctagaggccatagcgtgtgttctactagctccctgtacctgcaggatctctccgcagccgcatcggagtgcatcgaccccagcgttgtgtttccttatcccctgaatgacagttcctctcccaaatcctgcgcatcacaagactctagcgcgttttcaccctcatctgactccctcttatccagcacagaaagtagccctcagggctctcctgagccgctggtcctgcatgaggaaacaccgccgaccacctccagtgacagcgaggaagaacaagaagatgaggaggaaattgacgtggtcagcgttgaaaagagacaggcaccgggtaaacgtagcgagtctggatcgccgagtgcaggaggacacagtaaacctccccactctcctctggtgttgaaaaggtgtcacgtcagtacgcaccaacacaattacgccgccccaccctctacccgcaaggactatccagctgccaaaagagtcaaacttgactctgttagggtgctgagacagataagtaacaatcggaaatgcactagccctcgctcaagtgataccgaagaaaacgtaaaaagacggactcataatgtcctcgaacggcagaggcgaaatgaactgaagagatcattctttgcactgcgagatcagatccccgagctggaaaacaacgaaaaagcacctaaggtagtcattttaaagaaggctacagcgtatatcctgagtgttcaggccgaagagcagaaactcattagcgaggaggacctcctccggaagaggagggagcagctgaaacacaagctggagcaattgagaaattcgtgcgcc

SEQ ID NO: 21274 - DNA, 1317 bp, Artificial Sequence; identical to SEQ ID NO: 21273
  Description of Artificial Sequence: Synthetic coding sequence

SEQ ID NO: 21275 - DNA, 1317 bp, Artificial Sequence
  Description of Artificial Sequence: Synthetic coding sequence
atgcccctgaacgtgagcttcacaaatagaaattatgacctcgactatgactcagtacaaccttatttttattgtgatgaagaggagaatttttatcagcaacagcagcaatcagagctgcagccacccgccccgagcgaggacatctggaaaaaattcgagctgcttcccaccccgccattgtctccaagtcggcggagcgggctgtgctctcctagttacgtggcagtaacgcctttctcactgaggggcgataacgatggagggggagggtcgttctcgaccgctgaccagctcgaaatggttaccgaactcttggggggagatatggtgaaccagtctttcatttgtgatcccgacgacgagacttttatcaagaatatcataatccaggattgcatgtggagcggattcagcgccgcagccaagctcgtttctgagaagctcgcaagttaccaggcggctcggaaggactcaggctctcctaatcccgctcgggggcacagtgtgtgctcaaccagctctctgtacttacaggatctgagcgctgctgctagcgaatgtatcgaccccagcgtggtgttcccgtacccattgaacgactccagctcgccgaagtcttgtgcaagccaggacagttccgccttctccccttcgagcgactcattgctttcctccaccgagagctccccacaggggagtcctgaacccctcgttctgcatgaggagactccaccaactacttcctctgattccgaagaggagcaggaggacgaggaggaaatcgacgtcgtcagtgtcgagaaacggcaggctcctggcaaacggagtgaatccggaagtccaagcgccggaggacattctaagccgccccacagccctttagttctcaaacgatgtcacgtgagcacacaccagcataattacgcggccccaccatccactagaaaggactatcccgccgccaagagggtcaagctagatagcgtgcgggtactaagacagatctctaataatagaaaatgcacgagtccaaggtcaagtgacaccgaggagaatgtgaagcgacggacccataatgtgctcgaaaggcaaaggcgaaacgaactcaagcgtagcttttttgcactgcgggatcagatccccgagctagagaacaacgaaaaagcccctaaggtggtcattcttaaaaaggcgactgcctacatcctgagcgtgcaggccgaggaacagaagctgatttctgaagaagacctgctgcgcaagcgcagggagcaactgaagcataagctagaacagctgaggaattcttgtgcc

SEQ ID NO: 21276 - DNA, 1317 bp, Artificial Sequence; identical to SEQ ID NO: 21275
  Description of Artificial Sequence: Synthetic coding sequence

SEQ ID NO: 21277 - DNA, 1317 bp, Artificial Sequence
  Description of Artificial Sequence: Synthetic coding sequence
atgccgctcaatgtctcatttacgaatcgcaactacgacctggactacgattccgtccaaccgtacttttactgtgacgaagaagaaaacttctatcaacaacagcagcaatccgaactgcagccccctgcaccttcagaagatatttggaaaaagttcgagctgctgccgacgccacctctgagcccgagccggaggtccgggctgtgctcgcctagctacgttgccgtgaccccgtttagcctgcgtggagataacgacggcggaggaggatcgttctccactgcggatcaactggagatggtgaccgaactcctgggaggagacatggtcaaccagtccttcatttgcgaccctgatgacgaaacgttcattaagaacatcatcatccaggactgcatgtggagcggattcagcgcggcagcaaagctggtcagcgaaaagctcgcttcgtatcaagcggcacgcaaagattcaggatccccgaacccggcccgcggacattcggtctgctcaactagctcattgtacctccaagacctgtcagcggctgcatcggagtgtatcgacccatcagtggtgttcccgtacccgctgaacgactcctccagcccgaagtcgtgcgcctcccaggattcgtccgcgtttagcccaagtagcgattcgctgcttagcagcactgaatcgtcgccgcaaggctcacccgaaccattggtcctgcacgaagaaacccctccgaccacttcttccgactcggaagaagagcaggaagatgaagaggagatcgatgtggtttcagtcgagaaacggcaagcaccgggaaagagatctgagtccggatccccatcagcagggggccactccaaaccaccgcacagcccactcgtcctgaagaggtgccacgtgtccacgcaccagcacaattacgcagccccgccgtccaccagaaaagattacccagcggccaagcgcgtgaagctggacagcgtgcgggtcctccgccagatcagcaacaatcggaagtgtacctcgcctcgctctagcgacaccgaggagaatgtcaagagacggacccataatgtgctcgagcggcagcgcaggaacgaactcaaacggtcgttttttgccctgagagatcagatcccagaactcgaaaacaacgaaaaggccccgaaggtcgtgatcctgaagaaggccactgcctacatcctgtcagtccaggcggaagagcagaaactcatctcggaagaggatctgctgcgcaagcggcgggaacagttgaagcataagctggagcaactcagaaattcctgtgct

SEQ ID NO: 21278 - DNA, 1317 bp, Artificial Sequence; identical to SEQ ID NO: 21277
  Description of Artificial Sequence: Synthetic coding sequence

SEQ ID NO: 21279 - DNA, 1317 bp, Artificial Sequence
  Description of Artificial Sequence: Synthetic coding sequence
atgccactcaatgtaagctttactaatcgcaattatgaccttgactacgactcagttcagccctatttttactgtgatgaagaggagaatttttatcagcagcagcagcagagcgaattgcagcctcctgcccccagcgaagacatctggaaaaagtttgaactgttgcccacacctcccctgagcccttccagacggagtggcctttgttctcctagttatgtcgccgtgacaccgttctcactgcgaggagacaatgatgggggcgggggcagcttcagcactgctgatcagctggagatggtgactgaattgctggggggggatatggtgaaccagtcattcatatgtgatcccgatgacgaaacttttataaagaacatcatcatccaggactgcatgtggagcggcttcagcgctgccgctaagttggtgtctgaaaaactagcttcctatcaggctgcacgtaaagactcagggtcacccaatcccgctagagggcattcagtctgctccacatcctccctttatcttcaggatctgtctgctgccgcaagtgagtgcatcgacccatctgtcgtcttcccatacccgttgaacgattcatccagccctaaaagctgcgcaagccaggatagttcagcttttagtccgagtagcgattccctgctatcctccacagaatcctctccccaaggaagtcctgagcctctagtactgcacgaggagactccccccaccacatcctcagacagtgaagaagagcaggaagatgaggaagaaattgatgtggtgagtgtcgagaagagacaggcccccggtaagagaagtgagagtggtagtccctctgcagggggccactcaaaaccacctcacagccctctggtcttgaagcggtgtcacgtatctacacatcagcataattatgcagcacccccttcaacgcgcaaggattacccggcggcaaagagagtgaaactcgattcggtgagggtcttaaggcaaatctccaacaaccgtaagtgtacatcaccaaggtcctcggatacagaggagaacgttaagcggagaacacacaacgttctggagagacagcgtcgcaacgaactaaaaagatcgttttttgccctccgcgatcagatcccagaactggagaataatgaaaaggcgcccaaggtggtgatcttaaagaaggctactgcttacattcttagcgtgcaggcagaggagcagaagctcataagcgaggaggatcttctgagaaagcgcagggagcagcttaaacacaagctagaacaactcagaaactcctgtgct

SEQ ID NO: 21280 - DNA, 1317 bp, Artificial Sequence; identical to SEQ ID NO: 21279
  Description of Artificial Sequence: Synthetic coding sequence

SEQ ID NO: 21281 - DNA, 1317 bp, Artificial Sequence
  Description of Artificial Sequence: Synthetic coding sequence
atgcctcttaacgtgagctttaccaatcgaaactacgatcttgactacgactccgttcagccctatttctactgcgatgaagaagaaaacttttaccaacaacaacagcaatcggagctccagcctccggctccatcggaggacatttggaagaagttcgaactcctgcccactcctcctctgtccccatcgcggaggtccggtctgtgttccccatcctacgtggccgtgaccccatttagcctgcgcggagataacgacggtggaggtggctcattctcgactgcggaccaacttgaaatggtgaccgagctgcttgggggtgacatggtcaatcagtcctttatctgcgacccagatgatgaaaccttcatcaaaaacatcattattcaggattgcatgtggtcaggattttccgcagcggcaaagttggtcagcgagaagttggcatcataccaagccgcacgaaaagatagcggttccccgaatcctgcccgcggacacagcgtttgttccacctcatcactttacctgcaagatctctcggcagctgcaagcgaatgtatcgatccgtcggtggtttttccttatccactcaatgattctagctcccctaagagctgcgcgagccaagactcctccgcattttcgccatcatcggatagcctgctttccagcaccgaaagctcccctcagggcagcccggagccgttggtgctccatgaagaaactccgcctacgaccagctcagattcagaagaggaacaagaagatgaggaagagattgacgtggtcagcgtggaaaagagacaggcacctgggaagcgatctgagtcggggtccccctctgccggaggccattcaaagccgccacactctccacttgtgctgaaaagatgtcacgtctcgacccatcagcataactacgcagcgcccccatcgactagaaaggactacccggccgccaagcgggtgaaacttgatagcgtgagagtgctcagacagatcagcaataatcgcaaatgtactagcccgcgaagctccgacaccgaagaaaacgtcaaacgacgtactcataacgtactcgagcggcaaagacgcaacgagcttaagcgatcatttttcgcgctgcgggaccaaatccccgaactggagaacaacgaaaaggcgccaaaggtcgtgattctgaagaaagcaacggcatacatcctttctgtccaggctgaagaacagaagttgattagcgaagaggatcttctgagaaagcgccgtgaacaactcaagcataaactggaacaacttcggaattcctgtgcc

SEQ ID NO: 21282 - DNA, 1317 bp, Artificial Sequence; identical to SEQ ID NO: 21281
  Description of Artificial Sequence: Synthetic coding sequence

SEQ ID NO: 21283 - DNA, 1317 bp, Artificial Sequence
  Description of Artificial Sequence: Synthetic coding sequence
atgccgctgaacgtgtcgtttaccaaccgcaattacgatctcgattacgatagcgtgcagccttacttttactgtgatgaagaagagaacttttaccaacaacagcagcaatcggaactgcaacctcctgcaccatcagaagatatatggaagaagtttgaacttctgcctacgcctcctctgtcgccttcccgtcgatccggcctttgtagcccaagctatgttgccgtgactcctttttcgctgagaggagataatgacggtggtggtggttcgtttagcactgcggatcagctcgaaatggtgacggaacttctgggtggagatatggtcaatcagagcttcatttgcgatccggacgacgaaacctttatcaagaacattatcatacaggactgtatgtggtctggtttcagcgcggcggctaaattggtgtcggaaaagctcgcctcataccaggcggctagaaaagattcgggttccccgaaccctgcaagaggtcatagcgtctgtagcacttcttccctgtacctgcaagatctttcggcagcagcctcggagtgcattgatccttccgtcgtattcccgtatcctcttaacgactcctcctcccctaaaagctgtgcgagccaggactcctcagcatttagcccgagctcagactctcttctctcctcgactgaaagctccccccagggaagccctgagccacttgtgctccacgaggaaacccctccgactactagttccgatagtgaggaagagcaggaggacgaggaggagatcgatgtggtgtcggtggagaagcggcaagcaccaggtaaacgatcggaatcaggctccccctcggcaggcggccacagcaaaccaccgcatagccctcttgtgctgaagcgttgtcatgtgtccacccaccagcataactacgctgcccctccctcgacccgtaaggactacccagcagcaaaacgggtgaagctcgactccgtgagagtcctgcgacagattagcaacaataggaagtgcacctcccccaggtcatctgataccgaggaaaacgtgaagagacggacccataatgtgcttgaaaggcagcgccgtaacgagcttaaacgctcgttttttgccctgcgcgaccaaattcccgaactggaaaacaacgagaaagcccctaaggtggtcattctgaagaaggcgactgcatacattctgtcggtccaggctgaagaacaaaagttgatctcagaagaggatctgctgcgcaagcggagagaacaactgaagcataaactggaacaacttagaaatagctgtgcc

SEQ ID NO: 21284 - DNA, 1317 bp, Artificial Sequence; identical to SEQ ID NO: 21283
  Description of Artificial Sequence: Synthetic coding sequence

SEQ ID NO: 21285 - DNA, 8439 bp, Artificial Sequence
  Description of Artificial Sequence: Synthetic coding sequence
atgattccggcccggtttgctggcgttcttctagcactggctctgattctgcctggcacattatgtgctgagggcacaagaggacgatcgtccacagcgagatgctctttattcgggtctgattttgtgaacacgtttgatggcagtatgtatagctttgccggatactgtagctatctgctagccggcggatgccaaaaacgctcattttcaattatcggagattttcagaacggaaaacgagtctcgttgtctgtgtatcttggcgaattttttgatattcatctatttgttaacggcaccgtcactcagggagatcaacgtgtgtcaatgccatatgcgtccaaaggtctgtatctggagacggaggcgggatactacaagcttagtggggaagcctacggattcgtagccagaatcgatggaagcgggaatttccaagttttgttatctgaccgatatttcaataaaacgtgcggcctgtgtggaaattttaatatctttgcggaggacgattttatgacgcaagaagggacattgaccagtgatccctatgatttcgcaaattcttgggcgctttcgagcggagaacaatggtgcgaacgcgcctcccctccgtcgagcagttgcaatatcagttcaggtgaaatgcagaagggactttgggaacaatgccagctccttaaatcaacttcggtttttgcgcgctgtcatcctttagtcgatccggagccgtttgtcgctttatgtgagaaaacgctgtgtgagtgcgccggggggttggaatgcgcctgcccagcgctgcttgaatacgcgcgtacgtgtgcacaggaaggtatggttctttatggttggacggaccacagcgcatgctctccggtttgcccggctggtatggagtaccggcagtgcgtaagcccgtgcgcaaggacatgtcaatctcttcatatcaatgaaatgtgccaggaacgttgcgtcgacggttgttcatgtcctgagggccaactgcttgacgaaggactttgcgtagaatctaccgaatgcccgtgtgtccattctggcaaacggtaccctcccggcacatcactgtcaagagattgtaacacatgtatttgtcgtaattcacagtggatttgtagcaacgaagagtgtccaggagaatgcttggttacgggccaatcacatttcaagtcttttgataaccgctatttcactttctcggggatatgccagtatcttctggcgagagattgccaggaccatagcttttcaattgttattgagacggttcagtgtgctgatgatcgtgatgctgtttgcacgagatctgtcactgtgagactcccaggtcttcataacagcttggtcaaattaaaacatggtgctggagtagcaatggacggacaggacgttcagttgccgttgttgaaaggggatttgcgcattcaacatacagttacagcaagcgtgcggttgtcctatggagaagatcttcagatggactgggatggacgggggcgtctgctggtaaaattgtctccggtctacgctggcaaaacgtgcgggctctgcgggaattataatggcaatcagggcgatgattttctaacgccgtcgggcctggctgagccgagagtggaagactttggtaatgcatggaaactccacggcgactgccaagatctgcagaagcaacatagcgacccatgtgcgttaaatccccgcatgacgcgcttctcagaagaagcctgcgcagttctgacaagcccgacattcgaagcgtgtcatcgggccgtcagtccgcttccgtaccttagaaattgcaggtacgatgtgtgctcatgttcagatggtcgcgaatgcctctgtggcgctttagcttcatacgctgcggcatgtgccggaaggggcgttagagttgcgtggcgagaaccaggacgctgtgaactcaactgcccgaaagggcaggtgtacctacagtgtggtaccccgtgcaacttaacatgcagatcgcttagttacccggacgaggagtgtaacgaagcttgcttggagggatgcttttgtccgccaggcctgtatatggacgaacgtggagattgtgtaccaaaagctcaatgtccgtgttactatgacggggagatctttcaaccagaggacatttttagcgaccatcatacgatgtgttactgcgaagatggattcatgcactgtacaatgtcgggagtgccggggtctcttctccctgatgctgttctttcaagcccactgagccatcgttctaaacgatctctgtcttgtcgtccgcctatggtgaaattagtttgcccggcggataatttgagagcagaaggcttggaatgtactaaaacatgccaaaattatgatcttgaatgcatgtctatgggttgcgtgagtgggtgtctgtgcccaccgggcatggtccgtcatgagaacagatgcgtagcgttagaacgctgcccatgtttccatcagggaaaagaatacgcccctggcgaaacagtgaagattggatgcaatacctgtgtttgccaggatcgcaagtggaactgtacggatcatgtctgtgacgctacttgtagcacaattggaatggcacattacctgacttttgacggacttaaatatctgttcccgggcgaatgtcaatatgtacttgtacaagattattgtggctcaaatccgggcacatttagaatcctagttggtaataaaggatgctcccacccgagtgtaaaatgcaaaaaaagagtcactatcttggtcgaagggggagaaatcgaattatttgatggtgaggtgaacgttaaacggccgatgaaagatgaaacacatttcgaagttgttgagagcggcagatacatcattctccttctgggcaaggcactgtctgtggtttgggataggcatctatctatcagcgtcgttcttaagcagacgtatcaagaaaaggtctgcggtttatgcggcaattttgatggaatccagaacaatgacctgacctcaagcaacctgcaggttgaagaggatccggttgatttcgggaactcgtggaaagtttctagccaatgcgctgacacaagaaaagtacctctggattcgtcaccggctacctgtcataataacattatgaagcagactatggttgattcgtcgtgccgaattcttacatcagacgtctttcaggattgtaacaagcttgtagatccggaaccttacctcgatgtatgcatttatgatacatgctcatgtgaatctattggtgattgtgcttgcttttgcgatacgattgcggcctacgcgcatgtctgtgcccaacatggcaaggtagttacatggagaacagctacactgtgtccacaatcatgcgaagaaagaaaccttcgagagaatggttacgaatgcgaatggaggtataatagctgtgccccggcatgccaggtcacatgccaacacccagaaccgcttgcatgtcctgtgcaatgcgtcgaaggctgccatgcgcattgtccgcctggaaaaatcctggacgaacttttacaaacatgcgtcgacccggaagattgccccgtttgtgaagttgcgggccgccggtttgcgagcggcaaaaaagtcacattgaacccgtcagatcctgagcattgtcagatctgtcattgtgacgtggttaatttaacttgtgaggcttgccaggaaccaggcgggcttgttgtcccccctaccgatgcgcctgtaagcccgacaacactttatgtagaagacatttccgaacctccacttcacgatttctactgctcccggctgctagatttagtatttttactagatggatcatctagactctctgaggcggagtttgaagtcctgaaggcgtttgttgtagacatgatggagcgtcttcggataagccaaaaatgggttcgggtggctgtagtcgaatatcatgatggctctcatgcctatatcggcctgaaagaccgcaaaagaccatccgagctgcggcgaatcgcatctcaggttaaatatgcgggctcccaagtcgcgtccacgtcggaggtgctgaagtatacgctttttcagattttttccaaaatagatcggccggaggcaagtcggatcacacttcttctgatggcctcacaagagcctcaaagaatgagtcgtaattttgtgcgatatgttcaaggcttgaaaaaaaaaaaggtaatcgttattccagtgggcatcggacctcatgcgaatcttaagcagatccggctgatcgaaaaacaagctcctgaaaataaagccttcgttttgagctctgtggacgaacttgaacaacagcgtgacgaaattgtcagctatctttgcgatctcgctccggaggcaccgcctccgacgcttccgccggatatggctcaagtgacagttgggccaggacttttaggagtcagtacactgggtcccaaacggaattctatggtcctagatgtggccttcgtactggaaggatcggataagattggagaggcggattttaatcgctcaaaagaatttatggaggaggtgatccagcgaatggacgtcggccaagattccatacatgtaacggtattgcaatattcttatatggttactgttgagtatccttttagtgaggctcagtcaaagggcgacatcttgcagcgggttcgggaaattcgataccaagggggtaatagaacgaacacgggactcgctctgcgctatttaagcgaccattcattcctggtgtcccagggggatcgtgaacaagcaccgaacttggtatatatggtgactggaaatccggcatcagatgagatcaaacgcctgccgggcgatatccaagtagtacctatcggtgtcggacccaacgccaacgtgcaggaattggaacgtattggttggcctaacgcgccgatattgatccaggactttgagactctccctagggaggcgccggaccttgtgctccagagatgttgcagcggagaaggacttcaaataccgacacttagtcccgcaccagactgttcacagccgttagacgtcattctgcttcttgatggctcctcttcttttcctgctagctatttcgatgagatgaagtctttcgctaaagcgtttatctctaaagcaaacattggccctcggttaacacaggtttcggtcttacagtatggaagtattacgactatcgatgtcccctggaatgtggtgcctgagaaagcgcacttattgtcactggtggatgttatgcagcgcgaaggcggaccgagccagattggcgatgcacttggctttgccgtgagatacctgaccagcgaaatgcatggagcgaggccaggagcatcaaaggcagtcgttatccttgtaacagacgtgtccgtagattcagtggatgccgcggccgatgccgctaggagcaatagagtaaccgtcttcccaatcggcatcggcgatcgttatgacgccgcccaattacgcattcttgcaggcccggcgggtgattcaaatgttgtcaaattgcagcggatcgaagaccttccgactatggtcacacttggcaactcatttttacacaagctttgctccggctttgtcaggatttgcatggatgaagatggtaacgaaaaacgtcctggtgacgtatggacgctcccggatcagtgccatacagtgacgtgccaacccgatggccagacactgttgaaaagccaccgcgttaactgcgaccgtggactgcgacctagctgcccgaactctcaatctcctgtcaaggtggaggagacatgtggatgcaggtggacttgtccttgcgtgtgtaccggatccagcacacgccacatcgtgacttttgacggacaaaatttcaaacttaccggttcttgctcttacgtcttgtttcaaaacaaagaacaagatctcgaagtaattctccataatggcgcttgctctccgggtgcgaggcaaggatgtatgaagagcatcgaagtaaaacattccgcgctgtcggttgaacttcactcagatatggaagtcacagtgaatggaagactggtaagcgtgccttacgtcgggggaaatatggaggttaatgtatatggggctattatgcatgaagtgcgctttaaccacctgggtcacatttttacgttcacaccgcaaaacaacgaatttcagcttcaactctctcctaagacatttgcctcgaaaacttatggcctttgtggtatctgcgatgaaaatggcgcgaacgattttatgttgagagacggtactgtcactacggattggaaaacccttgttcaggagtggacggtccagaggccaggacaaacgtgtcagcctattctggaagaacagtgcttagtacctgatagctcacactgccaggttcttttattaccgttgttcgcggagtgtcataaagttttggctccggctacattttatgctatttgccagcaggattcatgccaccaggaacaggtctgtgaagttattgccagctatgcacacttatgtagaaccaacggcgtttgcgtggattggcgtacaccggatttttgcgccatgagctgtccgccttcccttgtctataaccattgtgaacatggctgtcctagacactgcgatggtaacgtttcgtcttgtggggatcaccctagcgaaggatgcttctgtccgcctgataaagtgatgttagaaggatcatgcgttccggaggaagcctgcacacaatgtattggagaagacggagtccagcatcaattccttgaagcctgggttccagaccaccagccgtgccaaatttgtacgtgtctgagtggccgaaaagttaattgcacaacccagccttgcccaacagccaaggctccgacttgcggactgtgtgaagtcgctcgcctgagacagaatgcagatcagtgttgccccgaatatgaatgtgtttgcgacccggtctcgtgcgaccttccgccggtcccgcactgtgaaagaggtttacagccgacgctgacgaacccgggagaatgtagaccgaactttacatgtgcatgccgcaaagaggaatgcaaaagagtaagcccgccgtcctgccctccgcaccgcttacccacacttagaaagacgcagtgttgcgatgagtacgagtgcgcgtgcaattgtgttaactctactgtgagctgccccttaggctacctggcatcgacagctactaatgactgcggctgtacaactactacatgtctgccggacaaagtttgcgttcacagaagcactatctatcccgtcgggcagttttgggaagagggatgtgatgtctgcacttgcacggatatggaagatgctgttatgggactgcgcgtcgcgcaatgtagtcagaagccttgcgaagattcatgtaggtcagggtttacatatgtcctgcatgaaggggagtgttgtgggcgttgtctgccgtctgcgtgtgaagtcgttacaggatcaccgcgcggggattcccagagttcctggaagagcgtaggctctcaatgggcgtcaccggagaacccatgcctaatcaatgaatgcgttagagtaaaggaagaagtctttatccaacagcgcaacgtctcgtgtccacagttagaggttccagtatgccccagcgggtttcaactttcatgtaagacatcggcttgttgtccttcttgtcgctgcgaacgtatggaggcatgtatgttgaatggaacagttatcggaccgggcaaaacagttatgattgatgtttgtacgacatgtaggtgcatggtccaagtcggcgtgatctctggttttaagttggaatgtcgtaagacgacatgtaacccgtgcccgttgggctataaagaagaaaacaatacaggcgagtgttgcggaagatgtttacccacggcatgcaccatccagttacgtgggggccaaataatgacacttaaacgcgatgagaccttgcaagatggctgcgatacacacttttgcaaagtcaacgaaagaggggagtacttttgggaaaaaagggttaccggatgcccgccgtttgacgaacacaaatgcctggcagaaggtggcaaaattatgaaaataccgggcacttgctgtgatacatgcgaagaaccggaatgcaacgatattacggcacgactgcaatatgtgaaagtcggctcgtgcaaatcagaagttgaggttgatatccattattgtcaaggtaaatgcgcgtctaaagccatgtacagtatagatattaatgacgttcaggaccagtgctcgtgctgctcgccaacccgtacagaaccgatgcaagtcgcattacattgcaccaacggctcagtagtttaccatgaggtcttgaacgcaatggaatgcaaatgttccccgcgcaaatgctctaaa

SEQ ID NO: 21286 - DNA, 8439 bp, Artificial Sequence
  Description of Artificial Sequence: Synthetic coding sequence
atgattccggcaaggttcgccggagttctgctggctctggctctcatcctccccgggactctgtgcgcagagggcactagaggcagatctagcaccgccagatgttcattgttcgggtctgacttcgtcaacacctttgacggcagcatgtactcatttgcaggatattgttcttacctgcttgcgggagggtgtcaaaagcgctcctttagcatcataggcgacttccaaaacgggaagagggtgtcactgagcgtatacctgggcgaattctttgatatccatctctttgtcaatggcacagtaacccagggcgatcagagagtttcaatgccctacgcttctaagggtctctatctggaaaccgaagccgggtactataagttgagtggggaggcgtacgggtttgtggctagaattgacggcagcggaaatttccaggtgctgctgagcgatagatacttcaataaaacctgcggattgtgcggcaattttaatatcttcgctgaggatgatttcatgacccaggagggtaccctaactagtgacccgtatgattttgccaattcatgggctctcagctctggtgagcagtggtgcgaaagggcctctcccccgtcgtcttcttgtaacatctcgtcgggggagatgcaaaagggcctttgggagcagtgtcaactgcttaaaagtacaagcgtgtttgccagatgccacccacttgtggatcctgagcctttcgttgccctctgtgagaagaccttatgtgagtgcgctggaggacttgagtgcgcatgccccgctctcctcgagtacgcccggacctgtgctcaggaaggaatggtgctgtacggttggaccgatcactcagcctgttcccccgtgtgtcccgcgggtatggagtatcgtcagtgtgtatcaccttgtgctagaacatgtcagtcactgcacattaacgagatgtgccaggagcggtgcgtggatggttgttcatgtcccgaggggcagctgctggatgaaggcctctgtgtggagtctacagagtgcccatgtgtgcactccggtaagaggtatccccccggaacctcgcttagtcgcgattgtaacacttgtatatgcagaaactcacagtggatttgttccaacgaggagtgcccaggagaatgcttggtcaccgggcaaagccattttaagtctttcgacaatcgatacttcacattcagcggtatctgccagtatctcctggctagggactgtcaggaccattccttctccatcgtgatcgaaacagtgcagtgcgcagatgatcgggatgctgtctgcaccagatcagttacagtgaggttaccagggttgcacaactcactggtgaaattgaagcatggagccggagtagctatggacgggcaggatgtgcaactgccattgctaaagggagacctgcgaattcaacatactgtgaccgctagtgtaaggctgtcttacggtgaagatctccagatggattgggatgggagagggagactgttggtgaagctctcgccagtctacgccggaaagacctgcgggctttgcggtaattacaatggcaaccagggagatgattttctgactccatctggtctcgccgagcccagggtggaagacttcggtaatgcatggaaacttcatggagactgtcaggacctccaaaaacagcattcagatccgtgcgcactaaatcctaggatgactcggttttccgaggaggcttgcgctgtgttaacatctcccactttcgaggcgtgccatcgcgcagtgtccccgttgccctatctgaggaactgtcgatatgacgtctgttcctgctcggacggaagagagtgcctgtgcggtgcacttgcttcctacgccgctgcctgcgccggccgtggcgtcagggtggcttggcgggaacccggaaggtgcgaactgaactgtcccaaggggcaggtgtatctccagtgcggtacaccatgcaacctgacctgtcgctctctttcctacccagacgaagaatgtaacgaagcctgcctggagggctgtttttgcccacctgggctgtacatggatgagcgcggcgattgtgtcccaaaggcgcagtgtccctgttactatgacggagagatctttcagccagaggacatttttagcgaccaccacacaatgtgctactgcgaggacggtttcatgcactgtaccatgtctggagtaccaggatccctgttgcccgatgccgtgctgagcagtccactgtcgcaccgttcaaaacgcagtctttcctgtagacctccgatggtgaagctggtgtgccccgcagataatttaagagctgagggcttagaatgtacgaaaacctgccagaactatgatctggaatgtatgagcatgggttgtgtcagtgggtgcctgtgcccgcccggcatggtgcgacatgaaaatcgatgtgtcgccctagagcggtgcccttgcttccatcagggaaaggagtacgcacccggggagactgttaagatagggtgcaatacttgtgtgtgtcaggaccgaaagtggaattgcaccgaccacgtttgcgacgctacctgttccactataggcatggcacattacttgaccttcgacggccttaagtatctcttccccggcgagtgtcagtacgttctcgttcaggactactgcgggtctaatcctggaaccttcagaattttagtaggcaacaaggggtgttcacacccatccgtcaagtgcaagaaaagagtaacaatactggttgagggaggagagattgagctgttcgacggggaagtgaacgtaaagcgtcccatgaaggacgaaactcacttcgaggtggtagagtccgggagatatatcattcttctcctaggtaaagccctgtccgtggtctgggacaggcatctctctatcagtgtggtgttaaagcagacttatcaagaaaaggtgtgcgggctgtgtgggaactttgatgggattcagaacaatgacctgacaagctcaaatttgcaggttgaggaggatcccgttgattttggcaattcatggaaagtgtctagccagtgtgctgatacaaggaaagtcccacttgacagctccccagcaacctgccacaacaatattatgaaacagactatggttgacagcagttgcaggatcctcacatctgatgtgtttcaggattgtaataaactggtggatccagagccgtatctagatgtctgtatttacgacacatgctcgtgtgagtcaataggcgattgcgcatgtttctgtgacaccatagcagcttacgcccacgtgtgcgcgcaacacggtaaggtggtgacgtggaggacggcaacattatgtccccagtcatgtgaagagaggaatttgcgcgaaaacgggtatgaatgcgagtggcgttacaacagttgtgctccagcatgtcaggtgacttgtcagcaccctgagccactggcttgtcccgtgcaatgtgtggaaggctgtcatgcccactgcccacctgggaaaattcttgacgagctgctgcagacctgtgtggaccccgaggactgccctgtgtgtgaagtggccggtcggaggttcgcgtcaggaaaaaaggtgacattgaaccccagtgatcccgagcactgtcagatctgtcactgtgacgtggtgaatctcacttgcgaagcctgtcaagagccaggaggcctagtcgtcccgcccaccgacgctccagtgtctccaactactctttacgtagaagatatctccgaacccccactccatgatttttattgctcacgcctcctcgatctcgtgtttttactggacgggtccagccgactgtcagaagccgagtttgaagttctgaaggcgttcgtggtcgatatgatggaaagacttcgcatatcacagaaatgggttcgcgtggcagttgtggagtaccatgatgggtcccatgcctacataggccttaaggatagaaagcgcccatcagaactcaggcgtattgcctctcaggtaaagtatgccggctcccaggtggcctctacctctgaggtcctgaaatacacactttttcagattttctccaagattgataggcccgaggcatcccggatcaccctgctgttgatggcttcacaggagccgcagaggatgagtaggaacttcgttcgatatgtacagggcctgaaaaagaaaaaggtgatcgtcattccagtgggaataggcccccacgcaaatttaaagcagatccggctgattgagaaacaggctccagagaataaggcgtttgtactatcttctgtggatgagctagaacagcaacgagatgagatcgtctcgtatctgtgcgaccttgcgcctgaagcccccccccctaccctgcccccagatatggcccaggtaaccgtggggccaggcttactgggggtgtcaactcttggtccgaagaggaactctatggtcttggatgtggccttcgtgctcgagggatcagacaaaattggtgaggcggactttaaccggtccaaggaatttatggaggaagtgatccaaaggatggatgtcggccaggactccattcatgttaccgttttacaatactcctacatggtcacagtggagtacccttttagcgaagcccagtctaaaggcgatatcttgcagagggtgagagagatcagatatcagggcggaaatcggaccaatactgggctggccttgcgttatctttctgatcattcatttctcgtgagccagggcgatcgtgagcaggcacctaatctagtgtatatggttacaggaaatcccgcatccgacgagattaagaggttgccgggagatatccaagtcgtccccatcggcgtggggcccaacgccaatgtgcaggaactggagcggatcggctggcccaatgcgccgatcctcattcaggatttcgagactcttccccgggaagctcccgatctggttttgcagcgttgctgcagcggggaaggcctgcagatccctacgctgtctcctgcgcctgactgttcccagcccctcgatgtgattttattattggacggctccagcagttttccagcaagctactttgacgaaatgaagtctttcgctaaagcctttatctctaaggccaatatcggcccacgcctcacccaggtcagtgtactccagtacgggagcatcactacgatcgatgtgccatggaacgttgtaccagagaaggcacatctcctgagcttggtggatgtgatgcagagggagggggggccgagccagataggggacgcactgggattcgctgtcagatacctgacaagcgaaatgcatggtgctcggccgggagctagcaaggccgtcgtaattctggtcacggacgtctcagtggacagcgtggatgccgctgcggatgccgcacggagcaaccgggtgaccgtgtttccaattggcatcggtgaccgatacgacgccgcacagttgcggattctcgctgggccggctggcgactccaatgtcgtgaagttacagcgcattgaagatctgcccacaatggtaactttgggtaattcgttcttgcacaaactgtgtagtgggtttgtgaggatctgcatggatgaggacggcaatgaaaagcgccccggcgacgtctggaccctccccgaccagtgccatacggtaacctgtcagccagatggccagacactgctgaaatcccaccgggtaaattgtgatcggggactccgcccctcgtgtcctaatagccagagcccggtcaaggtcgaagaaacatgtgggtgcagatggacctgcccatgcgtgtgcaccggtagctctaccagacacatcgttacatttgatggccagaattttaaactaactgggtcatgctcctatgtgctgtttcagaataaggagcaagaccttgaggtgatcctgcacaatggggcgtgctcacctggcgcccgacaggggtgcatgaaatccatcgaagtgaagcattcagctctctccgtagagttgcacagcgacatggaggtgaccgtcaacggtagacttgtgtccgtcccctatgttggtggcaacatggaggtgaatgtttatggcgctattatgcacgaggtgcggttcaatcacttgggtcacatattcacattcactccccagaacaacgaatttcaactccaattgagccctaagacatttgcttctaagacgtatggcttatgtggaatttgtgacgagaacggggcaaatgacttcatgctgagagacggcacggtgactacagattggaaaactttagttcaggagtggaccgtgcagcgacccggccagacttgtcagcccatcctagaagagcagtgcctagtgccggactcaagccattgtcaagtcctgttactgcccttgttcgccgaatgccacaaagtactggcgcctgcgacattttatgccatttgccagcaggattcctgccatcaggagcaggtttgcgaggttatcgcatcatatgcgcacctttgcagaactaacggcgtgtgtgtggactggcgtacacctgacttctgcgctatgtcctgtccacctagcctcgtgtataatcattgcgagcatgggtgcccccggcactgtgatggaaacgtttcttcctgtggggaccatccatcagaaggttgtttttgcccccccgacaaggtcatgttggaggggtcctgcgtccctgaagaggcatgtactcaatgtataggagaagatggcgttcagcatcagtttttggaggcgtgggttcccgaccatcaaccttgccaaatctgtacctgcttgagcgggcgcaaggtgaattgtacgacgcagccctgcccaacagcaaaagcccctacttgtggcctgtgtgaagtggccaggctacggcagaacgccgatcagtgctgcccggaatatgagtgcgtttgcgacccagtttcatgcgacttaccgcccgtgcctcattgtgaacgtggtctacaaccaactttgactaatcccggagagtgcagaccgaattttacctgcgcatgccggaaggaagaatgtaaacgggtttcaccacccagctgtccgccccacaggctgcccaccctgcggaagacacagtgttgcgatgaatatgagtgtgcctgtaattgtgttaattccacagtgagttgtcctctcggctatctggcgagtacggccacaaacgactgtggatgcacaactactacatgtcttccggacaaagtgtgtgtgcacagatccacgatctaccctgtcggccagttctgggaggagggctgcgacgtgtgtacctgcaccgatatggaggacgccgtaatgggcctgcgcgtggcccaatgctcccagaagccgtgcgaagatagctgtcgatcaggctttacttacgttctgcacgaaggcgagtgctgcggtcgatgcctgccaagcgcatgtgaggtagtcacaggctctccacgaggtgacagccagtcatcatggaagtcagtcgggagtcagtgggcctcaccagagaacccatgcctgatcaatgagtgtgtaagggtgaaagaggaagtgttcattcagcagcggaacgtttcttgtcctcagctagaggtgccagtctgtcctagcgggtttcagctgagctgcaaaaccagcgcctgttgtccttcgtgtagatgcgagagaatggaagcatgtatgctgaatggcactgtcatcggcccggggaagaccgtgatgattgacgtgtgtaccacttgccgctgtatggtgcaggtgggcgtaattagtgggtttaaactggagtgtcggaaaaccacatgtaatccgtgtccactgggctacaaagaggaaaacaatactggtgagtgttgtggaaggtgcttaccaacagcctgcacgattcagttacgtggcggccaaatcatgacacttaagagagacgagaccctgcaggatgggtgcgacacccacttctgcaaagtcaatgagcggggtgagtacttctgggagaaacgcgtcaccggttgccccccatttgacgagcacaaatgcctagctgaaggcggaaaaatcatgaagatacctggaacctgttgcgatacctgcgaggagcctgaatgcaacgacattacggccaggctgcaatatgtgaaggtgggttcctgcaagtccgaagtggaggtggacatccattattgccagggcaagtgcgcctcgaaggccatgtactcgattgatattaatgacgtgcaggatcagtgctcctgctgctcgcctaccagaacggaacctatgcaagtggctctgcactgtactaatggatccgtggtgtaccacgaggtcctgaacgcaatggagtgcaagtgctccccacgcaagtgtagcaag

SEQ ID NO: 21287 - DNA, 8439 bp, Artificial Sequence
  Description of Artificial Sequence: Synthetic coding sequence
atgattcctgcacggtttgctggagtgctactagcattagcactcattttgccggggaccctttgtgctgaagggacacgcggccggtcttctacagccaggtgctcgctgtttggctcagatttcgttaacacctttgacggaagcatgtactcattcgccggatactgctcctatctcctcgcagggggctgccagaagaggtctttcagcattattggggatttccagaacggcaagcgtgtgagcctgtcagtgtatctcggtgagttcttcgacattcatctattcgttaatgggaccgtgacacagggggaccagcgggtatccatgccctacgcatccaagggcctctacctggaaacagaggcaggctactataaactgagcggggaagcatatggattcgtggctcgtattgacggctctggcaattttcaagtgttgctgtccgatcggtattttaacaaaacgtgcgggctttgtgggaacttcaacatcttcgctgaggatgattttatgactcaggagggcaccctgacttccgacccctatgattttgcaaactcatgggctctctcctctggagagcagtggtgtgaaagagccagccccccgtcaagtagctgtaatattagtagtggcgaaatgcagaagggtctatgggagcagtgccagcttctcaaatccacaagtgtgttcgcccgctgccacccacttgtcgaccctgagccttttgtggctctctgcgagaaaacactctgcgagtgtgcagggggcctagagtgtgcctgtccggccttgctggagtacgctaggacctgcgcgcaggagggtatggtgttatatggctggacagatcatagcgcatgttcccccgtgtgtcctgctggcatggagtatcgtcagtgtgtttcaccctgcgcaagaacgtgccagtccctccacattaatgagatgtgccaagagcggtgcgttgatggctgctcctgtcccgaggggcaactgcttgatgagggcctttgtgtggaatccaccgagtgcccatgcgtgcactcgggaaaacgatatcccccgggcacgagccttagccgcgactgcaatacatgcatttgccgtaactcacaatggatctgctcaaatgaggaatgccccggggagtgtttggtaactggccagtcacattttaagagttttgacaaccggtacttcactttctctggaatctgtcagtatttgctggccagagactgtcaggaccactccttcagtattgtgatcgagacagtgcagtgcgctgatgatcgtgacgccgtatgcacccgatctgtcaccgtccgactgcccggccttcacaattcgctggtgaaattaaaacacggggcaggcgtcgccatggacgggcaggatgtacaactgcccctgctcaagggggacttacgaattcagcacaccgtgaccgcctctgtacggctaagctacggcgaggacctgcagatggactgggacggccgtggacggctcctggtgaaactgagcccggtgtatgctgggaaaacctgtgggctctgcgggaattataatggcaaccagggggatgatttcttgacaccttcaggcctcgctgagccacgggttgaagactttgggaatgcctggaagttgcacggtgactgccaggatttacagaaacagcactccgatccctgcgctttgaaccctagaatgactaggttctcagaagaagcatgcgcagtcctgacctcacccacattcgaagcctgccacagggccgtgtctccacttccataccttcgaaattgcaggtatgacgtttgctcttgcagcgacgggcgggaatgcctgtgtggtgcattggcgtcatatgccgctgcgtgtgcagggcgcggcgtgcgggttgcctggagagagccagggagatgtgagctgaattgtccaaaggggcaggtgtatttgcagtgtggcactccgtgcaatctcacatgtcgcagcttatcttaccccgatgaggagtgcaacgaggcttgcttggaaggatgtttctgcccacctggtctgtacatggacgaacggggggactgcgtacccaaggctcagtgtccttgctattatgatggtgagatctttcaaccagaggatatattctcagaccatcacacaatgtgctattgtgaggacgggtttatgcactgtacgatgtcgggtgtgcccggatctcttttgcccgatgctgttctttcttctcctctgtcccatcgttccaagagaagcttaagctgccggccaccaatggttaagctcgtgtgtcctgcggacaacttacgggcggaggggctagaatgcacaaaaacatgccaaaactacgacctggagtgcatgagtatgggctgcgtgtctggatgcttgtgtccccctgggatggtgaggcatgagaacagatgcgttgcgctcgagaggtgtccctgtttccatcaaggcaaggagtacgctcccggcgaaacagtcaagatagggtgcaacacgtgcgtgtgtcaggaccggaaatggaattgtactgaccatgtttgtgatgccacatgtagcacgatcggtatggctcactatctgactttcgatgggctcaagtatctctttccgggtgagtgtcagtacgtcttggtgcaggactactgcggctccaacccagggaccttccggattcttgttggtaacaagggttgcagccacccatccgtaaaatgcaagaaaagggtaaccatcctagtggaaggtggggaaatagaactgtttgacggtgaagtaaacgtcaagagacctatgaaggatgaaacccacttcgaagttgtggagagtggcaggtatattattctcttgttaggaaaagccctatctgttgtgtgggacaggcatctctccatatctgtggtgctgaagcagacctatcaggagaaggtctgcggcctctgcgggaattttgatggtatccagaacaacgacctgacctcatccaatttgcaggtggaagaggatcccgtggatttcgggaactcctggaaggtttcgtcccagtgtgccgacacacgaaaggtaccactcgatagtagtcccgccacctgtcacaacaacattatgaaacagaccatggttgatagcagctgcagaattttgacgagcgatgtttttcaagactgtaataagttggtggaccccgagccctacttagacgtatgtatctacgacacctgcagttgcgagtccatcggcgactgcgcctgtttctgcgacaccattgctgcatatgcccacgtgtgcgctcagcatggaaaagtggtgacatggcgaactgccacactctgtcctcagagctgtgaggaacggaacctcagggaaaacgggtatgagtgcgagtggagatacaacagctgtgcacctgcatgtcaggtcacttgccagcacccggagcctctcgcctgtccggtccagtgcgtggagggctgtcatgcccattgcccaccaggtaagatcttggacgaactgctgcagacctgtgtggacccagaagactgccctgtgtgtgaagtggccggcaggagattcgcctctggcaagaaagtcactctaaacccttccgaccctgaacactgccagatttgccactgtgatgttgtgaatcttacgtgcgaggcatgtcaggaaccgggcggacttgtcgttcctccgacagacgcccctgtgagcccaaccacattatacgtggaagatatttcggagcctccattacacgatttttattgttctcgactattagaccttgtctttcttctggatggatccagccgcttatctgaagcggagttcgaagtcctgaaggcattcgtggtggatatgatggaaaggcttaggatctctcagaaatgggttcgagtggccgtagtcgaatatcacgacgggagccacgcttacattggattgaaagaccgcaagcgcccatctgagctgagacgaatcgccagccaggtgaaatatgctggatctcaggtagcatccacctctgaagtcttgaagtatacactctttcaaatcttctctaaaatcgaccgcccagaggcatctagaattacgctcctcctgatggctagtcaggagccgcagcgaatgtccagaaatttcgtgaggtacgtacagggcctgaagaaaaagaaggtaattgtgattcccgtgggtatcggtcctcacgccaatttgaagcaaattcggcttatagagaagcaggcaccggagaataaagcgtttgtgctgagcagcgtggatgagcttgagcagcagcgggacgaaattgtcagctatttatgcgacctcgccccagaggctccacctccgaccctaccccccgacatggcccaggttacagttgggccaggtctactgggagtgtcaacgctggggcctaagcgtaattcgatggttttggacgtggcttttgttttagagggtagtgacaaaatcggagaggcagatttcaaccgctctaaggaattcatggaggaagttatacagaggatggacgtgggccaggactccatacacgtgaccgtgctacagtatagctacatggttactgtggagtaccccttttccgaagcgcagagtaagggcgatattctccagcgcgtcagagaaatcagataccagggtgggaataggacaaatacaggattagctcttcgctatctgtctgatcactctttcctggtcagccaaggcgacagagaacaggcgccaaatctcgtctacatggtgacaggaaacccagcttctgacgaaattaagagactgccaggggacatccaggttgtaccgatcggggtgggacctaacgctaacgtccaggagttagagcgaataggatggccaaatgctcccatattgatccaggatttcgaaacactgccacgagaggcccctgatctggtactacaaaggtgctgttctggggagggcctgcagatcccaacgctgagtcccgctcctgattgcagtcagcccctcgatgttatcttgttgttggacggctcgagcagtttccccgcgtcctattttgacgaaatgaagtcattcgccaaggcgttcatctccaaggcgaatatagggccacgtctgactcaggtgtcagtgctacagtacgggtcaatcacgaccatagacgtgccctggaatgtcgttcctgagaaggctcatctgctttccctagttgacgtgatgcagcgagagggaggtccaagtcagatcggtgatgctctgggcttcgccgtcaggtatctgactagtgagatgcacggggcaaggccaggggcaagtaaggccgtggtgatcctggtgacagatgtttcagtcgactccgtagatgccgcggccgacgccgctagatctaatagggtgactgtctttcctatagggattggggaccggtatgacgccgcccagctgaggatcctagcaggtccagcaggcgattcgaatgtcgtaaagttgcagagaattgaggacttgcccacaatggttactctggggaactctttccttcacaagctctgctctggctttgtcaggatctgtatggacgaggatgggaacgaaaagaggccaggcgacgtgtggactttacccgatcagtgtcataccgtgacttgtcagccagacggacaaacgctcctgaaatcccaccgagtcaactgtgacaggggactgcgcccaagctgccccaatagccagtcccccgttaaagtcgaagaaacctgcgggtgtcgctggacctgtccatgtgtctgcactggaagctctacacggcacatcgtcaccttcgacggccaaaattttaagcttacaggaagctgttcctacgttctgttccagaataaagagcaggatctggaggtgattctgcataatggagcttgttctccaggtgctaggcaaggatgcatgaaatccattgaggttaaacactcagctctttccgtggagctgcattcggatatggaggtaaccgtgaatggccgtctagtgtccgtgccctacgtaggagggaacatggaggttaatgtgtacggggccattatgcatgaagttaggtttaatcacctgggtcacatcttcactttcacccctcagaacaacgagttccagctccagctgagtcctaaaacttttgcctccaagacttacggattgtgcggaatctgtgacgagaacggtgccaacgattttatgctgcgggatgggactgtgaccacagattggaaaacccttgttcaagagtggacagttcaacgtccagggcaaacgtgccagccaatcctggaggagcagtgtctcgtccctgattcatcccactgccaggtcctgctgttgcccctgtttgctgaatgccacaaagtgctggctccagcaactttctacgccatctgccagcaggatagctgccatcaggagcaggtatgcgaggttatcgctagctatgcccatctctgccgcactaacggcgtgtgcgtggattggcgcacacccgacttctgcgccatgtcatgccccccctctctggtatataatcattgtgagcacggttgccctcggcattgcgatggcaacgtgtctagttgcggggaccacccatctgagggctgcttttgcccacccgacaaggtgatgctggagggaagttgcgttcctgaggaggcttgcacccagtgcatcggggaagatggcgtccagcatcagtttttggaagcatgggttcctgaccatcagccatgccagatctgtacatgcctctctggtagaaaggtgaactgtaccactcagccctgtcccacagccaaggctcccacctgtggattatgcgaggttgctagactgcgccagaatgccgaccaatgctgccccgaatacgagtgcgtgtgtgatcccgtatcatgtgatttacccccagtccctcactgcgagcggggactgcaaccgactctgacaaacccgggcgaatgtcgcccaaacttcacatgtgcctgtaggaaggaagagtgcaagagagtgagtccgcctagctgtcccccccaccggctgcctacacttagaaaaacacagtgttgcgacgagtacgagtgtgcctgtaactgcgtaaactctactgtgagctgtccgctgggctacttggcttcgacagctacaaacgactgtggctgtaccaccaccacttgcttgccggacaaagtgtgcgtccatcggagcacaatataccccgtcggacaattctgggaggaaggttgcgacgtgtgcacctgtactgatatggaggatgctgtcatgggcctgcgagttgcccaatgtagtcaaaagccctgcgaggattcctgcagaagtggcttcacatacgtgcttcacgagggcgagtgctgtggccgttgcctgcccagcgcttgcgaagtcgtaaccggaagccctagaggggactctcagtccagctggaagtcagtgggctcacagtgggcctctcctgaaaatccatgtttgattaacgaatgtgttagggtcaaggaggaggtgtttattcagcagaggaatgtgtcttgtccgcagctcgaggtgccagtttgcccctccggttttcaattgagttgcaagactagcgcgtgctgcccatcctgcagatgcgagcgcatggaggcttgcatgctgaatggcacagtcattggccctggaaagactgttatgatcgacgtttgtacaacctgccggtgtatggtacaagtgggggtaatctctggtttcaagcttgagtgtcgcaagactacatgtaatccttgtccgctggggtacaaagaggagaataatacaggagagtgttgcggccgatgtctacccaccgcctgcaccatccagctaaggggtggccaaattatgactcttaaaagggatgagactctacaagatgggtgcgatacacatttttgtaaggttaatgaacgaggagaatacttttgggagaagagggttaccggctgccccccgttcgacgaacacaaatgtctggcagaggggggtaaaatcatgaagatcccgggcacctgctgcgacacctgtgaagaaccagagtgcaacgacattaccgctaggctccagtacgtcaaagtgggctcctgtaagtcggaggttgaagtggatatacattactgtcagggcaagtgcgcgtctaaggccatgtacagcatcgatatcaacgatgtgcaagaccaatgtagttgttgttctcctacacgcactgaaccaatgcaggtcgccctccactgcaccaacgggtcagtggtttatcatgaggtgctgaatgccatggagtgcaagtgttccccgcggaaatgcagtaag

SEQ ID NO: 21288 - DNA, 8439 bp, Artificial Sequence
  Description of Artificial Sequence: Synthetic coding sequence
atgattccagcacgatttgcaggcgttcttcttgcactggccctgattctgcccggtaccctgtgcgcagaaggaacccggggaagaagctctaccgcaagatgttcactgttcggttccgattttgtgaacacctttgatggatcgatgtacagctttgcagggtactgttcctaccttctggctggaggatgtcagaagagatcgttcagcattattggtgatttccagaacggcaagcgggtgtctctgtcagtgtacttgggtgaattcttcgatattcatctttttgttaacggaacggtgacccaaggggaccagcgcgtctcgatgccttacgcatccaagggactgtacctggaaaccgaagcaggttactacaaactgtcgggtgaggcatacgggtttgtcgcgcgcatcgacggtagcggaaacttccaagtgctgctctccgaccgatactttaacaaaacgtgcggtctttgtggtaacttcaatatcttcgccgaagatgatttcatgactcaagaaggcaccttgacctccgatccctacgatttcgcaaattcctgggcgcttagctccggtgaacaatggtgcgaacgcgcaagccctccatcatcgagctgtaacattagctcgggtgaaatgcaaaaaggcctttgggagcaatgccagctcctgaagtccacttcagtctttgcacgttgtcatcccctggtcgacccagagccctttgtggcactgtgtgaaaaaactctgtgtgaatgtgcaggcgggctcgaatgtgcgtgtccagcactgctggagtacgcgcgaacgtgtgcacaagagggcatggtgctttacggatggacggatcactcagcatgcagccctgtgtgtcccgcaggtatggaatacagacaatgtgtgtcaccatgtgcacgtacgtgtcaatccttgcacatcaacgagatgtgccaagagcgatgtgtggacggttgtagctgtcctgaaggccaactgcttgatgagggactttgcgtggaatccactgagtgcccatgtgtccattccggtaagcgttacccgcccggcacctcactgtcccgagactgtaatacctgtatctgcaggaactcacaatggatctgcagcaacgaggagtgtcccggagaatgcctcgtgaccggtcaatcccacttcaagagctttgataacagatacttcacctttagcggtatttgtcaataccttctggcacgggattgccaggaccattccttttcgattgtcattgaaacggtgcagtgtgcagatgacagagatgcggtgtgtaccaggagcgtgaccgtgcgcctgcccggtttgcataattcgcttgtcaaactgaaacatggcgctggagtggccatggacggtcaagacgtccaattgccactgcttaagggggatctgcggattcagcacactgtgaccgcgtcagtgagactcagctacggagaagatctgcaaatggactgggatggaagaggccgccttctggtcaagctctcaccggtgtacgctggaaagacgtgcggactttgcggaaactacaatggtaatcagggggatgattttctgactccatcgggcctggccgaacctcgggtcgaggactttggaaacgcttggaagctccatggagattgtcaagaccttcaaaagcaacactccgacccctgcgctcttaaccccagaatgaccagattttcggaagaagcatgtgctgtgctcacctcccctaccttcgaggcatgtcatagagcagtgtctcctctgccgtacttgagaaactgtagatacgacgtctgctcgtgttccgacggccgggagtgcctttgtggagccctcgcatcatacgcggccgcatgcgcgggacgaggcgtgcgagtggcatggcgggaacctggaagatgcgaactgaactgtccaaagggacaggtctatttgcaatgtgggactccatgcaaccttacttgcagatctcttagctacccggacgaagaatgcaacgaagcctgtctcgagggatgtttttgtcctccagggctttacatggacgaacgtggtgactgtgtgccaaaggcacaatgtccgtgttactatgatggagagatttttcaaccagaggacattttctccgatcatcacaccatgtgttactgtgaagatggcttcatgcactgtactatgtcaggagtgcccggatcccttctcccagatgcagtgctctccagccccctttcacatcgatccaaaagatcgctgtcatgccggccccctatggtcaagctggtgtgccccgcagataatcttagggcagaaggcctggaatgcaccaagacttgtcaaaactacgatctcgaatgtatgtccatgggatgtgtctcaggatgtctctgccctccagggatggtccggcatgaaaatagatgcgtggcgttggagaggtgcccctgtttccaccagggtaaggagtacgctccaggcgaaactgtgaagattggttgcaatacttgcgtgtgccaagatcgtaaatggaactgtaccgatcacgtgtgtgatgcgacctgttcgaccatcggtatggcccattaccttacttttgacggtctgaaataccttttccctggggaatgtcagtacgtcctcgtgcaagattactgtgggagcaatccgggtactttcagaatcttggtgggaaacaagggttgttcacatcctagcgtgaagtgtaaaaagcgtgtgactattctggtggagggaggagaaattgagctttttgacggagaagtgaatgtgaagaggcctatgaaggacgaaacccattttgaggtcgtggaatctggtcggtacatcattcttcttctcggcaaggcactctccgtggtctgggatcgccatctctccatttccgtcgtccttaaacaaacctaccaggaaaaggtgtgcgggctttgcggtaactttgatggcatccaaaacaacgaccttacgagctcaaacctccaggtggaggaagatccagtggactttggcaactcttggaaggtgagctcccaatgcgcagatacgcgaaaagtcccactggattcgtcccccgctacttgtcacaacaacatcatgaagcaaacgatggtcgactcgtcgtgtagaattctcacttccgacgtgtttcaggattgtaacaaacttgtggaccctgaaccttaccttgatgtgtgtatctacgacacctgcagctgcgaatcaatcggggactgcgcctgcttttgtgacaccatcgccgcatatgcacatgtctgtgcacagcacgggaaggtggtcacttggcggaccgcaaccctctgtccacaaagctgtgaagaaagaaacctgcgcgaaaatggttacgaatgtgaatggcggtacaattcctgtgcacccgcctgtcaggtgacctgtcaacatcccgaacctctcgcctgcccagtccaatgtgtcgagggatgccacgcccattgtcctcctggcaagatccttgacgagttgcttcagacctgcgtcgatcctgaagattgtccggtctgtgaagtcgccggcagacgctttgcgtccgggaagaaagtgactctgaacccgtcagacccagaacattgccagatttgtcattgtgacgtcgtgaacctcacttgtgaagcctgccaagagccaggcggtcttgtggtgccaccaaccgacgcgccagtgtcgccgaccactctgtatgtggaggatatttcggagcctcctcttcacgacttttactgttcacgcctgcttgacttggtctttctgttggatggttcaagccggctctccgaggcagaatttgaagtgttgaaggcctttgtggtcgatatgatggagcgacttagaatttcgcaaaagtgggtgcgcgttgcggtggtggagtaccacgatggttcgcatgcctatatcggactgaaagatcgaaaacgcccttcggaacttcgccgtattgcatcacaagtgaaatacgcaggcagccaggtggcaagcaccagcgaagtccttaagtacaccctgtttcaaatcttttcaaagatcgacagacctgaagcctctcgtattactctgcttctcatggcctcccaggaaccgcaaaggatgtcccgtaactttgtgaggtacgtgcaggggctgaaaaagaagaaggtgatcgtgatcccagtgggtattggtcctcatgcaaacctgaaacagattaggcttattgaaaaacaagcacctgagaacaaagcctttgtgctgtcctccgtggatgagcttgaacagcaacgggatgaaatcgtgtcatacctctgcgatcttgcaccggaagcaccgccaccaacccttcctccagacatggcccaagtgactgtgggaccaggactgttgggtgtgtcaactcttggaccaaagcgcaactctatggtgctggacgtggcgtttgtgcttgaagggagtgacaaaattggtgaggcagactttaacaggtccaaggaattcatggaagaagtgattcaacggatggatgtgggacaagacagcattcatgtcaccgtccttcaatacagctacatggtgaccgtggaataccccttcagcgaagctcagtcgaagggtgatattctccagcgggtcagggaaattagataccaaggggggaaccgcactaacactggccttgccctgcgctacctgagcgaccatagctttcttgtgagccagggggatcgggaacaggctcctaacctggtgtacatggtgacgggaaatcccgcatccgacgagattaagagactccctggtgatatccaggttgtgcccataggggtgggacctaacgcaaacgttcaagagcttgaaaggattggatggcccaacgcacctatccttatccaagactttgaaaccctgcctcgagaggcacctgatcttgtcttgcaacgctgttgttccggagaaggactgcaaattcctaccctgtcgccagctccagattgctcacaaccactcgatgtcatactcctgctcgatggatcatctagctttcctgcatcgtattttgatgagatgaaatcgtttgcgaaggcattcatttcgaaggctaacattggtcctaggctcacgcaagtgtcagtcctgcaatacggatccattaccaccatcgatgtgccctggaacgtggtgcctgaaaaggcccatcttctgtccctcgtcgatgtgatgcagcgggaaggaggtccttcacagataggggatgcgcttggttttgcagtgcgctacctcacctcggagatgcacggcgcacggccgggtgcatcgaaggccgtcgtgatcctggttaccgatgtttccgttgactcggtggacgccgcagcagatgcagccaggtccaaccgtgtcactgtgttcccaataggtattggtgaccggtacgatgcagcacaacttcgaatccttgcaggtcctgccggggatagcaacgtcgtgaaacttcagcgtattgaagatctgcctaccatggtcacccttgggaactcctttttgcataagttgtgttcaggatttgtgcggatatgtatggatgaggatggaaacgaaaaaagacccggtgatgtgtggactctgcccgaccagtgtcataccgttacttgtcagcccgacggccaaacccttcttaaatcgcatcgggtgaactgtgaccgggggctgcgaccctcatgtccgaactcacaatcacctgtgaaagtagaagagacttgtgggtgcagatggacctgcccatgtgtgtgtacgggatcctcgaccagacacattgtcaccttcgatggacaaaacttcaagctcaccggatcctgctcgtacgtgctgtttcaaaacaaagaacaggatctggaggtaatacttcacaatggcgcatgttcgcctggcgccagacaaggctgtatgaaatccattgaggtgaaacattcggctctttccgtcgaactgcattccgatatggaagtgaccgtgaatggtcggctcgtgagcgtgccttacgtggggggtaatatggaggtcaatgtctacggcgcaatcatgcacgaagtcagatttaaccaccttggacacatattcacttttaccccgcagaacaacgaatttcaacttcaactctcgccaaagacctttgcatctaagacctacggattgtgcggtatttgtgatgagaacggtgcaaatgatttcatgctgcgcgacggaaccgtgactaccgactggaaaactttggtgcaggaatggacggtgcagcgccctggccaaacgtgccaacccatcttggaagaacaatgcctcgtgcctgattccagccactgccaggtgctgcttctgcccctttttgcagaatgccataaagtgcttgcacctgccaccttctacgcaatatgtcagcaagactcatgtcaccaagaacaggtgtgtgaggtgatagcctcatacgcacacctttgcagaacgaacggagtctgtgtggactggagaaccccggatttttgtgcaatgtcctgtcctccttcccttgtgtacaaccattgtgagcatggttgtccaaggcattgtgatggaaatgtctcttcatgtggcgaccacccctccgaaggatgtttttgcccaccggataaggtgatgttggagggctcatgtgtgcccgaggaggcttgcacgcagtgcattggggaagatggggtgcagcaccagtttctggaagcctgggttcctgaccatcagccatgtcagatttgtacttgcctgtcgggacgcaaggtcaactgtactacccaaccatgtcctactgcaaaggcaccaacctgtggcctttgcgaagtggcaagactgagacaaaacgcagatcagtgttgccctgaatacgaatgtgtgtgcgatcctgtatcctgcgacctccccccagtgcctcactgtgagcgtggactccaacctactctcactaaccccggagaatgtcgaccaaacttcacttgtgcctgtagaaaggaagagtgcaagcgtgtgagcccgccttcttgtcctccacatcggcttcctactcttcggaaaactcagtgttgtgatgaatacgagtgtgcctgtaactgtgtcaactccaccgtctcgtgtccactgggatacctcgcatcgaccgcgaccaacgattgcggctgtaccactactacctgcctgcctgacaaggtgtgtgtgcatcgtagcaccatttacccggtgggccaattctgggaggaagggtgtgatgtgtgtacttgtactgatatggaagatgccgttatgggacttcgggtggctcagtgcagccagaaaccctgtgaagattcgtgtagatcgggatttacctacgtcctccatgaaggggaatgttgtggacgctgccttccctccgcctgcgaagtggtgaccggctcacctcgtggtgatagccagtcctcctggaagtccgtcgggtcccagtgggcgtcacctgaaaatccatgcctgattaatgagtgtgtgcgggtgaaagaggaagtgttcatccagcaaaggaacgtgtcgtgtccccaacttgaagtgcctgtgtgcccctcgggtttccaactgtcgtgtaaaacgtcggcatgttgtccttcgtgtcgttgcgagaggatggaagcctgcatgcttaacggaactgtcatcggtcccgggaaaaccgtgatgatagacgtgtgcactacctgccggtgtatggtccaggtgggagtgatctcgggattcaaacttgaatgtaggaaaactacttgtaacccgtgtccccttggctacaaggaagaaaacaataccggagaatgctgcggaaggtgtctgccaaccgcatgtaccatccagcttaggggcgggcaaatcatgacccttaaaagggacgaaaccttgcaggacgggtgcgacactcacttctgtaaggtcaacgaaagaggtgagtacttctgggagaaaagagtcactggatgcccaccatttgatgaacacaaatgcctcgcagagggtgggaagatcatgaagataccaggcacctgttgtgatacttgcgaggaaccggaatgcaacgatattactgcgaggctccaatacgtgaaggtcggctcctgtaagtcagaagtcgaagtcgatatccattactgccaaggaaagtgtgcatccaaggcaatgtactcgattgacataaacgatgtgcaggatcagtgttcgtgctgctcgcctactcgcaccgaaccgatgcaagtggcccttcactgtaccaatggctccgtcgtctaccatgaagtccttaacgcgatggaatgcaagtgctccccaaggaaatgttcgaag

SEQ ID NO: 21289 - DNA, 8439 bp, Artificial Sequence
  Description of Artificial Sequence: Synthetic coding sequence
atgattccagcacgttttgccggtgtgcttttggcgctcgccctgatattgcccgggactctgtgtgccgaaggtacgaggggccgcagctcaaccgctagatgctcgctgtttggatcggactttgtgaatacctttgacggatctatgtactcgttcgcgggatactgctcctacctcctcgctggcggatgtcaaaagagatccttttccattatcggagattttcaaaatggtaagagggtgtccctctcggtctacctcggagagtttttcgatattcatctgttcgtgaacggtactgtgactcagggcgatcaaagggtgtcaatgccttacgccagcaagggcttgtaccttgaaaccgaagccggctactacaagctgagcggcgaagcatacggattcgtggcgagaatcgatggttcgggaaatttccaagtcctgctgtcagatcggtactttaacaagacgtgcgggttgtgtggtaatttcaacatttttgccgaggacgactttatgactcaagaaggaactcttacttcagatccctacgacttcgccaattcgtgggcactgagctccggtgagcagtggtgcgagcgagcgtccccaccatcgtcctcatgcaacatcagcagcggagaaatgcagaagggactgtgggaacagtgtcaacttcttaagtccacttctgtgttcgcgcgttgtcatccgctggtcgatccggaaccctttgttgcactttgtgaaaaaactctttgtgaatgtgcaggcggtcttgagtgtgcatgtccagcactcctggaatatgccagaacctgcgcacaagaaggaatggtgctgtacggatggaccgatcactccgcatgcagcccggtctgtcccgcgggcatggaatacaggcagtgcgtgagcccttgtgcccggacctgtcaatcactccacattaacgagatgtgtcaggaaagatgcgtggacggctgtagctgtcccgaaggacaacttctggacgaaggattgtgtgtggaatccactgagtgtccttgcgtgcattcaggtaagagataccctcctggcacctcgctctcgcgcgactgtaacacctgtatttgtaggaactcccagtggatttgttcgaacgaggaatgtccaggcgaatgtctcgttactggacaatcgcatttcaagtcatttgacaatagatacttcaccttctccggaatttgccagtacctgcttgcacgggattgtcaagatcattcgttctcaattgtgattgagactgttcagtgcgccgacgatagggacgcagtttgtacgagatcagtcactgtgcggttgccaggcctgcataacagccttgtgaaacttaaacacggtgccggtgtggctatggatggacaagatgtgcaactgcctctgctgaagggagacttgcgcatccaacacactgtgaccgcaagcgtgaggctttcatacggagaagatcttcaaatggattgggacggcagaggacgcctgcttgtgaagctctcgccagtgtacgcaggcaagacgtgtggactgtgcggaaattacaacgggaaccaaggggacgattttcttactcccagcggacttgccgaaccacgggtggaggattttggtaatgcttggaagctgcatggagactgccaagaccttcagaagcagcattcggatccgtgtgcgcttaatcctcgcatgaccagattttcggaggaagcatgtgcagtgctcaccagccctacctttgaggcatgtcatagagcagtctcgcccctgccttacctgcgtaactgtcggtacgacgtctgttcatgctcggacggacgggagtgcctttgcggtgcacttgcatcgtacgcagcggcatgcgctggtagaggagtgcgggtcgcatggagagagcctggacgatgcgaactcaactgtccgaaaggccaagtgtacttgcagtgcggaaccccctgcaatctgacgtgcaggtccctttcgtatcccgacgaagagtgtaacgaggcttgtctggagggttgcttttgcccgcccggcctgtacatggatgagagaggggactgtgtccctaaggcacagtgtccatgctactacgacggtgagatcttccagccagaagatatcttttctgaccatcacacgatgtgttactgcgaggatggttttatgcactgtaccatgtcaggcgtgcccgggtcgctgctccctgatgccgttctttcatcccctctttcccataggtccaagcggtcactctcctgtcggcctccaatggtgaagttggtgtgtcccgccgataacttgcgcgcagaagggctggagtgcaccaaaacctgccaaaactacgatctcgaatgtatgtcaatgggctgtgtctcagggtgcttgtgtcctcctggtatggttcgtcatgagaatcgctgcgtcgccctggaacgatgcccatgtttccatcagggtaaggaatacgctcccggtgagactgtgaagattggttgtaacacttgcgtgtgtcaggatagaaagtggaattgcactgatcatgtgtgtgacgcaacttgttccactatcggaatggcacattacctgacttttgacggccttaagtacctgttccccggagaatgtcaatacgtcttggtccaagattactgtggatcgaaccctgggaccttccgcatactcgtcggtaacaaggggtgttcccatccctcagtcaaatgtaagaagcgcgttactattcttgtcgaagggggtgagattgagctttttgacggagaggtgaacgtgaaacgccctatgaaggacgagactcacttcgaggtggtcgaaagcggccgatacatcattctgctgctcgggaaggcactgtccgttgtctgggaccggcacctgagcatttcggtggtgctcaaacaaacctatcaggagaaagtgtgcggcctctgcggaaactttgatggtattcagaataacgatcttacctcatccaatcttcaagtggaagaggatccagtggactttggaaactcttggaaggtgtcctcccaatgcgcggacactcggaaggtgccccttgatagcagcccagcaacctgccacaataacattatgaagcagactatggtcgacagcagctgccgaatcctgacctccgacgtgtttcaggattgcaacaagctcgtggatcctgagccttaccttgatgtgtgcatttatgacacttgttcgtgcgaatccataggagattgcgcctgcttttgtgataccattgcagcctacgcacatgtgtgtgcccagcatggtaaggtggtgacctggcgaacggcaacgctgtgcccgcaatcgtgtgaagagagaaatctccgcgagaatggttacgaatgtgagtggcggtacaacagctgtgcacccgcttgtcaagtgacttgtcaacacccagagcctcttgcctgtcctgttcagtgtgtcgagggttgtcatgcccattgcccacccggtaaaatccttgatgaacttttgcaaacctgtgtggatccagaggactgccccgtctgtgaggtggcaggaagaagattcgcctctgggaagaaggtcacgcttaacccttccgatccagaacactgtcagatctgccattgtgatgtggtcaaccttacgtgcgaagcatgccaagaaccaggcgggttggtggtccctccaactgacgccccggtgtcccccaccaccctgtacgtcgaggacatttcggaaccaccgctccatgacttttactgctcgcgcctgctggatctggtgttcctgctcgatggatcctccagacttagcgaagcggaattcgaagtgctcaaggcatttgtcgtggatatgatggagcgccttcgaatatcgcaaaagtgggtgagagtcgctgtggttgaataccatgatggatctcatgcatacataggacttaaagatagaaagcgcccttcggagctgaggcggatagcatcccaagtgaagtacgcaggatcgcaggtggcatcgacctcggaggtgctgaagtacacgctttttcagattttcagcaaaattgatagaccggaagcctccagaattactctcctcttgatggcatcccaggaaccccaacgcatgagccggaattttgtgcgctacgtccaaggactcaagaaaaagaaggtgatagtgatcccagtgggaatcggccctcacgcaaaccttaaacaaatccggctgattgagaaacaggctccagaaaacaaagcattcgtgctgtcgtcagtcgacgaactggagcagcagcgagatgaaattgtttcgtacctgtgcgatctggccccagaagccccgcctccaacccttccaccagatatggcccaggtgactgtgggtcctggtttgttgggggtgtctacgctgggtcctaagcgtaactcaatggtgctggatgtcgcgtttgtcttggagggtagcgataagatcggtgaagctgacttcaatagatccaaggaattcatggaagaagtgatacaaagaatggatgtcggccaggatagcattcatgtgactgttcttcagtactcctatatggtcactgtggaatacccattttccgaagcacaatcgaagggagacattctccagcgtgtgcgcgaaatccgctaccagggtggtaatcggaccaataccggacttgctcttaggtacctttcggatcactcctttctcgtgtcacaaggcgacagagaacaggccccaaatctggtgtacatggtgacgggaaaccccgcgagcgatgaaatcaagcgcctcccgggagatattcaagtggtgcccatcggggtcggacctaacgctaacgtgcaggagctcgaaaggattggctggccgaatgcgccaatccttatccaagattttgaaactctgcctagagaagcgcctgatctcgtgcttcagcggtgttgttccggcgaaggtctgcaaatacctaccctttcacccgcccctgactgtagccaacccctggatgtgatactgttgctcgatgggtcctctagctttccggcatcatactttgatgagatgaaatcgtttgccaaggccttcatctccaaggcaaacatcggcccacgccttacccaagtcagcgtgcttcaatacggctcaataaccaccatcgacgtgccttggaatgtggtgccagaaaaggcacacctgctgtcattggtggatgtgatgcagcgagagggcggacctagccaaattggcgatgcactgggttttgcagtccggtaccttaccagcgagatgcatggcgcgcgcccaggggcatcaaaagcagtcgtgattcttgtcaccgatgtgtcggtggattccgtcgatgccgcagcagatgcggcacgttcgaaccgggtcactgtgtttcctattggtatcggggaccgttacgacgcggcacagctgagaatcctcgcgggacctgctggcgatagcaatgtcgtcaagctccaacgtatcgaggaccttcccactatggtgacgctgggaaactcatttcttcataaactgtgttcaggatttgtgcgaatttgcatggatgaagatggcaacgaaaaacggccgggggatgtgtggacccttcctgatcaatgccataccgtcacttgccagcctgatggtcagactctgttgaagtcgcaccgcgtgaactgtgatagagggttgcgtccttcatgcccaaactcccaatctcctgttaaggtcgaagaaacctgtggctgtagatggacttgtccgtgtgtgtgcactggatcatcgactcggcatatcgtgacttttgatggtcaaaactttaagttgaccggttcctgcagctacgttcttttccaaaacaaagaacaagatcttgaagtcattctgcataatggggcatgtagcccaggcgcgagacaagggtgtatgaaatcaattgaggtgaagcattccgccctgtctgtggaacttcatagcgatatggaagtgactgtgaacggacggcttgtctcggtgccatacgtgggtggaaacatggaagtcaacgtgtacggggcaattatgcatgaggtgagattcaatcatctggggcacattttcacttttaccccacagaacaacgaatttcagctgcaactcagccccaagacctttgcctcgaaaacctacggattgtgtgggatctgtgacgagaacggggcgaacgatttcatgctccgagatgggactgtcaccactgattggaaaaccctggtgcaggaatggactgtgcaaagaccaggacaaacttgccagccgatcttggaagagcaatgcctcgtgccggattcatcccactgtcaagttctcctgttgcctttgtttgcagaatgtcacaaagtgcttgcacctgcaactttctacgctatatgtcagcaggatagctgccaccaagagcaagtctgtgaagtcattgcttcgtacgcccacctctgcagaactaatggagtttgtgtcgactggcgaacccccgacttttgcgcaatgtcgtgtccaccatcgttggtctacaatcactgtgaacatggttgtcctcgtcactgcgatggaaacgtgagctcatgtggggaccatccatcggagggctgtttctgccccccggacaaagtcatgcttgaagggtcatgtgttcccgaggaagcatgcactcagtgcattggggaagatggagtccagcatcagtttcttgaagcatgggtgcctgatcaccagccatgtcagatttgcacctgcctgtccggtcgtaaagtcaactgcactacgcagccttgccctactgcgaaggcccctacttgtggactgtgtgaagtggcaagactgaggcagaacgcagaccagtgttgtccagaatatgaatgtgtctgtgatccagtgtcatgtgatctgcctcccgtgcctcattgcgaaagagggctgcagccaaccctgaccaatcccggtgaatgccggcctaatttcacctgtgcatgccgcaaggaggagtgtaagcgtgtgagccctccttcctgcccaccacatagacttccaaccctgcgtaagacgcaatgttgcgacgagtacgaatgcgcctgtaattgcgtcaactccaccgtgtcctgtcctctgggatacctggcatccaccgcaacgaatgactgtggatgtaccacgaccacgtgtctgccagacaaggtgtgcgtccaccgatcaaccatttatcctgtcggacaattttgggaggaaggttgtgacgtctgcacctgtaccgatatggaagatgcagtgatggggctccgggtcgcacaatgctcgcagaagccgtgtgaggactcttgcagatccggtttcacctacgtgctgcacgagggagaatgctgtggtcggtgtttgccctcggcttgtgaggtggtgactggatctcctcgtggcgactcacaatcctcgtggaagtccgtcggtagccaatgggcaagccccgagaacccctgtcttatcaacgaatgtgtcagagtgaaagaagaagtgtttatccagcagcggaacgtctcctgccctcagcttgaggtgcctgtgtgcccttcgggattccaacttagctgcaagaccagcgcgtgttgtccttcgtgtaggtgtgaacgtatggaggcatgtatgctcaacggaactgtcattggaccaggaaaaacggttatgatagacgtgtgtaccacctgtcgctgtatggttcaagtgggcgtcatttcgggctttaaactggaatgtagaaagactacctgtaatccctgtccgcttggttacaaggaagagaacaacactggcgaatgttgtggacgctgccttcctactgcatgtacgatacaactgagaggaggtcaaatcatgactttgaaaagagacgaaaccttgcaagacggttgtgacactcacttttgtaaggtgaacgagaggggggaatacttttgggaaaagcgggtgaccggatgtccaccttttgatgaacataagtgtttggcagaaggaggcaagattatgaagatcccaggcacctgttgcgacacttgtgaagaacctgaatgcaatgatatcaccgctcggttgcaatatgtgaaggtggggtcttgtaagtccgaagtggaagtggatattcactattgtcaaggaaagtgtgcatcaaaggccatgtactcgatcgatatcaacgacgtgcaggatcagtgttcgtgttgttcaccaacccgcaccgaacccatgcaggtggcattgcattgcaccaatgggtcggtggtgtaccatgaggtgctgaacgcgatggagtgcaaatgctcgcctcgcaaatgttcaaag

SEQ ID NO: 21290 - DNA, 8439 bp, Artificial Sequence
  Description of Artificial Sequence: Synthetic coding sequence
atgatcccagcaagattcgccggggtccttttggccctcgccctgatccttccaggaactctgtgcgccgaaggtactagaggacgctcctcaactgcaagatgcagcctgttcggcagcgacttcgtcaacactttcgacggaagtatgtactcattcgccggatactgctcctacctcctggcaggaggctgccagaaaaggtccttctccatcatcggcgactttcagaatggaaagcgcgtgtccctgtcggtctacctcggagagttctttgatatccacctctttgtgaacggaaccgtgacccagggtgatcagagagtctcgatgccttacgcaagtaaagggctctacctggagactgaagccgggtactacaagctgtcgggagaagcctacggtttcgttgcgaggatagacggctccggcaatttccaggttctgttgtcggaccgctacttcaataagacctgcggcttgtgcggaaacttcaacattttcgcggaagatgactttatgactcaggagggcacgctgacctcagacccttacgacttcgctaattcatgggcactctcgtcgggagagcagtggtgtgaaagggccagccctccctcgagctcgtgcaacatctcgtcaggcgagatgcagaaaggcctctgggaacaatgccagctcctgaagtccacttcagttttcgcgaggtgccatccactggtcgacccggagccattcgtcgcactctgtgaaaagactctctgcgaatgtgctgggggtttggaatgcgcgtgcccggcattgctggagtacgccaggacttgtgcgcaggaaggcatggtcctgtacggatggaccgaccactcggcctgcagcccggtgtgcccggccggaatggaataccgccagtgtgtgtcgccgtgtgcacggacttgccagtcactccacatcaatgagatgtgccaagaacgctgcgttgatggatgctcatgcccggaagggcaactcctcgacgaagggctctgcgtggagtcgaccgaatgtccatgcgtgcattcgggcaagcgctacccgccaggcactagcctgtcacgggactgcaacacttgcatctgccggaactcgcagtggatctgctccaatgaggaatgcccgggcgaatgtttggtgacgggtcaaagccacttcaaatcgttcgacaacagatacttcaccttctctggaatatgccagtacttgctggcgcgtgattgtcaggaccactcattttcaatcgtgatcgagactgtgcagtgtgcggacgatcgcgatgccgtctgcactaggagcgtcaccgtcaggctgccaggactgcacaattcgctggtcaaactcaagcacggagcaggagtggctatggatggtcaagatgtgcagctgcctctgctgaagggtgacctgcggatccaacacaccgtgaccgcgtcggtgcgcctgtcatatggagaggacctgcagatggactgggacggacgcggtagactgttggtcaagctgagcccggtttacgcaggcaagacttgcggtctttgtggaaactataacggaaaccagggcgatgactttctgaccccatccggactggccgaaccgagagtggaggactttggaaacgcctggaaactgcatggagactgtcaagatttgcaaaagcaacacagtgacccgtgtgccttgaacccgcgcatgactaggttctcagaagaggcgtgcgcggtgctcacgtccccaacgttcgaggcctgccatagagccgtgagccctctgccttacctgcgaaactgccggtacgatgtctgttcctgttccgatggaagagaatgcctgtgcggagcgcttgcatcgtacgcggccgcctgcgccggtcggggggtgcgagttgcctggcgcgaaccaggcagatgcgagctgaactgcccgaaggggcaagtgtacctgcagtgtggaaccccgtgcaacctgacttgtcggtccctgagctacccggatgaggagtgcaacgaagcctgcctcgaaggatgcttctgcccgccgggactgtacatggatgaaaggggagattgcgtgccgaaggcacaatgcccgtgctactacgacggtgagattttccagccagaggacatcttctccgaccaccacaccatgtgctactgtgaggatggtttcatgcattgcactatgagcggggtccctggaagccttctgccagacgccgtgctctcgagccccctctcgcatagatcaaaaaggtccctcagttgccggccgcctatggtcaaactggtctgtccggctgataatctccgggccgaaggacttgaatgtactaagacctgccagaactatgatctggaatgtatgtccatgggttgcgtgagtggctgtctgtgtccgccgggaatggtgcggcacgagaaccggtgcgtggcgctcgaacggtgcccatgctttcatcagggaaaggagtacgccccgggtgaaactgtcaaaatcggatgcaacacctgcgtgtgccaggaccgcaaatggaactgcacggaccacgtctgcgacgctacctgttcgaccattgggatggctcactacctcacgttcgatggcctcaagtacctgttcccgggggaatgccaatatgtcctggtgcaagactactgtggctctaatccaggcacttttagaatcctggtgggaaacaaaggatgttcccatccaagcgtcaagtgcaagaaaagagtcacgatcctggtggaaggaggcgaaatagaactgtttgacggagaggtgaacgtcaagcggcctatgaaagacgaaactcacttcgaggtggtcgagtccggccggtatatcatcctgctcctcggaaaggccctgtctgtggtctgggaccggcatctgtctatcagtgtcgtcctcaagcaaacttaccaagaaaaagtctgtggcctttgcggcaacttcgatgggatccagaacaatgacttgaccagttccaacctccaggtcgaggaagatccggtggatttcggtaactcgtggaaggtgtcctctcagtgtgctgatacccgaaaggtgcctctcgatagcagcccggcgacctgccacaataacattatgaagcagaccatggtggactcgtcgtgtagaatccttacctccgacgtgttccaggactgcaataagctggtggatccggaaccataccttgacgtgtgtatctacgatacctgctcttgcgaatcgatcggtgactgcgcttgcttctgcgacactattgccgcttacgctcacgtttgtgcacagcacggaaaagtggtgacctggcggactgccactctctgcccccaaagttgtgaggaacgcaacctgcgcgagaatggatacgaatgcgaatggcggtacaacagctgcgccccagcgtgtcaggtgacttgccaacatcccgaaccgctggcatgcccggtccagtgcgtggagggatgccatgctcactgtcctccgggaaagatcctggatgaactcctgcagacttgcgtcgatccagaggactgtccggtctgcgaagttgcgggacggagattcgcctcgggaaagaaagtgaccctcaatccatcggacccggagcactgccaaatttgccactgcgacgtggtgaaccttacctgtgaggcttgccaagagccaggcggacttgtggtgcctccgaccgacgccccagtcagtcccaccaccctttacgtggaggacatcagcgaaccgcccctgcatgacttctactgctcccggctgctcgacctggtgtttctcctggacggatccagtcggctgtccgaggcggaattcgaagtgctcaaggcctttgtggtggacatgatggaacgcctgaggatcagccaaaagtgggtgcgcgtggccgtcgtcgagtaccacgacggatcccacgcatacatcggtctgaaggacagaaagaggccgtcagaacttagacggatcgcttcacaggtgaagtatgccgggtcgcaggtggccagcacctcagaggtgctgaagtacactctttttcagattttcagcaagatcgaccggcccgaggcatcacgaattactctgctccttatggcctcgcaggaacctcagcgcatgtcccgcaatttcgtgaggtacgtccaagggctgaaaaagaagaaggtcatcgtgatcccagtcggaatcggcccccacgccaacctcaaacaaatccggttgattgagaagcaggcgccggaaaacaaggcatttgtgctttcctcagtggacgaattggaacagcaacgggacgaaattgtgtcctatctctgcgatctggccccagaagcgcctccaccaactctgcccccagacatggcccaagttaccgtgggaccgggcctcctgggcgtgtccactctgggacccaagaggaattcaatggtgctggacgtggcattcgtcctggaaggttcggataagatcggcgaagcggatttcaacaggagcaaggagttcatggaagaggtgatccagagaatggacgtgggacaagatagcatccatgtgaccgtgcttcagtactcctacatggtgacggtggaatacccattttctgaagcacagagcaagggtgacatcttgcagcgggtccgggagatccgctaccaggggggaaaccgcactaacaccggcctcgccctcagatacctgtcggaccatagcttcctggtgtcgcagggggaccgggagcaggctcccaacctcgtctatatggttactgggaatccagcctccgatgagatcaagcggctgcctggagatattcaagtggtgccgatcggggtcggacctaacgcaaatgtacaagagctcgagcgaatcggttggccgaacgctccgatcctcatccaggacttcgagactctccctcgggaggccccggacctcgtgctgcagcggtgttgttccggagaaggactgcagataccaaccctgtcgccggcgccggattgcagccaacctctggacgtgatcctgctgctcgacgggtcctcatcctttccagcctcctattttgacgagatgaagtcgtttgcaaaggcattcatctcgaaagctaacattggaccccgcctcactcaagtgagcgtgctccagtacggctctatcactaccatcgatgtcccatggaatgttgtgccggaaaaagcgcacctgctgtcgcttgtggacgtgatgcagcgcgagggaggcccgtcccaaatcggagacgcactgggatttgctgtccggtacctgacgtccgaaatgcacggagcaagaccgggagcttccaaggcggtcgtgattttggtgactgacgtgagcgtcgactcggtggatgccgcggcagatgctgcacgctcgaatcgggtgactgtgtttcccattggtatcggtgatcgctacgatgccgctcagctccggatcctcgccggaccggccggggattccaacgtcgtgaagctgcaacggattgaggacctcccaaccatggtgaccctgggcaattcattcttgcataagctgtgcagcgggttcgtgcgcatctgcatggatgaagatggaaatgaaaaaagacctggcgatgtgtggaccctgccagatcagtgccacaccgtgacttgtcagccggatggacaaactttgctgaagtcacaccgcgtgaattgtgaccgaggactgcgcccgagctgcccgaactcccagtcccctgtgaaggtcgaagaaacctgcggatgccgctggacctgtccgtgcgtgtgtactggatcaagcactagacatatcgtcacttttgacggccagaacttcaagttgacgggctcgtgcagctacgtgctctttcagaacaaggagcaagatctggaagttatcctccataacggtgcctgctcgccgggagcgcgccagggatgtatgaagagcattgaggtcaagcatagcgcgctgtcagtggaactccactccgacatggaagtgaccgtcaatgggcgcttggtgagcgtgccatacgtcggaggaaatatggaggtgaacgtgtacggcgcgatcatgcacgaagtgaggttcaaccacctcgggcacatattcactttcactccacagaacaacgagttccaattgcaactctcgccaaaaactttcgcgtcgaaaacgtacggcctgtgcggaatctgcgacgaaaatggagccaatgacttcatgctccgggatgggacggtgactaccgattggaaaaccctggtgcaggagtggactgtgcaaaggccgggccagacctgccagcccatcctggaggaacagtgtttggtgcctgactcgagccactgccaagtgcttttgcttccgttgttcgctgagtgtcataaggtcctggcgccagctacgttctacgcgatctgccaacaggattcctgccaccaagagcaggtctgcgaggtgatcgcttcctacgcgcatctctgtcgcaccaatggggtgtgtgtggattggcggaccccagacttctgcgctatgtcatgtccgccgtcgttggtctacaatcactgcgaacacggatgcccccgccattgcgatgggaatgtgagctcgtgcggagatcacccgtcagaaggatgtttttgtccgccggacaaggttatgctggaggggtcgtgtgtcccggaggaggcttgcacccagtgcatcggagaggacggagttcagcatcaattcctggaggcttgggtgccggatcaccagccgtgccaaatctgtacctgtttgtcgggacgtaaggtcaattgcacgacccaaccctgcccgacggcaaaagcaccgacctgtggtttgtgcgaggttgccagacttcggcagaacgcggatcagtgttgccctgagtacgaatgcgtgtgcgacccagtttcctgcgacctgccgccagtgccgcattgcgaacgcggtctgcagccaaccctgaccaaccccggagaatgcagaccgaacttcacctgcgcgtgcagaaaggaagagtgcaaacgcgtgagccccccgtcctgcccaccgcatcggctgccgacgttgaggaaaacccagtgctgcgacgaatacgaatgcgcctgtaattgcgtaaactcgactgtgtcgtgccccctgggctaccttgcatccaccgcaaccaatgattgtggatgcaccactactacgtgcctgccggataaagtttgtgttcaccggtccactatctaccccgtaggccagttctgggaagagggatgcgacgtgtgcacctgcacggacatggaggacgccgtgatgggacttagagtggcacaatgcagccaaaagccttgcgaggactcatgccgcagcgggttcacttacgtgctccatgaaggagaatgctgcggacgatgcctgccctcagcctgcgaagtggtgactggatcgccgcgtggcgactcccaaagctcctggaaatccgtcgggtcccaatgggcctcgccagagaacccctgtttgatcaacgagtgcgtccgcgtgaaggaagaagtgttcatccaacaacgaaacgtatcctgtccgcagcttgaggtgcctgtttgcccttcaggctttcaactgagctgcaagacgtcagcatgctgcccttcatgccgttgcgaacggatggaggcgtgcatgcttaatggcaccgttatcggccctggaaagaccgtcatgatcgacgtctgcaccacctgccgctgcatggtgcaggtgggggtgatctcagggttcaagctggaatgccggaaaactacctgcaacccttgtccgctcgggtacaaggaagagaacaataccggcgaatgctgtgggcgctgcctgcctactgcttgcaccatccagctgcgcggcggacagatcatgaccctgaagcgcgacgaaactcttcaggatggctgcgatacccatttttgcaaggtgaatgaacgaggcgagtacttctgggaaaagagagtgactggctgcccgcctttcgacgaacataaatgcctggcggagggaggaaagatcatgaagatccccggtacctgctgcgatacttgcgaggaacctgaatgtaatgacattactgcccgcttgcagtacgtcaaggtcgggtcttgcaagtcagaggtggaagtagacatccactactgccagggcaaatgcgcctcaaaggcgatgtacagcatcgacattaacgatgttcaggatcagtgctcatgctgttcgccgactcggacggagcctatgcaggtcgccctgcactgtaccaacggatcggtagtgtaccacgaggtcctgaacgccatggaatgtaaatgctccccgagaaagtgctccaaa

SEQ ID NO: 21291 - DNA, 8439 bp, Artificial Sequence
  Description of Artificial Sequence: Synthetic coding sequence
atgattcctgcccgcttcgcaggagtgttgttagcccttgctttgatacttccgggaactttatgtgctgagggtacccgcggtcgaagctctacggcacgttgctctctcttcggttcggatttcgttaatacattcgacggtagtatgtacagctttgccggttactgctcttatctgctggctgggggttgccaaaagagatcattctctattattggggatttccaaaacggaaagagggttagtctgagtgtgtatctcggtgaattttttgatattcatttgttcgttaatggcactgttacacagggagatcaaagagtgagtatgccttatgccagcaagggattgtaccttgagacagaagccggttactataagctctctggggaggcttacggttttgtcgcgagaattgatggatctggcaacttccaagtgttgttgtccgacagatacttcaacaagacttgcggactatgcgggaactttaatatctttgcagaggatgattttatgactcaagagggaactttgacaagcgatccttacgatttcgctaattcgtgggctttgtcctcaggagaacagtggtgcgaaagggcatcgcctccatcatccagctgcaatatttcaagtggagagatgcaaaaggggctgtgggagcaatgccaattactgaagtcgacatccgtgttcgctagatgtcatcctttagttgaccctgagcctttcgttgccctttgcgagaagactctttgtgaatgcgctggaggattggagtgtgcttgccctgctttgctcgaatatgctaggacatgcgctcaagagggcatggtgctatatgggtggactgatcactcggcatgctctcctgtgtgccctgcaggtatggaatatagacagtgtgtgtcaccctgcgcgaggacctgtcaaagcctccatattaacgagatgtgccaggaaagatgcgttgatggttgctcttgtcctgaaggccagttactggacgagggcctctgtgttgaatccactgaatgcccttgtgttcactcaggtaaacgttatccgccgggtactagcttgtctcgggattgcaatacttgcatctgtaggaattctcaatggatctgctctaacgaagagtgccctggagagtgtctggtcactgggcaatctcatttcaagtcttttgataaccgctactttaccttttctgggatttgtcaataccttttagctagagattgtcaagaccactccttcagtatagttattgagaccgttcagtgcgccgacgatagagatgctgtctgcacccgcagcgttactgttcggctgccaggtcttcacaattctttggtgaaattgaagcatggcgctggtgttgctatggatggtcaggacgtccagctgccattgctgaagggggatttgaggatacaacatactgtaacagcaagtgtgcgtcttagctacggcgaggatttgcagatggattgggacggtaggggacgtctgctagttaagttgtctcctgtatatgctggtaagacatgcgggctttgcggaaattataatggtaaccagggagatgatttcctcactccatcaggactcgcagagccacgtgtggaggactttggtaacgcttggaagcttcatggggattgccaggaccttcaaaagcagcattccgatccttgtgcacttaaccctagaatgactcgattcagtgaggaggcatgtgcagtgttaactagccctactttcgaagcatgccacagagctgttagcccacttccatatctccgaaactgcagatatgatgtttgttcctgttcggacggccgcgagtgtctctgtggcgctcttgctagttacgcggcggcttgtgcaggtaggggcgtgagggttgcctggagggaaccaggtcggtgcgaattaaattgtcctaaagggcaagtttatcttcaatgtggcacgccctgtaatcttacctgtcgtagtttgtcctatcccgacgaggaatgtaatgaggcttgcctcgagggatgcttctgtcctcccgggctttacatggacgaaaggggagactgtgtgcctaaggctcagtgcccgtgttactatgacggtgagatttttcaaccagaagacatattttctgatcatcatacaatgtgctactgtgaagatggtttcatgcactgtactatgagtggagttccgggatctttgttgcccgatgcagtgttaagttcccccctttctcaccgatcgaaaaggtctttgtcctgtagaccccctatggtgaaacttgtatgccctgctgataaccttcgagctgaggggttggaatgcacaaagacatgccagaactatgaccttgagtgcatgtccatgggctgtgtgtcaggatgtttgtgcccgccaggtatggttaggcacgaaaatcgttgcgttgcattggaaaggtgtccatgtttccatcagggtaaagaatatgcacctggtgagactgtcaagataggatgcaatacttgtgtatgccaggacagaaagtggaactgcactgatcatgtctgtgatgcaacttgttcaacaataggtatggctcactaccttactttcgatggtcttaagtatctatttccaggggagtgtcaatacgtgctcgtgcaggattattgcgggtcgaatccaggcacatttaggatccttgtgggtaataaaggatgttcccacccatctgtgaagtgtaaaaaaagagtcacaatacttgtggaggggggtgaaatagaattatttgacggtgaggtcaacgttaaaagacctatgaaggatgaaacacatttcgaggttgttgaatcaggtagatatatcattcttttattgggcaaggcactatcagtcgtttgggatcgccatttgtcgatcagtgtcgtgcttaagcagacataccaagagaaggtttgcgggttgtgtggaaacttcgatggtatacaaaataatgaccttacgtcaagtaaccttcaggtagaagaagatcccgttgattttggaaattcgtggaaggtttcatcacaatgtgctgacactagaaaggttccccttgattcatctccggccacttgccataacaatatcatgaaacaaaccatggtggattcctcctgtagaattcttacatctgacgtcttccaggactgtaataaacttgtcgacccagaaccatatcttgatgtttgtatctacgacacatgttcctgtgaaagcatcggagattgtgcgtgcttttgtgatactattgccgcatatgcacatgtctgtgcgcagcatggaaaggttgtaacatggagaactgccacactctgcccacaatcttgtgaagaacgtaatctaagagagaacggttatgaatgcgaatggagatataattcgtgcgctcctgcttgtcaggtgacttgtcaacatccggagcctttggcttgtcctgtgcagtgcgttgaggggtgtcatgcacattgccctcctggtaagattttggatgaacttcttcaaacctgcgttgacccagaagactgccctgtgtgtgaagtggctggtaggcgctttgctagcgggaagaaagtcactttaaacccttccgaccccgagcattgccagatatgtcactgcgatgtggtaaatctcacatgtgaagcatgtcaagaaccaggaggtctcgttgtgcctccgacggatgcgcctgtgtctccgactactctctatgttgaagatatttccgaacctcctttgcatgacttctattgttccaggttgttagatctagtcttcttattggatggaagtagcagactatcggaggccgaatttgaagtgctcaaggcttttgtggttgatatgatggagcgtttgagaatttctcaaaaatgggttcgtgtggctgttgtggagtaccatgatgggtcacacgcctacatcggtcttaaagatcgtaaacggccttcagagttgcgtcgaatagcatcacaagttaagtatgctggaagccaggttgcctcgacttcggaggtcttaaagtacaccttatttcagatattctccaagatcgatcggccagaggcttcgcgtataacacttcttttgatggccagccaagaaccgcagcgaatgagtaggaactttgtccgttacgtgcaaggattgaaaaagaaaaaggtgattgtgatacccgtcgggattgggccacacgctaaccttaaacaaatccgtcttatcgaaaaacaagctccagaaaacaaagcattcgtgctctccagtgttgacgaacttgagcagcaaagagatgagattgtttcgtatctttgtgatcttgctcctgaagcacctccgccaactctacctccagatatggcgcaagtgacagtcggacctgggcttctgggcgtttccactctcgggccaaagaggaactcaatggttttggacgtggcttttgtgcttgaaggctctgataaaataggagaagccgactttaacagatctaaggaattcatggaggaagttatccaaaggatggatgtcggacaggacagcattcacgttaccgtcttgcaatactcatatatggtgacagtggaataccccttctctgaggcacagtctaagggtgatatccttcaaagagtgagagagattaggtaccagggcggtaacaggacaaatactggccttgctttgcgatatctgtccgaccatagcttcctggtatctcagggcgatcgggagcaagcccctaacttggtgtacatggttacgggcaatccagcatcagatgaaataaagagattgccaggagacatacaagtggtaccgatcggcgtgggtcccaacgccaatgttcaagaattggaacgaatcgggtggccgaatgccccaatccttatacaagattttgaaactcttccaagagaagcgcctgatctggttttgcaaagatgttgctcgggtgagggccttcaaatacctaccctgtccccggcacctgattgctcccagccactagacgtgatcctgttgctcgacggatcatcatcatttcctgcttcatatttcgatgagatgaagagcttcgcaaaggcattcatttctaaggcgaatataggtcctagacttacacaggtgagcgtgcttcagtacggctctatcactaccatagacgtaccttggaatgttgtacctgaaaaggcccacttactgtctcttgttgatgttatgcagcgcgaaggagggccatctcaaattggagacgctcttggttttgctgttagataccttactagcgaaatgcatggggctcgaccgggggccagtaaggctgtggtgattctcgttactgatgtgagcgtcgatagtgttgatgcggccgcagacgctgctcggtctaatagggtaacagtctttccaatcggaatcggggaccgatacgatgcagctcaacttcgaatcttggctggacccgccggcgattctaatgtagttaaactccaaagaatcgaagacttgcctactatggttaccctgggaaatagctttctccacaagctttgctctggtttcgttcgtatttgtatggatgaggacggtaatgagaaacgtccgggagacgtttggacgcttcctgatcaatgtcacactgtgacatgccagccagatggtcaaacccttcttaaatcgcatagagttaattgcgataggggattgaggccaagctgcccaaatagccagagtcctgtcaaagtcgaagaaacgtgtggctgtcgatggacatgtccatgtgtgtgcaccggatcgtccacccgtcacattgttacgttcgatggacaaaacttcaagcttactgggagctgctcgtatgttctcttccaaaataaggagcaagatttggaagttattcttcacaacggcgcttgtagcccgggagctcgtcagggatgcatgaaatctattgaggttaagcatagtgctctcagcgttgagcttcacagtgacatggaagttacagttaatggaaggttggtgagcgtgccttatgtcggagggaatatggaagttaatgtatatggtgctattatgcatgaagttagatttaaccacttgggtcatatttttactttcactcctcaaaacaatgaatttcagctccaacttagcccgaaaactttcgcaagtaagacgtatggattgtgtggtatttgtgatgagaatggagctaatgatttcatgcttcgggacggaaccgttacaactgattggaagactcttgttcaagaatggaccgtccagcgtcctgggcagacgtgccaacctatccttgaagaacaatgcttggttcctgactcctctcattgtcaggtccttttgcttcccttgttcgcagaatgccataaagtactcgccccagccactttctacgccatatgtcagcaggatagctgtcatcaggaacaggtctgtgaggttatcgctagctacgcccacctttgcaggactaacggtgtatgtgtagattggcgtactcctgacttttgcgctatgagctgcccaccgtcgttggtgtacaatcattgcgagcatgggtgcccccgacattgcgacggcaacgtttcttcatgtggcgatcatccttccgagggttgcttttgccctcccgataaagttatgttggaaggatcttgtgtacctgaggaagcttgcacacaatgtattggagaagatggtgtgcaacatcagttcttggaggcctgggttccggatcatcaaccgtgccaaatttgtacgtgcctgtccgggagaaaggtcaattgcactacgcaaccatgccctactgcaaaggcacctacttgcggtctctgtgaggtggcacggttgcgtcaaaatgcagaccagtgctgccctgaatatgaatgcgtctgtgatccagtgtcttgtgatctgccccccgtgccccattgcgagcgaggcttacaacctacccttactaacccaggcgaatgcaggcctaattttacctgcgcctgccgaaaggaggagtgcaagcgagtgtcccccccttcctgcccaccccataggttgcctacacttcgaaagacccagtgttgtgatgaatacgagtgcgcttgcaattgtgtgaattccacagtctcttgtccacttgggtatttagctagtacagcaacaaacgactgcggatgtacaaccactacttgtcttccagataaagtatgtgttcacaggtcaaccatctacccagtgggacaattttgggaggagggatgcgacgtatgcacttgtactgacatggaggatgctgttatgggcttgagggtcgctcaatgttcgcagaagccttgtgaagattcttgcagatccggattcacctacgttttacatgagggggagtgttgtggaagatgtcttcctagtgcatgtgaggtggtcaccgggagcccgagaggcgacagtcaaagctcgtggaagtccgtgggttcccaatgggcttcccccgaaaacccatgcctcattaacgaatgtgtgcgagtcaaagaagaggttttcattcaacaacgcaatgtttcatgtcctcaacttgaagtacccgtatgcccatcgggctttcagctgagctgtaagacaagtgcttgttgcccatcgtgtaggtgcgagagaatggaggcttgcatgttgaacggaactgtaataggacctggtaaaaccgttatgattgatgtctgtaccacatgcaggtgtatggtacaagtgggagttattagcggtttcaagcttgagtgtcgcaaaactacctgtaacccatgtcctctggggtacaaagaagaaaataatactggtgagtgttgcggtaggtgcctaccgactgcatgtactattcagttgcggggtggacagatcatgaccttgaagcgggatgagaccctccaggacggatgtgacactcatttttgcaaggtgaacgaacggggcgaatatttctgggagaagagggtgaccggctgccctcctttcgatgaacataagtgtcttgctgaggggggtaagataatgaagattccaggcacctgctgcgatacatgcgaagaacctgagtgcaacgacatcaccgcccgactgcagtatgttaaggtgggttcatgcaaatctgaagttgaggtggatatccactattgccaggggaagtgcgcatcaaaagctatgtactccattgatattaacgacgttcaagatcaatgttcttgctgctcccccacgaggacagagccaatgcaagtggcactccactgcacaaacggttctgttgtttaccatgaggtcctcaatgctatggaatgcaaatgttctccccgcaagtgtagtaaa

SEQ ID NO: 21292 - DNA, 8439 bp, Artificial Sequence
  Description of Artificial Sequence: Synthetic coding sequence
atgattcccgccagattcgccggtgtgctcctcgcactggcactcattctgccgggaaccctgtgtgcggaaggaacgcgcggccgctccagcactgcaagatgtagcctgttcggatcagatttcgtcaataccttcgatgggtccatgtactccttcgccggttactgctcgtacctcctggcgggaggatgccagaaacgctctttttctatcatcggcgattttcagaacggaaagagagtgtctctgtcggtctatctcggcgagttctttgacatacatctgttcgtcaacggtaccgtgacccagggcgatcaacgggtgagcatgccgtacgccagcaaaggcttgtacctcgagacggaagccggctactacaagctgtccggcgaagcatacggattcgtggcccgcatcgacggaagtggtaacttccaggtcttgctgtccgaccggtacttcaacaaaacgtgtggactttgtggtaactttaacatcttcgcagaagatgatttcatgactcaagaaggaaccctgacctccgacccttacgactttgcaaactcttgggcgctgagctccggagagcaatggtgcgagagggcgtcaccgccatcttcatcctgcaatatctcgagtggcgagatgcagaagggcctctgggaacaatgccagctcctgaagtcaacctcagtgtttgctagatgtcacccactcgtggatcctgagcctttcgtggccctctgcgagaaaaccctgtgcgagtgcgccggcggacttgagtgtgcgtgccctgcgcttctggaatacgcaagaacctgcgctcaagaaggcatggttctgtacggatggactgaccactcggcgtgcagcccggtgtgtccagcgggtatggaataccgccaatgcgtcagcccgtgtgctcgcacttgccagtccttgcatatcaatgagatgtgccaagagagatgtgtggacggatgctcctgcccggaggggcaactcctggatgaagggctctgcgtggagtcaactgaatgcccgtgcgtccattcgggcaagcgttacccgccgggaacgagccttagccgtgattgtaacacctgcatctgccgcaattcgcagtggatctgctcgaatgaggagtgcccaggagaatgtctcgtgactggacagagccactttaagtcgttcgacaacagatactttaccttcagcgggatctgccagtacttgctggcgcgggattgtcaggaccactcgttttcgatcgtaatcgaaaccgttcaatgcgccgatgaccgagacgccgtctgtactagatccgtgaccgtgcggctcccgggtctgcacaattctctggtgaagctgaagcacggagccggcgtcgcaatggacggacaggatgtgcaacttccgctcctgaaaggagatctccgcatccagcacactgtgactgcctcagtccgcctgtcgtacggagaggacttgcagatggactgggatggtcggggcaggcttctggttaagctgtccccggtatacgccggcaagacctgcggcctgtgtggcaactacaatggaaaccaaggagacgatttcctgaccccctcaggcctcgccgagccacgcgtggaggacttcggaaatgcctggaaactccatggggactgccaggatctgcaaaaacaacacagcgatccgtgtgcgctgaacccgagaatgacccgcttctctgaggaggcatgcgccgtgctgacttcgccgacctttgaggcctgccaccgggccgtgtcgccactgccatacctgagaaactgtcgttacgacgtgtgttcgtgtagcgacggccgcgaatgcctgtgtggggctctcgcgtcatacgcggcggcctgcgcgggaagaggcgtgcgcgtggcatggcgagaaccaggaagatgcgagctgaactgcccaaagggacaggtctatctccaatgcggaaccccgtgcaaccttacctgccgtagcctcagctaccccgatgaagaatgcaacgaggcctgccttgaaggatgcttttgcccgccaggtctgtacatggacgagagaggagactgcgtgcctaaagcccagtgcccatgctactacgatggagagatctttcagccagaagatatcttttccgaccaccacaccatgtgctattgcgaggacggatttatgcattgcaccatgtcgggagtgccgggatcgctgctgcctgatgcggtgctgtcgtcaccgctctcgcataggtcaaagcgatccctcagctgtaggccgccgatggtgaaacttgtgtgtccggcggacaatcttagggccgaagggctggagtgcactaagacttgccagaattacgacctcgagtgcatgagcatggggtgtgtgagcggctgcctgtgtccgcctggaatggtgcggcatgagaaccggtgcgtcgctctggaacggtgtccgtgctttcaccaaggaaaggaatacgcccctggagaaactgtgaaaatcggctgcaatacgtgcgtgtgccaagaccggaagtggaattgtactgatcatgtgtgtgacgccacttgttcgaccatcggcatggcccactacctgactttcgatgggctgaagtacctgtttcctggagaatgtcagtacgtgctggtgcaggattactgcgggagcaacccgggtaccttcagaatccttgtgggaaacaagggctgttctcacccttcggtgaagtgtaagaaaagagtgaccattctggtagaaggcggcgaaatcgagctgtttgacggcgaagtcaacgtgaagaggccgatgaaagatgaaactcatttcgaagtggtggagagcggacggtacatcatccttctgctgggaaaggcgctctcagtggtttgggaccgccacctgtcaatctccgtggtcctgaagcagacctaccaggaaaaagtctgcggcttgtgcggcaacttcgacggtatccagaacaacgacctgacctcgtcgaatctgcaggtggaggaagatcccgtcgattttggaaatagctggaaagtctcctcccagtgcgcggatacgcggaaggtgccattggattcgagccccgctacttgtcataacaacatcatgaagcaaactatggtcgatagctcatgtaggatcctcacgagcgacgtctttcaagactgcaataaactggtcgacccggaaccgtaccttgatgtctgcatctacgacacctgttcgtgcgagtcaatcggtgactgcgcctgtttctgcgacactatcgccgcgtacgctcatgtgtgcgcacaacacggcaaggtagtcacctggagaaccgcgactctctgcccgcagtcctgcgaggagcgcaacctcagggaaaacggctacgaatgcgaatggcggtataacagttgcgcaccggcatgccaggtgacctgccagcacccggaacccctggcgtgccctgtccagtgcgtagaggggtgccacgcacactgtccgccagggaaaatccttgacgaactgcttcagacctgcgtggatcccgaagattgcccggtgtgcgaagtcgccggccgccgattcgcgtcgggaaagaaggtcacgctgaatccttcagaccctgagcactgtcagatttgccactgcgatgtggtgaatctgacctgcgaagcgtgccaggagccgggaggcctggtggtgccacctactgacgccccagtgtcgcctaccaccctgtacgtggaagatatctccgaaccgccactgcacgacttctactgttcacgcctccttgaccttgtgttcctcttggatggctcctcccggctgtcggaagcagagttcgaagtgttgaaggctttcgtcgtagacatgatggaacggctgcggatctcccagaagtgggtgcgggtggcagtggtggagtaccatgacggctcgcacgcctatattggactcaaagatcgtaagcggccctcggaactccgccggatcgcaagccaagtaaagtatgccgggagccaggtggcttcgacctcagaagtgctgaagtacactctcttccagatcttttcgaagattgacagaccggaggccagccgcatcaccctgctgctcatggcatcgcaggagccgcagcggatgtcgcgcaattttgtgagatacgtccagggcttgaagaaaaagaaggtcatcgtaatcccggtgggtatcgggccccacgcaaacctgaaacagattcgcttgatcgagaagcaggcacctgagaacaaagcattcgtcctcagcagcgtcgatgaacttgaacaacagagggatgagattgtctcctacctctgcgacctggcgccggaggcacccccaccaactctgccgccggacatggcccaagtgacggtgggcccgggactgctgggcgtgtcgactctcgggcctaaacgcaattcgatggttctggacgtggcgttcgtcctggagggtagcgataagatcggagaggcggacttcaatcggtccaaagagttcatggaagaggtcatccagcggatggacgtcggccaggactccatccacgtcaccgtgctccaatactcatacatggtgacggtcgaataccccttctctgaagctcagagcaaaggagacatcctgcaacgggtgcgcgagatccggtaccagggagggaaccgaaccaataccggattggccctgcggtatctgtcggatcattcgttcctcgtgtcgcagggtgaccgggaacaggcaccaaatctcgtgtatatggtgaccggaaaccctgcctcggacgaaatcaagcgcctccctggtgacatccaagtggtgcctataggagtgggtccgaacgctaatgtgcaggaattggagagaattggttggcctaatgccccgattctgatccaggacttcgaaaccctcccgcgcgaagcgccggatctggtgctgcagagatgctgctcaggcgagggactgcagattcctactctctcaccggcaccggattgctctcagccgctcgacgtgatccttctcctggatggaagctccagcttcccagcctcctacttcgacgaaatgaagtcatttgccaaagcctttatctcgaaagctaacatcggaccccgcctgactcaggtcagcgtcctgcagtacggatctatcactaccatcgacgtgccttggaacgtcgtgccggaaaaggcccacctgctgtcattggtggacgtcatgcaacgcgaaggcggacctagccaaatcggggacgccctgggcttcgctgtgcgctacctcacctcagagatgcacggggccagaccgggagccagcaaggccgtcgtcatattggtgactgatgtgtccgtggattcggttgacgctgccgcggatgcggcccgctcgaatcgcgtgactgtgttccctattgggatcggtgacagatacgacgctgcacaactccgcattttggcgggtcccgcgggtgattcgaacgtggtaaaactgcaacgcatcgaagatcttccgacgatggtcaccctgggcaactcgttcctgcataaactctgttcaggtttcgtgcggatctgcatggatgaggacggcaatgagaaaaggcctggagacgtctggaccctgcccgatcagtgccacactgtgacctgtcaacccgatggacagaccctcctgaagtcgcatcgcgtgaattgtgaccggggtttgcgcccaagctgcccaaactctcaatcacccgtgaaggtggaggaaacctgcggatgccgctggacttgcccatgcgtgtgtactgggtcgtcgacccgtcacatcgtgaccttcgacgggcagaacttcaagctgaccggcagctgctcgtacgtcctgttccagaacaaagaacaagaccttgaggttatcctgcataacggagcgtgctcgccaggggccagacagggctgcatgaagtccattgaagtgaagcattcagctctgtcggtcgaacttcacagcgacatggaggtgactgtgaatgggcggctggtgtcggttccctacgtgggaggcaacatggaagtgaacgtgtacggggccatcatgcacgaagtgcgcttcaaccatctcggacatatcttcactttcactccgcagaataacgaatttcagcttcaactgtcaccaaagacgttcgcctccaagacttatggactgtgcgggatctgcgacgagaatggcgccaacgatttcatgttgagagacgggaccgtcactactgactggaaaactctcgtgcaggaatggaccgtgcaacgcccggggcaaacttgccagccaattctggaggaacaatgcttggtgcctgactcctcccactgccaagtcctcctcctcccgctcttcgccgaatgccataaggtgctcgctcctgctaccttctacgcaatatgccagcaggacagctgccatcaggaacaggtgtgcgaggtcatcgcgtcctacgcacatctttgcagaactaacggagtctgtgtggattggcgcactcccgacttctgcgccatgtcttgcccaccgtccctggtgtacaaccactgcgagcacggatgtccacgccactgcgacggaaacgtgtcctcctgcggagatcatccgtccgagggctgcttctgcccaccagataaggtgatgctggaaggatcatgcgtgccagaggaagcctgtactcagtgtatcggagaggacggtgtgcaacaccagttcttggaggcatgggtcccagaccaccagccatgccagatctgtacttgcctgtccggaaggaaggtgaattgcaccactcaaccatgccctactgcgaaggcacctacttgcggcctgtgcgaagttgcacgccttcggcagaacgctgatcaatgctgcccagaatatgaatgcgtctgtgacccggtgagctgtgacctcccaccggtgccgcactgcgagcgcggtttgcaaccgaccctgactaacccgggtgagtgtagaccgaactttacgtgcgcctgtaggaaggaagaatgcaagcgtgtgtccccaccgagctgtccaccacacagattgccaactctgcgcaaaacgcaatgctgtgatgaatatgagtgcgcgtgtaactgtgtgaatagcaccgtctcctgcccgttgggctaccttgcatcaaccgccacgaacgactgcggatgcacgactaccacttgccttccagacaaggtgtgcgtccatcgctccaccatctacccagtgggacaattctgggaggaaggttgcgatgtgtgtacctgcaccgacatggaggatgccgtcatgggactgagagtcgcgcaatgctcccagaagccttgcgaagattcctgcaggtcaggcttcacctacgtgctgcacgagggggaatgctgcggccgctgtttgccatccgcttgtgaagtcgtcaccggttccccgaggggtgattcgcagtcctcgtggaagtccgtgggatcgcagtgggcctcaccggaaaatccgtgtctgatcaatgaatgtgtgcgggttaaggaagaagtgtttattcagcagaggaatgtgagctgccctcaactcgaagtccccgtttgcccgtccggattccagctgagctgcaagaccagcgcgtgctgcccatcctgtcgctgcgagagaatggaagcatgcatgttgaacggaactgtgattgggcccggaaagactgtcatgatcgatgtctgcactacctgccgatgcatggtccaggtcggggtgatttcgggcttcaaactggagtgtaggaaaaccacctgcaacccatgtcctttgggatacaaggaggaaaacaatacgggagagtgttgtggccggtgtctccccactgcttgtaccatccagctgcgcggcggacagatcatgaccctgaagcgggacgaaactctccaggatggatgcgacacccatttctgtaaggtgaatgaacggggagaatacttctgggaaaaacgcgtcactgggtgccctcccttcgacgaacataagtgtctggccgaagggggaaagatcatgaagatacctggcacctgctgcgacacgtgcgaggagccggagtgtaacgacatcaccgcacggctccaatacgtgaaggtgggatcgtgcaagtccgaggtggaagtcgacatccactactgccagggcaagtgcgctagcaaggccatgtactccattgatatcaacgacgtccaagaccagtgtagctgttgctccccgactcgaactgaaccaatgcaagtggccctccattgtactaacgggagtgtggtgtatcatgaagtgcttaacgctatggagtgcaagtgctcgccgaggaagtgctcgaaa

SEQ ID NO: 21293 - DNA, 8439 bp, Artificial Sequence
  Description of Artificial Sequence: Synthetic coding sequence
atgatacctgccaggttcgcaggggtcctgctggcactcgcgctgatacttcccggcactctctgtgcggaagggacccggggaagatcgtccaccgcacggtgcagccttttcggaagcgactttgtcaacacctttgatggttcgatgtactcctttgcgggatactgtagttatctcttggctggaggctgccaaaagaggagcttttccattatcggggactttcaaaacggaaagcgtgtgtccctgagcgtctacttgggagagtttttcgatatccatctttttgttaacggtaccgtcacgcagggagatcaacgggtgtccatgccctacgcaagcaaaggactgtacctggagacggaagcaggttactacaaactttcaggcgaggcctacggattcgtcgcaagaatagatggatcggggaattttcaagtgctcctcagcgatagatacttcaataagacttgtggtttgtgcggcaacttcaacattttcgccgaagatgactttatgacccaagaggggaccctgacctctgacccatacgattttgcaaactcatgggcactgtcctccggtgaacagtggtgtgaacgcgcatcgccaccatcgtcgtcttgtaacatttcgtcaggcgaaatgcaaaagggactgtgggaacagtgtcagcttcttaaaagcactagcgtgtttgcaaggtgtcacccgctggtggatcctgaaccatttgtggccctttgtgaaaagaccctttgtgagtgtgctggcggccttgagtgtgcctgccccgctctgctggaatacgcaagaacttgtgctcaggaaggaatggtgctgtacggttggactgatcattccgcatgcagccctgtgtgtcctgcaggtatggaatacagacaatgcgtgtcaccttgtgccagaacctgccaatccctccacattaatgagatgtgtcaagagcggtgtgtcgatggatgctcctgtccggaaggtcaattgctcgatgaggggctttgcgtggaaagcactgaatgtccttgtgtgcattcgggcaagagatacccacctggcacctccttgagccgagattgtaacacttgcatctgtcgcaactcgcaatggatttgcagtaacgaggaatgccctggagaatgcctggtgacgggacagtcccatttcaaatcgtttgacaacaggtactttacgttttctggcatttgccaataccttctcgcacgggactgtcaggaccattcgttctcgatcgtgattgagacggtacagtgtgctgacgaccgagatgcggtgtgcactcgctcggtcaccgtgaggcttcccgggcttcacaactcccttgtgaagctgaagcatggcgccggtgtggcaatggacggccaggatgtgcaattgccactgctgaagggcgaccttcgcatccaacacaccgtcaccgcctccgtgcgcctttcatatggggaggatcttcagatggattgggacggacgtgggagattgctggtcaagctctcaccagtgtacgcaggtaaaacctgcggcctctgcggtaactacaacggtaatcagggagatgatttcctgactccatcgggtttggcagaaccgagggtggaagatttcggtaacgcatggaaactgcatggagattgtcaagatcttcaaaaacagcattctgatccatgcgctttgaatccgcgcatgaccaggttcagcgaggaggcctgcgcggtgctgacgagcccgacctttgaagcatgtcatcgtgcagtgagccccctgccataccttcggaattgccgttacgacgtctgcagctgtagcgatggccgtgagtgtctttgtggagcacttgcctcgtacgcggcagcttgcgcaggacgtggggtgcgggtcgcgtggagagaaccaggtcggtgtgaacttaattgccccaagggacaagtgtacctccagtgcggaactccgtgcaaccttacgtgtaggtccttgtcgtacccagatgaggaatgtaatgaggcatgtctggaaggatgtttctgtccacctggtctttacatggacgaaaggggcgattgtgtgcctaaagcccagtgtccttgctactacgatggagagatttttcagcctgaggacattttcagcgaccaccataccatgtgctactgtgaggatggtttcatgcactgtaccatgtcgggtgtccctgggtcgttgctccccgatgcagtcctttcatcgcctttgtcgcatagaagcaaaagatcgctttcgtgtagaccaccaatggtgaagctggtatgccctgcagacaatctgagggccgaaggcttggaatgcactaagacctgccagaattatgaccttgagtgtatgtcaatgggatgtgtgtccggatgtttgtgccctcctggcatggtgagacatgaaaatcgttgcgtggcccttgaacggtgtccatgctttcatcaaggaaaggaatacgcccctggcgaaaccgtcaagatcggttgtaatacttgcgtgtgccaagacagaaaatggaactgcactgatcatgtgtgcgatgcaacctgcagcactatcggaatggcccactacctgactttcgatggactgaaatacctttttcctggggaatgtcaatacgtcttggtccaagactactgcggatcgaacccgggcaccttcaggatacttgtggggaacaagggatgttcccacccttctgtcaagtgcaaaaagagggtgaccattctggtggaaggaggtgaaattgaactgttcgatggtgaggtcaacgtgaagcgcccgatgaaggacgaaacgcactttgaagtcgtcgagtcggggaggtacattattcttctgttgggtaaggccctcagcgtagtgtgggaccggcatctgtcgatttccgtggtgctgaaacaaacgtaccaagaaaaagtctgtgggctgtgtggaaacttcgacggaatccaaaacaacgatctgacctcatcaaacttgcaagtggaggaggaccctgtggactttggcaactcctggaaggtgagctcacagtgtgcagacacccggaaggtgcctcttgattcctcgcctgcaacttgccataacaacattatgaaacagacgatggtcgattcaagttgccgaatccttacttccgacgtgtttcaggactgtaacaagctggtcgatcctgaaccctacttggacgtgtgtatttacgacacctgttcctgcgaatccatcggagattgtgcatgcttttgtgacaccattgcagcctacgcacatgtgtgcgcacagcacggcaaggtggtgacgtggaggaccgcgaccctgtgcccccagagctgcgaagaaagaaacctgcgggaaaatggatacgaatgcgagtggcggtataactcgtgcgcacctgcatgtcaggtgacctgccagcacccagagcccctggcatgtccagtgcagtgtgtggaaggttgccatgcacattgtccccctggtaagattctggatgagctgcttcagacttgtgtcgatccagaagattgtccggtgtgtgaggtcgcaggtaggaggtttgcttccggtaagaaggtgactctgaacccctcagatcccgaacattgtcaaatctgccactgtgatgtggtaaatcttacgtgtgaggcatgtcaagaaccgggagggttggtggtgcctccaactgacgcacccgttagcccgaccactttgtatgtggaagatatctccgaacctcccctgcacgacttctactgcagcaggctcctcgatcttgtctttcttcttgacggatcatcacgactgagcgaagcagaattcgaagtgcttaaagcctttgtcgtggatatgatggaaagactgcggatatcgcagaagtgggtcagagtcgccgtggtggaataccatgacggatcgcacgcatacataggactcaaggaccggaaaagacccagcgaactgaggagaattgcttcccaagtgaagtacgccgggtcccaagtggcgtccacctcggaggtcctgaaatacaccctgtttcagatcttttcgaagatcgatcgccccgaggcatcccggattaccctgctcctgatggcatcgcaagaacctcaaagaatgagccgcaattttgtgcgttacgttcaaggccttaagaaaaagaaggtcattgttatcccagtcgggattggacctcatgcgaatcttaaacagatacggctcatcgagaagcaggcaccagagaacaaggcattcgtgctttcttcagtggatgagctcgagcaacagagagacgaaattgtgtcctacctgtgtgatcttgcccctgaagcaccaccccccacgttgcctcccgacatggcgcaggtgactgtgggaccaggcctgcttggagtgtcaacccttggtcctaagaggaattcgatggtgctcgatgtcgccttcgttctggaggggtcagacaagattggggaagccgatttcaacagatcgaaggaattcatggaagaagtgatccaacgtatggacgtcgggcaggattcaatacacgtgaccgtccttcaatactcgtatatggttaccgtggagtacccattttcagaagcacaatccaagggcgatattcttcagagagtgagagagatccgttaccagggaggtaacaggacgaatactggccttgctctgcgctacctcagcgaccattcatttttggtgagccaaggggatagagagcaagcacctaacttggtgtatatggtgaccggtaaccccgcatccgatgaaatcaagcgcctgccaggagatattcaagtggtgcccattggggtgggacctaacgcaaatgtgcaggaactggaacgcatcgggtggcctaacgcgccgatattgatccaggatttcgagactctccctagagaggcgcccgatcttgtccttcaacggtgctgctcaggagaaggactgcagattccaactctgtctccagcgcctgactgttcccaaccacttgatgtgattcttctgcttgacgggagttcttcgtttcctgcttcatacttcgacgaaatgaagagctttgcaaaagcgttcatatcaaaggccaacattggcccacgattgacccaagtctcggttcttcagtatgggagcataaccacgatagacgtcccctggaacgtggtgccagaaaaggcccatctgctgtcgctcgtggacgtgatgcaaagagaaggcggaccttctcaaatcggagatgccctgggttttgcagtcaggtatcttaccagcgaaatgcatggcgccagaccaggagccagtaaggcagtcgtcattctcgtcactgatgtgtccgtggattccgttgatgctgccgcagacgccgcacgcagcaaccgggtgaccgtctttcctattggaataggagatcgttacgatgccgcccaacttcgaatcttggccggacccgcaggcgattctaacgtggtgaaacttcaaagaattgaggatctgcctactatggtaactctgggtaattcctttcttcacaaactttgtagcggattcgtgcggatttgcatggatgaagatggtaacgagaaaagacctggcgatgtgtggactctgcccgaccaatgtcatactgttacctgtcaacccgacggccagactcttctgaaatcccatcgagtgaactgtgatagaggacttcgaccatcgtgtcctaattcacagtcccctgtgaaggtggaagaaacctgtggatgccgatggacttgcccttgtgtgtgcacggggtcgtcaactaggcacatcgtgacgtttgatgggcaaaactttaagctgaccggatcatgttcttacgtcctttttcagaataaggaacaggatcttgaagtcattctgcataacggagcatgttcgcctggcgccagacagggttgcatgaagtccattgaggtgaagcactcagcgctgtcggttgaactgcacagtgatatggaagttactgtgaacggacgccttgtttcggttccatacgtcggcgggaacatggaagtgaacgtctacggagcaatcatgcatgaggtgcgatttaaccatcttggacacattttcacgtttactccccagaataatgaatttcaattgcaactgagccctaagacctttgcatcaaaaacctacggactttgtggcatttgtgatgagaatggcgcaaatgacttcatgctgcgagatgggaccgtgaccactgattggaaaacgctggtgcaggagtggaccgtccaacgacctggacagacttgtcaaccgattcttgaggaacagtgtctcgttccagatagctcgcactgtcaagtcctgcttctgcctctttttgcggaatgtcataaagtccttgctccagcaactttctacgcgatatgtcagcaggactcctgtcatcaggaacaggtctgcgaagtgatcgcatcctacgcccatctctgtcgtaccaacggagtgtgtgtggattggagaacccctgatttctgtgcaatgtcatgtcctccttcccttgtgtacaatcattgtgaacatggttgtcccagacactgtgacggaaacgtgtcaagctgtggcgaccatccgtcagaaggttgtttttgtcctcctgataaagtgatgctcgaaggttcctgtgtgcctgaagaagcatgcacccagtgcatcggcgaggacggggtgcaacaccagtttctggaggcatgggtgcctgatcaccagccttgccaaatatgcacttgtcttagcggcagaaaagtcaattgtaccactcaaccttgtcctacggccaaggctcccacgtgtggactgtgtgaagtggcgaggcttcgtcagaatgcggatcaatgttgcccagaatatgaatgtgtgtgcgaccctgtgtcctgcgatctcccgccggttccacattgcgaaagggggctgcaacctactcttactaacccaggagaatgtagaccaaacttcacctgtgcatgtcgcaaggaagagtgcaagagagtgtccccgccgtcgtgtccaccacatcgcctgcccactctccgcaagacccagtgttgtgatgaatacgaatgcgcatgtaattgtgtcaattcaaccgtgagctgccctcttggttacctcgcgtccactgcaaccaacgattgtggttgcactaccacgacttgcctgccagataaagtttgtgtgcatcggtcaaccatctacccagtgggtcaattttgggaggaaggttgtgatgtgtgtacgtgcaccgacatggaagatgccgtgatgggcttgcgtgtggcccaatgctcccaaaagccatgtgaggactcgtgccgctcgggttttacttatgtcctgcacgagggtgagtgttgtggcaggtgccttccgtcggcatgtgaagtggtcactggttcgcctaggggtgattcccagtccagctggaagtcggtgggatcccaatgggcttcgcccgagaacccatgtctcattaacgaatgtgttcgggtgaaggaggaagttttcattcaacaaaggaatgtgtcgtgtccgcagctcgaggtgcccgtgtgcccctccggttttcagctgtcatgtaaaacttccgcgtgttgtccttcatgtagatgtgaaagaatggaagcatgtatgctcaatgggaccgtcatcggaccaggcaagaccgtcatgatcgacgtctgtactacttgtcgctgtatggtgcaagtgggcgtcatctccggtttcaagctggagtgtcgaaagacgacttgcaatccatgtcctctggggtacaaggaggaaaacaacactggtgaatgctgcgggcgctgtctccctaccgcatgcactattcaactccgcggaggacagatcatgacgctgaagcgggatgagacgcttcaagatggatgcgatactcacttttgcaaggtgaacgaaagaggcgagtacttttgggaaaagcgcgtgactgggtgtccaccatttgacgagcacaagtgtcttgccgagggaggcaagattatgaagattccaggcacttgttgtgatacctgtgaagaacccgaatgcaacgatattaccgcacggttgcaatacgtgaaggtgggatcctgtaagtcagaggtcgaagttgatattcattactgtcagggaaagtgtgctagcaaggcaatgtacagcattgacattaatgacgtccaggatcagtgctcatgttgctcgcctacccgaacggaacctatgcaagtagcactccattgcactaatggctcggtggtgtaccatgaagtgctgaacgcgatggagtgtaaatgttcaccccggaaatgttcgaaa

SEQ ID NO: 21294 - DNA, 8439 bp, Artificial Sequence
  Description of Artificial Sequence: Synthetic coding sequence
atgatcccagcccgtttcgcaggagtgcttctagctctagccctgatccttccaggcacgctgtgtgcggagggcacccgagggaggagctccacagctaggtgttccctgttcggaagtgattttgttaataccttcgacggtagtatgtacagctttgccgggtactgcagctacttactggccggaggctgccagaagagaagcttctcaattatcggcgattttcaaaacggaaaacgcgtttcactatcagtgtatctgggtgagttctttgacattcaccttttcgtcaacggtaccgtgacgcagggtgatcagcgcgtcagcatgccctacgcaagcaagggattatatctggagactgaagcgggatattacaaattgagcggcgaggcttacgggttcgtcgcacgcatagatgggtctggaaatttccaggtgctgttgtctgacaggtacttcaacaagacatgtggcttgtgcggtaacttcaacatatttgctgaggacgactttatgacccaggaaggaactttgacaagtgatccatacgacttcgctaactcatgggcgttaagttcgggggagcaatggtgtgagagagcctcccccccctcctcctcttgcaacatcagtagcggcgagatgcagaagggattgtgggagcagtgccagcttttgaagagcacttcagtcttcgcacgatgtcatcctctggttgaccctgagccgttcgtggccctgtgcgagaagacgctgtgtgagtgtgcaggcggactcgagtgtgcatgccccgccctcctcgaatatgcaaggacttgtgcccaggagggtatggtcttatatgggtggaccgaccattccgcttgtagccccgtctgtcccgccgggatggaataccggcagtgcgtcagcccctgcgcccggacctgtcagagtctgcacattaacgaaatgtgtcaggagcgctgcgtggacgggtgttcttgccccgaaggtcaactgctggacgaggggctatgtgtggagtcgacggagtgcccctgtgtgcacagcgggaaaaggtacccgcctggcactagtctttctcgagattgtaatacctgtatctgccgtaactctcaatggatctgttctaatgaggagtgcccaggcgaatgcctggtgactggacaaagccactttaagtctttcgacaacaggtacttcaccttttcaggcatctgtcagtatttgcttgctagagactgccaggatcactccttttccatcgtcattgagaccgtccagtgtgctgacgatcgggacgccgtctgtactaggtccgtcacagtaaggttgccgggcctgcataatagtttggtcaaactgaagcacggcgctggcgtggcgatggacggccaagatgtgcagttgccactcctcaagggcgaccttagaatccagcacacagtgacagcctccgttcggctgtcatacggtgaggatctgcagatggattgggatggcagggggaggcttctagttaaactgtcccctgtctacgccggcaaaacttgcggactgtgtgggaattacaacgggaatcagggcgatgattttctgacaccgagcggcctggcagagcctagggtggaagattttggaaatgcttggaagctgcatggagattgccaggatctgcagaaacagcattcagacccctgcgcccttaatccccgcatgacaaggttcagcgaagaggcatgcgctgtgctgaccagcccaacttttgaggcgtgccacagggccgtgagtccactgccttaccttagaaattgccggtacgacgtgtgctcgtgctccgacgggcgggaatgcctatgcggcgcgctcgcctcttatgctgcggcctgcgctggtcggggtgtgcgggtggcctggcgcgaacccggcagatgcgaactgaattgcccgaagggccaggtttatttgcaatgcgggacaccttgtaacttgacttgcagaagtctgtcctatccagatgaggagtgcaacgaagcatgcctcgagggttgtttttgtccacctggactgtatatggacgagcggggagattgcgtgcctaaggcccagtgtccctgttactacgacggagagatattccaacctgaagacatcttcagtgatcaccacaccatgtgttactgtgaggatgggtttatgcattgcacgatgtcgggggttcctggatcactcctgccagacgccgtgctgagttcccccctaagtcatcgcagcaagcggtccctttcttgtcgaccccctatggttaaactggtctgccccgcagacaatttacgggccgaagggttggaatgcacaaagacatgccagaattatgatttggaatgtatgtcaatgggctgcgttagtgggtgtctgtgtccaccagggatggtgagacacgagaatagatgcgtagcgctagagcggtgtccttgttttcatcaaggcaaggaatacgcgcccggggagacggtgaagattggatgcaatacttgcgtgtgccaagacagaaagtggaattgcacagaccatgtctgcgacgcgacatgttctacaatcgggatggcccattatctaacttttgacggactgaagtatctgttccctggagaatgccagtatgtgttggtgcaggactactgcggcagtaatccaggaacttttagaatcctcgtagggaacaaaggctgctctcatccaagcgtaaaatgcaaaaagcgcgttacgattctcgtggaaggcggcgaaattgaactattcgacggggaggtgaacgtgaaaagacccatgaaagacgaaacacatttcgaagttgtggagagtggaaggtacataatactactattggggaaagcgcttagtgtggtgtgggataggcacctgtccatatctgtcgtccttaagcagacatatcaagaaaaggtttgcggtctgtgtggaaacttcgacggaatacaaaacaacgatctcactagttcaaacttacaggtggaagaggaccctgtggactttggtaacagttggaaggtctcttcccaatgcgccgatacccgaaaagtcccgttagatagtagtccagccacctgccacaataatattatgaagcagactatggtggactcctcttgcaggattcttacttcggacgtgtttcaggactgcaacaagcttgtggaccctgagccatatctggacgtgtgcatttacgacacttgtagttgtgaatcgattggggattgcgcctgtttttgtgataccatcgctgcctatgctcatgtctgtgcccagcacggtaaggtggtaacatggagaacagcaacactttgtcctcagagctgcgaggagagaaatttgcgcgagaacgggtacgagtgtgaatggagatacaattcttgcgcacctgcctgccaggtaacttgccagcatccggaacccctagcctgccccgtgcaatgcgtggaagggtgccatgcacattgcccacccggcaaaatcctcgacgaactcctccaaacctgcgtggacccagaggactgccctgtctgtgaagtggcggggcggcgtttcgcctctggtaaaaaggtgacattaaatccctctgatccggagcactgccagatatgccactgcgacgtcgttaacctgacctgtgaggcttgccaagagcctggcgggctcgtagtgcctcccactgatgcaccggttagtccgaccaccctgtatgtggaagacatctcagaacctcccctccatgacttttattgctcgagattgctggacctggtttttttgctggatggtagcagtcgtctctcggaggcagagttcgaggtgctcaaggcatttgttgtcgatatgatggagcggttaagaatctcccagaaatgggtaagagtcgccgtggttgaatatcatgatggctcacatgcgtatataggtctcaaggatcgaaaacgtcctagcgagctgcgtaggatcgcgtcacaggtgaagtatgcggggtcgcaagtagcctccacatccgaggtcctgaaatataccctgttccagatatttagcaagatcgaccgacccgaagcctcccggatcaccttgttactcatggcctctcaggagccccagcgcatgagcagaaactttgtacgctacgtgcagggtctaaagaaaaagaaggtcatcgtaattcctgtcggaataggtccccacgccaatttgaaacaaataagactgatcgagaagcaggctccagaaaataaagccttcgtcctgtcttccgttgacgagttggaacaacagcgggatgagatagtgtcttacctgtgtgatctggcccctgaagccccccctcccaccctgccaccagacatggctcaggtcacggtggggcctggcttgctgggtgtttctacactcggcccaaagcggaacagtatggttttagacgttgcttttgtgctggagggctctgacaaaattggggaggctgactttaatcggagcaaagaatttatggaagaggtaattcagaggatggacgttgggcaggactcaatccatgtgactgtcctgcagtactcatacatggttacagttgagtatccgttttccgaagcgcagagcaaaggagatatcctgcagcgagttagggagattagataccagggtggtaacaggactaacaccggattagctctgcgctatctgtcagatcattccttcttagtctctcagggggaccgcgaacaggcgccgaaccttgtgtacatggttacagggaaccccgccagtgacgaaatcaagcgtctaccaggcgacatacaggtggtgccgataggagtcggcccaaatgcaaacgtacaggagctggagagaattggttggcctaacgcgcccatcctgattcaggactttgagacgctgccgcgcgaagcccctgacctagttttgcagaggtgctgctcaggtgaaggactgcagattccgaccctgagccctgcgcctgactgcagccagcctctggatgttatcctcttattagacgggagctcaagctttcctgcaagttatttcgatgaaatgaagtcttttgcgaaggcatttatctctaaggcgaacattgggccaagacttactcaggtgagcgtgctccagtatggctctattaccacaattgacgttccatggaacgtcgtgccagagaaggcgcacttgctgtcattggttgacgtgatgcagagagaaggtggaccctcccaaattggggacgccttgggttttgccgtccgatatctgacctccgagatgcatggagccagacccggcgcatcaaaagctgtggtcattctggtcactgacgtgagcgtcgacagcgtggacgcagctgccgatgccgcaaggtcaaatcgggtaactgttttccctatcggaatcggggatagatatgacgccgcccagctgaggatcctggccggtccagcgggcgattcgaatgtcgtgaagctccagcgaattgaagacttgccgactatggtcaccctcggcaactcttttctccacaagctgtgctctggctttgttcgcatatgtatggatgaggacgggaatgagaagcgtcccggagacgtgtggacactaccagaccaatgccataccgtcacatgtcagcctgacggtcagaccctgctcaaatcacacagggtgaactgcgaccggggcctgaggccgagctgtcccaacagccaatccccagtgaaagtggaagaaacctgtggatgcagatggacttgcccttgcgtatgcacaggatcctccacaagacatattgtcacttttgacggccagaattttaagctgactggaagctgttcttatgttctcttccagaacaaggagcaggatttagaggtaatcctgcataacggcgcctgttctccaggagctaggcagggctgcatgaagagcattgaggtgaagcatagtgcgctcagcgttgaactgcacagcgacatggaagtgaccgtcaacggacgattagtctccgtcccttatgtaggagggaatatggaagttaacgtgtatggagctattatgcatgaggtacgatttaaccacctgggccacattttcacttttacaccccagaacaacgaatttcaactgcagctgtcccctaaaacattcgcttcaaagacttatggactctgcgggatctgtgacgaaaatggcgctaacgactttatgttacgggatggcacggtaactacagactggaagactctcgtacaggagtggaccgttcagcgcccggggcagacttgccagcctatattggaagagcagtgtcttgtgcctgactcttctcactgccaggttctcctcctgcctctgttcgcagagtgccataaggtccttgcacccgcaaccttctacgcgatatgccaacaagacagttgccatcaggagcaggtctgcgaggtcatcgctagttacgctcacctctgtcgaaccaatggagtttgtgtggattggaggacccccgacttctgtgcaatgtcttgccccccatcattagtgtacaatcactgcgagcacggttgcccccgccattgcgatggaaacgttagttcttgcggcgatcatccctccgaggggtgtttttgccctcccgataaagttatgctagagggcagctgcgtgccagaggaggcctgcacccagtgtataggtgaagatggggtgcagcaccaatttctggaggcatgggtgcccgaccatcagccctgtcagatttgcacctgtctgtccgggagaaaagtgaactgtaccacccagccgtgccctaccgcaaaggccccaacctgcggactctgtgaagttgctaggttgcggcagaacgccgaccagtgctgtcctgagtacgaatgcgtgtgtgatccagtctcttgtgacctaccccctgtgcctcactgcgagcgtggcctgcagccgaccctgactaatcccggcgagtgtcgccccaacttcacttgtgcctgccgtaaagaagaatgcaagcgggtgtctcccccctcttgccccccacataggcttcccacgctgcggaagacgcagtgttgcgatgaatacgagtgtgcatgcaactgcgtcaattctaccgtatcctgtccattaggatatctcgcttctaccgcaaccaatgactgtggttgtactaccacaacctgtttacctgacaaagtgtgtgtgcatcgatccaccatctacccagttgggcagttctgggaagagggctgtgatgtctgtacctgtactgacatggaggacgccgttatgggcctgcgcgtggcgcagtgttcgcagaagccctgcgaagacagctgtcgcagcggatttacgtatgtccttcacgagggcgagtgctgtggaaggtgtttgccaagcgcctgtgaggtcgttaccggcagccctcggggggactcgcaatcttcatggaagtccgtggggtctcagtgggccagccctgaaaacccctgccttattaacgaatgtgtccgcgtcaaagaagaagttttcatacaacagcgaaacgtttcatgtccacagctggaggttcccgtgtgcccatccggttttcagctgtcctgtaagacttctgcctgctgtccctcttgtcgctgcgagcgaatggaggcctgcatgctcaacggcaccgtcatcggccccggaaagaccgttatgattgatgtttgcactacctgccgctgcatggtgcaggtgggcgtgatctctggatttaagttggaatgcaggaagacaacctgtaatccatgccccctaggttacaaagaagaaaacaatactggcgaatgctgcggcagatgcttacctaccgcatgcaccatccagcttagaggcggccagatcatgaccttgaagagggatgaaacccttcaggatggttgcgacactcacttctgcaaagtcaacgaacggggggaatacttctgggagaaacgcgtgacaggctgccctcccttcgacgaacacaagtgtctggccgaaggggggaagattatgaaaatccctgggacctgctgcgatacatgtgaagaacccgaatgcaatgacatcacggcccggctgcagtatgtgaaggtggggtcatgtaagtcggaggtggaagtggatatccactattgtcagggcaagtgtgcctccaaggctatgtactccatagatataaacgatgtacaagatcagtgctcatgttgctcccctacgagaacagagcccatgcaggtcgctctgcactgcacaaacgggagtgtggtgtaccacgaggttctgaatgccatggagtgcaagtgttcgcctaggaagtgtagtaag

SEQ ID NO: 21295 - DNA, 8439 bp, Artificial Sequence
  Description of Artificial Sequence: Synthetic coding sequence
atgatccccgccagattcgccggcgtgctgcttgccctcgccctgattcttccaggaacactgtgcgcggagggcacccggggtcgatccagcaccgcccggtgctccttattcggcagcgatttcgtcaatacgttcgacggaagcatgtacagtttcgccggttattgctcttatctcctggccggcggatgccagaagcggagctttagtattatcggggattttcaaaacgggaagagagtgtcgctctccgtgtatctgggtgaattctttgatattcatctgttcgtgaatggcacagtgacacagggggatcaacgcgtaagcatgccctacgcaagcaaggggctttatctcgaaactgaggcaggatactacaagctgtcaggggaggcatacggatttgtggctcgtattgatggctcaggtaactttcaagttctactgtccgatcggtattttaacaagacttgcggactgtgcggcaactttaatatcttcgctgaggatgacttcatgactcaagagggtacattgacttctgatccctatgactttgcaaacagttgggctctgtcatctggcgagcagtggtgcgaacgggcgtctccaccaagctcttcttgcaatatttccagcggggagatgcagaaaggcctttgggagcagtgtcagttgttgaagtccacttcagtattcgcacgctgtcaccctctagtggacccggagccctttgtagcactgtgcgaaaaaaccctgtgtgagtgcgccgggggcctggagtgtgcgtgccctgcactgctcgaatacgctcggacctgcgctcaggagggtatggttttgtacggttggaccgaccatagcgcatgttcccccgtctgcccagcgggcatggaataccgccagtgcgttagcccatgtgcacggacttgtcagtccctgcatattaacgagatgtgtcaggagcggtgcgtggacgggtgtagctgtcccgaaggacaactgctggatgagggcctgtgtgtggagtcgaccgagtgcccctgcgtccattccggcaaaagatacccccccggcacctcacttagcagggattgtaatacttgcatttgtcgaaactcacagtggatatgctctaatgaggagtgccctggcgagtgtctggtgactggccagtcgcatttcaaaagtttcgataacagatatttcacattttccggcatctgccagtacttgctggctcgtgactgccaggaccactctttctctattgttatcgagaccgtgcagtgcgcagacgacagggatgccgtgtgtaccagatctgtgacagtaagactccctggcttacacaactctctggtaaagctgaagcacggggctggggtggctatggatggacaggacgtgcagttaccattgttgaagggtgatctgcggattcaacacactgttacagcctctgtgaggttgtcctatggagaagatttacagatggattgggatggtagggggcgcctactggtgaaactaagcccggtgtatgctggaaaaacctgtgggctttgcggtaattacaatggaaatcaaggtgatgactttctgacaccttctggccttgccgagcctcgcgtcgaggattttggcaacgcttggaaactccacggtgactgccaggatttacaaaaacaacatagcgatccttgcgccctgaacccacggatgacccgcttttccgaagaggcctgtgccgttctgacatcaccaaccttcgaagcttgccaccgcgccgtgagtccgctgccataccttagaaattgcaggtatgacgtttgcagttgctctgatggcagagaatgtttatgtggcgctctggccagctatgctgcagcctgcgccgggcgcggagtgcgcgtggcctggcgggagcctgggcgctgtgaactaaactgcccgaagggacaggtttatcttcagtgcgggactccatgtaacctgacatgtcgctctctatcctatccggacgaggagtgtaacgaggcttgtctcgaggggtgcttctgtccgccaggactgtacatggatgagaggggcgattgcgttcctaaagcgcagtgcccttgttattatgacggcgaaatcttccagccggaggatatctttagcgaccaccacaccatgtgttactgtgaggacgggttcatgcactgtactatgagtggagtgccagggtctttactccccgacgcagtgctgtcctctccactgagccatcgctcgaagcgatcattgagttgcaggcctccaatggttaagcttgtgtgcccagccgataatcttcgcgctgagggcctcgagtgcaccaagacctgtcagaattacgatctagagtgtatgagcatgggatgtgtgtctgggtgtctttgccctccggggatggttcggcacgagaaccgctgcgtggcacttgagcgctgtccctgttttcaccagggcaaggagtacgcaccaggcgagactgtaaaaattgggtgtaacacgtgcgtctgtcaggacaggaagtggaactgcacagaccatgtatgcgatgctacttgttctacaatcggaatggctcactatctgacatttgatggtctcaaatatctgttccccggggaatgccagtacgtcctggtccaagattattgcgggagtaacccaggcacatttcggattctggtggggaacaaagggtgtagtcaccctagtgttaagtgcaagaagagggtaacaattttggtggagggaggagaaattgaactcttcgatggggaggtaaacgtgaagcgccccatgaaagacgagacccattttgaagttgtcgaatccggccgctacatcatcctgctgctcggtaaggccctaagcgtggtttgggatagacacctatctattagtgtggtgctgaaacagacctaccaggagaaagtgtgcgggttgtgcggtaattttgatggaatccagaacaacgacctcacatcgagcaacttgcaggtcgaggaggatcccgtggatttcggaaattcttggaaagtgtcatcccagtgcgctgataccagaaaggtcccgttagattctagccccgccacttgtcacaataacatcatgaagcagacaatggttgatagctcttgccggattctgacgtccgacgtgttccaagattgcaataaactcgttgacccagaaccctacctggacgtctgtatttacgatacctgctcatgcgagagcatcggagactgtgcttgcttttgcgataccatcgccgcctatgctcacgtttgcgcgcagcacggaaaggtggttacgtggagaacggctacgctgtgcccccagtcctgtgaggaacgaaatctccgagagaatggctacgagtgcgagtggcgctataattcttgcgctccagcatgccaggtgacctgccagcacccggagccattagcatgtccagtccagtgcgttgaaggatgccacgctcactgtccaccaggcaaaatcctggatgagctgttgcaaacctgtgtggaccctgaagattgtcccgtgtgcgaggtggccgggagacgattcgcctccggcaagaaggtcacattaaatccttccgatccagaacactgtcaaatctgtcattgtgacgttgtcaacctgacatgtgaggcttgtcaggagcccggcggtctggttgtgccaccaactgatgcgcctgtgtccccaaccactctctacgtagaagatatatccgagcctccgctgcatgacttctactgttctagactcctggatctcgtgtttttgctggatggctccagccgcctgagcgaagcggagttcgaagtgctcaaggcattcgtcgtggatatgatggaaagattgagaatttcccagaagtgggtccgggtggccgtggtcgaatatcacgatggctcccacgcctatattggtctgaaggacagaaagcggccgtccgaactgagaagaattgcctctcaggttaagtacgctgggtcccaggtcgctagcacctccgaagttctgaagtatactctgttccagatattctctaagattgaccgcccggaggcaagtcggataacactcctcctgatggcatcacaggaaccccagaggatgtccagaaatttcgttcgatacgtccaaggcctcaagaagaaaaaagtgattgtcattcccgtcggtataggtccccacgcaaatctaaagcagatccgtctgatcgagaaacaggcacctgaaaataaggcgtttgtgctaagtagtgtagacgagctggagcaacaacgagatgagatagtgtcctacctgtgcgacctggcccctgaagctcccccacctacacttcccccagacatggcccaagtcacggtaggaccggggctcctgggggttagcactttggggcctaaacggaacagcatggtcttagacgtcgcctttgttttggaaggatctgacaaaatcggtgaggccgactttaatcgaagtaaagagttcatggaggaagtgattcagcggatggatgtgggccaggactccatacacgtaaccgtcctgcagtactcctatatggttactgtggagtaccctttttcagaagcacagtccaagggagacatacttcagcgggtgcgcgagatacgatatcagggaggtaatcggacaaataccggcctcgcgctgcggtacctaagtgatcactccttcttggtcagtcagggggaccgcgaacaggcaccaaacttggtgtacatggtcaccggaaatcctgcctctgatgaaatcaagcggctgccaggcgacatccaggttgtgcccattggcgtcggtcccaacgccaatgtgcaggagttagaaagaatcggctggcccaacgcacccatcctaattcaggactttgaaactctgcctcgggaagcaccagatctggtgctgcagaggtgttgtagtggtgaaggtctacagatccctacactgtctccagcacctgactgttctcaaccgttggatgtaatacttttgctcgatggctcgtccagcttcccagctagttacttcgacgaaatgaaatctttcgctaaagctttcattagcaaggctaatatcggtcctagactcactcaggtttcggtacttcagtacggctcaataactaccatcgacgtgccgtggaacgtagtgcccgagaaggcgcacctcctgagtctcgtagacgttatgcagcgcgaaggtgggccgtcccaaattggcgacgctttgggatttgccgttcggtatttgaccagcgagatgcacggggctcggccaggcgcttccaaggctgtggtgatcctagtcacagacgtgagcgtggatagcgtcgatgccgcagctgatgcagctaggtcgaatcgggttaccgtgtttcccatcggaatcggagatcgatacgacgccgctcaactcagaatcttggccggccctgctggggattctaatgtggtaaagctccagcgcattgaggaccttcctacaatggttaccctcggaaactcattcctgcacaagctctgcagtggattcgtgcgaatttgtatggacgaggatggaaacgagaagagaccaggggacgtgtggacactgcctgaccagtgccacacggtcacctgtcaacccgacgggcagacattgttgaaaagtcatcgggttaattgcgacagaggcctgcggccatcttgccctaattcgcagtcaccagtcaaggtggaggagacttgtggctgcaggtggacgtgcccctgcgtgtgtacgggatcctccactcggcacatcgtgacatttgatgggcagaactttaagctaaccgggagctgttcctatgttctgttccagaacaaagaacaggacctggaggtgattctgcacaatggcgcttgtagccccggcgcccggcaaggatgtatgaagtctatagaagtaaaacacagcgcactctctgtcgaattgcactctgatatggaagtgaccgtgaacgggcggcttgtcagcgtgccctacgtaggcgggaatatggaggtgaatgtatacggcgcgatcatgcatgaggtgcgcttcaatcacctcgggcacatctttactttcaccccgcaaaataatgagttccagctgcaactctctcctaagacatttgcatcgaagacttacggtctgtgtggaatttgcgacgaaaatggagctaacgacttcatgctacgggatggaaccgttacaaccgactggaaaacgttggttcaggagtggacagtgcagcgcccaggacagacgtgtcagccaatactggaggagcagtgccttgttccagacagcagtcattgtcaagtcctgctgcttcctctatttgccgagtgtcataaagtactagctccagccacgttttacgccatctgtcagcaggattcatgccaccaggagcaggtttgtgaagtgatcgcgtcttacgcgcacctgtgtagaactaacggggtgtgtgtcgactggagaactcctgacttctgtgcaatgagctgccccccatctcttgtttataaccactgtgaacacggttgcccacgtcactgcgacggaaatgtcagctcttgcggagaccacccctctgagggttgcttctgcccgcccgataaagtcatgctggaaggtagctgcgtaccagaagaagcctgtacgcaatgtattggagaggacggtgtgcagcatcagttcctggaggcctgggtgcctgatcaccagccctgtcaaatttgtacttgcttgtcgggcagaaaggtcaactgcaccacccagccttgccctacggcgaaagctcccacatgtgggctatgcgaagtcgcccgtctccgacagaacgcggaccaatgctgccccgagtacgaatgtgtttgcgatccggtgagttgtgacctgccacccgtacctcactgtgagcggggcttacaacccaccctgactaatccaggagagtgccggccgaactttacttgtgcttgccgcaaagaagagtgcaaacgtgtgtctcccccgagctgccctccgcacaggctgcctacgttgcgcaagactcagtgctgcgatgaatatgaatgcgcatgcaactgtgtgaacagtaccgtaagctgtccccttggatacctggcttctacggccacaaacgactgtggatgtaccacgaccacatgcctaccagacaaggtgtgcgtgcatagatcaactatttaccccgtgggacagttttgggaggagggttgtgatgtgtgtacatgcaccgatatggaagacgctgtgatggggctgcgagtggcacagtgttctcaaaaaccctgcgaagatagctgtaggagcggctttacctatgtactgcacgagggggaatgttgtggacgatgccttccgtccgcctgcgaggtagtgacaggttctccccggggcgactctcagtccagctggaaatcagtgggaagccaatgggcatcccccgaaaacccctgcttaattaacgagtgcgttagagtgaaggaagaagtcttcatacagcagcggaatgtcagctgccctcaactcgaagtccctgtgtgtccctcagggttccaactgtcttgcaagacctccgcctgctgcccttcttgtcggtgcgaacgcatggaggcctgcatgttgaatggcacagtcatcgggccaggcaagactgtcatgattgacgtctgtactacttgtcgttgtatggtgcaggtgggtgtcattagcggttttaagttggagtgtagaaagacgacgtgcaacccctgtcctctgggctataaagaagaaaacaatacgggtgaatgctgcggcaggtgcctcccaacagcatgcaccattcagctgcggggaggccaaatcatgactctgaaaagggacgaaacactccaggatggttgtgacactcacttctgtaaggttaacgaacgcggagaatacttctgggagaagcgcgtaacggggtgcccacccttcgacgagcacaaatgcctggccgaaggaggaaagattatgaagatacctggcacctgttgcgacacgtgtgaggaaccggagtgtaatgatattacagcccggctgcagtacgtcaaagtggggtcttgtaaatccgaggtcgaggtggacatccactattgtcaggggaaatgtgcctcaaaagccatgtacagcattgatataaacgacgtccaggaccagtgttcctgttgctcgcccacacggaccgagcctatgcaggtcgcacttcactgtactaacggttcagtggtctaccatgaagtgctcaacgctatggaatgcaagtgtagtccccgcaaatgcagcaaa

SEQ ID NO: 21296 - DNA, 8439 bp, Artificial Sequence
  Description of Artificial Sequence: Synthetic coding sequence
atgatccctgcacgattcgccggcgtgctgctggctctcgcgctgatcctgccaggcacgctctgcgccgaaggaacccgcgggagaagcagtacagctcgatgcagcttattcggctctgatttcgtgaacacctttgacgggagcatgtatagcttcgccgggtactgttcttatctgctggcaggagggtgccagaaacggagcttctctatcattggcgatttccagaacgggaaacgtgtcagcctgtcagtctacctcggggagtttttcgatattcacttgttcgtgaatggaacagtaacacagggtgaccaaagggtaagcatgccctatgctagcaagggattgtatctggaaacagaggccggctactacaaattgtctggagaggcatatggctttgtggcccgtattgatggttcagggaactttcaggtgttactcagcgataggtatttcaacaaaacgtgtgggctctgtggcaacttcaatatttttgctgaagatgactttatgacgcaggaaggaaccttgaccagtgatccctacgacttcgcaaattcatgggccttgtcttcaggtgaacagtggtgcgagagggcctccccgccaagctcttcatgcaacatatcctccggcgaaatgcaaaaaggcctgtgggaacagtgccagctgctgaaatcgacttccgtcttcgcccgatgccatcctctggtggatcccgagccattcgtggctctgtgtgagaaaaccctatgtgagtgcgctgggggtctggaatgtgcctgccctgccttgttggagtatgctcgcacatgcgcgcaggaaggcatggtgctctacgggtggacagatcatagcgcgtgtagccctgtctgcccagctgggatggagtacaggcagtgtgtgagcccctgcgccagaacctgtcagtccctgcacataaatgaaatgtgccaagagagatgcgttgatggctgtagctgtcctgaggggcagctcctggatgaaggcttatgtgtggagtctacagagtgtccttgtgtccattcagggaagaggtacccccccggtacgagcctctctagggattgcaatacctgtatctgcaggaattctcagtggatttgttctaacgaggaatgcccaggagaatgcctggtcactggacaatcccatttcaagagttttgacaatagatactttaccttttccggaatctgccagtacctgcttgcccgggactgtcaggatcactccttctcgatcgtgattgaaaccgtgcaatgcgccgatgaccgagacgcagtctgtacacggtccgtgaccgtacgactgcccgggctgcacaactccctcgtcaaacttaagcatggcgctggagtcgccatggacggccaggatgtgcagctgccactgctcaagggagatctgagaattcagcacaccgtaacagcctctgttcgactgagctatggcgaggacctgcagatggattgggacggccggggcaggctacttgtgaaattgtcacctgtctatgcagggaagacatgcggactgtgtgggaattacaatggtaaccagggggatgactttctgaccccatcgggcctcgcagagccccgagtggaagactttgggaacgcttggaagctgcatggcgattgtcaggacctgcagaagcagcactccgatccgtgtgctctgaacccccgtatgacaagattctccgaggaggcatgcgcagtgctaacatcccccacattcgaagcctgccatagggccgtgagccccctcccatacctgaggaattgcaggtacgatgtttgttcatgttctgatggcagagaatgcctatgcggggctttggcctcttacgccgccgcttgtgcagggcgaggtgtgcgagtagcttggagggaaccggggaggtgcgagttgaattgtcccaaagggcaggtctacctgcagtgcggtacgccatgtaatcttacctgccgaagtctgtcataccccgatgaggagtgcaatgaggcctgcctcgaagggtgcttctgccccccaggtctatatatggacgaaagaggcgattgcgtgccgaaggcacagtgtccttgttactatgacggggaaatctttcagccagaagacattttctcagaccatcacaccatgtgttattgcgaggacggtttcatgcactgtacaatgagcggggttccaggatctcttctccccgacgccgtgctttcaagcccactctcccatagatctaaaagatctctgtcatgtaggccgcccatggtgaagctggtttgtcctgccgacaatttgcgagccgagggcctcgaatgtaccaagacctgccagaattacgatctcgagtgcatgtctatgggttgcgtgtctggctgtctgtgtcctccaggtatggtgcgacacgaaaatcgctgtgtcgccctcgagaggtgtccctgttttcaccaggggaaggagtacgctccaggcgagacggtcaagatcggatgcaatacgtgtgtttgtcaggaccgaaaatggaactgtaccgatcacgtctgtgacgcgacttgttccactatagggatggcgcactacctgacgtttgacggtttgaagtacctgttcccaggcgaatgtcagtatgtccttgtacaagattactgtgggagtaatcctggcacattccgaatcctggtcggaaataaaggctgcagccacccttcagtgaagtgtaaaaaaagagttacaattctcgtggaggggggagagatcgaactctttgacggggaggtgaatgtcaagcggcccatgaaggacgaaacccatttcgaggtggtggagagtggccgatatattatactgctgcttggtaaagccctgagcgtggtgtgggaccgccacctgagtatcagcgtcgtgctgaagcaaacctatcaagaaaaggtgtgcggactttgcgggaatttcgacggcatacaaaataatgatctaacttcaagtaacctgcaagtagaagaggatcccgtcgatttcgggaacagttggaaagtgtcgtcccagtgcgctgacactagaaaggtgcctcttgactccagcccggccacctgtcataataatattatgaagcaaaccatggtcgatagctcctgcaggatcctgacaagtgatgtcttccaggactgcaataaactggtcgatcctgagccttaccttgacgtttgcatatatgatacatgtagctgcgagagcatcggggattgtgcctgcttctgtgacaccatcgcggcttacgctcacgtctgtgcccagcacggaaaggtagtcacctggaggacagcaaccttgtgtccccagtcctgcgaagaaagaaatctgcgagaaaacggctacgaatgtgaatggaggtataatagttgcgccccagcatgccaggtcacatgccagcatccagaacctctggcttgtcctgtacagtgcgtggaaggctgccacgcacattgccccccaggaaaaatcctagacgaactcctgcagacctgtgtggatcccgaggattgccctgtctgcgaagtagccggaagaaggttcgccagtggaaaaaaagtgactctgaacccatccgacccagaacactgccagatctgtcactgcgacgttgtcaacctaacttgtgaagcgtgtcaggagccgggcggactggtggtgccccccaccgacgcccccgtgagcccaactacgctctacgtggaggacattagcgagccccctctccacgacttttactgttcacgattgctggatctggtgttcctgctggacgggtcttccagactcagcgaggccgaattcgaagtgctgaaagctttcgtcgttgatatgatggaaagacttaggatcagccaaaaatgggtcagagtggcagtcgtggaataccacgatggtagccacgcatacatcggtctgaaggacagaaaaagaccctctgaactaaggcgaattgcttctcaagtaaagtacgcaggttcccaagtggcgtccacctctgaagtgctcaagtacacactgttccaaatattttctaaaattgatcgaccggaggcctccagaattaccttgctgctgatggcctcccaggagccacagaggatgagccgaaattttgtgcgctacgtgcagggcctcaaaaaaaaaaaggtaatcgtcatcccagtggggatcggtccccatgcaaatctgaagcaaatcaggcttatagagaagcaggctcctgaaaacaaggcttttgtgctatcaagcgtggatgaactcgagcagcagagggacgaaatcgtgagctacttgtgtgacctggctcccgaggccccccccccaacgctgcctccagacatggcacaagtgacagtcgggcccgggctcctgggggtctctaccctcggccctaagcgtaatagtatggtgctagacgttgccttcgttcttgaaggttctgacaaaattggcgaagctgactttaacaggagcaaagagtttatggaagaggttattcagagaatggatgtcggacaggactcaatccatgtaaccgtgcttcagtactcctatatggtgacagtagagtacccattttccgaggctcagtctaaaggggacatcttgcaacgagttagggagatccggtaccagggaggcaatagaactaacacaggtcttgcactcagatatctgagcgatcattctttcctcgtgagccagggcgaccgagagcaggcaccaaatttggtgtacatggttacaggaaacccagcttctgatgaaattaaacgtttacctggggacattcaggtggttccaatcggcgtggggcccaacgctaatgtacaagaactcgaacgaattgggtggccaaacgcacctattttaattcaagattttgagactctgccaagggaggcaccagatctcgttctgcagaggtgctgtagcggtgagggcctccagatccctaccctgagccccgccccagattgcagtcagccgttagacgtgattttgctccttgacggcagtagcagctttcccgcttcttatttcgacgaaatgaagtcatttgccaaagcctttatctcaaaggcgaacatcggtccaagactgactcaggtgtctgtcttgcaatacgggtctataactaccatcgacgtgccctggaatgtggtgccagaaaaggcacacttgctgagcctcgttgacgtgatgcagcgagaaggcggaccatctcagattggtgacgccctcggcttcgccgtgaggtacctgactagtgaaatgcatggcgcccgcccaggggcatctaaggcggtggtcatcctggtgaccgacgtgagcgtagacagcgtcgacgcggccgctgacgccgccagaagtaacagggtcacagtcttcccgattgggatcggtgataggtacgacgctgcgcaactgaggatcctggctggtccagccggagattctaacgtggtgaaactacagaggatcgaggatttgcctaccatggtgacgctcggcaactcttttctccacaaactctgcagcgggttcgttaggatctgtatggatgaggatggtaatgaaaagaggcccggagatgtctggacactccccgaccagtgccacacagtaacatgtcagcctgatggtcagacactcctgaagagccaccgagttaactgcgacaggggcctgagaccctcctgtccgaattcccagagccctgtcaaggtggaagagacctgtgggtgccgatggacctgtccctgcgtgtgtactgggtcctcgacaagacatatcgtgacgtttgacggtcagaattttaaattgacgggcagttgcagctatgtgctgttccagaacaaagaacaggacctggaggttatactgcacaatggcgcctgcagcccaggtgcaagacagggctgtatgaaaagcatagaggtcaaacacagcgctctgtccgtggaactccatagcgacatggaggtgaccgtgaatggcaggcttgtgagtgtgccttacgtgggaggcaatatggaagtgaacgtctacggcgccattatgcatgaagtgagatttaatcacctaggacatatcttcacctttacaccgcaaaacaacgagttccagctgcagctgagcccaaagacatttgccagtaaaacatatggcctatgcgggatctgcgatgaaaacggagctaacgatttcatgctgagggacggtactgtaacaactgactggaaaactttggtccaagagtggactgttcaaaggcctggacagacttgccagcccatactggaagagcagtgccttgtcccggattctagccattgtcaggttcttctactcccactgttcgcagagtgtcacaaggtgcttgcacccgctacattttacgccatttgccaacaagacagctgccaccaagaacaggtctgtgaggtcatagctagctacgctcacctctgtaggaccaacggcgtgtgcgtggattggcgcaccccagatttctgcgccatgagctgtccccccagtctggtttataatcattgcgaacatggctgcccacggcattgtgatgggaacgtctcatcctgcggtgaccatccgagtgagggatgcttttgtccccccgataaggtgatgctggaaggtagctgcgttcctgaagaagcctgtacacagtgcataggcgaagacggcgtgcaacaccagttcttggaggcttgggttcctgaccatcagccatgccagatttgcacctgtctctctggacgaaaggtgaactgtactacccagccttgtccaacagctaaggccccaacgtgcggactttgtgaagttgcgaggctgcggcagaacgcggatcaatgctgcccggagtatgaatgcgtgtgcgaccccgtatcttgcgacctccctcctgtgccccactgcgaaagaggcttacagcccactctgacgaatccaggcgaatgtcgtcccaacttcacatgcgcatgccgaaaggaagagtgcaagagagtctcccccccttcatgtccgccgcatcgattgcccaccttgaggaaaactcagtgctgtgacgaatatgaatgcgcttgcaattgtgtgaacagtaccgtgagctgtcctctcggatacctagcgagcacggctacgaatgactgcggctgtaccaccaccacctgtctcccagataaggtgtgcgtacatagaagcacaatctatcccgtgggacaattctgggaagagggatgcgatgtgtgtacttgcactgacatggaagatgccgtgatgggccttagagtggcccagtgctcccagaagccctgtgaagacagttgcaggagcggttttacatacgttctacatgaaggggagtgctgcgggcgatgtctgcccagtgcgtgtgaagtcgtgactggatcacctcgaggcgactcccagagcagttggaagagtgtcggatcacagtgggcgtctcctgagaacccctgcctaattaacgagtgcgtgcgagtcaaagaagaggtgttcatccagcagcgaaacgtttcttgtccccagctggaggtccccgtctgtcccagtggtttccagttgtcctgcaagacctcagcctgttgccctagctgcaggtgcgaacgaatggaggcatgcatgcttaacggcacagttattggacccggaaagacagttatgatcgacgtctgtacaacttgccgatgcatggtacaggtgggagtcatctcaggtttcaagcttgaatgtagaaagacgacctgcaatccgtgccccctgggttataaagaggagaacaacactggcgaatgttgtggccgatgccttcccacggcttgtaccatacagcttcgaggcggacagattatgacgctcaagagggacgagactttgcaggatggctgtgatacccacttctgcaaggttaacgaaagaggcgaatacttctgggagaaacgcgtcactggatgccccccttttgatgagcacaaatgtctagcggagggtggaaaaatcatgaagatccctgggacatgctgtgatacatgcgaagaacctgaatgcaacgacataaccgctcgcctccagtacgtcaaggtgggatcctgcaagagcgaggtggaagtggatattcattactgtcaaggcaaatgcgccagcaaagctatgtatagcattgacatcaatgatgtgcaggatcagtgtagctgttgcagtcctaccaggacagaacctatgcaggtggctctgcactgcaccaacggttccgtggtctaccatgaggtcctgaacgcaatggaatgcaaatgctctcctcgaaagtgcagtaaa

SEQ ID NO: 21297 - DNA, 8439 bp, Artificial Sequence
  Description of Artificial Sequence: Synthetic coding sequence
atgatccccgctagatttgcaggcgtgctgttagccctggcccttatactgcccgggacgctgtgtgctgaaggtactagaggcaggtcctctactgctcgctgctccctgtttggttccgactttgtcaacactttcgacggaagcatgtattcgtttgccggatactgctcgtacctgctggcaggcggctgtcagaagagatcattttctatcatcggggattttcaaaatggcaaacgcgtatccctgtccgtctatctgggtgaattcttcgatattcacctgtttgtgaacggcacagtaacccagggtgatcagagagtgagtatgccatacgcttcaaaggggctgtacctagaaaccgaagccggttattataagttgagtggggaagcctacggttttgtcgcccgcattgatggcagcggaaacttccaggtgctccttagcgaccggtacttcaataaaacgtgtggcctctgtggaaacttcaacatcttcgcagaagacgacttcatgactcaagaagggacactgacgtctgatccatatgattttgcaaatagctgggcattaagctccggggagcagtggtgtgaaagagcgagcccaccctccagttcctgcaatatctcttccggggaaatgcagaaaggactgtgggaacaatgccaattactaaagtccacttctgtatttgcacggtgccaccctctggttgatcctgaacctttcgtggccctatgcgagaagacgctgtgtgagtgtgctggcgggctggaatgtgcatgtccggctttactcgaatacgccaggacctgcgctcaagagggtatggtcctatacggatggaccgatcacagcgcttgcagcccggtgtgtcccgctgggatggagtaccgccagtgcgtctccccttgtgctcgaacgtgtcagagccttcatatcaatgagatgtgccaggaaaggtgcgtcgacggatgctcctgcccggaagggcagctgctcgacgagggcctctgcgtggaaagtacagagtgcccgtgtgttcactcgggcaaaagatacccccccgggacatcgctctctagggactgtaacacgtgtatttgccgcaactcacaatggatctgtagtaacgaggaatgcccaggagagtgtttggttacaggccagagccacttcaagagttttgacaaccggtattttactttttcaggaatctgccagtatttgctggcacgggactgccaagaccattccttctcgattgtcattgagaccgtgcagtgtgccgacgatcgggacgccgtctgtactcggagtgtgactgtgagactacccggtttgcacaacagcttggttaaactcaagcacggcgccggcgtcgcaatggatggacaggacgtgcagcttccattactaaagggggacctgcgcatacaacatacagtgaccgcaagtgtgcgccttagctatggcgaggacctgcagatggactgggacggcaggggcagactactggtgaagctgtctcctgtgtacgctggcaaaacttgcgggctgtgtggcaattacaatggaaaccagggcgatgacttcttgacaccaagtggtctagccgagcctcgcgtcgaggatttcgggaacgcctggaaactgcacggcgactgtcaggatcttcagaagcagcattccgacccatgcgcacttaacccacgaatgactcgcttttctgaggaagcctgcgcagttctgacttcccccacgttcgaagcctgtcacagggccgtgagccccttaccatacttgcggaattgtcgctacgacgtctgcagttgtagtgatggacgcgagtgcctgtgtggggccttagctagttacgccgccgcgtgcgccggccgcggagtccgcgttgcctggagagagccaggacggtgtgagctgaattgtccaaagggtcaggtgtacttgcaatgtggtactccgtgtaatctaacgtgtagatctctctcataccccgatgaagagtgtaacgaagcttgcctggaaggctgtttctgcccgcccgggttgtacatggacgaacggggcgattgtgtacccaaggcccaatgcccttgctactatgacggcgagatatttcaaccagaggacatcttttctgaccatcataccatgtgctattgcgaggacggattcatgcactgtacgatgagtggcgtacctggctctctgcttccagatgcagtgttaagcagccctctgtcacacagaagcaagaggtctctgtcctgccgacctcccatggtcaagctggtgtgccccgcagacaacttgagagctgaggggctcgagtgtactaaaacatgtcagaattacgaccttgaatgcatgtcaatgggatgcgtgtctggttgcctgtgtcctcccggcatggtgagacacgaaaatagatgtgtggcgctggagaggtgcccatgctttcaccagggaaaagagtatgcccctggcgaaacagtcaaaatcggctgcaacacatgtgtttgtcaggatcggaagtggaactgcactgaccacgtgtgcgatgcaacttgctccaccatagggatggcccattatctgacttttgatgggcttaagtatcttttcccgggggaatgtcaatatgtgctcgtccaggattactgtgggtccaatccaggcacattcaggatcttggtggggaacaaagggtgctcccacccatctgtcaagtgtaaaaagcgggtgacaattctagtagagggcggcgaaattgagttgttcgacggtgaggtgaatgttaaacgccctatgaaggacgaaacacactttgaggtggtagagagcgggaggtacataatcctcctgctgggaaaggcgttgtccgtggtttgggaccggcacctgagcatctctgtcgtattaaagcagacgtaccaggagaaagtatgtggtttgtgtggaaatttcgacgggatccagaataatgatttgacttcctctaacttacaggtagaggaagatcctgttgatttcggcaattcatggaaggtgagtagtcaatgcgcagacacacggaaggttcctctggattcaagccccgccacatgtcacaataatattatgaagcaaacaatggtagacagctcatgtcggatcttgacctcagatgtgtttcaggactgtaacaaattggtagatcctgagccgtacttggatgtgtgtatctatgacacctgctcctgcgaatccattggggattgtgcttgcttctgtgataccattgctgcgtatgcacatgtatgtgcgcagcacgggaaggtggtaacctggagaacggctacactgtgccctcagtcatgtgaggagagaaacctccgagaaaatggctatgaatgtgaatggcgttacaatagctgtgcacccgcctgccaggtcacctgtcagcaccccgaacccctggcttgcccagtgcagtgcgtcgaagggtgtcacgcccactgccctcccggtaaaattctggacgaacttcttcaaacctgcgtcgaccccgaggattgccctgtctgtgaagtagctgggagacggtttgcttccggcaagaaggttacattgaacccctctgatccagagcactgtcagatttgtcactgtgatgtggtgaacttgacctgcgaagcttgtcaggaaccgggggggctggtagtgcctccgaccgatgccccagtgtccccaactaccttatatgtggaggatatctccgagccacctttacacgacttttactgttcacggctgctggaccttgtgtttctcctggatggctcctcacgtctctctgaggcagagtttgaggtcctaaaagcttttgtcgttgatatgatggagcgcctgagaatcagccaaaaatgggtgcgtgtggctgtcgttgagtaccatgacggctcgcatgcatacattggactgaaggacagaaagcggcctagcgagttgcgaagaattgcaagccaggtgaagtatgcaggctcacaagtggcgagcaccagcgaagttcttaaatataccctctttcaaatcttttctaagattgatcgtcctgaggctagccgaattaccctcttgttgatggcatcccaggagccgcagagaatgagtcgcaattttgtgcggtatgtgcagggattgaaaaagaagaaggtgattgtaatccctgtggggattggcccccacgcaaacctgaagcaaattcgtctcattgagaagcaggcccctgaaaataaggccttcgtgctgagtagcgtagacgagctggaacagcagcgagatgaaatcgttagctacctgtgtgacttagcacccgaggccccgccgccgaccctgccccctgacatggcacaggtgacagtggggcctgggcttttgggcgtcagtacgctggggcctaagcgcaacagtatggtactcgatgtggcgtttgtcttggagggctcggacaagattggagaggctgacttcaatcgcagcaaagagtttatggaagaagtcatccagaggatggatgtgggacaggacagcatccacgttacggtgctccagtatagctacatggtgacagtcgagtaccccttctctgaagcccagagcaaaggcgacatattgcaacgcgttcgggaaattcggtaccaaggtggaaatcgtactaacacaggacttgctttaagatacctctccgaccattcttttctagtatctcagggagatcgtgaacaggctccaaatctcgtctacatggtgaccggaaatcccgcatctgacgagatcaaacgtctccccggtgatatccaggtagttcccataggcgtggggcccaatgctaacgttcaggagttggagagaataggttggcccaatgcccccattctgattcaagacttcgagacattgcctagggaggctcccgacctggtactgcagagatgttgttcaggcgaagggctccagattccaaccctttctccggctccagattgctctcagcctctagatgtgattttacttttggacggttcatcttcgttccctgcctcctactttgatgaaatgaaatcctttgcaaaagccttcatctctaaggccaacattggtccccgcctcacccaggtgagcgtcctgcagtacggatctattaccactatcgacgttccatggaatgtggtgcctgaaaaggcacacctgctatctctcgttgatgtgatgcagagagaagggggtccctctcagattggcgatgcgctgggcttcgccgtccggtatctaacttcagagatgcacggagctcgccctggagcatcaaaggctgtggtgatactcgtgaccgacgtatccgtggatagtgtagatgccgccgccgacgctgctcggagtaaccgagtgaccgttttccctattgggatcggggatcggtacgacgccgctcagcttcgtatcctggctgggccagcaggggactccaacgttgtgaagctgcagcgcatcgaagaccttcctaccatggtgacactgggaaactcatttctacataagctatgtagcggatttgttagaatatgtatggacgaagatggaaatgagaaaaggccaggcgatgtgtggactttgccggaccagtgccataccgtgacttgtcagcctgatggccagaccctcctcaaatcccatagagtcaactgcgatcggggattgcggcctagctgccctaattcccagagtcccgttaaggtggaagagacctgtggctgccgctggacctgcccgtgcgtgtgcaccggctcttcaacgcgccatattgtgacattcgacggccagaattttaaactgaccggcagctgcagttacgtgctgttccaaaacaaggaacaggatctggaggtgatcctccacaatggcgcatgcagtccaggtgcacggcaagggtgcatgaaatccattgaggttaaacactcagcgctctcggttgaactgcactcagatatggaggtgacagtgaacgggcgcctggtgtcagtgccctatgtgggaggcaacatggaggtcaacgtgtatggtgcaataatgcatgaggttcggttcaatcacctaggacacatcttcaccttcacaccccagaacaacgagtttcaactacagttaagtcccaagacgtttgcctcaaaaacatacggattatgcggaatttgcgacgagaacggagccaacgattttatgctgagagatggcactgtgaccaccgactggaaaactctggtgcaagaatggactgtgcagcggccaggtcagacttgtcagccgattctggaagagcagtgtctcgtgcccgacagcagtcactgccaggtcctcctccttcccttattcgctgaatgccataaagtgctggctcccgctacattttacgccatctgccagcaggactcctgccaccaggagcaggtctgtgaggttattgcctcttacgcacacctgtgtcgcactaacggggtgtgcgtggattggcggacccctgacttttgtgctatgagttgtcccccttccctggtgtataatcactgtgagcatgggtgtccgcgccattgtgatggtaatgtgtcttcctgcggtgaccacccaagtgaagggtgcttttgcccccctgacaaagtgatgttggaggggagttgcgtgcccgaagaagcgtgcacccagtgtataggcgaggatggagtacagcaccagttcctggaagcctgggttcccgatcatcagccgtgtcagatttgcacgtgtttaagcggccgcaaagtgaattgcaccacccagccttgtccaacagcaaaggctcccacttgtggcctttgtgaagtggctcggttgaggcaaaatgccgatcagtgctgccctgaatatgagtgtgtttgcgatcccgtttcttgtgatctcccacccgttccgcattgtgagcgcggattgcagcctacgcttaccaatccaggtgagtgtcgccccaacttcacttgcgcttgtagaaaagaggagtgtaagcgcgtgtctccgcccagctgtccaccccaccgactccccactctcaggaagacccagtgctgtgacgagtatgagtgtgcatgcaactgtgtgaacagcaccgttagttgccctctgggctacctggcaagcacagctacgaatgactgcggctgtacgactaccacctgcttacctgataaagtgtgtgtacaccgtagtacaatatatcccgttggccaattctgggaggagggatgcgatgtgtgcacctgtacagacatggaggatgccgtaatggggcttagagtcgctcaatgttcacagaagccgtgcgaagactcctgcaggtctggcttcacatatgtcctccacgagggcgagtgctgcggacggtgcctgccatcagcatgtgaggtagtcaccgggtctcctaggggggattcccagagcagttggaagtctgtgggtagccaatgggcgagccccgagaatccgtgtctcatcaacgaatgcgtgcgtgtcaaggaggaagtgtttattcagcagcgaaatgtgtcatgcccccagctcgaagtccctgtttgccctagcggttttcagctctcatgtaagactagcgcttgctgcccatcatgccggtgtgagaggatggaagcatgcatgctgaatggcacggtcatcggacccgggaagaccgttatgattgacgtgtgcacaacttgtcggtgcatggtccaagtcggcgtaatcagtggcttcaaactcgagtgccgaaaaacgacatgcaacccttgccccctgggttacaaggaagaaaacaatacaggcgaatgctgtggccgctgtctacccactgcctgcactattcagctccgagggggtcaaatcatgacgctgaaaagagacgaaaccttgcaggacggctgcgatacacatttttgcaaggtgaatgagaggggcgaatacttctgggagaaacgcgttacgggatgcccaccttttgacgagcataaatgcttagcagagggcgggaagattatgaagatacccggcacctgttgcgatacctgtgaggaaccagaatgcaatgacattaccgcacgtctccaatacgtaaaggtgggctcctgtaaaagtgaagtagaagtagacatccactattgtcaaggcaagtgtgctagcaaagccatgtatagtatcgacatcaacgatgtacaggaccagtgcagttgttgttcccctacacgaaccgagcctatgcaagtggcactacactgcacaaatggatccgtggtgtatcatgaggtattgaacgcaatggagtgcaaatgtagccccagaaagtgttcaaaa

SEQ ID NO: 21298 - DNA, 8439 bp, Artificial Sequence
  Description of Artificial Sequence: Synthetic coding sequence
atgatcccggcgcggttcgcgggagtgctgcttgctctcgccctcatcctgcccggaactctttgcgccgaaggtactcggggccgctcttcgactgcccggtgtagcctgtttggatcggattttgtgaatactttcgatggcagcatgtactcgttcgcgggctactgctcctacctgctggccggaggctgtcagaagaggtcgttcagcatcatcggtgacttccagaacggaaagcgcgtctcattgtccgtctacctgggcgaattctttgatatccacctcttcgtgaacggtaccgtgacccaaggagatcaacgcgtctccatgccttacgctagcaaagggctgtacctggagactgaggccggatactacaaacttagcggagaagcctatgggttcgtggctcgcatcgatggttctggtaacttccaagtgctcctgtccgaccgttatttcaacaagacgtgcggactctgcggcaactttaacatattcgccgaggatgatttcatgacccaagagggaaccctgacttcggatccttatgactttgccaactcgtgggcgctgtcgtcgggggagcaatggtgtgagcgcgcctcgcccccgtcgagctcctgcaacatcagctcaggagaaatgcagaagggcctctgggagcagtgccagctgttgaaatccacttccgtattcgcccgatgccacccgctggttgacccggagcctttcgtggccctctgcgagaaaaccttgtgcgagtgcgcgggcggacttgagtgcgcgtgcccagcgctgctggaatacgccaggacttgcgcgcaggaaggtatggtgctgtacggatggaccgaccacagcgcgtgctctccagtctgcccggcgggaatggaataccggcagtgcgttagcccttgcgcgcgtacgtgccagtcgctgcacatcaacgagatgtgtcaggaacggtgtgtggatggctgcagctgcccggagggacaactgctggacgagggactgtgcgtggaaagcactgagtgcccttgcgtccactcaggcaagagatacccgcccggaacctccctgtccagagactgcaatacttgcatctgtcggaattcgcagtggatctgcagcaacgaggaatgccccggagagtgcctcgtgactggacaatcccactttaagtcctttgacaatagatatttcactttttccggaatctgtcagtacctgctcgcacgcgactgtcaagaccattcattctcaatcgtgattgagacggtgcaatgcgcggacgatagggatgcggtgtgcacccgcagcgtgaccgtccggctgccgggacttcataacagccttgtgaagctcaagcatggggctggagtggcaatggacggtcaggatgttcagctgccgctgctcaagggagatctgaggattcagcataccgtgacggcgtcggtccggctgtcatacggagaggacctgcaaatggactgggatggtcggggtagactgctggtgaaactgtcccccgtctacgccggaaaaacctgcgggttgtgcgggaactacaatggtaaccaaggtgacgactttctgaccccttccggactggcggagcccagagtcgaagatttcggcaacgcatggaaactccacggagattgccaggatttgcagaagcaacacagcgatccttgcgcactcaacccacgcatgaccagattctcagaagaagcatgtgccgtgctgaccagccccacctttgaggcctgccaccgggccgtgagcccgctgccgtacttgcgcaactgccgctacgacgtttgctcatgctcagacggacgggaatgcctctgcggtgcgcttgcctcatacgccgccgcttgtgctggccggggagtgcgagtggcgtggcgggaaccaggtcgctgcgagctcaactgccctaagggacaagtgtacctgcagtgcggaaccccgtgtaacctcacttgcagatccctgtcgtatccggacgaagaatgcaatgaggcctgcctcgaaggatgcttctgcccaccagggctgtacatggatgaaaggggagattgcgtgccgaaagcgcagtgtccgtgctactacgacggagaaatcttccagcccgaggacatcttctcagatcaccataccatgtgttactgtgaagatggtttcatgcactgtaccatgagcggcgtccccggatcgctgctgccggacgcggtgctctcctcgcctctgtcgcatcgcagcaagcggtcgctttcgtgccgcccgcccatggtgaagctggtctgtcctgcagataacctgcgtgccgaggggctcgagtgtaccaaaacctgccagaactatgacctggagtgtatgtctatggggtgcgtctcaggctgcctgtgcccgccggggatggtcaggcacgagaacaggtgcgtcgcccttgaacgctgcccctgcttccatcagggcaaagagtacgcgccgggcgagactgtcaagattggatgcaatacgtgcgtgtgccaggataggaagtggaactgtacggatcacgtctgcgatgccacctgctcaactatcggaatggctcactacctcaccttcgacggactcaagtacctgttcccgggtgaatgccaatacgtgctcgtgcaggattactgcggatctaatccaggaacgttccgcatcctggtgggaaacaagggctgttcccacccgagcgtcaagtgcaagaagagagtgactatccttgtggaaggcggagagatcgagttgttcgacggtgaagttaacgtgaagcggccaatgaaagatgaaacccatttcgaggtcgtggagagcggacgctacatcattttgctcctcggcaaggcactgtccgtggtgtgggaccggcacctgagcatctccgtagtcctcaagcagacctaccaagaaaaagtctgtggactgtgcggaaacttcgacggaatccagaataacgaccttaccagctcgaaccttcaagtcgaagaggatcctgtggacttcggcaactcatggaaagtcagttcacagtgcgcagatactcggaaggtgcccctcgattccagccctgctacctgccacaacaacatcatgaaacaaactatggtggactcatcctgccgcattctgacttctgacgttttccaggactgcaacaagctggtggaccccgaaccgtacctggacgtgtgcatctacgacacctgcagctgcgaatccatcggagattgcgcgtgcttctgcgataccatcgctgcatacgcgcacgtgtgtgcgcaacacggcaaagtggtgacctggagaactgcgactctttgcccgcagtcatgcgaagaacggaacctgcgcgagaacggatacgaatgcgaatggcggtacaattcctgcgccccagcttgccaagtgacctgccagcacccggaacctctggcctgcccagtccaatgtgtcgaagggtgccatgcgcactgtccacctggaaagatcctggacgagctgctgcagacgtgcgtcgaccctgaagattgtccggtctgcgaagtcgctggccgcaggtttgcgtcgggcaagaaagttactttgaatcctagcgacccggaacactgtcagatctgtcactgcgacgtggtgaatctcacctgcgaagcctgccaagagcccggtggactcgtcgtccctccgactgacgcgccggtcagcccgactaccttgtacgtcgaggacatctcggaacctccactgcacgacttctactgctcgagactcctggatttggtctttctgctggatggctcctcccgcctgtccgaagcggaattcgaagtgttgaaggccttcgtcgtggacatgatggagcggctgagaatcagccaaaagtgggtgcgcgtggcagtcgtggagtaccacgatggatcacatgcgtacatcggactgaaagaccggaaacggccgtcagaactgcgcagaattgcttcccaggtgaagtacgccggatcgcaagtggcttccacctcggaggtgctcaagtacactctctttcaaatcttctccaagatcgatcggccggaagcctcccggatcaccctcctgctgatggcgtcacaggaaccccaacggatgtcgcggaacttcgtgcggtatgtccagggactcaaaaagaagaaggtgattgtgatccctgtgggcatcggcccgcacgccaacttgaagcagatcagactgatcgaaaaacaggcaccggaaaacaaagcatttgtgctgtcatcagttgacgaattggaacaacaacgggatgaaatcgtgagctacttgtgcgacttggctcctgaggctcctccaccaaccctcccaccagacatggcacaggtgactgtgggccccggcttgctcggggtgagcaccctgggacccaaaagaaactcgatggtgctggatgtggcattcgtcctggaaggaagcgacaaaatcggagaagcggacttcaatcggtcaaaagaattcatggaagaagtgatccagaggatggatgttggacaggattcgatccacgtgactgttctccagtactcctacatggtgaccgtcgaataccctttctcggaagcgcagtcaaagggagatatcctccagcgcgtgcgtgagatccggtaccaaggaggaaaccggaccaataccggcctcgccttgcgatacctgtctgaccactcctttctggtatcgcagggagacagggaacaagccccgaatcttgtgtacatggtgactggcaaccctgcatcggacgagatcaagcgccttccgggggatattcaggtcgtgccgattggagtgggcccaaacgccaatgtgcaggagctggaacggattggttggcccaacgcaccgattctgattcaagactttgagactctgccgcgcgaagcaccggatctggtcctgcagcgctgctgttcgggtgagggactgcagatccccacgctgtcgccggcaccggactgctcccagcctttggatgtgatcctcctgcttgatggatcgtcgagcttccctgcgtcgtactttgacgaaatgaagtcattcgccaaggctttcatatcgaaggcgaatatcggcccccgcctgacccaagtgtctgtgctccagtatgggtcgatcaccactatcgacgtgccgtggaatgtggtcccggaaaaggcccacttgctgagcttggtcgatgtcatgcaaagggaaggcggcccatcccagatcggagacgccctgggctttgctgtgcgctacctgacttcagaaatgcatggagctcgcccgggagcctccaaggcggtcgtgatcctggtcaccgatgtgagcgtggactcggtggatgccgccgcggacgccgcccgctccaaccgcgtcaccgtgttccccatcggcatcggcgaccgctacgacgctgcgcaactcagaatcctggcgggaccggctggagacagcaacgtcgtgaagctgcagcggattgaggacctccctactatggtgacgctgggaaacagcttcctccataagttgtgttccggcttcgttcggatctgcatggatgaggatggcaacgagaagcgcccgggcgacgtctggacgctgcccgaccagtgccatacggtcacctgccaaccggacgggcagacccttctgaaatcacatcgcgtcaattgtgaccggggactgcggccgagctgccctaactcccaatcacccgtgaaggtggaagaaacttgtggctgcaggtggacttgcccgtgcgtctgcactggctcaagcacgcggcacatcgtgaccttcgacggccaaaacttcaaattgaccggctcgtgcagctacgtgctgtttcagaataaggaacaggacctcgaggtgatcttgcataacggggcgtgttcacctggagctcggcaggggtgcatgaagtcaattgaagtgaagcatagcgcactgtcagtggaactgcattccgatatggaagtgactgtgaacggtagactcgtgtcggtgccgtacgtgggaggcaacatggaagtcaacgtgtacggcgccatcatgcatgaagtgagattcaaccacctcggccatatcttcacgtttacgccgcagaataacgaattccagctgcagctttcccctaagactttcgcaagcaagacctacggactctgtggaatttgcgacgaaaatggtgcgaacgactttatgctccgcgatggaactgtaaccaccgactggaaaactctggtgcaggaatggactgtgcagcggccaggacagacttgccagccaatactcgaagaacagtgcctggtaccggacagctcccattgccaggtgctgctccttccgctgttcgccgagtgccacaaagtcctcgcaccggccactttctacgccatctgccaacaagattcctgtcaccaggagcaggtgtgcgaagtcatcgcatcatacgcgcatctgtgccgcactaacggggtgtgcgtggattggcggactccagacttctgcgctatgtcgtgcccgccgtcactggtgtacaaccactgcgagcatggctgcccgaggcactgcgatggaaacgtcagctcgtgcggggaccacccgtccgagggttgcttttgccctccggataaagtgatgcttgaggggtcctgtgtgccagaagaagcgtgcacccagtgtatcggcgaagatggagtccagcaccagttccttgaagcctgggtcccggaccatcaaccgtgccagatttgcacctgcctctccggtcgcaaggtcaattgcaccactcaaccatgtccaaccgcgaaagcccctacctgtggactctgtgaggtggcacgcctccgacaaaacgccgatcaatgctgccctgaatacgagtgcgtctgcgatcctgtctcctgtgatttgcctccggtgccacactgcgagcgcggactgcagccgactctgaccaatccgggggagtgcagaccgaactttacttgcgcttgccgcaaggaagaatgtaagcgggtgtcgcccccatcctgcccgccacacagactgccgactctgcgaaagactcaatgctgcgacgaatacgagtgtgcgtgtaactgcgtgaactctaccgtgtcatgccccctcggatatctggcctccaccgccaccaatgactgcggatgcaccaccacgacgtgcctcccggacaaagtgtgtgtccaccggtccaccatctatccggttgggcaattctgggaggagggttgcgacgtgtgcacttgcaccgacatggaggacgctgtgatggggctgagggtggcgcaatgttcgcaaaaaccgtgcgaagattcctgccgctccggcttcacctacgtcctgcacgaaggcgaatgctgtgggcgctgcctgccatcggcctgcgaggtggtgactggttcgccaagaggcgactcccagtcgtcctggaaatcagtgggaagccagtgggcgtcgcccgaaaacccgtgcctgatcaacgagtgcgtgcgggtgaaggaagaagtgttcatccaacagaggaatgtctcgtgcccgcagcttgaagtgcctgtgtgcccgtcgggattccaactctcatgcaagacttccgcttgctgcccgtcctgtagatgcgagagaatggaagcctgcatgctgaacggaactgtcatcggtccgggtaagactgtgatgatcgacgtgtgtaccacgtgtcgctgcatggtgcaggtgggagtgatctccggcttcaaacttgaatgccggaaaactacgtgtaacccttgccctctcggctacaaggaggagaataacactggagagtgctgcggtcggtgcctgccaaccgcctgcactatccagctgcgcggtggacaaatcatgacccttaagcgggatgaaactctgcaggacgggtgcgacactcacttctgcaaggtgaacgagcggggggagtatttctgggaaaaacgggtgactgggtgcccgccttttgacgaacacaagtgcctggccgagggcggcaagatcatgaagatcccagggacttgctgcgacacttgcgaggaaccggagtgtaacgatatcaccgcacggctgcaatacgtgaaggtgggctcgtgcaagtcagaagtggaggtggacatccactactgtcaaggaaaatgtgctagtaaggcgatgtactcaatcgacatcaacgatgttcaagatcaatgttcgtgctgctccccaacccgcaccgagccaatgcaggtggctctccattgcactaatgggtctgtcgtctaccacgaggtgctgaatgctatggaatgtaaatgtagcccaagaaaatgctccaag

SEQ ID NO: 21299 - DNA, 8439 bp, Artificial Sequence
  Description of Artificial Sequence: Synthetic coding sequence
atgatcccagctcggttcgcaggtgtactgctggctctggccctgatcctgccaggtaccctttgcgccgaaggaacccggggaagaagctccaccgcacgatgttctctctttggaagcgacttcgtgaacaccttcgatgggtccatgtactcatttgcaggctattgcagctaccttttggccggaggatgccaaaagcgctcgttctcaatcatcggagacttccagaatgggaaacgcgtgagtctgtcggtttaccttggggagtttttcgacattcacttgttcgtgaatggaactgtgactcagggtgaccaacgggtgtctatgccttacgccagtaaagggctttacctcgaaactgaggccggatactacaagctctcgggtgaagcctacggtttcgtagctaggattgacggatcgggcaactttcaagtgttgctttccgatcgctatttcaacaagacctgcggattgtgtggaaacttcaacatattcgcagaagatgacttcatgactcaagaaggaactcttacctcggacccgtacgacttcgcgaattcatgggccctgtcgtccggagaacaatggtgcgagagagcgtccccaccgagctccagctgcaacatctcctcgggggagatgcagaagggactgtgggaacaatgccagctgctgaagtccacctccgtgttcgcacgatgccacccgctggtggaccctgaaccgtttgtcgcactttgtgaaaagacgctctgcgagtgcgccggaggcctggaatgtgcgtgccccgccctgctcgaatacgcgcggacctgcgcccaggagggtatggtcctctatggctggactgaccattcggcctgttccccagtttgcccggcagggatggagtacagacaatgtgtgtccccgtgcgcccggacgtgccagtcactgcatatcaatgagatgtgccaggaacgctgcgtcgatggctgctcgtgccctgaaggacagctgctggatgagggactttgcgtggaatccaccgagtgtccatgcgtgcactcaggaaagcggtacccgcccggaacctcgctctccagagactgtaacacctgcatctgcagaaactctcagtggatctgcagcaacgaagagtgccctggcgagtgtctggtgaccggacaatcccacttcaaatcctttgacaatagatactttaccttctcgggcatttgtcagtacctgctggctcgggactgtcaggaccactcattcagcatcgtgatcgaaaccgtccagtgcgcggacgatagagatgccgtctgcaccagatcggtgacggtgcgcctcccaggcctccataatagcctggtcaagctgaaacatggcgcgggagtggcaatggacggtcaggacgtgcaactgccgctcctgaaaggagatctgaggatccagcataccgtcaccgcctcagtgcgactgtcatacggagaggacctccagatggattgggacggccgcgggcgcctgctcgtcaaactctcccccgtttacgcgggaaagacttgtggtctgtgtggtaactacaatggcaaccagggagatgattttctgaccccgtcgggcctggccgagccgcgggtggaagatttcggaaacgcgtggaagctccacggtgactgccaagacctgcaaaagcagcactccgacccgtgcgccctcaacccgcgcatgactagattctcagaagaagcgtgcgcggtgcttacttcgccgaccttcgaagcctgtcatcgcgcggtttcgccactgccgtacctgcgaaattgccgctatgacgtttgcagttgctcggacgggcgcgagtgcctgtgcggagccctcgcttcctacgccgcagcatgcgccggaagaggagtcagagtggcttggagagagccgggccggtgcgagttgaactgccctaaaggccaggtgtacctgcagtgtggaacgccgtgcaacttgacgtgcaggtccctgtcgtacccggacgaagaatgcaatgaggcatgtctggaaggatgcttctgcccccctggactctacatggatgaacggggcgactgcgtgcccaaagcccaatgtccgtgctattacgatggagagatcttccaaccagaggatatcttcagtgatcaccataccatgtgctactgcgaggacggattcatgcactgtaccatgtcgggagtgcccggctcactcctgccggatgcggtgctgagctcaccgcttagccatcggtcaaaaaggtcgttgtcgtgccggcctcctatggtgaaactcgtctgcccggctgacaacctcagagcggaagggctggaatgcacgaaaacttgccaaaactacgacctcgagtgcatgagcatgggatgcgttagcggatgtctgtgtccgccaggaatggtgcgccacgaaaaccggtgtgtggcccttgaaaggtgcccatgcttccaccagggaaaggagtacgcgccgggagaaactgtcaagatcgggtgcaatacttgcgtctgccaggaccggaagtggaattgtactgatcacgtctgcgacgcaacttgctcaaccatcggaatggcgcactacttgaccttcgacggattgaaatacctgtttccgggcgagtgtcaatacgtgctggtgcaagactactgcggatccaacccgggaaccttccgaattctggtgggaaacaaaggatgctcacacccaagcgtgaagtgcaagaagagagtgaccatcttggtggagggcggagagatagaactgtttgacggggaagtgaatgtgaagcgcccaatgaaggacgaaactcattttgaagtcgtcgagagcggacgctacatcatcctgctcctggggaaggccctgtcggtggtttgggacagacacctgtcaatctcggtggtcctcaagcaaacctaccaggaaaaggtgtgcggcctttgcggaaactttgatggaatccaaaacaacgacctgacttcttcgaacctgcaggtggaggaggacccagtcgacttcggcaacagttggaaggtgagcagccaatgtgccgacacccgcaaagtgccgctggatagctccccggcaacctgccacaacaatatcatgaagcagactatggtagactcgtcctgccgtatccttacttcggatgtgttccaggactgcaacaaacttgttgaccctgaaccttacctggatgtgtgcatctacgacacctgttcatgcgagtcaatcggagattgcgcctgcttttgcgacaccatcgcggcttacgcccacgtatgcgcgcagcacgggaaggtggtcacttggcggaccgccacgctgtgcccccagtcctgcgaggagcgcaacctccgagaaaacggctacgaatgcgagtggcggtacaattcctgcgcaccggcttgccaggtcacctgccagcacccggagccgctggcctgtccggtgcagtgtgtcgaagggtgtcatgcgcactgcccgccaggaaaaatccttgacgaattgctgcaaacttgcgtcgaccctgaggactgtccggtgtgcgaagttgcggggcgccgctttgcgtcgggcaagaaggtcactctcaacccgtcggacccagagcattgtcaaatctgccactgcgatgtggtcaacctgacttgcgaagcctgccaagaacctgggggactggtggtgccaccgacggatgctcccgtgtcaccgacgactctctacgttgaggatatcagcgaacctccactgcatgatttctactgttcccggctcctcgatcttgtgtttctgctggacggaagctccaggctctccgaggccgagtttgaagtgctgaaagcattcgtggtggacatgatggagagactgcgcatcagccagaagtgggtccgcgtggcggtggtcgagtatcacgatggatcacacgcttacattggcctgaaggaccggaagcggccgtcagagttgcgccggattgcatcgcaggttaagtacgctggctcccaagtggcatcgactagcgaagtgctcaaatacactctgttccagatattctccaagatcgacagaccagaggcgagcagaatcaccctgctcctcatggcatcgcaagagccgcagaggatgtcccgcaactttgtccggtacgtgcaggggcttaagaagaagaaggtgattgtgatcccggttggtatcggcccccatgccaatctgaagcagattaggttgatcgagaagcaggcgccagaaaacaaagcgttcgtgctctcgtcggtggatgaacttgaacagcagcgcgacgagattgtctcgtacctgtgcgatctggcacctgaggctccaccgcctaccctgcctccggacatggcacaggtgacggtcggccctgggctgcttggtgtgtcgactctgggaccaaagagaaattccatggtccttgatgtcgcgttcgtactggaggggagcgacaagatcggagaagccgatttcaaccgaagcaaggaattcatggaggaagtgatccagcgcatggacgtcggccaggactccatccacgtgactgtcctccagtacagctacatggtgacggtggagtacccgttctctgaagcgcagtcgaagggtgatatcctccaaagagtccgggaaattcggtaccaaggaggaaaccggactaacaccgggctggccctgagatacctgtcagaccactcctttttggtttcccagggtgaccgcgaacaggcccccaatctggtgtacatggtgactggaaatccagcttcagatgaaatcaagcgactgcccggcgacatacaggtggtgcctatcggagtgggaccgaacgcgaacgtccaagaactggaaaggatcggttggccgaacgctccaatccttatccaggacttcgagactctgccgcgcgaagcaccagatcttgtcctgcagcgctgttgtagcggcgagggcctccaaattccgaccctgtcgccggcgcccgactgtagtcaaccactcgatgtgatcctcctgttggatggctcatcatccttcccggcctcctacttcgatgagatgaaatcgtttgccaaggccttcatctccaaggccaacatcggaccaaggctgacccaggtgtcggtcttgcaatacggttccatcactacgatagatgtcccctggaacgtggtgccagagaaggcccacctcctgtcgctcgtcgacgtgatgcaacgcgagggaggcccgtcgcaaatcggggacgccttgggattcgcagtgcgctatctgacttcggaaatgcacggagctaggccgggcgcctcaaaggctgtggtcatcctcgtgactgatgtctcggtggacagtgtggatgctgctgcggatgctgcgcggagtaatcgcgtgactgtgttcccaatcggaatcggtgaccgctacgatgcagcccaactcaggatcttggccggaccagccggagattcgaacgtcgtgaagctgcagaggatcgaagatctcccgactatggtgaccttgggtaacagcttcctgcacaaactgtgctcggggttcgtgcgcatctgcatggacgaagatgggaatgagaaaagaccgggagatgtctggaccctgcccgaccagtgtcatactgtgacttgtcaaccggacggccagactctgctgaaatctcatcgggtcaattgcgaccgcggactgcggccctcgtgtccaaactcccaatcgccggttaaggtggaggagacgtgcggatgccggtggacttgcccatgcgtgtgcaccggaagctccaccaggcatatcgtgactttcgacggacagaatttcaaactcaccggatcctgcagctacgtgctgttccagaataaagaacaggacctggaagtcattctgcacaatggagcgtgtagcccgggcgcgcgccaaggctgtatgaagtccatcgaggtgaagcactcagcactctcggtggaactgcatagcgatatggaggtgactgtgaatggtagactggtcagcgtgccctatgtaggaggtaatatggaagtgaacgtgtacggcgctatcatgcacgaagtccgctttaatcatctcggacacatcttcacttttacgcctcagaacaatgagttccaattgcagctgtcccctaagacgtttgcttcaaagacctatggcctctgcggaatctgcgacgagaatggagccaacgatttcatgctgcgtgacggcactgtcacgaccgactggaaaactctggtgcaggagtggaccgtgcagcggccgggacagacgtgtcaaccgatcctcgaagagcagtgtctggtgcctgactcaagccactgtcaggtgttgcttcttcctctcttcgcagaatgccacaaagtcctggccccggcgaccttctacgcaatctgccaacaagattcgtgtcatcaggaacaggtatgcgaggtcatcgcctcatacgcccatctgtgtagaaccaacggggtctgcgttgactggcgcacccctgacttttgcgcaatgtcatgtccaccctcgctggtgtacaaccactgcgaacatggatgcccgcgccattgcgacggaaacgtgtctagctgcggcgatcacccgtccgaaggttgcttctgcccgcccgacaaagttatgttggaaggaagctgcgtgccggaggaggcttgcacccagtgcattggcgaggacggagtgcaacatcaattcctcgaagcctgggtgcctgatcaccagccatgccaaatttgcacttgcttgtcgggacgcaaggtcaactgcactactcaaccttgccccaccgcaaaggcgcccacttgcggactctgcgaagtggccaggctgcggcagaacgcagaccaatgctgcccggaatacgaatgcgtctgtgacccagtctcgtgtgacctcccaccggtcccgcactgcgaacggggactgcagccgaccctgaccaatccaggggaatgccgcccgaacttcacttgcgcctgcagaaaggaggagtgcaaaagagtgtccccaccgtcctgcccgcctcaccggctgccgacgctccggaaaactcagtgttgcgacgaatacgaatgtgcctgtaattgcgtgaactcgactgtgtcttgtcctctgggatacctcgcctctactgctaccaatgattgtggatgcaccaccaccacttgcctcccagataaagtctgcgtgcaccggtcaaccatctacccagtgggccaattctgggaagaagggtgtgacgtctgcacgtgcaccgacatggaggacgccgtgatgggactcagggtcgctcagtgttcacagaagccatgcgaagattcctgcaggtcaggttttacgtacgtgctccatgaaggggagtgctgcggccgctgtttgccgagcgcctgcgaagtcgtgactggatcaccgagaggtgattcgcagagctcctggaagagtgtgggctcccaatgggcctcccctgaaaacccatgtctgatcaacgaatgtgtgcgcgtgaaggaggaggtgttcattcagcagcgcaacgtgagctgccctcagctcgaggtgcctgtctgtcctagcggattccagctgtcgtgcaagacctccgcttgctgtccctcatgtcggtgcgaacgcatggaagcgtgtatgctgaatgggaccgtcatcgggccaggcaagaccgtgatgatcgacgtctgcaccacctgccgctgcatggtgcaagtgggcgtgatctcgggattcaagctcgaatgcagaaagactacctgcaatccgtgccctttgggttataaggaagagaacaacactggcgaatgctgcggtcggtgtctgcctactgcttgcaccatccagctgcggggaggccagattatgactctcaagcgggatgaaaccctgcaggacggctgcgatacccacttctgcaaggtcaacgagcgcggggagtacttctgggagaagcgggtgaccggatgtccaccgtttgacgaacacaagtgcctcgccgaggggggaaagatcatgaagattcctgggacctgctgcgatacttgcgaagaacctgaatgtaacgatatcactgcccggctccagtacgtgaaagtggggtcctgcaagagtgaagtagaggttgacatccattactgccaggggaagtgcgcgagcaaagcaatgtacagcatcgacatcaatgatgtccaagatcagtgcagctgctgcagccccactaggaccgagccgatgcaggttgccctgcattgtaccaacggatccgtggtgtaccatgaagtccttaatgctatggagtgcaagtgttctccacgaaagtgctcaaag

SEQ ID NO: 21300 - DNA, 8439 bp, Artificial Sequence
  Description of Artificial Sequence: Synthetic coding sequence
atgatacctgcaagattcgcaggcgtgctgctggctctggccctgatcttgccgggaacactatgtgcggaaggtaccaggggccgttcctccaccgcacgttgctccctgttcggatctgactttgtaaatactttcgacggatctatgtattccttcgccggttactgttcttacctgcttgcaggagggtgccagaagcgtagcttctcgattattggagatttccagaacggtaagagggtaagcctctccgtttatctgggggagttcttcgatatccacctgtttgtcaacggtacagtaacacagggggatcagcgagtgtccatgccgtacgcaagcaagggactgtacttggagactgaggctggctattacaagttgagtggggaagcatacggatttgtggcccgaattgacggcagcggcaattttcaggtgttgctctctgatcggtacttcaacaaaacctgtggattgtgtgggaactttaacatcttcgccgaggacgatttcatgacccaagaaggcacactgacttcagacccttacgacttcgcaaactcctgggccctctcatcgggagaacagtggtgtgaacgggcctcacctcccagttcatcctgcaatatctcctctggggaaatgcagaaaggactctgggaacagtgtcagctgctgaaaagcacaagcgtcttcgccagatgccaccctctggtcgatccagaacctttcgtggccctgtgcgagaaaacactttgcgagtgcgcggggggcctggagtgtgcctgccctgctcttcttgaatacgcacgcacatgtgctcaggagggaatggttctgtatggctggacagaccattccgcctgctctccggtctgtcccgccgggatggagtatcgccagtgcgtgagcccgtgtgcacgcacttgccaatctctacacatcaatgagatgtgccaggagagatgcgttgatggttgcagctgccctgaggggcaacttttagatgaagggctgtgcgtggaatcgacggagtgcccctgcgttcatagcgggaaacgctatccccctggtaccagcttgagccgcgactgcaacacatgtatttgccggaattcacaatggatctgcagcaatgaggagtgcccaggcgagtgcctggtgacagggcagagtcacttcaagagcttcgataatcgatactttacatttagtggcatctgtcagtacttgctcgctcgagattgccaggatcactcattcagcatagtcatcgagaccgttcagtgtgcagatgatcgggacgctgtttgcacacggtctgttacggttcgactgcccggtttgcataacagccttgtgaaactgaagcacggagcaggcgtcgccatggacggccaagatgtgcagttgcctctgcttaagggagacttacggatccaacacactgtcacagccagcgtccggctaagttacggcgaggatttacaaatggactgggatgggcgcggtcggctactagtgaagcttagccccgtgtatgctggtaaaacatgcggtttatgtggtaattacaatggcaaccagggtgatgattttctcacgccatcagggctcgcggagccaagggtggaggactttgggaacgcatggaaacttcatggggattgtcaggatttacagaagcagcattccgacccgtgtgcattgaatccgcgcatgacccgcttctcagaggaggcctgtgctgtgctaaccagtcctacctttgaggcatgccacagggcggtctcaccgctgccttacctgcggaactgtagatacgatgtgtgtagttgttcagacggccgggaatgcctatgcggagcgctagcatcgtacgccgcggcttgcgctggacggggggtgagggtggcctggcgcgagcccggccgatgtgagcttaattgccctaaggggcaagtttacttacagtgcggtacgccttgcaacctcacgtgtaggagcctgagctaccccgacgaggagtgtaatgaagcctgcttggagggatgcttctgcccccccgggctttacatggacgagcggggcgattgcgtgcccaaggcgcaatgtccctgctattacgacggagagatattccagccagaagacatcttcagtgaccaccacacaatgtgctattgcgaggacggcttcatgcactgcaccatgagtggtgtacctggaagcctcctgcctgatgccgtgctctcatcccctctttcacacaggagcaaaaggtccctgagctgccgcccacccatggttaagctagtgtgccctgcggacaatttacgcgccgagggcttagagtgtaccaagacctgccagaactatgatctcgagtgtatgagcatgggatgcgtgtccgggtgcctttgtccaccgggcatggtgcgccacgagaatcggtgcgtggctctggagcgatgcccatgtttccatcaggggaaggagtacgcccccggggaaactgtcaagattggatgcaacacctgcgtgtgtcaggaccgcaagtggaattgtacagaccatgtgtgtgacgccacatgctctacaatcggcatggctcactacttgacattcgacggcctgaaatatctgttccccggagagtgtcagtacgtgttggtccaggattactgcggctccaaccctggcacctttagaatattggtaggaaataagggctgctctcatcccagcgttaaatgcaaaaaacgcgtgacgattttggtggaaggaggggaaattgagctgttcgacggtgaggtcaatgtcaaaaggccaatgaaagacgagactcactttgaagtcgtggaatccggccgctacatcattctattgctcggaaaggctctctccgtcgtctgggacaggcacctatctatctccgttgtcttgaagcagacctaccaggaaaaggtgtgcggactctgcggtaacttcgacggcatccagaacaatgaccttacctcgtctaacctccaggttgaggaggatcccgttgactttggtaatagctggaaagtgagtagtcaatgcgctgacaccagaaaagtgcctttggattcttctccagctacgtgccataataatattatgaaacaaacaatggtggactcaagttgtcgaattctcaccagtgatgtgtttcaggattgtaacaagcttgtggaccctgagccatatctcgacgtctgtatatacgacacctgctcttgcgaatctatcggagattgcgcctgtttctgtgacaccattgctgcttacgcacacgtctgtgcccaacacggtaaggtcgtgacatggcggaccgccacactgtgcccccagtcttgtgaggagcgtaaccttagagagaacggctatgagtgtgagtggcgctacaacagttgcgcccctgcctgccaagtgacctgccaacatcctgagcctctggcctgtccagttcagtgcgtggaagggtgccacgcccattgccctccagggaagatactcgatgagctattgcagacctgtgtcgatcctgaggactgccccgtctgtgaagtagctggcagaaggttcgcgtcaggcaaaaaggtgactctgaacccgagtgaccctgagcactgtcagatttgccactgcgacgtggttaacctcacatgtgaagcatgccaggaaccaggcggcttggtggtcccccctactgacgctcctgtttctccaaccaccctgtacgtggaagacattagtgagccccccctgcacgacttttattgcagccggctgctggatcttgtgttcctgctggacggctcctcccggctgtccgaggccgagttcgaggtgttgaaggccttcgttgttgacatgatggagcggctgaggatctctcagaagtgggttcgcgtggcagtggtcgagtaccatgatggctctcatgcctacattgggctaaaagatcgcaaacgccccagcgagctgcggcggattgcctctcaggtgaaatacgctgggtctcaggttgcctccacgagcgaagtgctgaagtatactctgttccagatcttctctaagattgacaggcccgaggcatccaggattacgctgctgctgatggcgtcccaggaaccccaacggatgagtcggaatttcgtcagatatgtgcagggcctcaaaaaaaagaaagttatcgttattccagtcggaattggtcctcacgcaaatctgaagcagatccgccttattgaaaagcaagccccagagaacaaggcgtttgttctctctagtgttgatgagctggagcagcaaagggacgaaatcgtcagttacctgtgcgatttggcccctgaagcgccaccacccacactgcctcccgatatggcacaagtcaccgttggcccagggttactcggggtgtctactctcgggcccaaacgtaattcaatggtgctcgacgtggccttcgttttggaaggctccgataagattggcgaggctgactttaataggagcaaagagtttatggaggaagttatccagagaatggacgtggggcaagacagcattcatgtgacagtactccaatactcttacatggtcacagttgagtatccattttctgaggcccagtcgaaaggcgatatccttcagcgagttagggaaatccgctatcagggaggtaatcgcactaacaccggtctggccctgcgctatctgtcagaccactcattcctggtaagtcaaggagacagagagcaggcaccaaaccttgtgtacatggtcaccgggaatcccgcgtcagatgagatcaaaaggctgcccggagacatacaggtggtgccaataggtgtcggtccgaatgccaatgtgcaggagcttgagcgcataggttggcccaacgcaccaatccttattcaagactttgagacactcccccgggaggcacctgacctggttctgcagaggtgctgttccggtgagggtctccaaattcctacgctgtcacccgcacccgattgcagccaacctctggatgtgattctcctcctggacgggagttctagcttccctgcttcctacttcgatgagatgaagtctttcgctaaggcgttcatttcgaaggcgaatatcgggccgcggctgactcaagtgtctgtgctgcagtacggatccataaccacgattgacgtgccctggaacgtggttcctgagaaagcccaccttctctctttagtcgacgtcatgcagcgggaaggtggaccctcccagatcggcgacgctttgggctttgctgtccggtacctgacttccgaaatgcacggggctcgcccaggggcatccaaagctgtggttattctggtgacagatgtcagcgttgactcagtagacgccgcagccgatgcagccagaagcaaccgtgtcaccgtgttccctatcggcatcggagatcgctacgacgcagcgcaattgcgaatcttagcgggaccagcaggcgattccaacgttgttaagctccagaggattgaggacctccccactatggtgaccttgggcaacagcttcctgcacaagttgtgcagtggcttcgtccggatatgcatggatgaggacggcaacgagaaacgtccgggcgatgtatggaccctccctgaccaatgccacacggtcacctgtcaacctgacggccagacgctactgaagtcccatagagttaactgtgatcggggacttcggccctcatgtcctaatagccagtcccccgtgaaggtcgaagagacttgcggatgtcgctggacttgcccttgtgtgtgtactgggagcagcacccggcatattgtgaccttcgacggacagaatttcaagctgacgggcagctgttcatatgtcttgttccagaacaaagaacaggatttggaggtgatcctccacaacggggcctgcagcccaggcgcacggcaggggtgcatgaaatctatagaggtgaagcactctgcgctgtcagtggaactccattctgacatggaagttactgtaaacggccgactggtgtctgtcccttacgtgggaggaaatatggaggtgaatgtctacggggccatcatgcacgaggtccggttcaaccacctggggcacatctttacattcaccccacagaacaatgaattccagctgcagctgtcgcccaaaacctttgctagtaagacttatggactctgcggcatttgcgatgaaaatggggctaacgacttcatgcttcgcgatggtacggtgacaacagactggaagacgctcgtccaagagtggaccgttcagagacctggccagacttgtcagcctattctcgaagagcagtgcctagttccagattcatcacactgtcaagtgctgttgttgcctctgtttgcggaatgtcataaggtactggcaccagctaccttctacgccatctgccagcaggacagctgccaccaggaacaagtctgcgaggttatagctagctatgcccatctgtgcagaacgaatggcgtatgtgtggattggcgaacaccagatttctgtgcaatgagttgccccccaagcctcgtgtataatcattgtgagcacggatgtccgcgacactgcgatgggaatgtcagttcttgtggcgatcaccccagcgaagggtgcttttgccccccagataaagtgatgctcgagggcagctgcgtgcctgaggaggcatgcacccagtgtatcggagaggacggcgtacagcatcagttcttagaggcatgggtcccagaccaccagccatgtcagatctgcacctgtcttagtggacgtaaggtaaactgcaccactcaaccctgccccaccgccaaagcgccaacgtgcggcctgtgcgaggtggctagactccgacagaacgctgaccagtgttgtcccgagtacgagtgcgtctgtgacccagtctcctgcgatcttccccccgtaccccactgcgagaggggcttgcagcccaccctgacaaaccctggagagtgccgccccaactttacctgcgcttgtaggaaggaggaatgcaaaagagtgagtcccccttcctgtccaccacacagactacccaccttacgaaagactcagtgttgtgatgaatatgagtgtgcctgcaattgtgtgaactctacagtgtcatgtcccctagggtatctggctagtacggccactaatgattgcgggtgtactacgacaacctgcctccccgacaaggtctgcgtgcatcgctccaccatctacccggtgggacagttttgggaggaaggatgcgacgtgtgtacctgtaccgatatggaggacgccgtcatggggctcagggtggcccagtgcagccagaagccgtgcgaggactcctgtaggagcgggttcacttacgtgcttcatgagggagagtgctgcgggaggtgcctgccgagcgcatgcgaagtcgttaccggaagtccacgaggcgatagccagagttcatggaagtcggtgggctctcagtgggcaagccccgaaaacccttgtctgattaatgagtgcgtgagagtaaaagaggaagttttcatccaacagagaaatgtgtcatgtccccaactcgaagttcccgtgtgtccaagcggcttccagctgtcttgcaaaacatcagcatgctgcccatcgtgcaggtgtgagcggatggaagcatgcatgctgaatgggactgttatcgggccgggaaaaactgtgatgattgacgtctgtaccacttgcagatgcatggttcaagtcggcgtcatttctggctttaagttggagtgtcggaaaaccacctgtaatccatgcccacttggctacaaggaggaaaacaacacaggggaatgttgcggacggtgccttcctaccgcctgcactattcagctgcgcggagggcagatcatgaccctgaaacgagatgaaacgctgcaggatgggtgtgacacgcacttctgtaaggtgaatgagaggggtgaatatttttgggagaaaagagttacaggctgccctccatttgacgagcacaaatgtctggctgagggcggcaagattatgaagatacctgggacttgctgcgatacctgcgaggaacctgagtgcaacgacatcacagccagattgcagtacgtcaaggtggggtcctgcaagtccgaagtggaggtcgatattcactattgccaggggaagtgcgccagtaaggcaatgtattctattgacatcaatgacgtccaagatcagtgttcttgctgtagccccaccagaactgagcccatgcaagtagcgttgcattgcactaatggaagcgtcgtgtaccacgaagtcttgaatgcaatggagtgtaaatgctcccctcgtaagtgcagcaaa

SEQ ID NO: 21301 - DNA, 8439 bp, Artificial Sequence
  Description of Artificial Sequence: Synthetic coding sequence
atgatacctgcgaggtttgctggcgtgttgttggcgctagccctcattttgcccggaaccctgtgcgcagaagggacaagagggaggtcttctacagctcggtgtagtctgtttggtagtgactttgtgaacacgttcgatggttctatgtatagcttcgccgggtattgctcttacctgttggcaggcgggtgccaaaagagaagcttctccatcatcggagatttccaaaacgggaaacgcgtctcattgtctgtatatcttggagaattttttgacattcacttattcgtcaacggaaccgtgactcagggcgatcagagggttagtatgccttacgcgagtaagggcctgtatctggaaaccgaggctggatactacaagctgtctggggaggcttatggcttcgtagcgcgcattgacggatctggcaatttccaggtgttgttgagcgatcggtactttaacaagacctgtggcttatgcgggaactttaatatcttcgctgaggacgacttcatgacccaggagggcactctaacgtcggatccgtatgacttcgccaacagctgggccctttcatcgggagagcagtggtgtgaacgcgcgagccccccgtcctcctcctgcaacattagttccggagaaatgcagaagggcctgtgggagcagtgccagctgctaaaatctaccagcgtgttcgctagatgtcatccgctggttgacccagagcccttcgtggcattgtgcgagaagacactgtgcgaatgcgccggcggattggaatgcgcgtgtccagccctgctggaatacgctaggacttgcgctcaagagggaatggtgctttacgggtggaccgatcacagcgcgtgctccccagtgtgccctgccggcatggaataccggcaatgcgtctctccctgcgctcggacttgccagagccttcacatcaatgagatgtgccaagagagatgtgtagatggttgtagctgcccagaaggacagctgctggatgagggcctgtgtgttgagagcacagaatgcccatgcgttcacagcggcaagagatacccacctggaacttcattgtccagggactgtaatacttgtatctgtaggaactcacagtggatatgttccaatgaggagtgccccggcgagtgtctcgtgaccggccagagccatttcaagagtttcgacaatcgatatttcacatttagcgggatttgccagtacctcctcgcgcgcgactgccaagaccattctttttctatcgtgatagagacggttcaatgcgccgatgaccgggacgccgtatgcacacggagcgtcactgtgcggctgccgggcctccacaattcgctcgtgaaactgaaacatggcgcgggcgtggctatggatggtcaggacgttcagctgcccctgctgaagggggacctgcggatccagcacactgttactgcaagtgtgaggctgtcctacggtgaagacctgcagatggattgggacggcaggggccggctactggtgaagctgagccctgtgtacgccggcaaaacgtgcgggttgtgtggaaactataatggaaatcagggagatgactttctcactccctccggcttggctgaaccccgcgtggaggacttcgggaacgcatggaaactgcatggtgactgccaggacctacagaagcagcattcagatccttgtgctctcaatccacgcatgactcgcttcagcgaggaagcctgcgccgtcctgaccagcccgaccttcgaggcctgccacagagccgtcagcccattaccatacttgcgcaactgtcggtatgacgtctgttcctgtagtgacggcagagagtgtctatgtggggccctggcatcttacgccgccgcctgcgccgggcgtggggtacgcgtggcgtggcgggagccagggcgatgtgagttaaactgtccaaaagggcaggtatatctgcaatgtggcactccctgtaatttaacgtgccggtcgctaagctacccagatgaggaatgcaatgaagcatgtttagagggttgcttctgtccacccggcttgtacatggatgagcgcggcgactgtgtgcctaaggctcagtgcccttgttactacgacggggaaatcttccagccagaggatatatttagtgaccaccatacaatgtgttattgcgaggatggcttcatgcactgtaccatgagcggcgtccctggctccctgctccccgacgcagtcttgtcatccccactgtctcatcggagcaaacgttccctctcctgtagaccgcccatggtcaagctagtgtgtccggcagataacctgagagcggaaggtctggagtgcacgaaaacttgccaaaactatgatcttgagtgtatgagtatgggatgcgtgtcaggatgcttatgtccccccgggatggtgagacacgagaacagatgtgtcgcgctggaacggtgtccctgcttccaccagggtaaggagtatgcgccaggagagactgtgaaaattgggtgtaacacatgcgtttgccaggacagaaaatggaactgcacagatcatgtgtgcgatgcaacttgctcaactatagggatggcgcactatctgacgttcgacggactgaagtatctcttcccaggagaatgtcagtatgttttggtgcaggattattgcggttctaaccccggcaccttccggatcctcgtcggcaacaaaggatgtagtcatccaagcgttaaatgtaagaaaagggtgaccatcctggtggagggcggggagattgaactcttcgatggcgaagtgaacgttaagcgacccatgaaagatgagacacattttgaagtggtagagtccggtcgatacattatcctgctgctagggaaggccctcagtgttgtgtgggatcgtcatctgtccatctcagtggtgttgaaacagacataccaggagaaagtgtgcgggctatgtggtaacttcgacggtatccagaacaacgacctgacaagcagtaatttgcaggtcgaggaggatcccgtggattttggaaactcttggaaggtttcaagccagtgtgcagatacgagaaaggtaccgctggattcatcccccgcaacctgccataacaatatcatgaagcagaccatggtggactcatcttgtcgcatcctgacgagtgacgtgttccaggactgcaacaagctggttgaccctgagccatacttagacgtgtgcatctacgacacatgctcatgcgagtcgatcggtgactgcgcgtgtttttgtgatacaatcgctgcttatgcccacgtgtgcgcccagcatggcaaggtcgtgacttggcgaaccgccactctctgtcctcaatcctgcgaggagcggaacttgagagaaaatgggtatgagtgtgaatggaggtacaacagctgcgctccggcctgtcaggtcacgtgccagcaccccgagccgctggcatgccccgttcagtgcgtggagggttgtcatgctcactgtcccccgggaaaaatcttggacgaattgcttcagacttgtgttgatcctgaggattgccctgtctgtgaggtcgcgggaaggcgcttcgcttcagggaaaaaggtaacactcaatccatctgacccagaacattgccagatctgtcactgtgacgtggtcaatcttacctgcgaggcctgccaggagcccggggggctggtggtgcctccaaccgacgcccctgtcagtcccactacattgtacgtagaggacatttctgagcctccccttcacgacttctattgcagccgcctgctggatctggtgttcctgctggacggttcgagtaggttatctgaagccgaatttgaggtgcttaaggcattcgtggtcgacatgatggagaggctgcgcatctcgcagaagtgggtgagagttgccgtggtcgagtaccatgacggctcccacgcttacattggcctgaaagatagaaagagaccctccgagttgcggcggatcgcttcacaggttaagtacgcaggctctcaggtagctagcacgagcgaagttcttaaatataccctctttcagatcttcagcaaaattgacagacctgaggcaagtaggatcactctcttgctgatggctagccaggagccccagagaatgagtagaaacttcgttaggtatgtgcagggtctcaaaaaaaagaaggtaatcgtgatacccgtgggcatcggtcctcacgccaacttgaaacaaattcggctaattgagaaacaagcaccagaaaataaagcattcgtcctgagcagcgtcgacgaattggaacagcagcgggacgaaattgtatcctatctgtgtgacctggctccagaagcccccccgccaacactcccccctgatatggcacaagtgaccgtgggacccggtctgctgggggtttccacgttagggcccaagcggaatagtatggtgcttgacgtggcctttgtcctcgaaggcagtgacaaaataggggaagctgactttaataggagcaaagaatttatggaagaagtgatacagcgcatggacgtaggacaggattcaattcatgttactgttttgcaatactcatatatggtcactgtggaataccctttctctgaggcacagtctaagggagacatactccagcgggtgcgcgagattagataccagggtgggaatagaacaaatacaggactggcgcttagataccttagcgatcactcttttcttgtatctcaaggcgatcgagaacaagcccccaacctggtctatatggtaacagggaaccccgcaagcgacgagatcaagcgcctccctggtgatatacaggtggttccaatcggtgtggggcctaatgctaatgtccaggagctcgaaagaattggctggccaaatgcccccattttgatccaggacttcgagaccctgccaagggaagctcccgatctggtattgcagcgttgttgctctggcgagggcctccagattccaacactgagcccagctcccgattgcagtcagcctctggacgtgatattgctcctagatggctccagctcattccccgcgtcctatttcgacgaaatgaaatctttcgctaaggcatttatcagcaaggccaatataggacctagactaacccaggtctcggtgctccaatacggaagtatcacaacaatcgatgtgccctggaacgtcgtccccgagaaagcccacctgttgtccctggtcgatgtgatgcaacgcgaaggcggtccttcccagatcggagacgcccttgggttcgccgtccggtatctcaccagcgagatgcatggtgcacggcctggagcgagtaaggcggttgtgatcctggtgacggatgtcagtgtcgatagcgttgatgcggcagccgacgcagccaggagtaatcgggtgactgtgtttcctataggcatcggagatcgctatgacgctgcacagcttcgtattctggctgggccggctggcgatagcaatgtggtgaaattacagcgaatcgaggacttacctacaatggtaactctgggaaactcattcctgcataagctatgtagcggtttcgtccggatttgtatggacgaggatggcaacgaaaagcggcccggcgatgtgtggacactgcccgaccaatgtcatactgtgacctgtcagcccgacgggcagacactgttaaagtcccatagggtgaattgtgaccgcggacttaggccctcgtgccccaacagccagagccccgttaaggtagaggagacctgcggctgcagatggacctgtccctgcgtttgcaccggatcctccaccagacacattgtgacgttcgacgggcaaaactttaagcttactggttcttgcagctacgtgctcttccagaacaaagagcaagatcttgaggttatcctccacaatggcgcatgttctcccggtgccaggcaaggatgcatgaaatcaatcgaggtcaaacactcagccctgtcagtcgagctccattccgacatggaggttaccgtgaatggaagactagtctctgtcccttatgtcgggggaaatatggaggtgaacgtgtacggggccattatgcatgaagttcggttcaaccatttagggcatatattcacttttacaccacagaacaacgagttccaactccagctcagccccaagaccttcgctagcaaaacttacgggctctgtggcatctgtgatgagaacggcgctaacgactttatgctgagagatggaacagtcaccacagactggaagacactagtccaggaatggacagtacagcgccctggccagacctgtcagcctatcctggaggagcagtgcctcgtgcccgactcaagccactgccaggtgcttctgctacctttgttcgcagagtgccacaaagtgctcgcccccgccaccttctatgcaatttgccagcaggacagctgccaccaggagcaggtgtgcgaggtgattgcctcatacgcgcacctatgccgtactaacggtgtgtgtgttgactggagaacacctgatttctgcgcaatgagctgtccaccaagcttggtgtacaaccactgtgagcatgggtgtccacgacattgtgacggcaacgtttcttcttgcggagaccacccctcagagggatgcttttgtccgcctgacaaggtcatgctagaaggaagttgcgttccggaggaggcctgcacacaatgcatcggcgaagacggcgtgcagcaccagtttctcgaggcatgggtgcctgatcatcagccgtgccagatctgtacctgcctgtccggtcggaaggttaattgtacaacacagccctgccccacagccaaagccccaacgtgcggcttgtgtgaggtagcaaggctgagacagaacgccgaccagtgttgtcctgaatacgagtgcgtgtgcgatcccgtgagttgtgacctacctccggtccctcattgcgagagaggacttcagccgacgctgactaatcccggggagtgtcggccaaatttcacttgcgcatgtaggaaagaggaatgtaagcgcgtgtcccctccgtcatgtccgccccacaggctgcccacacttaggaagacacaatgctgcgatgagtacgaatgtgcgtgtaactgtgttaactcaactgtcagctgtccactcggctacctcgccagcaccgctaccaacgactgtgggtgcactacaaccacctgccttcctgataaagtgtgtgtccatagaagcaccatttacccagtagggcagttctgggaggagggatgcgacgtgtgcacgtgtactgacatggaagatgccgtcatgggcttacgcgtcgcccagtgttcacagaagccatgcgaggatagctgtagatctggctttacatatgtgctgcatgagggagagtgctgtggacggtgccttccctcggcttgcgaggtggtcaccgggtcaccgcgaggagactcgcaatccagctggaaatcagtagggtcccagtgggccagtcctgagaatccctgtctgataaacgagtgcgtgcgagtaaaagaggaggtgttcatacagcagcggaacgtgtcttgcccacagcttgaggtacccgtatgcccatccgggttccagctctcctgtaaaacttccgcgtgttgcccgtcttgccggtgcgaaagaatggaggcctgtatgttgaacgggacagttatcggcccagggaaaaccgtgatgattgacgtttgcacaacctgtcgatgcatggtgcaggtgggtgtcatcagtgggtttaaacttgaatgtagaaaaacaacttgcaacccttgccctctcggttataaagaggagaataatactggtgagtgttgcggtcgctgtctgcctacggcctgcaccatacaactcaggggcgggcagattatgacactcaagagggatgaaactctccaggatggctgcgatacacatttctgcaaagtcaatgagcgtggggagtacttctgggagaagagagtaactggctgtcccccctttgatgaacacaaatgcttggcagaaggtgggaaaatcatgaagatccctgggacttgttgtgatacctgtgaggaaccggagtgcaacgatatcacagcccggctacagtacgtgaaagtcgggtcctgtaagtcagaggtcgaggtcgatatacattactgtcagggcaagtgtgcatccaaggccatgtattccatcgatattaacgacgtgcaggatcagtgtagctgttgctcacctaccagaaccgaaccaatgcaagtagctttgcattgtaccaacgggagtgtcgtgtaccatgaagtgctcaacgccatggagtgcaaatgcagtcccagaaaatgttccaag

SEQ ID NO: 21302 - DNA, 8439 bp, Artificial Sequence
  Description of Artificial Sequence: Synthetic coding sequence
atgattccggcgcgcttcgccggcgttcttctagccctggcactgatcctgcctggcactctctgtgcggaaggcactcgcggccgctctagcactgcgcgttgcagcctgttcggctccgacttcgtgaacaccttcgatggttccatgtacagcttcgcgggctactgcagctaccttctggctggcggatgtcaaaagcggtcattctctatcattggggatttccaaaatggtaagcgtgtcagcctaagtgtctacttgggtgagtttttcgacattcacctattcgtgaatggcaccgttacccaaggtgaccagcgggttagcatgccgtacgcgtctaaaggtctatacttggagactgaggccggctactacaaactgtcgggtgaggcgtacggtttcgttgcccgcatagacgggagcggtaatttccaagtgcttttgagcgaccgttactttaataaaacttgcggcctgtgcggcaacttcaacatttttgccgaggatgatttcatgacccaggaaggaaccctgaccagcgatccatacgacttcgcgaacagctgggcactatcctctggtgaacagtggtgtgagcgcgcttccccacctagctctagctgcaacatttccagcggcgaaatgcaaaagggcctgtgggagcagtgccaactgctgaagagtacttccgtgtttgcccgctgtcaccccctggtcgaccccgaaccttttgttgcactatgcgagaaaactctgtgtgagtgtgccggtgggctggagtgtgcttgcccggcactgctggaatacgcccgaacctgcgcacaggaaggcatggttctctatggctggacggaccacagcgcatgctctccagtgtgtccagccggtatggaataccggcagtgcgtgagcccctgcgcgcgtacgtgccagtccctgcacattaatgagatgtgccaagaacgttgcgtggacggttgctcatgtcctgaaggccagctgctggacgagggtctgtgtgtggagagcaccgagtgcccctgcgttcactccggaaagaggtacccacctgggacatctctttctcgtgactgtaatacctgcatatgccggaattcccagtggatatgcagtaacgaagagtgcccaggcgaatgtttggttacagggcagtcccactttaaatcttttgacaatcggtattttacctttagcggtatatgtcagtatctgctggcccgtgactgccaagatcacagcttttcaatcgtgattgagacggtgcagtgcgcggacgatcgagacgccgtttgcactcgctcagtgaccgttcggctgccgggcctgcacaactctctggtgaagctgaaacacggggctggtgtggccatggacggccaggacgttcaacttccactgctgaaaggggacttgagaatccagcatacggtgacagcgagcgttcgcctgtcgtatggcgaagatctgcagatggattgggacgggcgcggccgcttgctggtcaaactgagtccagtttatgccggcaaaacttgcggtctgtgtggcaattacaatggcaaccaaggagacgactttctgaccccaagcgggctggcggaaccgcgtgttgaggatttcggtaacgcctggaagctacacggcgactgccaggatctgcaaaagcaacacagcgacccatgcgccctgaaccctcggatgacgaggttcagcgaagaggcctgtgccgtgctgacgagcccaactttcgaagcgtgtcaccgggcagtcagcccactgccttatcttcgcaactgtaggtacgatgtgtgtagttgctctgacggccgcgagtgtctgtgtggagctctcgccagctatgccgcggcgtgcgccggccgcggggtgcgggttgcctggcgcgagccgggtcgctgtgagcttaattgtccgaaaggccaggtgtaccttcagtgtgggacaccatgcaacctcacttgtaggagcctgagctaccccgacgaggagtgcaatgaggcctgcctggagggctgcttttgccctcctggtttgtatatggatgaacgcggcgactgtgtgccaaaggcccagtgtccgtgctactacgacggtgagatcttccagcctgaagatattttttcagatcaccataccatgtgctactgtgaggatggctttatgcactgtactatgtctggagttccgggttcccttctgccggacgctgttctgagcagcccactgtcccatcgctctaagcgttcattgtcgtgccgcccaccgatggtcaaactggtgtgtccagcagataatttgcgcgcggaaggtctggagtgcaccaagacctgtcagaactacgacctggaatgcatgtccatgggttgcgtcagcggttgcctgtgtccgccaggaatggtacgccacgagaaccgctgcgttgcattagaacgctgcccttgcttccaccagggcaaggaatacgctcccggagaaacagtcaaaatcggatgcaatacttgcgtgtgtcaagatcgcaaatggaattgtaccgatcacgtgtgcgacgcgacctgttcaactatcggtatggcgcactatctgaccttcgacggcctgaaatatctgttccctggtgaatgccagtacgtactcgtgcaagactactgcggtagcaaccccggtacctttagaatcctggtgggtaacaaaggttgtagccacccttctgtgaagtgcaagaaacgagttactattctggtggagggcggtgagatagaattgtttgacggagaagtcaatgtgaaacgtcccatgaaggacgaaactcatttcgaggttgtggaatctggcagatacattatcctgttattaggcaaggcactgagcgttgtctgggacaggcacctgtcaatctcggttgttctgaaacagacctatcaggaaaaggtttgtggcctgtgtgggaatttcgatggtattcaaaacaatgatctgacctcctctaatctgcaggttgaggaagaccctgttgactttggcaatagttggaaggtgtcatctcagtgtgcagatacgcgcaaagtgcctctggattctagccctgcaacttgccacaacaacattatgaagcagactatggtcgacagcagctgccggatcctgactagcgatgtctttcaggattgcaataagctggtggatccggaaccatatctggacgtctgtatttacgacacctgtagctgcgagagcatcggtgactgcgcctgtttctgtgacaccattgccgcatatgcgcacgtgtgtgcgcagcacgggaaggtggtcacatggcgcaccgcgacgctgtgtccccaatcctgtgaagaacgcaacctgcgcgaaaatggctacgaatgtgaatggcgctacaactcctgtgctcctgcgtgtcaggtcacctgccagcacccagaaccactggcctgtccggtgcagtgcgtggaaggctgccatgcccactgcccgcctgggaaaatcttggacgagctgctgcagacctgtgtggatccagaggattgcccagtgtgcgaagtagcgggtcgcagatttgcttccggtaagaaagtgactctgaacccaagcgaccctgagcactgccagatttgccattgcgacgtagtaaacctcacctgcgaagcctgtcaggagccaggcggcctggttgtccctccaacagacgctcctgttagcccgaccacgctgtatgtcgaggacatcagcgagccaccgctgcacgatttttactgttccaggctgctggacttggtttttcttttagacggtagctcccgactgtctgaggctgaatttgaggtcctgaaggcatttgtggttgacatgatggagcgcctccgaatttctcaaaagtgggtgcgcgtcgccgtggtggaataccacgacggttcccacgcatacattggcctgaaagaccgaaaaagaccttcagagctgaggcgcattgcgagccaggtgaaatatgctggctctcaagtagcttccacaagtgaggtcttaaaatataccctattccagatttttagcaagattgaccgccctgaagccagccgcatcaccctgctgcttatggcttcccaggagccgcaaaggatgtcgcggaactttgttcgctacgtgcagggcctaaagaaaaaaaaggtgattgtcattccggtcggtatcggccctcacgccaatctgaaacagatccgcttgatcgagaagcaagcgccggagaacaaagcatttgtcctgtcatctgtcgatgagctggaacagcagcgcgacgagattgtcagctatctgtgtgacctggcacctgaagcgccaccgccaacgctacctcctgatatggcacaggttacggtgggtccaggcctgctgggtgtgtctacactgggccccaaacgcaacagcatggtgttggacgttgcgttcgtgctcgagggctctgacaagatcggtgaggctgacttcaaccgaagcaaggaattcatggaagaagttattcagcgcatggacgtggggcaagattccatccacgtgaccgtcctacaatactcgtacatggtgactgtagaatatccgttttcggaggcacagagtaagggtgacatcctgcaacgcgtccgcgaaatcaggtatcagggtggtaatcgcacgaatactggactggcgctgcgctatctgagcgaccacagcttcttggtgagccaaggtgaccgggagcaagctccaaatctggtgtacatggtgacaggtaaccctgcgtccgatgaaataaagcgcctgcctggcgatattcaagtcgtccccattggcgtgggtccgaatgcaaacgttcaagagctggaacggataggttggcctaatgccccaattctgattcaggacttcgagaccttgcctcgagaggcgccggatctggtcctgcagagatgctgcagcggcgaaggtctccaaattcctaccctgagtccagcccccgattgctctcagcctttagacgtgatcctgctgctggatggaagctcgagctttcccgcctcgtacttcgatgagatgaaatccttcgcaaaagcttttattagcaaggcaaatattggtccgcgcttgacccaggtttctgtcctgcagtacggctctatcacgactatcgatgtcccatggaacgtcgttccggagaaagctcacctgctgtccttggttgacgtgatgcagcgagaaggtggtccgtcacagatcggtgacgctctgggcttcgccgtccgttacctaacaagcgagatgcacggcgctcgtcctggtgcctctaaagcagttgtcattctggttaccgacgtgtctgttgatagcgttgacgccgcagccgacgcagcacgcagcaaccgtgtgaccgtgtttccgattgggatcggcgaccgttacgatgccgcccaactgcgaatactcgcgggaccggcgggcgacagcaacgttgttaaactgcagcgaattgaggatctgccaaccatggtcacgctgggaaattccttcttgcataagctgtgcagtgggttcgtccgtatctgtatggacgaggacggcaacgaaaagagaccgggtgacgtttggactctgcctgaccagtgccacacggtaacctgccagccagatggtcagaccctgctgaaaagccaccgcgtaaattgcgatcgcggcctgcgacctagttgccctaactcgcagagtccagtaaaagtcgaagaaacgtgtggttgccgttggacctgtccatgcgtctgcaccggtagcagcacgcgccacatcgtgaccttcgacggccaaaacttcaaactgaccggcagctgtagttacgttttgttccaaaacaaggagcaggacttggaagtcatcctgcacaatggagcctgctctccaggtgccagacagggttgcatgaaatcaatcgaggtgaaacattctgccctgagcgtcgaactgcacagcgacatggaagtcaccgtaaacggccgcctagtgagtgtcccttatgtgggtggtaatatggaagtgaacgtctatggcgctataatgcacgaggttcgttttaatcacttaggtcatatcttcacgttcactcctcagaataatgagtttcagctgcagttgtcaccaaagactttcgcgtcaaagacctacggtctgtgtggtatttgcgatgagaacggtgcgaacgacttcatgctgcgggatggcaccgtcaccaccgattggaagaccttggtgcaggagtggacagtgcaacggccgggacaaacctgccagccgatcctggaggagcagtgcctcgttccagactcatctcactgtcaggttttactactgcctttgttcgccgagtgtcacaaggtcctcgcaccggccaccttttatgcaatctgccagcaggacagctgccatcaggaacaggtgtgtgaggtcattgcatcatacgcacatctgtgccggaccaatggcgtctgcgttgattggcgtactcctgatttttgtgccatgtcatgcccaccgtcgctggtgtacaaccattgtgagcacggctgtccacgccactgtgatggcaatgtgagcagctgtggcgaccatccttctgagggctgcttctgcccgccggataaggttatgcttgaaggaagctgcgttccagaggaggcgtgtactcagtgcatcggcgaggacggtgtccagcaccagttcctggaagcatgggtaccagatcaccagccttgccagatctgcacctgtttgtccggacgcaaggtgaattgcactacgcagccgtgcccaactgctaaggcaccgacctgcggcctatgtgaagtcgcaaggctgcgccaaaatgccgaccagtgttgtccagaatatgagtgtgtgtgcgatccggtcagttgcgatctgccgcctgtgcctcattgcgagcgcggactgcagccgaccctgacgaacccgggggaatgccgtccaaatttcacgtgcgcgtgtcgtaaggaagaatgcaaacgcgtgtctccaccttcgtgtccgccacataggttgcctaccctgcgaaagacccagtgctgcgatgaatatgaatgtgcttgtaattgcgttaacagcaccgtgtcatgcccgctgggttacctggcatctaccgccactaacgactgtggttgcaccaccactacctgcctgccagacaaggtgtgtgtacatcgctctaccatttacccagtgggtcagttctgggaggagggctgtgacgtttgtacgtgcaccgacatggaggacgcagtgatgggtttgcgcgtcgcccaatgctctcagaagccttgcgaggattcctgccgctctggatttacgtacgtgctgcacgagggtgagtgctgcggtaggtgtctgccgagcgcgtgtgaggtcgtgaccgggtctcctcgcggtgacagccagagctcgtggaagagcgttgggagtcagtgggcaagcccggagaatccgtgtctgattaatgagtgcgtccgcgttaaggaggaagtctttattcagcaacggaacgtctcttgccctcagctggaggttccggtgtgtccgagcggtttccagctgtcatgcaagacctcggcatgctgcccgtcatgccgctgcgagcgtatggaagcgtgcatgttgaacggcaccgtgatcggccccggcaagacggtcatgattgatgtctgcacgacttgtaggtgcatggtgcaggttggagtcatttctggcttcaagctggaatgccgcaagacgacctgtaacccatgtccgctcggttacaaggaggagaataacactggcgaatgctgcggaaggtgcctgcccaccgcgtgcacaattcaactgagggggggccaaatcatgaccctcaagcgtgatgaaacccttcaggacggttgcgatacacatttttgtaaagttaacgaacgcggcgagtacttctgggagaaacgtgtgaccgggtgtccgccttttgacgagcacaaatgtttggcggaaggcggtaagatcatgaagatcccaggcacctgctgtgacacctgcgaggaaccggagtgtaatgacatcaccgcgcgcctgcagtatgtcaaggtcggtagctgtaagtccgaagtggaagttgacattcattattgccaaggcaagtgtgcgtctaaagctatgtacagcattgatattaatgacgtccaggaccagtgtagctgttgcagcccaacgcgcaccgagccgatgcaagttgcgctgcattgcacgaatggtagtgtcgtttaccatgaggtgttaaacgcaatggaatgcaaatgcagtcctcgcaaatgtagcaag

SEQ ID NO: 21303 - DNA, 8439 bp, Artificial Sequence
  Description of Artificial Sequence: Synthetic coding sequence
atgatacccgctcggtttgctggcgtattgctcgcgcttgcgctgattctaccaggcaccctgtgtgccgaagggacgagaggccggagttccactgcacggtgttccctgtttggaagtgatttcgtgaacacgttcgatggctcaatgtatagcttcgccggctattgttcctatcttctggcaggcgggtgtcagaagcgatcctttagtatcatcggggatttccagaatgggaaaagagtcagcctcagcgtgtacctgggtgaattctttgatatacacttatttgtgaatggaactgtgacccagggtgaccaacgagtttcaatgccctatgcatcaaagggtctgtacctcgagacagaagctggctattacaaactgtccggagaggcatatgggttcgtagcccgaattgatggaagcggcaacttccaagtgcttctttcagaccggtattttaataagacttgtgggctatgcggtaatttcaatatattcgctgaagacgatttcatgactcaggagggaacattaacgagcgatccctacgattttgccaactcttgggccctctctagtggcgagcagtggtgcgaaagagcttctcccccttctagcagctgcaacatctcaagcggcgaaatgcaaaagggcctatgggagcagtgtcagctgctgaaatctacgtccgtcttcgcccgctgccacccactggtggaccctgagccattcgtggctctgtgtgagaaaacactctgcgagtgtgcggggggactggagtgtgcatgccccgcgctactggaatatgctcgtacctgcgcgcaggaaggaatggtgctgtatggatggacggatcattccgcgtgctcacctgtgtgtcccgcggggatggagtaccgccagtgtgtgtcaccctgcgctcggacatgtcagagcttgcacattaatgagatgtgccaggagagatgtgtcgatgggtgctcatgcccagaagggcaattgctggatgagggcctgtgtgtggaatctaccgaatgtccctgtgttcactctggaaaaagatacccacctggtacgtcactcagcagggattgcaatacctgcatctgccggaattctcagtggatctgttccaacgaggagtgtcctggcgagtgcctggtcaccgggcagagtcacttcaaaagcttcgataacaggtattttacatttagtggcatctgccagtacctactggcccgggactgccaggaccactcatttagtatcgttatcgagacagtccagtgcgctgacgacagagacgcggtttgtaccagaagcgtgactgttagactacctggtttacacaactcattggtgaaactgaagcatggtgccggagtggcgatggatggtcaggacgtgcaattaccattgctcaaaggggatttaaggattcagcacacagtaactgccagcgtcagactgtcatatggtgaggacctgcagatggactgggatgggagagggcggctgctagtgaaactgtcgcctgtgtatgccggcaagacttgcggcctgtgtggcaattataacggcaaccagggagatgattttcttacacctagcggactggctgaacctcgagtggaggatttcggaaacgcttggaaattgcatggcgactgtcaggacctccagaagcagcacagcgatccttgcgctctgaatcctaggatgactaggttttccgaggaagcatgtgccgtcttaacttcaccgacatttgaagcctgtcaccgagccgtttcccccctgccctacctgaggaattgcaggtacgatgtatgtagctgttccgatggccgcgaatgtctatgtggtgcactggctagctacgctgcagcgtgtgcaggaaggggcgtgcgagtggcatggcgggagcctgggcgttgcgaacttaattgccctaaaggacaagtatacttgcagtgcgggactccttgtaacctcacgtgccggtcgctctcctaccctgatgaggagtgtaacgaagcatgccttgaagggtgcttttgtccacctggtctctacatggacgagagaggagattgcgttccaaaagcgcagtgtccctgttactatgacggagagatatttcagcctgaggatatattctccgatcaccatacaatgtgctactgtgaggacggctttatgcattgcacaatgagcggagtgcctgggtcccttctgccagatgctgtgctgagctctccgctctcgcacaggtctaagcggtccttgtcctgccgtccacctatggtgaaactcgtctgccccgctgacaatttgagggctgagggtctcgagtgcacaaagacatgccaaaactatgatctcgagtgtatgtccatggggtgcgtgtcgggctgcctgtgtccaccgggaatggtgagacatgagaatcgctgtgtggcactggagcggtgtccctgcttccatcaaggcaaggagtacgcacccggtgagaccgtcaaaattgggtgtaacacctgcgtctgccaggatcgcaagtggaactgtactgatcacgtgtgtgacgctacctgttccacaattggcatggctcattatctgacatttgacggcctcaagtatctgtttccaggcgaatgccagtacgtgctggttcaagactactgcggaagcaaccctggtacttttcggattctcgtggggaacaaaggctgcagccaccccagtgtaaagtgtaaaaaaagagtgacgatactggtagagggcggagagattgagctgttcgatggtgaggtgaacgtgaagcgccccatgaaagatgagactcacttcgaggttgtcgagtcaggacggtatatcatactgctcttaggaaaagctttatcagtggtgtgggatcgccacttgagtatcagcgtggtgctcaagcagacatatcaggaaaaagtgtgtggtctgtgcggcaatttcgatggaattcagaataatgacctgacgtcttcaaatcttcaggtcgaggaagatccagtagacttcggtaattcttggaaggtgagttctcagtgcgcagacacgcggaaggtgcccctggacagctccccagcaacctgtcacaacaatatcatgaagcaaacaatggtggattctagctgtcgcattctcacttcagatgtttttcaggattgtaacaagttggttgacccagagccctatttagacgtgtgcatctatgatacttgttcctgcgagtcgattggggactgcgcgtgcttctgcgataccattgccgcctacgcgcacgtttgtgctcagcacggaaaagtggtgacctggcgcaccgctactttgtgcccacagtcttgtgaggaacgtaacctgcgggagaacggctacgaatgtgaatggcggtacaactcatgtgctcccgcatgccaggtgacatgccagcatcccgagcccctggcttgtccggttcagtgtgtagagggctgtcatgcacactgccctccaggaaaaatcctggatgaactgctgcagacttgcgtggacccagaagattgcccagtctgcgaagttgctggccgtcgctttgctagtggaaagaaagtaaccttgaacccatcagatcccgaacactgtcaaatttgccactgtgacgtggtaaacctaacatgcgaggcatgtcaggagcccggtggcctggtggtgccgcccacagacgcaccagtgtctcccacgacactgtacgtagaggatatctctgaaccgccccttcatgatttctactgtagtcggcttctggacctggtgtttcttctagacggctcatcgagactgagcgaagcggagttcgaggtgcttaaagcctttgtagtggacatgatggagagattgaggatctcccagaagtgggtgagagtggctgtggtcgagtatcacgacggctcgcacgcctacatcggtctcaaagaccgcaagagaccatctgaactgcgtcggatcgcgtcacaggtgaaatacgctggcagccaagtcgcaagtacttcggaggtgctgaaatatacactgtttcaaattttttcaaaaattgacaggcccgaagctagccggattaccctattactcatggcgagtcaggaaccccagcggatgagcagaaacttcgtcaggtacgttcagggtctgaaaaagaaaaaagtaatcgtcattcccgttgggattggccctcatgccaacctgaagcagatccgcctgatcgaaaagcaagctcccgagaacaaagctttcgtccttagcagcgtcgacgaactagagcagcaacgagacgagatagtgagttatctctgtgaccttgcgccggaggccccaccccctaccctgccccctgacatggcccaggtaacagtggggcccggtcttttgggcgtttccacactcggaccaaaaagaaatagcatggtcctggacgtcgctttcgtgctggaaggctccgacaaaattggagaggcagacttcaatagaagcaaagaattcatggaggaggtaatccaacgcatggatgtgggacaggactctatacatgtgacggtcttgcagtacagttacatggtgactgtcgagtacccattttcagaggctcagagcaagggagacatcctgcagcgcgtgcgcgagatccgctaccagggtggaaatagaactaatactggcctcgcattgcgttacttgagtgaccactcctttctggtatcgcagggcgatagggaacaggccccgaacctcgtatacatggtcacgggaaacccggcttccgatgaaataaagaggttacccggagacattcaggtcgtgcctattggtgtcggacctaatgcaaatgttcaggagttggagagaataggttggcccaatgcgcccatcctgatacaggacttcgagacgctacccagggaggcacccgacctggtccttcaacggtgctgtagcggcgagggactgcaaatcccaactctgtcacccgccccagattgttcccagcctctcgatgtgatcttgttactggacggctcgtccagttttccagccagctacttcgatgagatgaagtcttttgcgaaggccttcatctcgaaagcaaatataggaccgcgtcttactcaggtcagcgtgcttcaatatgggagtattacgaccatcgatgttccctggaacgtggtgcccgagaaagcccacctcttaagcctggtggacgtaatgcagcgcgaaggcggcccaagtcagattggggacgcacttggatttgccgtgcggtacttaactagtgaaatgcatggagcaagacccggagcaagtaaagccgtggtaatactcgtgaccgatgtgagtgtggatagtgttgacgcagctgccgacgccgcgcggtccaatcgggtgacagtcttcccaataggtatcggcgacaggtacgacgccgcccagttgagaattcttgctgggcctgcaggtgattcaaatgtggtgaagctgcagagaatagaggatcttcccactatggtcaccctcggtaactcatttctccacaagctgtgctctggatttgtgaggatttgcatggacgaggacggaaacgagaaacgtccgggagacgtttggacgctgcctgaccagtgtcacactgtaacatgtcagcccgatggccagaccctcctcaagagccatcgagtaaattgtgacagaggcctgcgtccgtcatgccctaattctcaaagccccgtcaaagtagaagagacttgcggctgcagatggacttgcccatgtgtctgcaccggcagcagtacccggcacatagtgacgttcgatggccaaaatttcaaattgaccggtagctgcagctatgtgctgtttcagaataaggagcaagatctggaagtaattctgcacaacggagcctgctcaccaggcgctaggcagggatgcatgaagtcaattgaagtgaagcacagcgctttgtccgtcgagctccattcagacatggaggtgaccgtcaacggcaggctggtcagcgtgccatatgttggcggtaatatggaggtcaatgtctacggggcaattatgcacgaagtgcgatttaaccacctaggccacatcttcaccttcaccccccagaacaatgaatttcaactgcagctgtctcctaagaccttcgcaagcaaaacctatggcctctgcggcatctgcgacgagaatggcgcgaacgatttcatgttgcgagacggaactgtgacgacagactggaagacactggtgcaggagtggactgtccagcggcctgggcagacctgccagcccatcctggaagaacagtgcctcgtgcctgattcctcccactgtcaggttctgttattaccactctttgcggagtgtcacaaagtgttggcaccagcaacattttacgctatctgccagcaggactcctgtcatcaggagcaggtatgcgaagtaattgcgagttatgcccacctgtgtcgaacgaatggcgtgtgtgttgactggcgcactcccgacttctgcgccatgagttgccctccctctttggtctataaccattgcgagcacggttgtcctcgacattgtgatggcaatgtgtcaagttgcggcgatcatccctcagaggggtgcttttgccctcctgacaaagtaatgttggaagggagctgcgtgcctgaagaagcgtgtacacaatgcatcggcgaagatggggttcagcaccaattcctggaggcctgggtaccagaccaccagccatgccagatatgtacatgtttgtctggtcgtaaagtaaactgcacgacccagccatgccccacagcgaaggctcctacgtgtggcttgtgtgaagttgcccggctgcgccagaacgccgaccagtgttgccccgagtacgaatgcgtgtgtgatcccgtatcctgtgatcttccacccgttccccattgcgagcgcggtctgcaaccgacactaaccaacccaggagaatgccgcccgaactttacttgcgcttgtcggaaagaggagtgtaagagggtgagccccccgtcctgtcctccacaccggcttcctacgctgcggaagactcagtgttgcgatgaatacgagtgcgcgtgcaattgcgtgaatagcaccgtatcttgccccctcggataccttgcgagcacagccaccaatgactgtggttgcaccacgactacctgcctgcctgacaaagtgtgcgtgcaccggtcgactatctatcccgtcgggcagttttgggaggagggatgtgacgtttgtacatgtacagatatggaagacgctgtgatggggttacgagtcgcacaatgtagtcagaagccatgtgaggactcttgtcggtctggtttcacatacgttctgcacgagggagaatgttgtggccgctgtctgccctccgcatgtgaagtcgtaaccggatccccccggggtgactcccagagctcttggaagtctgtgggctcacaatgggcatcccctgagaacccctgcctcattaatgaatgcgttcgtgtcaaggaagaagtgttcatacagcagagaaatgtgtcatgcccacagcttgaagtgcctgtgtgccccagtggatttcagctgtcatgtaagactagtgcctgctgtccctcgtgccggtgcgaaaggatggaagcatgcatgttaaacggcactgtgatcggacctggcaagacagtgatgatagatgtgtgtacgacctgccggtgtatggtccaggtgggtgtcatttcaggcttcaaattggagtgccggaagaccacatgtaatccctgtccactcggatacaaggaagagaacaacacaggtgagtgctgcggccgctgcctgcctacagcctgcacgatccaattaagaggtggccaaattatgacactcaaacgggatgagacactccaagatggctgtgacacacatttctgtaaggtcaacgagaggggcgaatacttctgggagaagcgcgtcacaggatgtcctcctttcgatgaacataagtgtctggcagagggaggcaagatcatgaaaatcccagggacctgctgtgacacctgcgaggaaccggagtgcaacgatatcactgcccgtctgcagtacgtaaaggtgggctcatgtaaatccgaagttgaggtggatatacattactgccaaggcaagtgcgcctcaaaggcgatgtactccatcgatatcaacgacgttcaagatcagtgtagttgttgctctcctacacggacagagccgatgcaggtggctctgcattgcacaaacgggagtgtggtctatcacgaagtgttaaacgcgatggaatgtaagtgtagcccaagaaagtgctctaag

SEQ ID NO: 21304 - DNA, 8439 bp, Artificial Sequence
  Description of Artificial Sequence: Synthetic coding sequence
atgatccccgcaaggttcgccggagtccttctcgcactcgcactaattctacctgggactctctgtgctgagggaactcgtggacggtctagtacagctcggtgttccctgttcgggtctgactttgtgaatactttcgatggatctatgtattctttcgccgggtactgtagttacctcctagctggagggtgccagaaaaggtcattctctatcatcggggatttccaaaatggaaaaagggtgagtctgtcagtataccttggagaatttttcgatatccatcttttcgtcaacggaactgtcacacagggggatcagagggtgtcgatgccttatgcatctaagggactttatctcgaaactgaagcagggtattataagctttcaggagaagcctatggatttgtcgctagaattgatgggtccggaaactttcaggtgctcctctccgatagatacttcaacaaaacatgcgggctctgtgggaactttaatatattcgctgaagacgattttatgactcaggaaggaactcttacatccgatccttatgatttcgccaactcatgggccttatctagtggggaacagtggtgtgaacgggcttctcccccttcctcctcctgcaatatctcttccggggagatgcagaagggactctgggaacagtgtcagctgctaaaaagtactagtgtttttgcccgatgccaccctcttgtggatccagaaccattcgttgccctctgtgaaaagacactatgcgaatgtgcaggaggactggaatgtgcttgtcccgctttactggagtatgccagaacatgtgcacaggaagggatggtcctgtacgggtggacagaccattctgcatgttcaccagtgtgtccagctgggatggaatatagacagtgtgtttcaccctgcgcgcgcacatgtcaaagtttacatatcaatgaaatgtgccaggagcggtgcgtcgatgggtgttcatgccctgaaggacagcttctcgatgagggactttgtgtggaatccacagaatgtccttgcgtccattcaggaaaacgctaccctcccggaacatccctctctagagattgtaatacatgtatctgcagaaattctcagtggatatgctcaaatgaggagtgtcctggagagtgcctggtcacaggacagtctcactttaaatctttcgataacagatattttacattctccggaatttgtcaatacctgctagcaagagattgtcaggaccactccttctctattgtcatagaaacagttcaatgcgccgatgatcgagatgcagtgtgtactcgtagtgtcacagtacggctgcccgggcttcataatagtctggtgaaattgaaacatggagcaggggtggccatggatggacaggatgtccagctaccattactaaaaggggatctcagaatacagcacactgtgacagctagtgtgcgcttgagttacggagaagatctacaaatggattgggatggacggggacggctactcgtgaaactctctcctgtgtatgccgggaaaacatgtggactgtgtgggaattataatgggaaccagggggatgattttctcacacctagtggactggccgaaccccgggtcgaagatttcggaaatgcctggaagctgcatggggactgccaggacctccagaagcagcatagtgatccatgtgctctcaatccccggatgactcggttctctgaggaggcttgcgctgttctcacttctcctacattcgaagcctgtcaccgtgcagtgagtccactcccctatctacgtaattgtcgatatgatgtctgctcatgttctgacggaagggaatgtttatgtggagccctcgcgagttatgccgccgcatgtgcaggaaggggggtccgcgttgcatggcgggaacctgggagatgtgaacttaactgtccaaaaggacaagtctatttgcagtgtgggacaccctgcaacctgacttgcagatccctgtcttaccctgatgaagagtgcaatgaggcttgcctggaggggtgtttctgtcccccagggctatacatggatgaaaggggagattgcgtgcccaaagcccagtgtccctgctattatgatggggagatcttccagcccgaggacatttttagtgatcatcacactatgtgctattgcgaggatgggtttatgcattgtacaatgtccggggtacctggatcactcctgcccgatgccgttctatcttcacctctgtctcatcgctcaaagcgctcattgtcatgtcggcctcctatggtgaaattagtttgtcccgctgacaatttgagggcagaaggactagaatgcactaaaacatgccagaactatgatcttgagtgcatgtctatgggatgtgtctctggatgtctctgccctccagggatggtgaggcatgaaaatcggtgtgtagccctggaacggtgtccctgtttccaccagggaaaagaatatgcccccggggaaactgttaaaataggatgcaatacatgtgtgtgtcaggatcggaaatggaattgcactgatcatgtttgcgatgcaacttgctcaacaataggaatggcacactatctaacatttgatggacttaaatacctcttccctggagaatgtcagtatgtactggttcaggattactgtggatctaaccccggaactttccgcatcctcgtagggaacaaaggatgttcccacccctcagtaaaatgcaaaaaacgagtgactatccttgtcgaggggggagaaattgaactgtttgatggagaagtcaacgttaaacgcccaatgaaagatgaaactcatttcgaagtggttgagagtgggagatacataatcctgctgctcgggaaggcattatcagtagtatgggatcgccacttgtctatatccgtggtcttgaagcagacttaccaggagaaagtttgcgggctgtgtggaaacttcgatggaatccagaataacgatctcacttcttccaatctgcaggtggaggaagatcctgtggatttcgggaactcctggaaagtctcctctcagtgtgcagatacaaggaaagtgccccttgattcctccccagccacatgccacaataacataatgaaacagacaatggtcgactcttcttgtaggatccttacatccgatgtattccaggattgtaacaaactcgttgatcccgaaccctatctggacgtgtgtatatatgatacttgttcctgcgagtctatcggagattgcgcttgcttctgtgatacaatagctgcctacgcccatgtgtgtgcacagcatggaaaagtagtgacatggcgaactgctacactctgtcctcagagttgcgaggaacgaaacctgcgggaaaatgggtatgaatgtgaatggagatacaacagttgtgcacctgcctgtcaggtgacatgtcagcaccccgagcctctcgcttgccctgtgcagtgtgtggaaggatgccacgcccattgccctcctgggaaaattcttgatgagcttttgcagacatgtgtggatcctgaagattgtcctgtttgtgaagtggcaggacggagattcgcatctgggaaaaaagtgacactcaacccatcagatcccgaacactgccagatctgtcattgtgatgtggtgaacctcacatgcgaagcttgccaggagccaggaggactcgtggtacctcccactgatgcccccgtgagtcccacaactctctatgtcgaagatatcagtgagccacccctccatgatttttattgttcccgactgctggatcttgtatttctcctggatggatctagtcggttgtctgaggcagaattcgaagtgctcaaagccttcgtcgtggacatgatggaacggctacggatcagtcagaaatgggtccgcgtggcagtggtagaatatcacgatggatcccacgcatatatcgggcttaaagatcggaaacggccaagtgaattacggaggatcgcctctcaagtaaaatatgccggatcacaggtcgcctccacatctgaagtcctaaagtacactctctttcagatcttttctaagatagatcggccagaggcttctcgaataacactcttgctcatggcttcccaggagcctcagcggatgtcccgcaattttgttcggtatgtccagggattaaagaaaaaaaaagtcatcgttatacctgtcggaatcgggcctcacgccaacctcaagcagatcaggctcattgaaaaacaggcccctgaaaacaaagcctttgtgttgtcaagtgtggatgagcttgagcagcagcgcgacgaaatagtgtcttacctctgtgatctcgcaccagaagctcccccccccacattgcctccagatatggcgcaggttacagtcggacctgggctcctaggggtttcaacactcggacctaaaagaaactcaatggtgttggatgtcgcgttcgtgctcgaagggtctgataaaattggagaagccgactttaatcggtctaaagagttcatggaagaagttatacagaggatggacgtcggacaggacagtattcacgttacggtacttcagtattcctatatggttacagtcgagtatcctttttccgaagcccagtccaaaggagatatactgcagcgggtgcgcgaaatccggtatcagggagggaataggactaacactgggctagcactaagatatctctctgatcactcattcttggtttcccagggggacagggaacaggcccccaacctagtctatatggtgactggaaaccccgcgtctgatgaaataaaacggctaccaggggacatacaggtcgtacccatcggagtgggacctaacgctaatgttcaggaactcgaaaggattggatggcccaacgcgcctatccttatccaggattttgagactctgcctcgggaagccccagatctagtgctccagaggtgttgtagtggggaaggactgcagatcccaactctttctccagctcccgattgctcccagcccttggatgttatcctgctattggacggatcctctagtttccctgcgagttactttgatgagatgaaatctttcgcaaaagccttcatatctaaagctaatatcggacccaggctgacacaggtatctgtgcttcagtacggatccatcactacaatagacgtaccctggaatgttgtacccgaaaaggctcacctgctgtccttagtggatgtcatgcaaagagaagggggaccttctcagataggggacgctctcgggttcgctgtgcggtacctcacatctgaaatgcacggagcccggccaggagcatctaaggcagtggttatcctggttacagatgtgtccgtggattcagtggatgccgctgctgatgccgcaagaagtaaccgggttacagtgtttcccataggaatcggagatcggtatgatgctgctcagctacggatcctcgcaggaccagcaggagattctaatgttgttaaattacagcgaatagaggacctacctacgatggttacactcggaaactctttccttcataaattatgttcagggtttgtccggatttgtatggatgaagatggaaacgaaaaacgccccggagatgtgtggacacttcctgatcagtgccatactgtgacatgccagcctgatgggcaaactctcctgaaatcacaccgggttaattgtgataggggacttaggccttcttgtcctaattcgcaatcaccagtgaaagtggaggagacttgcgggtgcagatggacatgtccatgtgtatgcacagggtcttccacaaggcacatcgtgacatttgatgggcagaacttcaagttaacaggatcttgctcttatgtacttttccagaataaggaacaggatttagaagtaatactccacaatggggcctgctctcctggagcccgtcaggggtgtatgaaaagtatcgaagtaaaacactctgccttatctgttgaactccatagtgatatggaagtgactgtgaacgggagactcgtcagtgtgccttatgtgggaggaaacatggaagtgaacgtctatggagccatcatgcacgaagtgcgcttcaaccacttggggcacatattcacatttactccccagaacaatgaattccagttgcagctgagtcctaaaactttcgcttctaaaacatatgggctgtgtggaatttgtgatgaaaatggagcaaatgattttatgctaagagatgggactgtcacaactgattggaaaacacttgtgcaggagtggacagttcagcggccaggacagacatgtcagcccattcttgaagaacaatgtctggtgccagactcatctcactgtcaggtgctgctcttaccactctttgccgagtgccataaggtgctcgcaccagccacgttctatgccatttgccagcaggattcgtgtcatcaggaacaggtgtgcgaagtaattgcttcttacgcccacctgtgtcgcacaaacggggtttgtgtcgattggagaacacctgatttctgtgcaatgtcctgtcccccgtccctcgtatataatcattgtgaacatgggtgcccacggcattgtgacggaaacgtatcttcatgtggagaccatcctagtgaagggtgtttttgtcctcccgataaggtgatgttggaaggatcctgcgtacccgaggaggcctgcactcagtgcataggagaagacggggtgcagcatcagtttctagaagcttgggttcccgatcatcagccctgccagatttgtacttgtttatccgggagaaaagtgaactgtactactcagccatgtcccactgccaaagctcccacatgcgggctttgcgaagtggcacggctacgacagaatgcagaccaatgttgtcctgaatatgagtgcgtgtgcgatccggtgtcgtgcgatcttcctcctgtgccacactgtgaacgcgggttgcagcctacactaacaaaccccggagagtgtagacctaatttcacttgcgcatgccgcaaagaagaatgtaaacgagtgtctcctccttcctgtcctccacaccggttacctactcttcgcaaaactcagtgttgtgatgaatacgaatgtgcctgtaactgcgtgaattctactgtgtcgtgccctctaggatatctcgcttccactgcaactaatgattgtggatgcactactacaacttgcctcccagataaggtgtgcgtccatcggtccactatatatcctgtggggcaattttgggaagaagggtgtgatgtgtgtacttgtacagacatggaagatgcagtgatgggactccgcgtcgcacaatgctcgcagaaaccatgtgaagatagttgtcgctctgggttcacatatgtactgcacgagggagagtgttgcggaagatgcttgcctagtgcctgcgaagtggtcacagggtcgccacgcggagattcccaatcttcttggaaatctgtggggtcccagtgggcttctccagaaaacccctgtctgatcaatgaatgtgttcgcgtgaaggaagaagtgttcatccagcagcgaaacgtgtcatgcccacagctggaggtcccagtgtgtcccagtgggtttcagctatcttgtaaaacatcagcctgctgtccatcttgccgttgcgaacgaatggaagcttgcatgctcaatggaacagtaataggacccggaaagacagtgatgatcgatgtgtgtactacatgcagatgtatggtgcaggttggagtcatctccgggtttaaactggaatgccgcaaaacaacatgcaatccgtgtccactaggatataaagaagaaaacaatactggagaatgctgcgggaggtgtctgcctactgcctgtacgatccagctccggggaggacagatcatgacactgaaaagggatgagactctccaagatgggtgcgatacacatttttgtaaagtgaacgaaaggggagaatacttctgggagaaacgagttacaggatgcccccctttcgacgaacacaaatgtcttgccgagggaggaaagataatgaagattcccggaacttgttgtgatacatgtgaagagccagaatgtaacgatataacagcacgactccagtacgtcaaagtggggtcttgcaaatcagaggttgaggtggatattcactattgtcaggggaaatgtgccagtaaagctatgtattctattgatatcaacgatgtccaggatcagtgctcatgctgctctcccacacgaacagagcccatgcaggtcgctctccactgtacaaatggatccgtagtataccatgaagtcctcaacgccatggaatgtaaatgttcgccccgaaaatgcagtaag

SEQ ID NO: 21305 - DNA, 8439 bp, Artificial Sequence
  Description of Artificial Sequence: Synthetic coding sequence
atgattccggctagattcgcgggcgtgctgcttgctcttgctctgatactcccaggcacactgtgcgctgaagggacaaggggcagatcctccacggccaggtgctcactgtttggttccgactttgtgaatacctttgatgggtcaatgtattcctttgccggttactgctcttacttgttggccggtggctgccagaaaaggtcattctctatcattggggactttcagaacggcaaacgagtgtctctcagcgtgtatctcggggagtttttcgacatccatctctttgtcaatgggaccgtgacacaaggcgaccaacgcgtcagcatgccatacgcttctaaaggcctgtacctggaaacagaggctggatactataagctttctggcgaggcgtacggattcgtcgctaggatcgacggtagtggcaattttcaggtgctgttgagcgaccgctattttaacaaaacctgcggactgtgtggaaacttcaacatcttcgccgaggacgactttatgacacaggagggcacacttactagcgacccgtacgactttgcaaactcatgggcactgagttccggggagcagtggtgcgagagggcaagtccaccgtcaagctcttgcaacatcagtagtggagagatgcagaaaggtttgtgggagcagtgccagttgttgaaatccacctctgtctttgctcggtgtcatcccctggtcgaccctgaaccttttgtggccctctgcgagaagacgctctgtgagtgtgccgggggccttgaatgcgcttgccctgcgttgctggagtatgcgcgcacctgtgcccaggaggggatggttctgtatggctggacagaccacagtgcatgctccccagtgtgcccagccggcatggaatacaggcagtgcgtgtccccctgtgccaggacatgtcaaagtctgcacattaatgagatgtgtcaggaacgctgcgttgacggttgttcatgcccggaggggcagctcctcgacgagggcctgtgtgtggagagtactgagtgtccttgcgtgcacagcggtaaaaggtaccctccgggcacatcactctctcgcgactgtaacacatgcatctgccgcaattctcagtggatctgtagtaacgaggagtgcccaggcgagtgcctggtaacggggcagtctcattttaagagctttgacaaccggtacttcaccttcagcggaatctgtcagtatctgctggctagggactgccaggatcactccttctcaatcgtcatcgagaccgtgcagtgtgcggacgatcgagacgcagtatgcacacggagcgtgaccgtaagactgcctggactgcataacagtttggtaaagctgaagcatggcgcaggcgttgcgatggacgggcaggatgtgcaactccctctgctgaagggagatctgagaattcaacatacagtaaccgccagcgttcgcctctcttatggggaggacctgcagatggactgggacggacgcggaaggctcctcgtgaagctcagtcctgtgtacgctgggaaaacatgtggtctctgcggtaactataacggcaaccaaggcgatgattttttgacccccagcgggttggcggaacccagggttgaagattttgggaatgcatggaaactccatggcgactgtcaggatctgcagaagcagcatagtgatccatgtgcacttaaccctcgcatgacacggttcagtgaagaggcctgtgctgtgctgacttctccaacatttgaggcctgtcacagagccgtgtcacccctgccctacctccgaaactgccgatacgacgtgtgttcttgttccgacggcagggaatgcctgtgcggcgccctggcctcctatgcagcagcttgcgcaggacggggagtgcgggtcgcttggcgggaacctggccggtgtgagttgaactgtccgaagggccaagtttatctgcagtgcggtaccccttgcaatctgacgtgccgatctctctcctatcctgacgaggagtgtaatgaggcctgcctggagggatgcttctgcccacccggcctttatatggacgagcgcggcgattgcgtccccaaagcccaatgcccatgctactacgacggggaaattttccagccagaagatattttcagcgaccatcacacaatgtgctattgcgaggacggatttatgcattgcactatgagcggcgtacctggaagtctgcttccagacgccgtgctgagtagtccactgagccaccgcagtaagaggtccttgtcctgcagaccaccaatggtcaaactcgtttgtccggccgacaacctgcgcgctgaagggctggaatgcacaaagacttgccagaactatgacctggagtgtatgtctatgggctgcgtgagcggatgtctttgtccccctgggatggtgcgacacgaaaaccgatgtgtagccctggagcggtgtccatgcttccaccaggggaaagaatatgccccaggggagactgtgaagattggctgcaacacctgcgtgtgccaggacagaaagtggaactgtactgaccatgtgtgcgacgctacatgctctacaatcggaatggcccactacctgacattcgatggactgaaataccttttccccggagagtgccagtatgtcctggtgcaggattactgtggaagcaaccctggcaccttcagaatccttgtggggaataagggttgctcacatccctcagtcaaatgtaagaagcgcgtgaccatcctggtagaaggcggcgaaattgagctcttcgatggtgaggtgaacgtgaagcgaccaatgaaagatgagacacattttgaagtcgttgagtccggaagatacatcattttgttgctcgggaaagctctcagcgtggtttgggacagacacctttccatatcagtggtgttgaagcagacataccaggagaaggtgtgcggactgtgcggtaactttgacggaatccagaataacgacctcacatctagtaacctgcaagtggaggaagacccggtcgattttgggaactcatggaaagttagttcccagtgtgccgacacaaggaaagtccccttggacagctcccctgcaacctgccacaataacataatgaagcaaacaatggtcgacagctcctgccgaattttgacaagtgatgtgttccaagactgcaacaagctggttgaccctgagccttacttggatgtgtgtatctacgacacatgttcttgtgagtctataggggattgcgcatgcttttgcgatacaatcgccgcttatgcccacgtatgtgcccaacatgggaaggtcgtcacatggaggaccgctaccttgtgcccgcagagttgtgaggaacgcaatctgcgggaaaatggatacgagtgcgaatggagatataattcctgcgctccagcatgtcaggttacatgtcagcaccccgagcctctggcatgtcccgttcaatgtgtggaggggtgtcacgcacactgcccacccgggaaaatactggatgagttgttgcagacctgtgtggacccagaggactgccccgtgtgtgaagtggctggccggagattcgcgtccggtaagaaagtcactctcaatccatccgacccagagcactgccaaatctgtcactgtgacgtagtgaaccttacttgtgaggcctgccaagagcctggcggcctcgtggtgcctccaaccgatgcccccgtgtctccaactaccttgtatgtggaggatatcagcgagccaccactgcacgacttctactgctcccgcctcctcgacctggtgtttctgctggatgggagcagtcggctgtcagaggcagagttcgaggtactgaaggctttcgtggttgacatgatggagcgactgagaatctctcagaagtgggtgcgagtggctgtagtcgagtaccacgatggctcccatgcctacattggcttgaaggaccgcaaacgcccctctgagttgcgccgcattgcctctcaagtcaagtacgcggggtcccaggttgctagtacgagtgaagtattgaagtacaccctttttcagatcttttccaagattgaccgcccggaggcctccagaattacgctgctcctgatggcatcccaagaacctcaaagaatgagtaggaactttgtgagatacgtgcaaggcctgaagaaaaaaaaggtgatcgtgataccagtcggaatcggcccgcacgctaatctgaaacaaattaggctgattgagaaacaagctccagaaaacaaggccttcgtgctgagttcagtggacgaactcgagcaacagcgggatgaaatagtgtcttacctgtgcgaccttgctcccgaagccccgccccctactctccccccagatatggctcaggtgactgtaggccctgggctgctcggcgtgtcaaccttggggcccaagcggaatagtatggtgctcgacgtcgctttcgtactcgaaggctccgataaaataggggaagcagactttaaccgatcaaaggaattcatggaggaggtcattcagagaatggatgtaggccaggactctattcacgtgactgtgttgcagtactcttacatggttaccgtggaatatcccttctctgaagcacagtccaaaggcgacatcttgcagcgggtgagagaaattagataccagggtggcaatagaaccaatactggcctggcacttagatacctcagcgaccactctttcctggtgtcccagggagacagagagcaggcccctaacctcgtgtatatggtgacaggtaaccctgccagcgacgagatcaaaagactccccggggatatacaggtagtaccaataggagtgggcccaaatgctaatgtccaggagctggaacggataggctggcctaacgccccaattctgatccaggactttgagacgctgccccgggaggcccctgatctcgtgttgcagcgctgttgttccggggagggccttcagatccccactctctcccccgcacctgactgtagtcagcccctggacgtgatcctcctgctcgatgggtcttccagcttccccgcctcctatttcgatgaaatgaagtctttcgcaaaagcttttatatctaaagccaacattggccctcggctgacccaagttagcgttctgcagtacggctcaatcacaaccattgacgtgccatggaacgtcgtgcctgaaaaggcgcatctgttgagccttgtagatgtgatgcagcgcgaaggcggccccagtcaaattggcgacgcactggggtttgcggtgaggtatctgacgagcgagatgcacggggcccgccccggagcttctaaagccgtcgtgattctcgttacggacgtgtctgtcgacagcgtggacgctgccgcagacgcggcccggagcaatagggtgaccgtatttcccattgggatcggggaccgctatgatgctgctcagctccgcatattggccggacctgccggagattccaatgtagtgaagctgcagaggattgaggacttgccgactatggtcaccctgggcaactcattcctgcacaagctgtgttcaggattcgtgaggatatgcatggatgaagatggcaatgaaaagaggcccggggacgtctggaccctgcctgatcagtgccataccgtcacctgccagcccgatggacagaccttgctgaagagtcatagagtgaactgcgaccgaggattgaggccctcatgtcccaattctcaaagcccagtcaaagtggaggagacctgtggctgtcgatggacatgtccttgcgtttgtaccggctcatccactagacatatagtgaccttcgatggccagaatttcaaactgaccgggagctgcagctacgtcctgtttcagaacaaggaacaagatctggaagtgattctccataatggtgcatgctctcctggggctaggcagggttgcatgaagagcatcgaggtgaagcactccgccctgtctgtcgaactgcacagcgacatggaggtaacggttaacgggcgcttggtttcagtcccctatgtgggcgggaatatggaggtgaacgtatacggtgccatcatgcacgaagtacgatttaatcatctcggccacatctttacgtttacaccccagaataatgaattccagctgcaactctctccgaagacgtttgcttccaaaacttatggtctgtgcggcatctgtgatgagaacggtgctaacgactttatgctccgggatggaactgtaacaactgactggaaaacactggtacaggaatggactgtacagcgccctggccaaacttgccagcccatcctggaagagcagtgtctggtcccagacagctcacactgtcaggtgctcttgctcccactcttcgccgaatgccacaaggtgcttgcccctgctactttctatgccatttgccaacaagacagctgccaccaggaacaggtgtgcgaagttatcgccagttacgcccacctctgccgcactaacggcgtgtgtgtcgattggcgcactcccgacttttgcgcaatgagctgcccaccctctctggtgtataaccactgcgaacacggatgcccgcggcactgcgatggaaatgtctccagctgcggagatcacccgagtgagggatgcttttgccctcccgataaagtgatgcttgaaggcagctgcgtgcccgaggaagcatgtacacagtgcataggtgaggatggcgtacagcaccagttcctggaagcctgggtccctgaccaccagccatgccagatatgcacatgcttgtccggaaggaaagttaattgtacaactcagccttgccccacggccaaggcaccaacctgcggattgtgcgaagtggcccgccttcggcagaacgccgatcagtgctgcccggagtatgaatgcgtgtgtgatcctgtgtcctgcgacttgcctccggtgcctcactgtgaaaggggcctgcagcccactctgacaaatcccggtgaatgccggcccaacttcacatgcgcctgtagaaaggaagaatgcaagcgcgtgtctcccccctcctgtcctccccaccggcttccgactctgcggaaaacccaatgctgtgatgaatatgagtgtgcctgtaattgtgtcaacagtaccgtgtcatgccccctgggatacctggctagcactgctaccaatgattgcgggtgtactaccaccacgtgcctgcctgataaggtctgcgtgcaccgaagtaccatatatcctgttggccaattctgggaggaagggtgtgacgtgtgcacttgcactgacatggaggacgccgtcatgggcctgagggtggcacagtgctctcagaaaccctgcgaagatagctgtcgatcagggtttacttacgtgctgcacgagggagagtgctgcggacgatgtttgccgagtgcctgtgaggtggtcacgggcagcccgcgaggggattcccagagttcttggaagtccgttggctctcaatgggccagccccgaaaacccgtgcctgatcaatgaatgtgtccgcgtcaaggaggaggtgttcattcagcagcggaacgtgtcatgccctcagttggaggtcccagtttgtccttctggattccagctttcctgtaagacttctgcatgttgtccgagctgtagatgcgagaggatggaggcctgcatgctcaacgggaccgttatcgggccaggtaagaccgtgatgatagatgtctgtacaacctgtaggtgtatggtacaggtaggagtgatcagcggcttcaaactggagtgccgaaaaacaacctgtaacccatgtcccttgggttacaaggaggaaaataatacaggtgagtgttgcggaaggtgcctcccgacagcctgtacgattcagctgcgaggagggcagatcatgacattgaagcgcgatgagaccctccaggatggctgtgacacgcacttttgtaaggtgaatgaacgcggagaatatttctgggaaaagcgagtgaccggatgccctcccttcgacgagcataagtgcctggcggaaggtggcaagatcatgaagatccctggtacctgctgcgacacctgtgaagaaccagaatgtaacgatatcaccgcacgattgcagtacgttaaggtaggaagttgtaaatccgaagtggaggttgacatccactattgccaagggaagtgcgctagtaaggctatgtactctatagacattaacgacgtgcaggaccaatgctcatgttgctcccccacaagaacagaacccatgcaggtggctctgcactgtactaacggctccgtggtctaccacgaagtcctgaatgcaatggagtgcaagtgctcccccaggaaatgctccaag

SEQ ID NO: 21306 - DNA, 8439 bp, Artificial Sequence
  Description of Artificial Sequence: Synthetic coding sequence
atgatcccagcccgattcgccggggtgctattggccttggctttgattctgcctggtactctctgtgctgaaggcacccgaggacgcagtagcaccgcccgctgtagtctgtttggtagcgatttcgtaaacaccttcgatgggagcatgtacagtttcgctggttattgctcatacttgctggcgggcgggtgccagaagcgtagtttctccatcattggcgatttccaaaatggcaaacgcgtatcactcagtgtctacctcggcgagttctttgatatccatctcttcgtgaacggcaccgttacacagggcgaccagcgtgttagtatgccttatgcttccaagggattgtacttggagaccgaagctggttactacaagttgtctggagaggcgtatggattcgtggctcggatagacgggtccgggaactttcaggttctgctgagtgaccggtatttcaacaagacctgcgggctttgcggcaactttaatatatttgctgaagatgattttatgacgcaagaaggaacgctgacatcagacccttatgacttcgctaattcctgggccctgagcagtggggagcaatggtgtgaacgggcttccccgcccagtagttcttgcaacatatctagtggagagatgcagaaggggttgtgggagcagtgccagcttctcaaaagcacaagcgttttcgcccgctgtcaccccctggtggatccagagccattcgttgcattatgtgagaagaccctttgcgagtgtgctgggggcttagaatgcgcctgtcctgccttacttgagtatgctcggacctgtgctcaggaaggtatggtcctctacggctggacagatcattctgcatgcagtcccgtgtgccccgcaggcatggagtaccggcagtgtgtgtccccctgtgctagaacatgccagtccctgcacattaacgaaatgtgccaggagcggtgtgtggatggatgcagttgcccagagggtcagctgttggacgagggtctctgtgttgaatcaaccgagtgcccatgtgtccacagcggcaaaaggtatcccccaggaacctccctgagcagggactgcaatacatgcatttgccgcaactcgcagtggatctgctctaacgaagagtgcccaggcgagtgtctagtgacaggtcagtcgcacttcaaatctttcgacaaccgctatttcaccttttcaggaatttgccagtatcttctcgcccgtgactgccaagaccactccttttcaattgtgatcgaaacggttcagtgcgctgacgatcgcgatgctgtgtgcaccaggagcgtgactgttagattgccgggcttgcacaactccctggtaaaactgaagcacggcgcaggcgtcgccatggacggccaggatgttcaactacccttgctgaaaggcgacttgcggattcaacataccgtgaccgccagcgtccgcctaagctacggggaggatctccagatggactgggatggtcgcggtcggctgctcgtcaagcttagtcctgtctacgccggaaagacttgtggcctgtgcggaaattataacgggaatcaaggcgatgacttcctgactcccagcggattagctgagccacgggttgaggattttggaaatgcatggaaactgcatggagactgtcaggatctgcagaaacagcacagcgacccatgcgctctgaatccccgaatgaccagattctcagaagaggcgtgtgcggttcttacttcgcccacctttgaggcctgtcacagagccgtgtccccgctgccctaccttaggaattgccggtatgatgtctgctcgtgctcagatggcagggaatgtctctgcggcgctttggcttcctacgctgcagcttgcgccgggcggggagtccgtgtggcctggagggagccaggacgctgcgagctgaactgccctaaaggtcaggtttatttgcagtgcggaacgccctgcaaccttacctgccgcagccttagctacccggacgaagagtgcaacgaagcttgcctggagggctgcttctgtccaccgggactatatatggatgagagaggagactgtgtgcctaaggctcagtgtccctgttattatgacggagagatttttcaacctgaagatatattctcagatcaccatacaatgtgctattgcgaggacggctttatgcactgtacgatgtcgggcgtgcccggaagcctgctgcccgatgcagtcttgagttcgccgttaagtcatcggtccaagcggtccctctcttgcaggccccctatggtgaaactggtgtgtccggcagacaatctcagggctgaaggcctggagtgtaccaagacatgccagaactatgacctcgagtgtatgtctatgggatgcgtttctggttgcctgtgcccaccaggaatggtgcgccatgagaatcgatgcgtcgctctcgagcgctgcccttgttttcaccagggaaaggagtatgccccgggagaaaccgtcaaaatcgggtgcaacacctgtgtgtgccaggacagaaaatggaattgtacagaccacgtatgtgacgctacttgttccactatcggcatggctcattatttaaccttcgacggcttaaaatacttgttcccaggcgagtgtcagtacgtactggtccaggattattgcggcagcaatcctggaacctttagaatccttgtaggcaacaaaggctgctcccatccttccgtgaagtgtaagaaacgagtcaccattctggtggaagggggtgaaattgagctgttcgatggtgaagtgaatgtgaagcgcccaatgaaagatgagactcattttgaggtggtggagagcgggcggtatattatcctactactaggaaaggccttgagtgtagtgtgggaccgacatttgtcgatttccgtggtgctgaagcagacctaccaggagaaggtttgcggcctttgtgggaattttgacgggatccagaacaacgatctgacttcctccaatcttcaggtggaggaggaccccgtggacttcgggaattcatggaaggtgagctctcaatgtgcggatactcggaaggtgcccctggactcgtccccagctacttgtcacaacaacatcatgaagcagactatggtggactcctcctgtaggatccttacctcggacgtgttccaggattgtaataagcttgtagaccctgaaccctatctggatgtatgtatttatgatacttgttcctgtgagagtatcggagactgcgcttgtttctgtgacaccatcgccgcctatgctcacgtttgtgcccaacatggtaaagtcgtgacttggcggaccgctactctctgcccccagtcatgtgaggagcgtaacctccgagaaaatgggtacgaatgcgaatggagatacaattcgtgtgcaccagcctgccaagtgacctgccaacatccagaacctttggcatgtcccgtccaatgtgttgaggggtgtcacgctcactgtccaccaggaaagatcttggacgaattgctgcagacctgcgtcgaccccgaggactgtcctgtgtgtgaagtggctggcagaagatttgccagcggcaagaaggtcaccctgaaccctagcgatccggaacattgtcagatatgtcattgtgacgtggttaacttaacatgcgaagcatgccaggagccgggaggcctcgttgtgcctcctaccgacgccccggtctctcccacaaccttgtatgtggaagatatctccgagccaccccttcatgatttttactgctctcggctcctggacctcgtgttcctccttgacggaagtagccgcctttcagaagctgagttcgaggtgttgaaagcttttgttgtagatatgatggaacggctgcgcatcagccagaaatgggtgcgagtggcggtagttgagtatcatgacggatctcacgcctatattggacttaaagaccgaaagcgcccgtctgaactgagaaggatcgcctcgcaagttaagtacgctggctcccaggtcgcaagtacttccgaggtcctcaaatacaccttgttccaaatcttttccaagatagatcgaccagaagcttcccgaataaccctgctgctcatggcatcccaagagccccagaggatgagtcgcaacttcgtgagatacgttcagggcctcaaaaagaagaaggttatagtgatccccgttggaataggcccacatgccaatctcaagcagatccgtcttattgagaagcaggctcccgagaataaagcttttgtgttatccagcgtggacgagctggagcagcagagagacgaaatcgtgagctacttgtgtgatttagcacccgaagccccgcctcccacgctgccgcctgatatggcccaagtgactgtgggtcctggtttactcggcgtatcaaccctcggtcctaagaggaactccatggtgctcgatgttgcctttgtcctggaagggtccgataagattggcgaggctgattttaatcgtagtaaagagttcatggaagaagttatccagcggatggatgtgggacaggacagcatacacgtgacggtactgcagtactcttacatggtcaccgtggaatatcctttttcagaagcccagtcaaaaggcgatatacttcaaagggtccgagaaatcaggtatcagggtggaaatagaactaacaccggattggccctaaggtatttgtctgaccattctttcttggtttctcagggcgatagagagcaagcccctaatttggtttatatggtgacaggcaaccctgcctccgacgaaattaagagactgcctggtgacatccaggtggtcccgattggcgtggggccgaatgctaatgttcaggaactcgagcggattggctggcctaatgcccctatcctcattcaggacttcgagaccctcccacgggaagctcctgacctcgtgctccagaggtgttgctccggtgaggggctgcaaatcccaaccttgagcccagcccccgactgtagtcagccactggatgttattctgctgctcgacggctcaagctccttccctgcctcttactttgacgagatgaaaagcttcgccaaagcttttatatctaaggcaaatatcggaccccgattgacacaggtgagcgttctgcagtacggttctataaccactattgatgtgccatggaacgtcgtgcctgagaaagcacaccttctctccctggttgacgtgatgcagcgggagggtggtccgagccagatcggagatgcgcttggcttcgcggttcggtacctcacaagcgaaatgcatggtgcccgaccgggagcgtctaaggctgtggtcatactcgtgacagacgttagcgtggattctgttgacgccgctgccgacgcagcgcgcagtaacagagtgactgtttttcccataggaataggagaccgctatgatgcagcacagctccggatcctggccgggccagcaggagattctaacgtggttaagctgcagagaatcgaggacttgcccaccatggtgaccctgggcaactccttcctgcacaagttgtgctcaggttttgttaggatatgtatggacgaagatgggaacgaaaagaggccaggcgacgtgtggacgctccccgaccagtgccacaccgtgacatgtcaacctgatggccagacattgctcaagtcgcaccgggtgaactgtgacaggggcctgcggccgagctgccctaacagccagtccccggtgaaagtagaggaaacctgcgggtgccggtggacctgcccttgcgtgtgcacgggaagcagtacacggcatatcgtgaccttcgacgggcaaaatttcaagctcacgggtagttgtagttatgtccttttccagaataaggagcaggatctggaggttattttgcacaacggtgcatgtagccctggagcccgtcaaggctgtatgaaatcaatcgaggtgaagcacagcgccctctcggtagagctccactcagacatggaggtgacagtgaatggaaggcttgtgtcagtgccgtatgtcggaggaaacatggaggtgaatgtctatggtgcgatcatgcatgaagtgagatttaaccacctgggccatatcttcaccttcaccccccagaacaacgagttccagctccagctcagcccaaagactttcgcttctaaaacttatgggctgtgcggaatctgcgatgagaatggagctaatgatttcatgcttcgggatggaacagttactactgattggaagaccctggtgcaggaatggacggtgcagaggcctggccagacatgccagcccatcctggaagaacagtgcctggttcctgacagttcccactgtcaagtgttactactgcctttgttcgccgagtgtcataaagtccttgccccggctactttctatgccatttgccagcaagactcctgccaccaggagcaggtgtgcgaagtcatcgccagttacgctcatctctgtcgaacaaacggagtctgcgtggactggcgcacgcccgacttctgcgctatgtcatgtcctccttccttggtatacaaccactgtgaacacgggtgtcctaggcactgtgatggaaatgtgtcttcctgtggtgatcaccccagcgagggctgcttctgtcctcctgacaaggtgatgctagaaggatcttgcgtgcccgaagaagcctgcacgcaatgtatcggggaggacggggtgcagcatcagtttctggaggcctgggtgccagatcaccagccttgtcagatctgtacctgtctctccggtcggaaggtgaactgcaccacacagccttgcccaaccgccaaggctcctacctgtggactgtgtgaggtggccagactgcgccaaaatgctgaccagtgttgtcctgaatatgagtgcgtttgtgaccccgtgagctgcgatctgcccccagtcccacactgcgagcgcggactgcagccaactctgacgaatccaggcgaatgcaggccaaatttcacttgtgcttgtaggaaagaagagtgcaaacgggtatccccacctagttgccctccccatagactgcccactctgcggaaaactcaatgctgtgatgaatacgaatgcgcctgcaactgtgttaacagcactgtatcttgtcccctggggtatttggcctccaccgccaccaacgactgcggttgtacaacaacaacttgcctgccagataaggtgtgtgtccaccggagtactatctatcccgtcggacagttttgggaggagggctgcgacgtgtgcacctgcaccgacatggaggacgcagtgatgggtctcagagtggcgcagtgcagtcagaaaccatgtgaggactcatgccgttccggatttacatatgtgctgcacgagggggaatgttgtggccggtgtcttcccagtgcttgcgaagttgtgaccgggtccccaaggggggacagccagagttcctggaaaagcgttgggtcgcagtgggcatcccccgaaaacccttgccttattaatgagtgtgtacgggttaaggaggaagtgtttattcagcagcgaaacgtatcttgtcctcagttagaggtgccggtttgtcccagtggtttccaactttcttgtaaaacctccgcctgttgccccagctgccgctgtgaacgcatggaagcgtgcatgcttaatggaacggtgattggccccggcaagaccgtcatgattgacgtctgcacaacgtgtcgttgcatggtccaggtgggggttatctcaggcttcaagcttgagtgccgtaagacaacatgtaacccctgtcccctggggtataaggaggagaacaatacaggggaatgttgcgggcgatgtttgccgactgcttgtactattcagcttcgcgggggtcagatcatgaccttgaagagagatgagactcttcaggatgggtgcgacacacacttttgcaaagtgaatgaaaggggcgaatacttttgggaaaagagggtgacagggtgcccaccattcgacgagcacaaatgtctggcggaggggggaaagataatgaagattcccgggacatgctgcgacacatgtgaagagccggagtgtaacgatattacagcgagattgcagtacgttaaggtggggtcgtgcaaatcagaagtggaagtagacatccactattgccaaggaaaatgcgccagtaaagcaatgtactcaatagatatcaatgacgtacaggatcaatgttcctgctgctcacctactcgcacagagccaatgcaggttgccctgcattgcaccaatgggtctgtggtgtatcacgaagtgctgaatgccatggaatgcaagtgcagcccccgcaaatgttcaaag

SEQ ID NO: 21307 - DNA, 8439 bp, Artificial Sequence
  Description of Artificial Sequence: Synthetic coding sequence
atgattcccgctcggttcgccggagtgctgctggctttagctctaatcctgcctggcactctctgtgctgaagggacccggggcaggagttcaactgcaagatgcagcctgtttggcagtgatttcgtaaatacctttgatggatcaatgtattcttttgcaggctactgtagctaccttctggctggtggctgccagaagaggagcttttctataatcggtgacttccaaaacggaaagcgcgtgtccttaagcgtgtatctgggtgagtttttcgatatacatctgttcgtcaatggaactgtcacccagggggaccagcgggtatccatgccctacgccagcaaaggactttatttggaaacagaggccggatattataagctctccggggaggcatacggcttcgtagccaggatcgatggaagcgggaacttccaagtgctgctgtccgatagatatttcaacaaaacatgtgggctgtgtggaaactttaacatctttgccgaagacgattttatgacccaggaggggacgttgaccagtgatccttacgacttcgccaattcgtgggcactgtcaagcggggagcaatggtgtgaacgcgcctcgccaccgagttccagttgcaacatcagtagcggcgaaatgcagaagggcctgtgggagcagtgtcagctgctcaaaagtacctcggtgttcgctcgatgtcatcctctggtcgatccagagcctttcgtagctctgtgtgaaaagacactgtgtgaatgcgcgggcggcctggagtgtgcttgcccggctctgctggaatacgcgagaacctgtgctcaagagggcatggtgctctatgggtggactgaccattctgcatgctcacctgtctgtcccgctggtatggagtaccgacagtgcgtgagtccttgtgcccggacttgccagtcgctgcacatcaatgagatgtgtcaagagcgatgtgtggacggctgttcatgcccggaagggcagctcctggacgagggattgtgcgttgaatctacagaatgtccgtgtgtgcattctgggaaaaggtatccgccgggaacttccttatctagagactgtaatacctgcatctgtcggaattctcagtggatctgtagcaacgaagagtgcccaggggagtgtctggtgacaggacagtcacacttcaagtctttcgacaataggtacttcacattttcagggatttgccagtatctactcgcccgagattgtcaggaccattcattttcaatcgtgatcgagactgtacagtgtgctgacgacagggatgccgtgtgcacccgtagtgtcacagtgcgtctgcccggtttgcacaattccctggtcaagctcaaacatggtgctggcgttgcaatggacggacaagatgtccagctcccactccttaaaggggaccttcgcatacagcatactgtcacggcctccgtgagactgagctacggggaagacttgcaaatggattgggacgggcgtggcaggcttcttgtcaaattgtctcctgtgtatgcaggtaagacgtgcggactgtgtggtaattacaatggcaatcagggggacgacttcctgacacccagcggactggcggagccaagagttgaggattttggtaacgcctggaaactgcacggggactgtcaggatcttcagaaacagcactcagatccatgtgcactaaatccccggatgacacgattcagcgaggaggcctgcgcggttctgacgagtccaacgtttgaagcttgccacagagccgttagtccgttgccgtacctgcggaactgtagatacgacgtctgctcctgttccgacggccgcgagtgcctttgtggggccctggcctcttacgccgccgcctgtgccggaaggggcgtgagagtggcctggagggaaccgggcagatgtgaactcaattgtcctaaagggcaggtgtacttacaatgcggaaccccttgcaacctgacttgcagatccttaagttaccccgacgaggaatgtaacgaagcatgcctggagggatgcttctgtccacctggcctttacatggatgagaggggggactgtgtacccaaagcccagtgtccatgctattacgacggggagatatttcaaccagaggatattttttccgaccatcatacaatgtgctactgtgaggacggctttatgcactgtacgatgagcggtgtgccggggtctctgctcccagacgctgtcctttcctcacccctcagtcatagatccaagcgatccttaagctgtcggccgcctatggttaaactggtatgccctgccgataaccttagggctgagggcttggagtgcacaaagacttgccagaactacgacctcgaatgcatgtcaatgggctgcgtgtcagggtgcctttgtccgcccggaatggtacggcacgaaaataggtgcgtggctctggaaagatgcccttgcttccaccagggtaaagagtacgctcccggagagactgtgaagatcggttgtaacacctgcgtatgtcaggatcgcaagtggaattgtaccgatcacgtgtgcgatgcaacttgctctaccattggtatggctcactacctgacgttcgacggactcaagtacctgtttccgggtgagtgtcagtatgtgctggtgcaggactattgcgggagcaatcccggcaccttcagaatccttgtcgggaataaaggctgttctcacccttcagttaagtgcaagaagcgcgtgacaattttggtggagggcggcgagatcgagctttttgatggggaggtaaacgtcaagcggcccatgaaagacgagacccactttgaagtggtggagtctggacgctacatcattctccttttgggtaaagctctgtcagttgtgtgggatcgacatctgagcatcagcgtggtgctgaagcaaacttatcaggaaaaggtgtgcggactgtgtggcaattttgacggaattcagaataatgacctcacgtcttccaacctgcaagtggaggaggaccccgtggactttggcaacagctggaaggtttcaagccagtgcgccgacacacgcaaagtgccgctcgactcttccccagcgacatgccacaacaatatcatgaagcagacaatggtagatagctcctgcagaatccttaccagtgacgtcttccaagactgtaacaagttggtggacccagaaccgtaccttgacgtctgcatttacgatacgtgttcttgcgagagcatcggagactgcgcctgcttctgcgatactatcgccgcctacgctcacgtttgtgcgcagcacggcaaggtggtgacttggcggacagctacgctgtgtcctcagagttgcgaagagcggaacctcagggaaaatgggtatgaatgcgaatggcgttacaactcatgcgcccccgcttgtcaagtcacatgtcaacacccagagcctttagcctgcccagttcagtgtgtggaaggatgtcatgctcactgccctccaggtaagattctggacgaactcctgcagacatgcgtggatccggaggattgccctgtgtgcgaggtggctggacgcaggtttgctagcgggaaaaaggtgaccctgaatccttcagaccctgagcactgtcagatctgtcattgtgatgtggttaatcttacctgcgaagcctgccaggagcctggaggtttagtcgttccaccaacagacgcaccagtctctcccactacgctctatgtggaggacatcagcgaaccccctttacatgacttttactgttcaagacttctagatctcgtgtttcttttagatggttcatctaggctgagcgaggctgagttcgaggtgctgaaggctttcgtcgtggacatgatggagagactgagaatctctcagaaatgggtacgggttgcggtagttgaataccatgatggatcccacgcatacatcgggcttaaagatcgcaaaagacctagcgaattgcgccggatagcgtcgcaggtaaaatacgcaggcagtcaggtggcttccacttccgaggtgctgaaatatactctctttcagatcttctccaaaatcgaccgccccgaggcatcacgaatcactttgctgttaatggcttctcaagaacctcagaggatgtctaggaacttcgtcaggtacgtgcagggccttaagaagaagaaggttattgtgatccctgtaggtatcggtcctcatgctaatctgaaacagatccgcctgatcgagaaacaggctccagagaacaaggccttcgtcctgtctagcgtggacgagctcgaacagcaaagggacgagattgtttcttacctctgtgatttggcacctgaggcacctccacccaccttaccacccgatatggcccaggtaaccgttggcccaggactcctgggagtgagtactctcggccccaagaggaacagcatggtacttgatgtggcctttgtactcgagggctcagacaaaataggggaggcggatttcaatcgctctaaagagttcatggaggaggtgatccagaggatggacgtggggcaggactctattcacgtcaccgtattgcagtattcatacatggtgacggttgagtaccccttcagcgaggcccaatcaaagggggatatcctccaacgggtgcgtgagatacggtatcaaggcggcaatagaaccaacacaggactggccctccggtatttgtcggaccactcttttctggtaagccagggtgatagggagcaagcacctaaccttgtgtacatggtcacagggaatccggcatctgacgaaatcaaacgacttcctggcgacattcaggtggtaccaattggagtcgggcccaacgccaatgtacaggaactggaaaggatcggatggcctaacgcccccattctgatacaggattttgagactctgcccagagaggctcccgatctggttctgcagcgctgctgttctggggagggcctgcagatacctaccctgtcaccggccccagattgctctcagccactggacgtgatactcctcctggatggctctagttcatttccagctagttacttcgatgagatgaagagcttcgcaaaagcctttatcagtaaagccaacatcgggccccgcctgactcaagtttctgttctccagtacggctccatcaccacgattgacgtcccatggaatgtagtgcctgaaaaggcacatctgctgtccctagtagacgtgatgcaacgcgaaggcggaccatcacagatcggggatgcactggggtttgccgttcgctaccttaccagtgagatgcacggcgcacgtcccggagcgagtaaggccgtcgttatccttgtcacggatgtttctgtggacagtgtggacgctgctgccgatgctgcacgcagtaatcgcgtaacggtgttccctatcggcattggagatcgatacgatgccgcccagctgagaattctcgctggaccggctggggattctaacgtcgtaaaactccagcggattgaggatctgcccaccatggtaactttaggcaacagcttcctccacaaactctgctcaggctttgtcagaatatgtatggacgaggacggcaatgagaagcgacctggcgacgtatggacactgccagatcagtgccataccgtcacatgccagccagatgggcagacactgctgaaatctcacagggttaactgcgaccgagggctgcggccatcttgtcccaactcacagtcacccgtcaaagtggaagagacgtgcggatgccgctggacttgcccttgcgtgtgcacagggtcatctacaagacatatagttacattcgacggtcagaattttaaactgacaggtagttgttcatatgtgctgtttcagaacaaggaacaggacctggaggtgatcctgcataatggtgcttgctctccaggggcacgccagggctgtatgaagagcatagaggtgaaacactctgcactgtcagtagagctgcactcggatatggaggtgaccgtcaatggtcgcctggtgtcagtgccctatgtgggcggtaatatggaggtcaacgtttacggtgctatcatgcatgaggttagatttaaccacctcggccatatctttacatttactccccagaataacgagttccagttgcagcttagccccaagacattcgcgtctaaaacatacggcctgtgcggtatttgcgacgaaaatggggcaaatgacttcatgctgcgagacggcaccgtaactacagattggaaaactctcgttcaggaatggaccgtgcagaggcccggacagacctgtcagccaatcctggaggaacagtgcctcgtaccagattcatctcattgccaggtgttgctcctacccctcttcgcagaatgccataaagttctggcaccagctacattttatgccatctgtcagcaggactcttgtcaccaggaacaggtctgcgaagtcattgccagctacgcccacctgtgtcgaaccaacggggtatgcgtggactggcggacccctgacttttgtgctatgtcatgtcctccaagtttggtctacaaccactgcgaacatgggtgtcctaggcactgcgacggcaatgtgagttcctgcggagaccaccccagcgagggctgcttttgcccgccagacaaagtgatgctggagggcagctgcgtgccggaagaggcctgtactcagtgtattggtgaagatggtgtgcaacaccagttcctggaagcctgggtgcctgaccatcagccttgccagatctgtacatgccttagtggccgaaaagtcaactgcacaacccaaccttgtcctaccgcaaaagccccgacctgtggcctgtgcgaagtcgccaggctgcgccagaacgctgatcagtgttgcccagaatatgaatgcgtatgcgaccctgtctcttgcgacctgccccctgtcccccattgtgaaagagggcttcagccgaccctcaccaacccaggggaatgtagaccaaactttacatgtgcgtgccggaaggaagagtgcaaaagagtgagccctccatcctgtccccctcacagattgccgacacttagaaaaacacaatgctgcgatgagtacgagtgcgcatgtaattgcgtgaactccaccgtgagctgtccactcggatatttggcttccaccgccacaaatgactgcgggtgcacaacaacaacctgccttccagataaagtatgtgttcatcgatctacgatctaccctgtggggcagttttgggaggaaggatgcgacgtctgtacttgcactgacatggaggatgcagttatggggttaagagttgctcagtgctcccagaagccctgcgaggactcttgtcgctcaggcttcacatacgttctgcatgagggtgagtgttgtggtaggtgtctccccagcgcttgtgaggtcgtgaccggaagtccaaggggcgactctcaatcctcatggaagtcagtcggcagccagtgggcttcccccgagaatccatgtcttataaacgaatgcgtgcgggtgaaggaggaggtgttcattcaacagaggaatgtgtcctgccctcagctggaggtgcccgtctgcccttcgggattccagttaagctgtaagacaagcgcctgctgtccgagttgcaggtgtgaacggatggaagcatgcatgttgaacggcacagtgattggcccaggtaaaactgtgatgattgatgtatgcaccacatgcagatgcatggttcaggtcggcgtaattagtggattcaaactggaatgcagaaaaacaacctgcaatccttgcccattggggtataaagaagagaacaataccggagagtgctgtgggcggtgcctgccaaccgcttgtaccatccaactccgcggcgggcagatcatgacactcaagagggatgagacactgcaggacggatgcgacacgcacttctgcaaagtgaatgaacgaggggagtacttttgggagaaacgcgtcacaggatgtccacctttcgatgagcacaaatgtctagccgaaggaggcaaaattatgaagattcccggcacatgctgcgacacctgtgaagagcctgaatgtaatgatataaccgcacgattgcagtacgtgaaagtaggatcttgtaagtccgaggtggaagtcgatattcactattgccagggcaagtgcgcttccaaggctatgtactccatcgatataaacgacgtgcaggaccagtgctcgtgctgctctcccacacggaccgagccgatgcaagtggccctacattgtaccaatgggtcagtggtttaccacgaggtcctgaatgctatggaatgtaagtgttcccctcgaaaatgtagtaag

SEQ ID NO: 21308 - DNA, 8439 bp, Artificial Sequence
  Description of Artificial Sequence: Synthetic coding sequence
atgataccagcaagattcgcaggagtcttgctggccctagcccttattctacccggtactctgtgcgccgagggaactcgaggacgatcatcgacggctcgatgctctcttttcggatcagactttgttaacacttttgacggttcaatgtattcattcgctggctattgttcatatttgcttgcgggcggttgccaaaagcggtcgttttccattattggagattttcagaacggaaagcgagtatcactctcggtttatttaggcgaattttttgatattcatctgttcgtaaatggaactgtcacccaaggagatcaacgtgtctccatgccctatgcttctaaaggactttaccttgaaacggaagcggggtactacaaattgtcaggtgaagcttacggatttgtcgccaggatagatggttctggtaatttccaggtactcctgtcggatcgatatttcaataagacttgtggactttgtggaaatttcaatatcttcgcagaggatgactttatgactcaagaaggaaccttgacgtccgacccatacgatttcgctaactcttgggcactttcctcaggtgagcaatggtgcgagcgtgccagccctccatccagtagctgcaacatatcatcgggagaaatgcaaaagggactgtgggaacagtgccaacttttgaaatcgacttccgtatttgccagatgtcatccgctggttgatccagagcctttcgtggcgctttgcgaaaaaacactgtgcgaatgtgctggaggcttggaatgcgcgtgccctgccctgctcgagtacgcaagaacgtgcgctcaggagggaatggtattgtacggttggactgatcatagtgcttgctctccagtatgtccggctggaatggaataccgccaatgtgtttcgccgtgcgcacgtacatgccaaagtctccatattaatgagatgtgccaagaacgttgtgtagatggatgctcttgcccagaaggccagctcctcgatgaaggattgtgcgttgagtcgaccgagtgtccatgcgttcattctgggaaacgttacccaccagggacttcgcttagtcgtgactgcaatacgtgtatttgtcgcaatagtcagtggatctgtagcaacgaagaatgcccaggagagtgtttggttactggtcaatctcattttaaatctttcgataaccgttattttactttttcgggaatatgccaatacctcctggcacgtgattgccaagaccattcgttctctatcgtcattgagacagttcagtgcgctgacgatagagatgctgtatgcacacgttcagtgacagtcagacttcccgggctccacaatagccttgtgaagcttaaacatggggcgggtgtcgctatggatggacaagatgtgcaacttccactcctcaaaggagatctacgaattcaacatacagtaacagcctctgtgagacttagctatggagaagatctacaaatggactgggacggtcgtggccgtttgcttgttaagctttctccagtttatgcaggaaaaacatgtggattatgtggaaattacaacggaaaccaaggagacgatttccttacaccatcaggcctggccgaaccacgagtcgaagatttcgggaacgcttggaaacttcatggcgattgtcaagacctccaaaagcaacatagcgatccatgcgcattaaacccgagaatgacccgattttcggaagaggcttgtgcagttttgacatcaccgaccttcgaagcttgccatcgtgcagtatcaccactcccataccttcgaaattgtcgatacgatgtttgcagttgttcggatggccgcgaatgcctctgtggagctcttgcttcgtatgcggctgcttgtgctggccggggagttcgagttgcctggcgagagccaggtagatgcgaacttaattgccccaaaggacaagtctacctccagtgtggaaccccatgtaatctaacttgcagatccctgtcatatccagatgaggagtgcaatgaggcttgcctggagggatgcttttgtccaccaggattgtatatggatgagagaggagactgtgtcccaaaagcgcaatgcccgtgctactacgatggagagatcttccaacccgaagatatattctcggatcatcacacgatgtgctattgtgaagatggattcatgcactgtactatgtctggtgtgcctggatcactcctaccagacgcagttctttcatcgccactatcgcatcgttcaaaacgatccctaagctgcagacctccaatggtcaaacttgtttgtccagctgacaacctgagagctgaaggtttagagtgcacaaagacttgccagaattatgatctcgaatgtatgagtatgggatgtgtatctggatgtctgtgcccgccaggcatggtaagacatgaaaacagatgcgtggcattggagcggtgtccatgttttcaccaaggcaaagaatatgctccaggagaaacagttaaaatcggatgtaacacttgtgtctgccaagatcgcaaatggaattgtaccgaccacgtctgcgacgccacgtgctcaaccattggaatggcacactacctcacttttgacggactcaagtatttattcccaggcgaatgtcaatatgttcttgtacaagattattgcggatcgaatccaggaacatttagaattttggttggaaataaaggatgttctcatccttcagttaaatgtaagaaacgtgttactatcttggttgaaggaggggaaatcgaacttttcgatggagaggtcaatgtcaagagaccaatgaaagatgagactcactttgaagtagtggagtctggacggtatataatcttgcttctagggaaggcactttcagttgtgtgggaccgacacctttcaattagcgttgtgcttaaacagacctatcaagaaaaggtctgtggactgtgtggaaatttcgatggtatccaaaataacgatcttacttcttctaacttacaggtagaagaggacccagtagatttcggtaatagttggaaggtgtcgtcgcagtgtgctgatacaagaaaagtcccattggatagttcgccggctacctgtcataataacattatgaaacagacaatggtggatagctcgtgccgaatcttgacttctgatgtctttcaggattgcaacaaactcgtagatccagagccgtatttggacgtgtgcatctatgacacatgttcctgcgagagtattggtgattgtgcgtgcttctgtgacacaattgcagcctacgctcacgtttgtgcacagcatggaaaggttgtcacatggcgaactgcaactctctgtcctcaaagttgcgaggaacggaatctccgcgaaaacggatatgaatgtgagtggcggtataattcctgtgctccggcgtgtcaagtcacgtgtcaacacccggaaccactagcctgcccagtacaatgtgttgagggatgtcacgcacattgccccccaggtaaaatcctcgacgagcttctacaaacatgcgtcgatccggaagactgcccagtgtgtgaagtagcaggacgaaggttcgcaagtggaaagaaggttacactgaacccatcagatccagaacactgtcagatttgccattgcgatgttgtaaatctcacgtgcgaagcatgccaggaaccaggaggtcttgtcgttcctcccactgatgccccagtgtcaccaacgaccttgtacgtcgaagacatatcagagccaccattgcatgatttctactgttctcgtctactagatttggtcttcctcttggacggaagctcgcgtcttagtgaggctgaattcgaggtcctcaaggcatttgttgtcgatatgatggaaaggttacgaatctcacaaaaatgggttagagttgccgttgttgaataccacgatggatctcacgcttatatcggactcaaagatagaaaacgaccttctgaactgcgtagaatagccagtcaagttaaatatgcaggttcccaggtggcatcgacatcagaagttctaaaatacacattgtttcaaatcttctcaaaaatcgatcgacccgaggcgtcaagaatcacacttttgttgatggcaagtcaagaaccccaaaggatgagtcgtaatttcgttcgttacgtgcaaggactcaagaaaaagaaagtgattgttataccggttggaattggaccacatgcaaatcttaaacaaattcgtttgattgagaaacaggcgcctgaaaataaagcttttgttctctcgtcggttgatgagttggaacagcagcgagatgaaatcgtttcgtacctttgtgacttagccccagaggcaccgccgccgactcttccaccggatatggctcaagttactgttggtcctggactcctgggtgtctctacattgggacccaaacggaattcgatggtgttggatgtggcttttgtcttagaggggtcagataaaattggagaagccgacttcaatagatcgaaagaatttatggaggaggttatccaacgtatggatgttggacaagacagcatccatgttactgtccttcaatattcatacatggtcactgttgagtaccctttctcagaagcccaatcaaaaggagatattctgcagagggttcgcgagatccgataccagggaggtaaccgcactaataccggattagcattaaggtatctaagcgatcattcgtttcttgtttcccaaggagaccgtgaacaagcaccaaatctagtgtatatggttacgggcaacccggctagtgatgaaattaagagactgcctggagatatacaagtggtgccaattggagttggacctaatgccaacgtacaagagttggagcgtattggttggcccaatgccccaatactgattcaagatttcgagactcttcctcgtgaagctccagatctcgttttacaaaggtgctgctcgggtgaaggacttcaaattcctaccctcagcccggcgcccgattgttctcaaccactggacgtaatattactacttgatgggagcagttctttcccagcaagttattttgatgaaatgaaatccttcgctaaagctttcatatcaaaggcgaatatcggaccgcgtttaactcaggtatcagtgctccagtatggatcgattactacgatcgatgtaccatggaacgtcgtccctgaaaaagcccacttgttatcgctagtcgatgttatgcaaagagaaggtggtcctagtcaaataggagatgctcttggattcgcagttcgttacttgacgagcgaaatgcacggagcccgtcccggtgcttccaaagccgtagttattttggtgactgacgtctctgttgattcggtcgatgctgccgcggatgcagcaaggagtaaccgagtgactgtcttccccatagggattggagatcgatatgatgccgctcaactcagaatccttgcaggtccagcaggtgatagtaatgtcgttaaattgcagagaatcgaggatttgccaactatggttacactaggaaacagttttctacacaagctatgttcaggatttgtacgaatttgcatggatgaagacggaaatgaaaaacgtcctggagatgtttggacacttccggatcagtgtcacacagtaacgtgtcaaccagatggtcaaacactactgaaatcgcacagagtcaattgtgaccgcggcttgcgcccgtcatgccctaattcccaatctcctgttaaagtggaagagacatgtggatgtcgctggacttgcccatgtgtgtgcacggggtcgtccacacgacatattgttactttcgacggacaaaatttcaaacttacaggctcatgttcgtacgttctttttcagaataaagagcaggacctcgaggttatattacataatggagcttgttcaccaggtgcccgacaaggatgtatgaaatcaattgaggttaaacattctgctttgtcagtcgaattacactctgatatggaggtcacggttaatgggcggttggtgtcggttccttacgttggggggaacatggaggttaacgtttacggagcgattatgcatgaagttagattcaatcacctgggacacattttcacttttacaccacagaataacgaattccagctccagctctcaccgaagacctttgcttctaaaacgtacggattgtgtggaatttgtgatgagaatggtgccaacgacttcatgctgcgtgatggaaccgtaactacggattggaagacactcgtgcaagagtggactgtacaacgcccgggacaaacctgccaaccgatactcgaggagcaatgcttagttcccgattcaagtcattgtcaagttcttttgttgccactgtttgccgaatgtcacaaagtattggctccagcaacattttatgcaatatgtcagcaagattcatgtcatcaagaacaagtgtgtgaagttattgcttcttacgcccatctttgcaggactaatggagtatgtgttgattggcgtacgccagatttctgtgccatgagttgcccaccgagcttggtgtacaaccattgtgaacatggttgcccacgacactgtgatggtaatgtctcatcatgtggtgatcacccaagcgagggctgtttctgtcctccagataaggttatgctcgaaggaagctgcgtaccagaggaagcttgtactcagtgtattggcgaagatggtgtacaacatcagtttttagaggcatgggttccagatcaccaaccttgtcaaatttgcacttgtctatccggtcgcaaagtaaactgcactacccagccatgcccaacagcaaaggctccaacttgcggactttgcgaagttgcacgactgcgtcagaatgcggatcaatgctgtccggaatatgagtgtgtttgtgatccagtttcctgtgacctgccacctgttccacattgtgaaagaggacttcaacccacacttactaatccgggggagtgccgaccaaactttacttgtgcctgccgtaaagaggaatgtaaaagagtgtctccaccgtcgtgcccgccacatcgattgccgacgttgagaaaaactcaatgttgtgacgaatatgagtgcgcttgtaattgcgtgaactccacggtttcttgtccgctgggttacctggcgtcaactgctactaatgattgtggctgcaccaccactacttgtttaccagataaagtttgcgttcatcgatcgacgatctacccggtcggtcaattctgggaggaaggttgtgacgtctgcacctgtactgatatggaggatgctgtgatgggactccgggtggcacagtgttcgcaaaaaccatgcgaagactcatgtagatcaggatttacttatgtcctgcatgagggcgaatgctgtggaagatgcctgccttccgcctgcgaagttgtgacaggatctcctcgaggggacagtcagagtagctggaaatcggttggcagtcagtgggcttcgcctgagaacccatgtctgattaatgaatgcgttcgggtcaaagaggaggtgttcattcagcaaagaaacgttagctgccctcagttagaagtgccagtgtgtccatcaggattccagttgagttgtaagacgagtgcatgctgcccgtcatgtagatgcgaacggatggaagcatgtatgttaaatggaacagttatcggacctggaaaaacagttatgatcgacgtttgcaccacatgcagatgcatggttcaggttggagtgatctccggatttaagcttgaatgtagaaaaacaacttgcaacccatgtccacttggatataaggaggaaaataatactggcgagtgttgtggaagatgtcttccaactgcttgtacgattcaacttcgaggaggacaaatcatgacactgaaacgtgacgagaccctacaggacggttgcgatacacatttttgcaaagttaatgaacgtggagagtacttctgggagaaaagagtaacaggatgcccaccgtttgatgaacataagtgtctggctgagggaggaaaaattatgaagatcccaggaacatgctgtgacacttgtgaggaaccggaatgtaatgatatcaccgctcgtcttcaatatgtaaaggtaggttcctgcaaatccgaggttgaggtggacatacattactgtcaagggaagtgtgctagcaaggccatgtactccatagacatcaatgacgtccaggatcaatgttcgtgctgttcaccaacacggacagaaccaatgcaagttgctcttcactgtacaaatggatctgtagtataccacgaggttctcaacgccatggaatgcaaatgttcgccccgaaaatgctcaaaa

SEQ ID NO: 21309 - DNA, 8439 bp, Artificial Sequence
  Description of Artificial Sequence: Synthetic coding sequence
atgatccctgcccgattcgcaggagttttgttagcactggcactcatcttaccaggtacattatgtgcggaggggacaagaggcaggtcgtcaaccgcccggtgttctctcttcgggagcgacttcgttaatacctttgatggctcaatgtattcttttgccggctattgctcgtatctgctcgcgggcgggtgccagaaaaggtcgttctctattataggggactttcagaacggaaagcgtgtgtccctgagcgtgtatttaggcgagttcttcgatatacacctgtttgtgaacggtaccgtgacgcagggagatcagcgagtatccatgccctacgcctctaaaggactctacctggaaacggaagccggctattataagctttccggcgaagcctatggatttgtggcccgcatagacgggagcggcaacttccaggtgttgctgagcgacaggtactttaataagacatgcgggttgtgcggcaattttaatatttttgccgaagacgatttcatgacacaggaagggaccctgacatccgacccttatgacttcgccaatagctgggccttatcatccggggagcaatggtgcgagagggcgtctcctccatcttcaagctgtaacatttccagcggagagatgcagaagggcctctgggaacaatgtcagcttttgaaatccacaagcgtatttgcacggtgtcatccgctggtggaccctgagcccttcgtggccctgtgcgaaaagacactgtgcgaatgcgctgggggcctcgaatgcgcttgcccggccctgctggagtatgcaaggacttgcgcccaggaaggcatggtactgtacgggtggacggaccacagcgcctgcagcccagtatgtccagcgggcatggaataccgccaatgcgtctcgccttgtgcccgcacgtgccagtcgctgcatataaacgagatgtgccaggagcgctgcgtcgacgggtgcagctgtcctgagggccagctgttggatgagggcctctgtgttgagagcaccgagtgcccctgcgttcacagcggaaaacgatacccgccaggtactagccttagccgcgattgcaatacctgcatctgtagaaacagccaatggatatgtagtaacgaagaatgtccaggtgagtgccttgtgacgggccaaagtcactttaaatcattcgataaccggtatttcactttttcgggcatttgtcagtacctcctggcacgagactgccaggaccatagcttcagcatcgtgattgagacagtacagtgcgccgacgatagagacgccgtgtgtacccgcagtgtgacagtaagacttcccggtttgcataactcattggtaaagctgaagcacggcgccggcgtggcgatggatggtcaagatgtgcagttacctctgttgaagggcgacctccggatccagcacaccgtcaccgcgtcagtgaggctctcttacggagaggacctgcaaatggattgggacgggcgcggcaggctgctcgttaagcttagccccgtgtacgcgggcaaaacgtgtgggctctgcggaaactacaacgggaatcagggagacgacttcttaactccatcaggcctggcagaacctcgggtggaggattttgggaatgcctggaaactgcacggagactgccaggaccttcagaagcaacattccgacccctgtgctctgaatccaagaatgacacggttctccgaggaggcctgtgcggtgctcacatcccctaccttcgaagcctgtcaccgggcagtgagtccgctaccttatttgagaaattgccgatatgatgtgtgctcctgcagcgacggaagagagtgtctctgcggtgcacttgcttcgtatgctgccgcctgtgctggccgcggggtaagggtggcatggagagaacccggcagatgcgaacttaactgcccgaaagggcaggtctatttgcaatgcgggacgccatgcaacttaacatgccgctccttatcatacccggatgaggagtgtaatgaggcgtgcctcgaaggttgtttctgccccccgggcttgtacatggatgaaaggggtgattgcgtccctaaggcccaatgcccatgctattacgacggggagatcttccagcctgaggatatatttagcgatcaccatactatgtgttactgtgaggatggatttatgcattgtacgatgtccggggtgccggggtccctgcttcccgacgctgtcctgtccagtcctctttcacaccggtcgaaacgctctctcagctgtcgccctcccatggtgaaactagtttgccctgctgacaacttgcgtgccgaagggctggagtgcaccaaaacctgtcagaactacgacctcgagtgtatgtccatgggatgtgtcagcggctgcctgtgccccccaggtatggtcaggcacgaaaataggtgcgtcgcactcgagaggtgcccgtgtttccatcagggaaaagagtatgctcccggagagaccgtgaaaattgggtgcaacacctgtgtatgtcaagatcgaaagtggaactgcactgatcatgtgtgtgacgcgacttgctctaccatcggaatggctcactacttgactttcgacggactaaagtatctgtttcctggggagtgtcaatatgtgttagtacaggattattgcggatccaacccagggacttttcggattttggtggggaataaaggatgttcacatccaagcgtcaaatgtaagaagcgtgtaacaatcttggtggaaggaggcgagatcgaattattcgacggagaggttaatgttaaacgccccatgaaagacgagactcactttgaggttgtggagagcggacgctacatcattctgctgttgggcaaggccctgagtgtcgtgtgggatcgccacctgtctatcagtgtggtactgaagcagacctatcaagagaaggtgtgcggcctctgcgggaatttcgacggtatccagaataatgacctcactagctcgaacttgcaagtggaagaggacccagtggacttcggcaattcctggaaagtttcaagccagtgtgcagacacacggaaagtccccctcgactcctctcccgcaacttgtcacaataatataatgaaacaaactatggtggatagctcgtgtcggattttgacatccgacgtcttccaggattgtaataagttggtggatccagagccatacctggacgtttgcatttacgacacctgttcttgcgaatctatcggcgactgcgcctgtttctgtgacactatcgccgcttacgcacacgtctgtgctcagcatggaaaggtcgttacatggcgcactgccaccctgtgccctcagtcttgcgaagagagaaatctcagggagaacggctacgagtgcgaatggcgatataattcctgcgctcctgcttgtcaagtgacatgtcaacatcccgagccgttagcttgtccagtgcagtgtgtggagggctgtcacgctcattgccctcccggcaagatactggacgagttgctacagacctgtgtggaccctgaagactgtcctgtgtgcgaagtggccggacggcgctttgcatcagggaagaaggtaacactgaatccgtccgatcctgagcattgccagatatgccactgcgatgtagtgaacctcacctgtgaagcttgccaggagccaggaggcctggttgtcccacccactgacgctcccgtcagccccacaacgctatatgtggaggacataagcgaaccccccctccatgacttttattgctccaggcttcttgaccttgtgttccttttggacggctccagtcggctctctgaagccgaattcgaagttctaaaggctttcgtcgtggatatgatggagagactgaggattagtcaaaaatgggttagagtagctgtggtcgagtaccatgatggaagccacgcatacatcggattaaaggaccgcaagagaccatcggaactgcgtcgcatagcttctcaagtaaaatacgccggttcccaggtggcctccacaagcgaggtactcaagtacactctcttccagatcttctctaagatagacaggcccgaagcttctagaatcacacttctacttatggcctcgcaagagcctcagaggatgtctcgcaacttcgtcagatacgtgcagggtttaaagaagaaaaaagtgatcgtaatcccggttggtattggaccccacgctaatctgaaacagattcggttaatcgaaaaacaggctccagagaacaaggcgtttgttctgagtagcgttgatgaacttgaacagcagcgcgacgagatcgtttcatatctgtgcgacctggcccccgaagcaccaccgcctaccttaccacccgatatggcccaggtgactgtgggtcccgggctgctaggggtgagtacgttgggccctaagagaaactcaatggtcctggacgtggcatttgtcctcgagggctcagataaaatcggcgaggcagatttcaaccggtccaaggaatttatggaagaagtcatccaaaggatggatgtcggtcaggatagcatccacgtgacagtccttcagtattcctacatggtgacggtggaatatccattcagcgaagcccaatccaagggcgatatcctccagcgggtgcgcgaaatcagatatcagggaggaaatcgcaccaataccggcctggctctacggtacctgagcgatcacagtttccttgtctctcagggcgatcgtgaacaagctcctaaccttgtttatatggttactggcaatcctgcctcggacgagatcaaacgcctgcccggcgacatccaggtggtgcccattggggtcggcccgaatgctaacgtccaagagttagaacgaatcggatggcccaacgccccaattctaatccaggactttgaaacgctcccgagggaggctccagacctggtcttgcagaggtgttgcagcggagaaggcctgcagatccctactttgtcccccgctcccgattgctcacaaccactcgatgtgatactgcttctggatggcagctcgtcattcccagcgtcatattttgatgaaatgaagtctttcgccaaagcgttcatcagtaaagctaatattggccctagactgacccaggtctccgttctccagtacggctcaattaccacgatcgacgtcccctggaatgtggtgccagaaaaggcccacctgctgtcattggttgatgttatgcagcgtgagggcggaccttctcagatcggtgacgccctgggcttcgcagtgcgatatctaactagtgaaatgcacggagccaggccgggggctagcaaggcagttgttatcctggtgactgacgtgtctgtcgattccgtggacgctgctgcagatgccgcgcgcagcaatagagtgaccgtgttccctatcgggataggcgaccgctatgatgccgcccagttaaggatcttggcgggccccgcaggcgatagtaatgttgtcaagttgcaacgaatcgaagatctgcctacaatggtgaccctggggaactctttcctccataagttatgctccggcttcgtgcggatctgcatggatgaggacggtaacgaaaagcgtccgggagacgtatggacactcccagatcagtgtcacaccgtcacttgtcaaccggacggtcagactctgctgaagtcccaccgggttaattgcgatcgaggattgcgacctagctgtccgaatagccagtctcctgttaaagtggaagaaacttgtggttgtcgctggacttgtccgtgcgtgtgcacagggagtagcactcggcatatcgtgacttttgacgggcagaattttaagctcaccgggtcttgctcctacgtactcttccagaacaaggagcaggacctggaggtgatcctccataacggggcctgcagccctggcgctcggcaggggtgcatgaaaagcattgaggtgaagcatagcgccctgtctgtagagctccattcagatatggaggtgacggtgaacgggaggctggtttcagtaccttacgttgggggcaacatggaggtcaatgtttatggcgccataatgcacgaggttagattcaatcatttgggacatatcttcacattcacgccacagaataacgagttccagcttcagctctcgccaaagacattcgcctcaaaaacatacggcctgtgtggcatttgcgacgagaacggggccaatgattttatgctccgcgatggaaccgtgacaactgactggaagacccttgtgcaggaatggactgtccagcgccccggccaaacatgtcagcccatcctggaagagcagtgcctcgtccccgacagttcccactgccaagtgctactgctccctctgtttgccgaatgtcacaaggtcctagctccagctacattttacgccatatgccagcaagattcatgccaccaggagcaagtgtgtgaagtgattgcctcttacgcccacctgtgccgcaccaatggtgtgtgcgttgactggcggacacctgatttctgcgcaatgagctgccccccgagtctggtgtataaccattgcgagcatggatgccctagacattgtgatgggaacgtgagctcctgcggcgaccatccaagtgaggggtgcttctgcccacctgataaggttatgcttgaaggatcctgtgtgccagaagaagcttgcacccaatgtatcggagaggacggcgtccaacaccagtttttagaggcctgggtccctgatcaccagccatgccagatttgcacctgcctgagcggccggaaggtgaattgcaccactcaaccgtgtccaactgctaaagcgcctacttgcgggctgtgcgaagtggctcggttgagacagaacgcagaccagtgctgtcccgaatacgaatgtgtttgcgacccggtatcctgtgatctcccaccggtgccccactgcgagcggggactgcagccgactctcaccaacccaggtgaatgtagaccaaactttacatgcgcatgccggaaggaggaatgtaagagggtgagtcctccctcttgtcccccccacaggctgccaactttgaggaaaacccagtgttgtgatgagtacgaatgcgcctgcaattgcgttaattcaacggtttcctgcccccttggctacctcgcatcgaccgctactaatgactgtggctgcacaacaactacctgcctgcctgataaggtttgcgtgcacaggagtaccatttatcccgttggacagttctgggaagaaggctgtgacgtctgcacctgcactgatatggaggatgcagttatgggactcagagtcgcgcagtgcagccaaaaaccctgtgaggacagttgccgttcagggtttacatacgtccttcatgagggagaatgctgcggccggtgtcttccatcggcttgtgaagtcgtcactggtagcccgcgcggcgactcccagtcctcctggaagtctgtgggatcgcagtgggcaagcccagagaacccctgtctgattaacgagtgcgtcagggtgaaggaggaggtgtttattcaacagaggaatgtcagctgtccacagcttgaggtgcccgtgtgtccttcaggattccagctctcatgcaaaacctcagcgtgctgtccctcgtgtcggtgcgaacgaatggaggcctgcatgctaaacggaacagtgatcggacccgggaagaccgtcatgattgacgtgtgcaccacctgccgctgtatggtgcaggtgggggtaatctctggatttaagttggagtgtcgaaaaaccacatgtaatccgtgtccattgggatataaggaggagaacaacacaggggagtgttgtgggaggtgtctgcccacagcgtgcaccatccagctccgaggcggacagatcatgaccctgaaacgggacgagacgctgcaggacggctgtgacacacatttctgcaaggttaatgagcgaggagaatacttctgggaaaaaagagtaaccggctgtcctccttttgacgaacataagtgcctggccgaggggggaaaaatcatgaaaattccggggacctgttgtgacacctgcgaagaacctgagtgtaatgatataacggccagattgcagtatgtcaaagtgggcagctgtaagagtgaagtcgaggtggacatccattattgccaaggaaaatgcgccagcaaagccatgtactcaatcgatatcaacgacgtccaggaccaatgcagttgttgtagcccaacaagaacagaaccaatgcaagtggcccttcactgcactaacggttccgtcgtgtaccatgaggtgttgaatgcaatggagtgtaagtgttcaccgaggaagtgctccaag

SEQ ID NO: 21310 - DNA, 8439 bp, Artificial Sequence
  Description of Artificial Sequence: Synthetic coding sequence
atgatcccagctaggtttgcaggtgtgcttttggcactggccctgattctgcctggtacgctttgtgccgagggaaccagagggcgctcctccacggcccgttgttccctgtttggttcagattttgtgaatactttcgacggctccatgtacagcttcgccggctactgttcatacctcctcgcaggcggctgccagaagcgctctttttcgataataggtgattttcagaacggcaagcgtgtctcactgtcggtgtacctgggagagtttttcgacattcatctgtttgtcaacggaacggtgacccagggagatcaaagggtgagcatgccatatgcaagcaagggcctgtacctggaaaccgaagctgggtactacaaactctcgggagaagcctacggttttgtggcaagaatagatggatcgggaaactttcaagtgctcctttcggaccgctactttaacaagacctgtgggctgtgcggcaactttaacatttttgccgaagatgatttcatgacccaggaaggaactctgacctccgacccatacgattttgcaaacagctgggccctgtcaagcggagaacaatggtgtgaacgcgcatccccgccatcctcctcctgcaacatttcgagtggagagatgcaaaaaggtctgtgggaacagtgtcaactgcttaaatcgaccagcgtttttgcgcgctgtcaccctctggtcgaccccgagccctttgtggccctgtgtgaaaagaccctgtgcgagtgtgcaggtggtctggaatgtgcatgtccagcacttctcgaatacgcaaggacctgcgcacaggagggaatggtgctttacggatggactgatcattccgcgtgtagccccgtgtgtcctgcaggaatggagtacaggcaatgcgtctcgccttgtgcacgcacctgtcaatcgttgcacattaatgagatgtgtcaagaaagatgcgtggacggctgttcatgtccagaaggacagttgctggatgaaggactttgtgtagagagcactgaatgtccttgcgtccactcagggaaacgctatcccccaggtaccagcctctcacgggattgtaacacttgtatctgtaggaattcgcaatggatttgtagcaacgaagaatgtccgggggaatgccttgtgacgggacagtctcatttcaagtcctttgataaccggtactttactttctccggtatatgtcaatacctgcttgcacgcgactgccaggaccacagcttctcaatcgtgattgaaaccgtgcaatgtgcagatgatcgagatgcggtctgcacccgctccgtgaccgtccgtttgcccggactgcataatagcctggtgaagctgaagcacggcgccggtgtcgcgatggatggtcaagacgtgcagcttccactccttaagggcgacctgcgaatccagcatacggtcaccgcgtcggtcagattgtcgtacggtgaagatctccagatggactgggacggacggggcagacttcttgtgaagctctcacctgtctacgcaggcaaaacttgcggactgtgtggtaactacaacggtaaccaaggcgatgattttcttaccccgagcggattggcagaaccgagagtagaagattttggaaacgcatggaaacttcatggggattgtcaagacctccaaaagcaacatagcgatccctgcgcattgaaccctaggatgacccggttttccgaagaagcatgtgcagtccttacctcgccgacctttgaggcatgtcacagagccgtctcaccactcccttacttgaggaattgtcggtacgacgtctgttcttgtagcgatggacgtgaatgtctttgcggagcactggcatcgtacgcagccgcgtgcgcagggcgtggagtgcgggtggcttggcgtgaacccggtaggtgcgaactcaactgtccaaaggggcaagtctacctccagtgtggaactccctgtaatcttacctgtcgttccctcagctaccccgatgaggaatgtaatgaagcctgcctcgaaggatgtttttgtcctccgggactctacatggacgaaaggggtgactgcgtgcctaaggcccagtgtccttgttactacgacggggagattttccaacctgaggacatattctcggatcaccataccatgtgttactgcgaagatggtttcatgcactgcactatgtccggcgtgcccggatccttgctccctgatgcagtgctgtcatcgccactttcacatcggtccaagagatcactgtcgtgtagacccccaatggtgaaactggtgtgcccggctgacaacttgagagcagaagggcttgaatgtaccaaaacctgtcaaaactatgatctcgagtgtatgtccatgggctgtgtcagcggatgcctctgtccaccgggaatggtacgacatgaaaacaggtgcgtcgcactcgagcggtgtccgtgcttccatcaaggtaaggaatacgcacctggcgaaactgtgaagatcgggtgcaacacttgtgtgtgtcaggatcggaagtggaattgcactgaccatgtctgtgacgctacgtgtagcaccattggcatggcacattaccttacctttgacggattgaagtacctcttccccggagagtgtcagtacgtgctggtgcaggactactgtggctcgaatccaggcacttttaggatccttgtgggtaacaagggatgttcgcacccatcggtgaaatgcaagaagcgggtcactatcctcgtcgagggtggagagattgagttgttcgatggagaggtcaatgtcaaacggccaatgaaggatgagactcactttgaagtcgtggagagcggcaggtacattattcttcttcttggtaaagctctctcagtggtttgggacagacaccttagcatctcggtggtgctgaaacagacgtaccaggagaaggtgtgtggactgtgtggaaactttgatggaatccagaataacgatctgacctcatcgaatcttcaagtggaagaggaccctgtcgatttcgggaatagctggaaagtctcatctcagtgcgcggatactcgaaaagtgccattggacagctcgccggccacctgccataacaatatcatgaaacaaaccatggtggactcatcgtgtcgcatccttacgtcagatgtctttcaggattgcaacaaactggtggacccagagccatacctggacgtgtgcatttacgacacctgctcatgtgaatcgattggggactgtgcatgcttttgcgatactatcgccgcgtacgcacacgtgtgtgcacaacacggaaaggttgtgacctggagaaccgcaactctttgtccacagtcctgtgaagaacggaaccttagggaaaacggttacgaatgtgaatggagatacaactcatgcgcacctgcgtgtcaagtgacttgccaacacccagaaccactcgcatgtccagtgcagtgtgtggaaggttgccatgcccattgtccgccaggaaagattctggatgagctccttcagacctgcgtggatccggaggattgtccagtttgtgaagtcgctggcagacggtttgcttcggggaagaaagtaactcttaacccttcagatcctgagcattgtcaaatctgccactgcgacgtggtgaacctgacgtgtgaagcatgtcaggaacccggaggacttgtggtgcccccaactgatgctcccgtatcaccaacgactctgtacgtggaagatatttcggagcctccacttcatgatttctactgttcgaggttgctcgaccttgtgttccttctggatggctcgagccgactgtcagaggcagaattcgaagtgctgaaggctttcgtggtggatatgatggaacgtctgaggatttcgcagaagtgggtcagagtggcagtcgtggaataccacgatggtagccatgcatacatcggcctgaaggatcggaagaggccttcagaacttcgtcggatagcctcgcaagtgaaatacgctggctctcaggtggcatcaacttcggaggtcctcaagtacaccctgttccagatcttttcaaaaatcgacagacccgaagccagccgcataacccttcttcttatggctagccaagagcctcaacgaatgtcgagaaactttgtccgttacgtgcaaggacttaagaaaaagaaagtgattgtgatccctgtaggtatcggtccgcatgcgaatctgaagcaaatcagacttatcgaaaagcaagcccctgaaaacaaagcatttgtgctttcgtccgtggacgaactcgagcaacagcgcgatgaaatcgtctcgtacctgtgcgaccttgcaccggaggcaccacctcccaccttgcctccagacatggcacaagtcaccgtgggacctgggcttttgggggtgtctaccctgggacctaagcgcaattcaatggttctggacgtagcattcgtcttggagggatcagataagattggagaagcagactttaaccggagcaaggaattcatggaagaggtcatccaaaggatggatgtcgggcaggactcaattcatgtcactgtgctccaatactcgtatatggttaccgtggaatacccatttagcgaggcccagagtaagggagatatcctccagagagtgcgagaaattcggtaccaaggtggcaatagaactaacaccggactcgctctccgctacctttccgatcatagcttcttggtgtcgcaaggggatcgcgaacaagctccaaacctggtctacatggttactggtaaccccgcctcagacgagattaagaggctcccgggtgacattcaagtggtgcctattggagtggggcccaacgccaatgtgcaagagctcgaaagaatcggttggccaaatgcacccatactcattcaagacttcgagactctgccaagagaggcgcctgacctcgtgctgcagaggtgttgctcaggggaaggactgcagattcctaccctttcgcccgcacctgattgttcgcaacctctcgatgtcatcctgcttcttgacggttcctcctcgttccccgccagctactttgacgaaatgaaatccttcgccaaagccttcatctcaaaagccaacattggacctcgtctgactcaggtgtctgtgctgcagtacggatccatcactaccattgacgtaccttggaacgtcgtgcctgaaaaagcgcacctgctgtccctggtggatgtgatgcaacgggaaggcggaccttctcaaattggtgacgcactcgggtttgcagtgaggtacctgacctccgaaatgcatggcgctcgacccggcgcttccaaggccgtggtcattctggtgacggacgtgagcgtggattcagtggatgcggccgcagacgcggcaagatcaaacagagtgaccgtgtttccaattgggatcggagatagatacgacgcagcccagctgaggatcctggccgggcccgcaggagattcaaacgttgtaaagctccagcgcatagaagatctgcccactatggtgaccctcgggaattcgttcctccataagctgtgttctgggtttgtgcgtatttgtatggacgaagatggcaatgagaagcgccctggtgatgtctggactttgccagaccagtgccacaccgttacttgtcaacctgatggacaaaccctgcttaagtcccaccgtgttaactgcgatagaggacttcgcccctcatgtccaaatagccaatcaccagtgaaggtggaagaaacttgcggatgtagatggacgtgtccctgtgtgtgtactggatcaagcactagacatatagtcacgttcgatgggcagaatttcaaacttaccggttcgtgttcctacgttttgtttcaaaacaaagaacaagatcttgaagtcattcttcataacggagcgtgctcgcctggagcaagacagggttgtatgaaaagcatagaagtgaagcattcggcactctcagtcgaactgcactccgatatggaggtgactgtgaacgggcggcttgtgtcggtgccctacgttggaggaaacatggaagtgaacgtgtacggtgcaatcatgcatgaagtcagattcaatcatctcggtcatatctttacctttactccgcagaacaacgaatttcagttgcaactttcccccaagacttttgcatcaaagacttacggcctgtgcggtatttgtgacgagaacggagcaaatgatttcatgctgcgagatggtactgtgaccactgactggaaaactctggtgcaagaatggactgtgcaaagacctgggcaaacttgtcagcccattctggaagagcagtgtctggtgccagactcctcgcattgtcaggtgttgcttctccccctcttcgcggaatgtcataaggtgctcgcccctgcaactttctatgcgatttgccaacaagattcgtgtcaccaggaacaagtctgtgaggtcatagcatcctacgcgcacctttgtcgcactaacggtgtgtgcgtggattggcgcacccctgatttttgcgcaatgtcgtgtcctccctcgctggtctataaccactgtgaacatggctgtccacggcattgcgatgggaatgtcagttcgtgcggtgaccatccttcggaaggatgcttttgccctccggataaggtcatgcttgaaggttcgtgtgtcccagaggaagcatgcactcaatgtattggtgaggatggagtacaacatcagtttctggaagcgtgggtgcctgatcaccagccatgtcaaatatgcacttgtctgtccggaagaaaggtgaattgcactacccagccttgccccaccgcaaaggcacctacgtgtggattgtgcgaggtggcgcgactgcggcagaacgcagatcagtgctgtccggaatacgagtgtgtgtgcgatcctgtgtcatgcgaccttccccccgtgcctcattgtgaacgcgggcttcagccgaccctgactaatccaggggagtgtcgacccaactttacctgtgcatgccgcaaggaagaatgtaagcgcgtttcccctcctagctgtcctccacatcgacttcctaccctgagaaaaactcaatgttgcgatgaatatgagtgtgcatgtaattgtgtgaattcaacggtttcgtgtccgcttggatacctggcctccaccgcgacgaatgactgcggctgcaccactaccacgtgtctccctgataaggtgtgcgtgcacaggagcaccatttacccggtcggacaattttgggaagaaggctgtgatgtttgtacttgtactgacatggaagatgccgtgatgggcctgcgggttgcccaatgttcacaaaagccatgcgaggatagctgtcgatccggatttacgtacgtgctccatgagggtgagtgttgtggacggtgtctgccatccgcatgcgaggtggtgaccggatcgccgcggggggattcccagtctagctggaagtcagtcggttcgcagtgggcgtctccagagaatccttgcctgattaacgagtgcgtgcgcgtgaaggaagaagtgtttattcaacaacgaaacgtgagctgcccacaactggaagtgccagtctgtcctagcggcttccagctgtcctgcaagacttcggcttgctgcccgtcgtgcagatgtgaacggatggaagcctgtatgcttaatggaaccgtgattggacctggtaaaaccgtgatgatcgatgtgtgtaccacttgtaggtgtatggtccaagtcggtgtgattagtggttttaagctggaatgccgcaagaccacctgtaatccttgtcctcttggttacaaggaggaaaacaacactggtgaatgttgcggcagatgccttcctaccgcttgtaccatccaactgcgcggcggccagataatgactcttaaacgcgatgaaaccctgcaagatggttgcgatacgcatttttgtaaggtcaacgagagaggtgaatacttttgggagaagagagtcaccgggtgccctccttttgacgagcataagtgccttgccgaaggcggaaagattatgaaaattccaggtacctgttgcgatacttgtgaggagccagaatgcaatgatatcaccgcaagactccaatatgtcaaggtaggatcctgtaagtccgaggttgaggtggatatccattattgtcagggtaagtgcgcatccaaggcaatgtattccattgacattaatgatgtgcaggatcagtgtagctgttgctcacctacccgtactgagcccatgcaagtcgccctccactgcaccaatggatccgtggtgtaccacgaagtgctcaacgccatggagtgtaagtgctccccaagaaagtgcagcaag

SEQ ID NO: 21311 - DNA, 8439 bp, Artificial Sequence
  Description of Artificial Sequence: Synthetic coding sequence
atgatccccgccagattcgccggagtgctcctcgcactggctctgattctcccagggaccctgtgcgctgaaggaactcggggacggtcgagcaccgcccggtgtagccttttcggatcggatttcgtcaataccttcgacggaagtatgtactcattcgcaggatactgcagctacctgcttgccggcggttgccagaagcgctcattctccatcatcggagacttccaaaatggaaagagagtgagcctttccgtttacctcggagaattcttcgatatacatctgttcgtgaacggtactgtgacccagggggatcagcgggtgtccatgccgtacgcgagtaagggcctgtacctcgaaacggaagccggatactacaaactgtctggagaagcatacggattcgtcgcgcggatcgatggtagcggaaactttcaggtgctcttgagcgaccggtacttcaacaagacctgtggattgtgcggaaactttaacatattcgccgaggacgatttcatgactcaagaagggaccctgacgagcgatccgtacgatttcgccaatagctgggcactgagctccggagaacaatggtgtgaacgagccagcccgccgagctcgtcgtgcaacatcagctccggcgagatgcagaagggactgtgggaacagtgccaactcttgaagagcactagcgtttttgcgcggtgccatccgcttgtggacccggaaccgttcgtcgccctgtgcgaaaagactctgtgcgaatgcgctggagggctggagtgcgcctgtccggccctgctggagtacgcaagaacttgcgcccaggaagggatggtcctgtatggatggaccgaccacagcgcctgctctccggtgtgtccggcgggtatggaatacagacaatgtgtgtcaccgtgcgctcggacctgtcagtcactgcatatcaatgaaatgtgccaagagagatgcgtggatggatgcagctgccccgaggggcagctccttgacgaaggactgtgcgtggagtccactgaatgcccgtgcgtgcacagtggcaaaaggtatccaccgggaacctccctgtcccgggattgcaatacgtgcatctgcagaaactcccagtggatctgctcgaatgaagaatgcccgggcgagtgcctggtgactggtcagtcccactttaagtcttttgacaaccgctacttcaccttttccggaatctgccaatacctcctggcccgggactgccaggaccattcgttctcaatcgtgattgaaaccgttcagtgcgctgacgaccgggacgccgtgtgcactagaagcgtcactgtccgcctgccgggtctgcataattcgctcgtgaaacttaagcacggagcaggcgtggccatggacggacaagacgtgcagctgcccttgctgaagggcgacctcagaatccagcacaccgtaactgcgtccgtccggttgtcctacggcgaagatctgcaaatggattgggatggtcgcgggagactgttggtgaagctgagcccggtgtacgctggtaagacttgtggcctgtgtggtaactataatggaaaccagggagatgatttcctgaccccgtcgggactcgcggagccgcgcgtggaggacttcggaaacgcatggaaacttcatggggattgccaagaccttcagaagcagcattcagatccgtgtgcgctcaaccctagaatgactcgctttagcgaagaggcatgcgctgtgcttactagcccgactttcgaggcctgtcatagagcagtgtcaccactcccatacctccgtaattgtaggtacgacgtgtgctcgtgttcggacggtcgggaatgtttgtgtggtgctttggcgtcctacgcggccgcctgcgcagggaggggagtgcgcgtggcatggagggaaccaggacgctgcgagctgaactgcccaaaaggacaagtgtacctgcagtgcggaactccttgcaatctcacctgcagatccctctcataccccgacgaagagtgcaacgaggcttgcctcgaaggttgtttctgtcctccggggctctacatggatgagagaggggactgcgtgcccaaggcgcagtgcccgtgctactacgatggagagatctttcagcctgaggacatcttctcggaccaccacaccatgtgctactgtgaggatggattcatgcactgcaccatgagtggagtgccgggatcgctcctgcctgatgctgtcttgtcgtcacctctctcccatcgctccaagcgctccctgtcgtgcagaccccctatggtgaaacttgtgtgcccggccgataaccttagagcggagggacttgaatgcactaaaacgtgccagaattacgacctggagtgcatgtccatgggatgcgttagcggatgtctctgcccacctggtatggtccgacacgaaaaccggtgcgtggccctggaacggtgtccctgctttcatcaaggtaaggagtacgcccctggagagacggtaaagatcggatgcaacacctgcgtttgccaagacagaaagtggaactgtactgaccacgtctgtgacgctacgtgctccactattggaatggcccattacctgactttcgacggcctgaagtacctgttcccgggggaatgccagtatgtgctcgtgcaagactactgtggatcaaatccaggcacttttcgcatcctggtgggaaacaaagggtgttcgcacccgtccgtcaagtgcaagaagagagtcacgatcctcgtggaaggcggcgagatcgaactgttcgacggagaagtcaacgtgaagcgcccgatgaaggatgagactcacttcgaggtcgttgagtccggccgctacatcatcttgctgctgggtaaagccctgtcggtcgtttgggataggcacctctccatctccgtggtgcttaaacaaacttaccaagaaaaggtgtgtggactgtgtggcaacttcgacggcatccagaataacgacctgacgtcatcgaatctgcaggtcgaagaggacccagtcgatttcggaaattcatggaaggtgtccagtcagtgtgctgatacccgcaaagtgccgctcgattcgtcaccggcgacctgccacaacaacattatgaaacaaaccatggtggacagctcgtgtagaatcctgacttcagacgtgttccaagattgcaataaacttgtcgatccggagccttacctcgatgtctgcatctacgacacctgtagctgcgaatccattggtgattgcgcctgtttctgcgataccatcgcagcctacgcccacgtctgtgcgcaacacggcaaggtcgtgacctggcgcaccgccacgctgtgtccgcaatcctgcgaggaacggaacctccgggagaacggatacgaatgtgaatggaggtacaacagctgcgcaccggcctgtcaggtgacctgccagcaccccgagccgcttgcatgccccgtgcagtgtgtggagggatgccacgcccactgcccaccaggaaagatacttgacgaacttctccaaacctgcgtcgacccagaagattgtcctgtgtgcgaggttgccggtcggcgtttcgcgtccgggaagaaggttacccttaacccttcggacccagaacattgtcagatatgccactgcgatgtggtcaacttgacctgcgaagcatgccaggaaccgggaggcctggtcgtacccccaaccgacgcgcctgtctcgccaacgaccctttacgtggaagatatcagcgaaccgcccctccacgatttctattgctcgaggctcctcgacttggtatttctgctggacggatcgagccggttgagcgaggcagaatttgaagtgctcaaggcttttgtcgtggatatgatggaaagactgcggatctcgcagaagtgggtgcgagtcgcggtggtggagtatcatgacggcagccacgcatacatcggactgaaagacaggaaacgtccttcggaattgcggcgcatcgcgtctcaggtgaagtacgcgggctcacaggtcgcctcgacctcggaagtcctgaaatacactctcttccagatcttctccaagatagatcgcccggaggcctcacgcattactctgctgctgatggcatcacaggagccacagagaatgtcacggaactttgtgcgctacgtccaaggtctgaagaagaagaaggtgatcgtgatcccggtgggaattggaccgcacgccaacctgaaacagatcagactgatcgaaaaacaggccccagagaataaggccttcgtgctctcctcggtggacgaattggaacagcaacgcgacgagatcgtgtcgtacctgtgcgacctcgctccagaggccccacccccgactctgccgccggatatggcgcaggtgaccgtgggaccgggcctgcttggcgtgtccaccctgggccctaagcgcaactccatggtgctggacgtcgcctttgtcctcgagggaagcgacaaaatcggcgaagcagactttaaccggtcgaaggaattcatggaggaagtcatccagcgcatggacgtgggacaggactccattcatgtgaccgtgctgcaatacagctacatggtcacggtagagtacccgttctcggaagctcaatcgaagggtgatatcctgcaacgtgtgcgggaaatccggtatcagggaggaaaccgcaccaatactggccttgcgttgaggtatctgtccgatcattcctttctcgtgtcccaaggcgatcgcgaacaagccccaaacctggtgtacatggttactggaaatcctgcttctgatgagatcaagaggctcccaggcgacatccaggtggttccaatcggcgtcggccccaacgcgaatgtccaggagctggagcggatcggatggccgaacgcgccgattctgattcaagattttgaaaccctcccccgcgaggcccctgacctggtgctccagaggtgctgctcgggggagggattgcagataccgacgctgtcgccagctcctgactgctcccagccgttggacgtgatcctgctgttggacggaagctcgagttttccagcctcgtacttcgacgagatgaagagcttcgcgaaggcgttcatcagcaaagcgaacatcggaccacggctcacgcaggtgtcagtcctgcagtacggatcaatcactactatcgacgtgccgtggaatgtcgtgcccgagaaggctcatctgctgtccctcgtggacgttatgcaacgcgaggggggaccctcgcagatcggcgacgctctgggcttcgcggtgagatacctgacctcggagatgcatggcgccagaccgggagcctcgaaggccgtggtcatccttgtcaccgacgtctccgttgactcggtggacgctgctgcggacgccgccaggtcgaaccgcgtgaccgtctttccgatcgggatcggcgatcggtacgatgcggctcaactccgcatcctggctggccctgccggagattcgaatgtggtcaagctgcaacggatcgaagatctgccgactatggtgaccctgggcaactccttcctgcataagctctgttccggtttcgtgcgcatctgcatggacgaggacgggaacgaaaagaggcccggagatgtgtggaccctgccagaccagtgccacactgtaacttgccagcccgatggccagaccctgctgaagtcccaccgcgtgaactgcgatcgagggctccgcccgtcgtgcccgaattcgcagtcgcctgtcaaggtggaagaaacttgcggctgccgctggacgtgtccctgcgtctgcaccggatcctccactaggcacatcgtgaccttcgacggtcaaaacttcaagctgacgggatcctgctcgtacgttctctttcagaataaggagcaggacctggaagtgatcctccataatggtgcctgttcaccaggcgcgagacaaggatgcatgaagtccatcgaagtgaaacactcggcactgtcagtcgagctgcactcagacatggaggtgacggtcaatggcagattggtgtccgtgccgtacgtgggcggcaatatggaggtcaacgtctacggagccattatgcacgaggtgcgcttcaaccacctggggcacattttcacctttacccctcagaataacgagttccaactccagctgagcccaaagacttttgcctcgaaaacctacgggctctgtggcatctgcgacgaaaatggcgccaacgacttcatgctgcgcgatggaactgtgactactgactggaaaacccttgttcaggaatggaccgtgcagcggcccggacagacttgccaacccatcttggaggagcaatgtttggtcccggattcgtcccattgccaagtcctgctgctcccgctgttcgccgaatgtcacaaggtgctggcgcctgccactttttacgcaatctgtcagcaggattcttgccaccaggagcaggtgtgtgaggtaattgcttcctacgcacatctttgcagaaccaatggtgtttgcgtggattggcgcaccccagacttctgcgcaatgagctgcccgccatccctcgtgtacaaccactgcgagcatggatgtccgagacactgcgacgggaacgtgtcaagctgcggagatcaccctagcgaagggtgcttctgtccaccagataaagtgatgcttgagggatcatgtgtcccagaagaagcgtgcactcagtgcatcggtgaggacggtgtgcagcaccagttcctggaggcatgggtccccgaccaccagccttgccaaatctgtacgtgtctgagcggccgcaaagtgaattgtacgacccagccttgcccaaccgccaaggctccgacttgcggtctgtgcgaagtggcacgcctccggcagaacgctgaccaatgctgccctgaatacgagtgcgtgtgcgatccggtgtcgtgcgatctcccgccggtccctcattgcgaaagaggcctccaaccgactcttaccaatccgggcgaatgccggcctaatttcacctgcgcttgccgcaaggaagaatgtaagcgcgtgtcgccaccatcgtgcccaccgcaccgcctgccaaccctcagaaagactcaatgctgcgacgaatacgaatgcgcctgcaactgcgtgaacagcaccgtatcgtgccccttgggctacctggcgagcaccgccactaatgactgcggatgcactaccaccacctgcctgccggataaagtgtgcgtgcatcgctcgacgatttacccggtgggacagttctgggaagaaggctgtgacgtgtgcacctgcactgacatggaggatgctgtcatgggactgcgtgtcgctcagtgctcacaaaaaccatgcgaggactcatgtcgctcgggattcacctatgtgctgcacgagggcgagtgctgtggacggtgcctgccgtctgcgtgcgaagtggtgactggatccccgcgcggcgacagccagtctagctggaagtccgtgggatcacagtgggcgtcgcctgagaatccatgcctcattaacgagtgtgtgcgggtgaaggaagaagtctttattcaacagcgcaacgtgagctgtccacagctggaagtgcctgtgtgcccatccgggttccaactctcatgcaagacttcagcatgctgtccttcttgtcggtgtgagcgcatggaagcctgcatgcttaatgggaccgtgattggcccggggaaaaccgtcatgatcgatgtgtgtaccacctgtcgctgcatggtccaggtcggggtcatcagcggtttcaagctcgagtgtaggaaaactacctgtaacccatgcccactgggatacaaggaagagaacaacaccggggaatgctgcggcaggtgcctgccgactgcatgcaccatccaactcagaggcgggcaaatcatgacgctcaagcgcgacgagactctgcaggacggatgtgacacccatttctgcaaagtgaacgaacgtggtgaatacttctgggagaagcgggtgactggttgtcctccgttcgacgaacacaaatgcttggcggagggagggaagattatgaagatccctggcacttgttgcgacacctgtgaagaaccggaatgtaacgacatcacggctcggctccaatacgtcaaggtgggttcctgcaagagcgaagtggaggttgatatccattactgccagggaaaatgcgcgagtaaagcgatgtattcgatcgacattaacgatgtgcaggaccaatgctcctgctgctcaccaactcggactgaaccaatgcaggtggcattgcattgcaccaacggctcggtcgtgtaccatgaggtgctgaacgccatggaatgtaagtgctcgccaaggaagtgcagcaag

SEQ ID NO: 21312 - DNA, 8439 bp, Artificial Sequence
  Description of Artificial Sequence: Synthetic coding sequence
atgattcctgcacggtttgctggcgtcctcctggcactggccctgattctaccaggcaccttatgtgctgaaggaacccggggccgctcctcaaccgctcgctgtagcctcttcggctcagatttcgtcaacacctttgatggaagcatgtattctttcgcgggttattgctcttatctgctagccggaggatgccagaaaagaagtttttccattattggtgatttccagaacggaaaaagggtgagcctcagtgtctatcttggggagttctttgacatccatctgttcgtgaatgggactgtgacccagggcgaccagcgggttagtatgccttatgctagcaagggactgtatctggagacagaagctgggtattacaagctgagtggagaggcatacggttttgtggctagaatagatggttccggcaacttccaggtgctgttgtccgatcggtacttcaataagacatgtggcctctgcggaaattttaacattttcgccgaggatgacttcatgactcaagaaggaacactgacctccgacccgtacgacttcgccaactcatgggcgctgtcatcaggagaacagtggtgtgagagggcttccccccctagctcatcttgtaacatatcctctggggagatgcagaaaggactctgggagcagtgccaattgctgaagtctacctcagtgtttgcacggtgccacccattagtcgacccagagcccttcgttgcgctgtgcgagaagacactgtgtgagtgcgctggtggcttggaatgtgcctgccccgcattgctggaatatgcacggacctgtgcacaggagggcatggtgctgtatgggtggaccgaccattcggcctgcagcccggtatgtccggcagggatggaatacagacagtgcgtttcgccatgtgcgaggacatgccaatcattgcacattaatgagatgtgtcaggaacggtgcgtggatggttgttcctgtcctgaaggccaactgctagacgaaggtctctgcgtggaaagtactgaatgcccctgtgtccattcaggcaagcgatacccgcctggtaccagtctctctcgggattgcaatacatgcatctgtagaaacagccaatggatctgtagtaacgaggagtgtcctggagagtgccttgtgaccggccagtcacacttcaaatctttcgataaccgctattttacctttagtggaatctgccagtatctgctggctagggactgtcaggaccactcattctccatagtgatcgagacagtccaatgtgcagatgatcgcgacgccgtgtgtacaaggtccgtgactgtccgcctgcccggcctgcacaacagtcttgtgaaactgaagcatggtgcaggagttgccatggacggtcaggacgtgcagctgccgctgctcaagggtgaccttagaatccagcatacagtgacagcttccgtgcggttatcatacggtgaggaccttcagatggactgggatgggcggggtcggcttctggtaaaactctcccccgtgtacgctggcaaaacttgcggcttatgtggcaattataatggcaatcagggagatgactttctgactccatctggcctcgccgaaccaagggtggaagactttgggaacgcttggaagcttcatggggactgccaagacctgcaaaagcagcactcggatccgtgcgccctcaacccacgaatgaccagattttcagaggaagcctgtgcagtgctgactagtcctaccttcgaggcgtgtcaccgtgccgtgtcgccacttccgtatctgagaaattgtcggtacgatgtctgttcctgcagtgacgggcgcgaatgtctctgcggcgctctggcctcctatgccgccgcttgcgccgggaggggagttagggtggcatggagagaaccgggaaggtgtgagctcaactgtccaaagggccaggtttatttgcagtgcgggaccccctgcaatctgacatgtcgatctctgtcctatccagatgaggagtgcaatgaggcatgtttggagggttgtttctgtcctccgggtttgtatatggacgagagaggtgattgcgttcctaaggcacaatgcccatgttattatgacggggagatatttcaaccggaagacatcttcagcgaccaccatacgatgtgttactgcgaagacggcttcatgcactgcacaatgtccggcgtacctgggagcttattgccagacgctgtgctgtcctcccctttatcccatcgatccaaaaggagtctgtcctgccgcccgcctatggttaagctggtgtgcccagccgataatttgcgggccgaagggcttgagtgcactaaaacctgtcagaactacgatcttgaatgcatgtccatgggatgtgttagcggctgcctatgcccaccaggaatggtgcgtcacgaaaataggtgcgttgctctggaaaggtgcccttgcttccaccaaggaaaggagtatgcgcctggggaaacggttaagattggttgcaacacatgcgtgtgccaggacaggaaatggaactgtacagatcatgtctgcgatgcaacatgttcgacgatcggaatggcccactatctcacattcgacggcctgaagtacctgtttccaggcgagtgccagtacgtattggttcaggactactgcggctccaacccgggtacttttcgcattctggttggaaataagggctgctcacacccctcagtaaaatgcaagaagcgcgtgaccatcctggttgagggcggcgagattgagctttttgacggtgaggtgaatgtcaagcgccctatgaaagatgagacccactttgaggtggttgagagtggtagatacataatcctccttttagggaaggccctgtcagttgtgtgggatagacacctgtcaatcagtgtggttctaaagcagacttatcaggaaaaggtctgcggactgtgtgggaacttcgacggaatccagaacaacgacctgacgtcaagtaatctgcaggttgaggaggaccctgtggattttgggaattcatggaaggtgtcctctcaatgtgcagacacacgaaaggttcccctcgattcgagcccagccacttgtcataacaacatcatgaagcaaaccatggtggacagctcctgccggatcctgaccagcgacgtgtttcaggattgtaataagcttgtggatcctgagccctacctcgacgtctgtatttacgacacctgctcctgcgaatccatcggcgactgcgcctgcttctgcgacacaatagctgcttacgcccatgtctgtgcccagcacggtaaagtggtaacctggcggactgctactctctgtccccagagctgcgaggaacggaatttaagagaaaacggttacgaatgtgagtggcgctataactcctgtgctcctgcctgtcaggtgacgtgtcagcacccggagccgcttgcttgtcctgtacagtgcgtggagggttgtcacgcgcactgcccgcctggcaagattctggatgaattgcttcagacgtgcgtcgacccagaggattgccctgtatgtgaagtggcgggccgcagatttgccagcggtaaaaaggttactcttaatccctcagatcccgagcattgtcagatctgccactgcgacgtggttaaccttacttgtgaagcatgtcaggagcccggcggccttgtcgtccccccaacggacgcacctgtttcacctaccaccttgtatgtggaggatatttctgagccccccctccacgacttctactgctccagattgctggatctggtctttctgcttgatggatcttcacggctcagtgaggcagagtttgaagtgctgaaggccttcgtggtggacatgatggaaagactgcgcatttcgcagaaatgggtgagagtggccgttgtggaatatcatgacggaagccacgcgtacatcgggcttaaggaccgaaagaggccgtcagaactgcggagaatcgcttcccaggtgaagtatgcagggagccaggttgcctccacctcagaagtgctgaaatacacgttgttccagatttttagtaagatagatcgacccgaggctagtagaataaccttgctacttatggcttcacaggaaccacaacgcatgtcaaggaacttcgtgcgttacgtccaggggctcaagaagaaaaaagtgatcgtgatcccagtggggattggtccacatgctaatcttaagcaaattcggcttatcgagaagcaggctccggaaaataaggccttcgtcctgagttccgttgacgagttagaacagcagagagacgaaatcgtgtcttacctctgtgatctcgccccagaagccccccctcccacgctcccccctgacatggctcaagttactgtcggccccggcctgctgggggtgtcaaccctgggaccaaagagaaattccatggtgttggatgtcgccttcgtcctggagggttcagataagatcggggaagcagacttcaacagatctaaagagttcatggaggaagtgattcaacgaatggatgtgggacaggacagtatacatgtgactgttctgcagtatagttatatggtgaccgtggagtaccccttctctgaggctcagagcaaaggcgatattctccagcgggttagagagatacgttatcagggaggcaatcggactaacacaggcctcgcccttcgttacctgagcgaccactcttttttggtttcacagggcgatcgtgagcaggcccccaatttggtgtacatggtcacaggcaacccagccagtgacgaaattaagcgccttccgggcgatatccaggtggtcccaatcggcgtcggaccgaacgcaaatgtgcaagagctggagagaattgggtggcccaacgcccccatcttgatccaggactttgaaaccttaccgcgagaagctccagacctcgtgctgcagcgttgttgctcaggggaggggcttcaaattcccacgctctcacctgcccccgactgtagtcagccgttggacgtcatcctgctacttgatgggtcgtcttccttccccgcttcatatttcgacgaaatgaaaagcttcgccaaggccttcatctcgaaagcaaacatcggccccagacttacccaagtctctgtactgcagtacgggtcaataaccactattgatgttccgtggaatgtggtgcctgaaaaggctcatcttctgtctctggtagatgttatgcagagggaaggggggccctctcagataggcgacgctttgggatttgctgtgcggtatcttacatctgagatgcacggagcaagacccggcgccagcaaggctgttgtgattttggtgactgatgtgtccgtcgacagcgtggatgccgccgccgacgcggcccgctctaacagagtcacagtgtttcctatcggtatcggggacagatacgacgcagcccagctcaggatccttgcaggtccggccggggactccaatgtggtcaagctccagcggatcgaggatctgccgacgatggtcactcttggaaactcattcctgcacaagctatgttctggctttgtgcggatctgcatggacgaggacggaaatgagaagcggcctggagatgtttggaccctccccgaccaatgccatactgttacatgtcagccagatggtcagacgctgctgaagtctcaccgtgtgaattgtgaccgcggactaagaccatcttgccccaatagtcagtcacccgtcaaagtggaggagacttgtgggtgtagatggacttgcccatgtgtgtgcacgggatcatccacccggcatattgttacatttgatggccaaaacttcaagctcaccggtagctgctcgtacgtgttgttccagaataaggaacaggatctggaggtgattctacataatggtgcctgttccccgggagcccgccagggctgcatgaagagcattgaagtgaagcattccgcattatccgtggagctgcattctgatatggaggtgactgtaaacggacgccttgtttcggtgccttacgttggtggaaacatggaggtgaatgtgtacggagcaatcatgcatgaagtgcgcttcaaccacttagggcacattttcacatttaccccacaaaataatgagttccagctacagttgagcccgaagacatttgctagtaagacatacggcttatgcggaatatgcgatgagaatggagcaaacgatttcatgctcagagacgggacggttaccacagactggaaaaccctagttcaggaatggactgtccagaggcccggccagacctgccagcctatcctggaggagcagtgcctggtgcctgactcaagtcactgtcaagtcctactgttgcccttgttcgcagagtgtcacaaggtactggctcccgccacattttacgccatctgtcagcaggattcctgccatcaggagcaggtgtgcgaagtaattgcctcatatgcccacctttgtagaacgaatggtgtgtgcgtggactggcggactcctgatttctgcgctatgtcctgcccaccctccctagtatacaatcactgcgaacacgggtgtcctcggcactgcgacggcaatgtgtcctcatgcggggaccatccgtctgaaggctgcttctgtccaccggataaggttatgcttgaaggcagttgtgtcccggaagaggcctgtactcagtgtatcggcgaagatggagttcagcatcagtttctggaggcttgggtgccagatcatcagccctgccaaatctgcacctgtctcagcgggagaaaggtaaattgcaccacccaaccttgtcccaccgccaaagccccaacatgtggactctgcgaggtcgcccggttacgacagaatgccgatcagtgttgcccagagtacgaatgtgtatgtgatcccgtgtcatgcgatttaccacccgtcccacactgtgagaggggccttcagcccactttaacgaaccccggtgagtgccggcccaatttcacctgcgcctgccggaaagaggagtgcaagagggtgagtccgcctagctgtccccctcatcggctcccgacgttacgcaagactcagtgctgcgacgagtacgagtgcgcatgcaattgtgtaaattccaccgtcagctgccctctcgggtatcttgctagcactgccacaaatgattgcgggtgcactaccacaacatgccttccagataaagtgtgcgtacaccgatctacaatttacccggtcggccagttctgggaggaaggatgcgacgtctgcacctgcacagatatggaggatgctgttatgggcctgcgtgtcgcccaatgttcccagaagccctgtgaagattcatgccgatctgggtttacgtacgtcctccatgagggagaatgctgtgggcgctgtcttccaagtgcctgtgaagtcgtcacaggatcccctcgcggtgactcccaaagctcatggaagagtgtggggtctcagtgggcttctcccgagaacccatgtctgatcaatgagtgcgtgcgcgtcaaagaggaagtctttatccaacagcgaaatgtctcctgtccccagctagaggtgcccgtgtgtccctctgggtttcagctgtcatgcaaaacgagtgcgtgttgcccgtcctgtcgctgcgagcggatggaggcctgcatgctgaatgggactgtgattggtcctggcaaaacagttatgatcgacgtttgtaccacctgccggtgcatggtgcaggtgggcgtgataagtggattcaaacttgaatgtaggaagactacatgcaacccatgtcccctgggctacaaggaggagaataacacaggggaatgctgcggaaggtgcctgccgacagcttgtacgatccagctgaggggtggtcagattatgacccttaagcgggacgagacactccaggatgggtgtgacacccatttctgtaaggtgaatgaacggggcgaatacttctgggaaaaacgggtgacgggttgtccacctttcgacgaacacaaatgcttggcagaggggggtaagattatgaaaatacctggcacatgctgcgatacgtgcgaggagccggagtgcaatgacattaccgcccgtctacagtacgtgaaggtaggatcctgtaagtcagaggtcgaagtggacatccactattgccaaggcaaatgcgcctctaaggcaatgtattcaatagacattaatgacgtgcaggaccagtgtagctgttgctcccctaccaggaccgagcccatgcaggtggccttgcattgcaccaatgggtcagtagtttaccacgaagtgctcaacgcaatggaatgtaaatgcagcccgcgaaagtgcagcaag

SEQ ID NO: 21313 - DNA, 8439 bp, Artificial Sequence
  Description of Artificial Sequence: Synthetic coding sequence
atgatcccagctagatttgcgggcgtgttgctagccctcgccctgatactgccaggaacactttgcgcagagggcaccagaggaaggagctcaactgctaggtgttcactctttggatcagacttcgtgaataccttcgatgggtctatgtattccttcgcgggctattgcagttatctgctggccgggggctgtcaaaagagatccttctcgattatcggtgacttccagaatggaaagagggtctcgttaagcgtgtatctgggggagttttttgacattcatttatttgtgaacgggactgtcacccagggtgaccagagagttagtatgccatatgccagtaaggggctatatctggaaacggaggctggatactataaactaagcggagaagcctatggcttcgtcgccaggatcgatggtagcggcaacttccaggtgctcctcagcgaccgctactttaacaaaacttgcgggctatgcggcaactttaacatctttgccgaagacgattttatgacacaggaaggaaccctgacctctgacccatatgactttgcgaacagctgggctctgagtagcggagagcagtggtgtgaaagggccagtccacccagtagtagctgcaatattagctccggagagatgcagaagggtctgtgggagcaatgccagctactcaaatcgacttccgtattcgccaggtgccaccctttggtggatcccgaaccatttgtggccctgtgcgaaaaaaccctctgcgagtgtgcaggggggctggagtgtgcctgccctgctttgctggagtacgccagaacatgtgcacaagaaggcatggtattgtatggctggactgatcactccgcatgctcgcctgtgtgtcctgctggcatggaataccgacagtgtgtttctccatgcgccaggacctgtcagtccctgcatattaacgagatgtgtcaggagaggtgcgtcgacggctgtagctgtccagaaggacagttgctcgacgagggtctttgcgtagagagtacggagtgtccctgcgtgcattcaggaaagaggtaccctcctggtacaagcctttctcgagactgcaatacctgcatttgtcggaattcgcagtggatttgcagcaacgaagaatgtccaggcgaatgcctggtaacggggcaatctcattttaagtccttcgataatcgatacttcaccttctctggaatctgccagtatcttctagcccgagattgtcaggaccactcattctctattgttattgagactgttcagtgtgccgacgaccgtgacgccgtatgcacaaggtctgttactgtgagactcccgggactgcacaacagcctcgtgaagttaaaacacggcgcaggtgtggccatggacggccaggatgtacagttgcctttgctcaaaggtgatctccgaatccagcatacagtaacagcatcagtacgtctgtcctatggggaggatttgcagatggactgggatggaagaggaagacttcttgtcaagctatcgcctgtgtacgcagggaagacctgcggattatgtggcaactataacgggaatcaaggcgatgacttccttacgccgagcggactcgcagaacctcgagttgaggacttcggcaacgcctggaagctccatggggattgtcaggacctacaaaagcagcattctgatccctgcgccctgaaccctcggatgactaggttttcggaagaagcttgcgccgtactcacatctcctacatttgaagcctgtcacagagctgttagccctctcccctacctgcgaaactgcaggtatgacgtgtgttcctgttccgacggcagggaatgtctctgtggtgctctcgccagctacgctgccgcttgcgctggccgaggggtgcgagtggcttggcgagaacctgggcgatgtgagctgaattgcccaaaaggccaggtatacttacagtgcggtaccccatgcaatcttacatgtcgaagtctttcctatccagacgaggaatgcaacgaggcctgcctggaaggatgtttttgcccccccgggttgtatatggatgagcgaggggattgcgtgcccaaggcacagtgcccctgctactatgacggcgaaatctttcagccagaggacatttttagcgaccaccacacgatgtgctactgcgaagatgggttcatgcattgcaccatgagcggtgtgcccgggtccttgcttcctgatgccgtcctgtctagcccactgtcccacaggtctaagagaagcctgagttgtcgtccaccgatggtgaaactggtttgccctgcagataatctgagagccgagggcctcgagtgcaccaaaacttgccagaattacgatttggagtgcatgagcatgggatgtgtttccgggtgcctctgcccacccggaatggtgcgacacgagaatagatgcgtagcattggagcgatgtccttgcttccatcagggcaaggagtacgcccctggtgagacagtaaagatcggctgcaatacatgcgtgtgccaggataggaaatggaactgcacagaccacgtgtgtgacgctacgtgttcaactatcggaatggcccattacctcacattcgacggactcaagtacctctttcccggcgagtgccaatacgtgctggtccaggattactgtgggtctaaccctggcacattccgtatcttagtgggtaacaagggatgctctcacccttcagtgaagtgcaagaagagagtgacgattctggtggaggggggagagatagagcttttcgatggagaagtgaatgtgaagagacctatgaaggacgagacccatttcgaagtcgtggagtccggcagatacatcatcttgctgctggggaaagctctgtcggtagtctgggatagacacttaagtatctccgtggtactgaaacagacttaccaagagaaagtctgtgggctctgcgggaactttgatggaattcagaacaacgatctgacctccagtaatctgcaggtagaggaagaccctgtcgatttcgggaattcttggaaggtatcttcccagtgcgccgatactcgtaaggtaccactggacagttcacccgcaacttgtcacaacaatattatgaagcagactatggttgatagctcctgcagaatcctaacatcggacgttttccaggattgcaacaagctggtcgatccagaaccctacctcgacgtgtgtatctatgacacatgttcctgcgagtccatcggcgactgtgcttgcttctgtgacaccatagcggcttatgcccacgtttgcgcacaacacgggaaggtagttacctggcgtaccgccaccctgtgtccccagtcctgtgaggaacgtaatctgcgggagaatggatacgaatgcgagtggagatacaatagctgtgcccccgcatgtcaagtgacttgccaacatcccgaacccctggcatgtcctgtgcagtgcgtggaaggttgccacgcgcattgtccccctggaaagatactcgacgaactgttacagacctgtgtcgacccagaagattgcccagtgtgtgaggtggcaggcagacgatttgcgtcaggaaaaaaggttaccttgaatccttctgatccagagcattgtcagatatgtcactgcgacgtcgtgaacctgacttgcgaagcctgccaggagccaggtggcttagtggtcccccctacagacgctcctgtatcccctaccactctgtacgtggaggacattagcgaacctccgctccacgacttctactgcagccgcctcctcgatctcgtatttctgctggacggatcaagtcgactttccgaagccgagtttgaagtgttaaaagcattcgtggtcgacatgatggagaggctccgaatctcccagaagtgggtgagggtcgcggtcgtagagtaccatgatggtagtcatgcttacatcggactgaaggacagaaaaaggccaagcgagctgaggcgtatcgcctcacaggttaaatatgccggtagtcaggtcgcatcgacatccgaagtgcttaaatatacgcttttccagattttctcgaaaatcgataggcccgaggctagccgtataacgttgttgctgatggcgtcacaggagcctcagagaatgtcacgaaacttcgtgcggtatgtccagggccttaaaaagaaaaaggttatcgttattccggtgggcattgggccccatgcaaacctgaagcagatcaggcttattgaaaagcaggcccctgagaacaaggcttttgtgctgtcatccgtcgacgagctggaacagcagagagatgagatcgtcagctacctttgcgacctcgcccccgaagccccgccacccacattgccccccgacatggcccaagtcaccgtgggccccggactgctgggtgtctccactttgggtcccaaaagaaactcgatggtccttgatgtcgctttcgtcctggaaggctctgataaaatcggcgaagctgatttcaaccgcagcaaagagttcatggaagaggtcatccaaaggatggatgtgggtcaggatagcattcacgtcactgtcttgcaatatagttatatggtgactgtagaatacccattttccgaagcacagtcaaagggagacattttacagcgcgtaagagagatccgttaccagggcgggaaccggaccaacactggactggccctacggtacctgagcgaccacagcttcttggtctctcagggggacagagaacaagcgcctaatttggtgtatatggtgacgggcaacccagcctcggacgaaatcaagcggctcccaggggacattcaagtggttcctataggcgtgggcccaaatgccaatgtacaggagctcgaaagaataggatggccgaatgctccaattctcatccaagactttgagactctgccccgagaggcaccagatctggtcctacagcgatgctgctcaggagaggggctccagatcccgaccctgagtcccgcgccagactgtagccagccccttgacgtgattcttctgctggatgggagctcctcatttcctgcatcttactttgacgagatgaagtcatttgcgaaggcctttatatccaaggccaacattggccctcgtctgacccaggtgagtgtgctgcagtatggcagcatcaccaccatcgatgtgccctggaatgtggtaccggagaaagcacatctgttgtccctggttgatgttatgcagagagaggggggaccctcccagatcggcgacgctctgggctttgctgtccgctaccttacttctgaaatgcatggtgcgaggcctggcgccagcaaagcagttgtgatcctagtcaccgacgtatctgtggatagcgttgatgccgcagcagacgccgcccgttcaaatagggtgactgtcttccccatagggataggggacagatacgacgcagcccagctgaggatactggccggccctgccggcgatagtaacgttgtgaagctgcaacgcatcgaggatctaccgaccatggtgactctcggcaactcgtttctccacaagctgtgttccggcttcgtcagaatctgcatggatgaagacggaaacgaaaagcgacccggcgacgtttggactctgcccgaccagtgccacactgttacttgtcagcctgacggccagacattgcttaagtctcatagagttaattgtgacagaggcctgagacctagctgtccaaatagtcagagtcctgtgaaagtggaagaaacttgtggttgccgttggacgtgcccttgcgtttgtacaggttcttctacacggcacattgtaacgttcgacggccagaatttcaaacttacgggcagctgtagctatgtgctgttccagaacaaagaacaggacctagaggtgatcctccataacggcgcatgcagtcctggcgctagacagggatgtatgaagtccatcgaggttaagcactccgccctgtcagtcgagctccactctgacatggaggtcaccgtcaacggacggctcgtatctgtgccctacgtgggaggtaatatggaggtgaacgtctacggtgcgatcatgcacgaggtgaggttcaaccatttgggtcatatctttacattcacaccccaaaataacgagtttcaactgcaattgagccccaaaaccttcgcatcgaagacctatggactgtgtggaatatgcgacgaaaatggggccaacgacttcatgttacgagatggaactgtgacgacagattggaagacgttagtgcaagagtggactgtgcagcgacctggccaaacctgccagcccattctcgaggagcagtgtctggtgcctgattcttctcattgtcaggtgctgctactgccactcttcgctgagtgccacaaagtgcttgcacctgcaacattctatgctatctgtcaacaagattcgtgccaccaggaacaggtctgcgaggtgatcgccagctacgcgcacttatgcaggacaaatggcgtgtgtgttgactggcgtactccggatttctgcgcaatgtcttgtcctccgtcccttgtctacaatcactgcgaacacggttgccccagacactgtgacggcaatgtgtctagctgtggtgaccacccatccgagggctgtttttgtccacctgacaaggtgatgttggaaggctcttgcgttccagaagaggcctgtacacagtgtattggggaagatggggtgcagcaccaatttctggaggcttgggtcccagaccaccagccctgtcagatctgtacctgcctcagtggtcgaaaagtgaattgtaccacgcagccgtgcccaacggcaaaggcccccacgtgcggcctttgtgaagtggccagactgaggcagaacgccgaccagtgctgcccggaatacgagtgcgtttgcgatccagtgagttgtgatctgccccctgttccccactgcgaaaggggacttcaacctacattaacaaaccccggcgagtgccgacctaatttcacatgcgcctgccgaaaggaggagtgcaagcgcgtcagtccaccgtcctgcccacctcaccgccttcccaccctccgaaagactcaatgctgcgatgagtacgaatgtgcgtgtaattgtgttaacagcacagtgagttgtccgcttgggtatcttgcctctaccgctaccaatgattgcggctgtacaaccacaacctgtctcccagacaaggtgtgcgtccacagaagtacgatctacccagttggacaattctgggaggaaggctgcgacgtctgcacctgcacagacatggaggacgctgtcatgggcttgagggtggcccagtgctcgcagaagccttgcgaggactcctgccgtagcggattcacatatgttctgcatgaaggcgaatgctgcgggaggtgcctcccttcagcatgtgaagttgttacggggagtcccagaggagacagtcagagcagctggaagtcagtaggtagccagtgggccagcccggagaacccttgcctcataaatgagtgcgtgcgagtcaaggaagaggtgtttatccagcagagaaacgtgagttgtccccagctggaggtgcccgtctgtccctctggtttccagctttcctgtaagacttcagcatgttgtccttcctgccgctgcgaaagaatggaggcctgtatgctgaacggtaccgtaatcggccccggtaagactgttatgatcgatgtttgcactacctgtcgatgcatggttcaagtgggcgtgatttccggctttaagttggaatgcaggaagacgacttgtaacccatgcccacttggctacaaagaggagaacaatactggagagtgttgcggcagatgcctgcctacggcatgtaccattcagctacgaggaggccagattatgaccctgaaacgagatgagacactgcaagatggctgcgacactcatttctgtaaggtgaacgagcgaggcgagtacttttgggagaaaagagttacaggctgcccccctttcgatgagcataagtgcctggcggagggaggaaagatcatgaaaattcccggcacctgttgcgacacatgtgaagagccggagtgtaatgatatcaccgctagactgcagtacgtgaaagtcggttcctgtaaatcggaggttgaagtggacatccattactgccaaggcaagtgcgcatctaaagccatgtatagcattgacatcaatgatgttcaggatcaatgttcttgttgcagccccacgaggaccgaacccatgcaggtggcattacattgcaccaatggtagtgtggtgtaccatgaggttttgaatgctatggagtgcaaatgttcacctaggaagtgtagcaaa

SEQ ID NO: 21314 - DNA, 8439 bp, Artificial Sequence
  Description of Artificial Sequence: Synthetic coding sequence
atgattcctgcccgttttgcgggtgtgctgcttgctctggcccttatactgcctggcacactgtgtgcggaaggcacccggggcaggtcatctacagctcgatgctctttgtttggctctgattttgttaacacatttgatggctccatgtactccttcgcgggctactgctcatacttgcttgccgggggatgccagaagcgttcctttagtatcataggcgattttcagaacggcaaacgggttagcttgagtgtttatctgggggagttcttcgatatccacctgttcgtgaacggcaccgtgacccaaggcgaccagagggtgtccatgccctacgcctccaaaggtctgtacctagaaacggaggctggatattataagcttagcggagaggcctacggctttgtggcccggatcgacggatctggaaacttccaggtgctcctgtccgacagatattttaacaaaacatgcggtctctgcggtaactttaacatcttcgccgaagatgatttcatgacccaggaagggacccttacttcagacccttacgacttcgcaaattcatgggcactgtcttccggtgaacaatggtgcgaacgcgcctcaccccccagttcctcatgcaacatctctagcggagagatgcagaagggactgtgggagcagtgccaactgctcaaatctacaagtgtgttcgctaggtgtcatcctcttgtggacccagaaccatttgtggccttatgtgagaagactctttgcgagtgcgccgggggcctggagtgtgcatgcccagccctgctcgagtatgccagaacttgtgcccaagaaggaatggttctctatggatggactgaccattctgcctgcagccccgtgtgcccagccggcatggagtatcgccaatgtgttagcccttgcgcgcgaacctgtcagtccctacacattaatgaaatgtgccaggaacgttgcgtcgatggatgcagctgccccgaaggccagttacttgacgaaggcctgtgtgtggagtcaacggagtgcccatgcgtgcactctgggaagcgttatccccccgggacttctctatcccgtgattgcaatacctgcatttgtcggaactctcagtggatctgctctaatgaagaatgccctggcgaatgcctggtcactggccagagtcacttcaaatcttttgataatcggtacttcacgttttctggcatctgccagtacctcctagcgcgggattgccaggatcacagtttttccatcgtaatagagacagtgcagtgtgcggatgacagggatgctgtttgtacccgctctgtgacggtccggctcccagggctgcacaattcacttgtcaagcttaagcatggggcaggggttgccatggatggccaggatgtccagctgccccttctgaagggagatttgagaatacagcacacagttacggcatctgtacgcctgagctacggagaagatctgcagatggactgggacggccgcgggaggctcctcgttaaattaagcccggtgtacgctggaaagacctgtggactgtgtggaaattataatggaaatcagggcgacgactttttgacaccatccggattggccgagccacgggttgaagatttcgggaacgcttggaaacttcacggcgattgccaagacctgcagaagcaacacagcgatccctgcgcactaaacccaaggatgaccaggttcagcgaggaggcttgtgcagtgcttacgagtcctactttcgaggcttgccaccgtgcggtgagtcctctgccgtacctgcggaattgtcgatacgatgtgtgttcatgttcagatggacgggagtgcctgtgtggcgctctcgcatcatatgctgctgcatgtgccggtagaggcgttcgcgtcgcttggagggaaccaggccggtgtgaactcaattgccccaagggacaggtatacctgcaatgcggcacaccatgcaacctcacctgtaggagccttagctacccagatgaggagtgcaacgaggcatgtttggagggctgtttttgtccgcctggtttgtatatggacgaacggggtgactgcgtgccaaaggcacagtgtccgtgctattatgacggagagatttttcagcccgaggacatttttagtgaccaccataccatgtgttattgtgaggatggctttatgcattgtactatgtctggtgtaccaggaagcctgctgcccgacgcagtactaagctcaccccttagccaccggagtaagaggtcgctgtcctgcaggcctcctatggtcaagttggtgtgccccgcagacaatctgagggcggaagggctggaatgtactaagacctgtcagaactacgacctggagtgcatgtctatgggatgtgttagcgggtgtctgtgccctccggggatggtacggcacgagaatcggtgcgtcgcattagagagatgcccatgtttccatcagggcaaggagtatgcaccaggcgaaaccgtaaaaatcgggtgtaacacgtgcgtgtgtcaggatagaaagtggaactgtacggatcatgtttgcgacgcaacctgcagtaccataggaatggctcattacttaactttcgatggtctcaagtacttgttccctggtgagtgtcagtacgtactggtccaggattactgcggatccaatcccgggactttccgcatcctcgtggggaacaagggctgctcacatccctcggtgaagtgtaaaaagcgcgttacaatcctggtggaggggggtgagattgaattatttgacggagaagttaatgtgaagagacctatgaaggatgagactcatttcgaggtggtggagtccggacgctacatcattttgctactgggaaaagccctgtcggtggtgtgggaccggcacctcagcatatcggtcgtcctgaaacagacctatcaggagaaggtgtgcggcctctgcggtaattttgatggaattcaaaacaacgatcttacttcatctaatctgcaagttgaggaggatccagtggactttgggaattcctggaaggtgtccagccaatgtgctgatacccggaaggtaccactggacagttctccggctacgtgccataataacatcatgaaacagaccatggttgattccagctgcaggatcctgacatcagacgtcttccaggattgcaacaaacttgtggatcctgaaccttacttggatgtatgtatctatgacacttgtagctgcgagagcattggtgactgcgcctgcttctgcgatacaattgctgcctatgcccatgtgtgtgctcagcatggcaaagtggtgacctggagaacagcaacactatgtcctcaatcctgtgaggaaagaaacctgcgtgagaatggatatgagtgtgagtggcgttataacagctgtgctccagcatgccaagtgacgtgccaacacccagagccacttgcatgccctgtgcagtgtgttgaaggctgccacgcccattgtccacctgggaaaatcctggacgagctgctgcagacatgcgtggaccccgaggattgcccagtgtgcgaagtcgccggccgacggtttgcctctggcaagaaagtgactctgaacccatcagatccagaacattgtcagatttgccattgcgacgtggttaatctgacttgtgaggcctgccaggagcccgggggattagtcgtccctccgacagatgccccagtttctccaacaaccctttacgtcgaggacatctcagagccccccctgcacgacttttattgctctcggctgctcgatctcgttttcttactggatgggtctagcagattatccgaggctgaattcgaggtgctcaaagccttcgtcgtcgatatgatggagcgcctgcggataagccaaaagtgggtgcgggtcgccgtggtggagtatcatgacgggagccacgcatatataggacttaaggatagaaagcggccatctgagctgcgccgtatcgcctctcaggtgaagtacgcgggatcccaagtggccagcactagtgaggttctcaagtatacccttttccagattttcagcaaaatagataggccggaagcttctagaatcaccctgttgctgatggccagtcaggaaccacagagaatgagcagaaattttgtccggtatgtgcaaggcctgaaaaagaaaaaggtaattgtgatcccggtgggcatcgggcctcacgccaatcttaaacagatcagacttattgaaaagcaagcgccagagaacaaggcttttgttctgtcgtccgtggacgaattagaacagcagagggatgagattgtgtcatatctctgtgacctcgccccagaggcacccccaccgactctcccgccagacatggcacaggtgaccgtgggacctgggttgctgggggtatccaccctgggaccaaaaagaaacagcatggtgctggacgtagctttcgtcttagaaggctctgataagatcggcgaagcggatttcaaccgatccaaggagtttatggaggaggtgatccagcggatggatgtaggacaggattccatccacgtgaccgttctccagtatagctatatggtaaccgtggaataccccttcagcgaggcgcagtccaagggcgacatcctgcaaagggtgagggaaatacgatatcagggcggtaacaggactaacacaggtttggctctcaggtatttgagcgaccatagtttcttggtgtctcagggtgatcgagagcaggctccaaacctcgtgtacatggtgacgggtaatcctgcttccgacgagatcaagcgactgcctggcgatatccaggtggtaccaatcggggtaggcccgaacgcaaacgtgcaggagctagagagaatcgggtggcccaatgcacctattctcattcaggatttcgagaccctcccaagagaggcccctgacttggtactccagaggtgttgctcaggtgaaggtttacagatccccacactgagccccgcaccggactgctcacaaccactggacgtgatattattattagacggcagcagcagcttcccggcctcttatttcgacgaaatgaagtcctttgcaaaagcttttataagtaaagccaatatcgggcctagactgacacaggtgtcagtgctgcaatatggctccattaccacgattgatgtgccttggaacgtggtgcccgaaaaggcgcatctgctgtcccttgtcgacgttatgcagcgggagggaggccccagtcagatcggagacgccctggggttcgctgtgcgatatttgacttccgagatgcacggcgcacgcccaggagcatccaaagcggtggttattcttgtgacagacgtgagcgtggattcagtggatgccgcagccgatgcagctcgatcaaaccgtgtgaccgtattcccgatcggaataggcgatagatacgacgcggcccagctccggattctggccggcccagcgggagacagcaacgtcgtcaagctgcaacggattgaagatctccccacaatggttactttaggaaatagttttctacacaagctctgcagcgggtttgtacgaatttgcatggacgaagatgggaatgaaaagagacctggcgatgtgtggacactgcctgatcaatgccacactgtgacctgccaaccggatggacagacactcttgaagtcacatagagtcaactgtgaccgcggcctgcgtccgagctgtcctaactcccagtctcccgtgaaggtggaagagacttgtggttgccgctggacatgtccatgcgtttgcactgggagctcgaccaggcatatcgtgacgttcgatggccaaaactttaaattgaccggctcctgtagctatgttttgttccagaacaaagagcaggatcttgaggtgatactccacaacggagcttgttcaccgggcgctcgacaagggtgtatgaaaagcattgaggtgaaacacagtgctctgagcgtagagctacactcggacatggaggtaactgtgaacggacggcttgtgtctgtcccatacgtcgggggaaacatggaggtgaacgtttatggtgctatcatgcacgaggtaagattcaaccacctcggtcatattttcacttttacaccgcagaacaacgagtttcagctccagttgagcccaaagactttcgcatccaagacatatgggctctgtggaatctgtgatgagaatggagcgaacgactttatgctccgggatggaaccgtaaccacggactggaaaaccctggtgcaggaatggactgtgcagagaccgggccaaacctgccaacctatccttgaagaacaatgcctcgtgccagattctagccactgtcaggtgctgctgcttcccctgtttgcagaatgtcacaaggtgcttgctccggccaccttctatgccatttgtcagcaagacagttgccaccaagagcaggtgtgtgaagtgatcgcctcttatgcgcatctgtgtcgcaccaatggggtatgtgtcgattggcgcacaccggacttttgtgccatgagttgtcctccgtcactggtctataaccactgtgaacatggttgcccgcgccactgcgacggcaacgtctcatcttgcggagaccatccgtccgaaggctgtttctgtccgcccgacaaagttatgcttgagggtagctgtgtgcccgaggaggcatgcacccaatgcatcggtgaggacggcgtgcagcatcaattcctggaagcttgggtgcccgatcaccagccctgccaaatctgtacatgtctcagcggtcggaaagtgaactgtactacacagccttgcccaacagcaaaagctcccacatgtggcctgtgcgaagtggcccggctccgccagaatgccgatcagtgttgccctgagtacgagtgtgtctgcgatcccgtgagttgtgacttaccgccagttcctcactgtgaacgtggccttcaacctacactgacaaatccaggtgaatgtcgtccgaatttcacctgcgcatgtaggaaagaagagtgcaagcgggtctcccccccctcatgtcctcctcatcgcttacccaccctgcgcaaaacacaatgctgcgatgaatacgagtgcgcttgcaactgcgtgaactcgactgtctcgtgtccccttggatatctggccagcactgcaactaacgactgtggttgcacaacaacaacatgtctacctgacaaggtttgcgtccatcgaagtaccatctaccctgtcggacagttttgggaagagggctgtgacgtatgtacctgcactgacatggaagacgctgtcatgggactccgcgttgcccagtgtagccaaaagccctgcgaagactcctgcaggagcgggtttacatatgtgctgcatgagggggagtgctgcggtagatgcctgccttctgcctgtgaagtggttactggtagtccccgtggcgactctcagagcagctggaagtccgtgggctcccagtgggcctctcctgaaaacccttgtctgattaatgaatgtgtgcgtgtgaaggaggaggtctttattcagcaacgaaatgtgtcttgcccacagttagaagtgcctgtgtgcccatcggggtttcagctgagttgcaagacttcggcttgttgtcccagctgccgctgtgagaggatggaagcgtgcatgttgaatgggacggtaattgggcctggcaagacagttatgattgatgtgtgtactacctgtcggtgcatggtgcaggtgggtgtgatttccgggtttaaactggagtgcaggaaaactacctgcaacccttgcccactggggtataaagaagaaaacaacacgggcgagtgctgtgggcgatgcttgcccacggcttgtactattcagcttaggggaggacagataatgactctaaagcgggatgagactctgcaagatggctgtgatacccacttctgcaaagtgaacgaaagaggcgagtatttctgggagaagcgagtcaccggctgtcctcctttcgatgagcacaagtgcctcgctgaggggggtaagataatgaaaatcccggggacttgctgtgatacatgcgaagaacccgaatgcaatgatataactgccagacttcaatatgtgaaagtcggcagctgtaagtccgaggtagaagtggatattcattactgccagggcaaatgcgcatctaaggccatgtacagtatcgatattaatgacgtgcaggaccaatgctcttgctgttcgcctacacgaacagagcctatgcaagtcgctctgcattgtacaaatgggagtgtggtttaccacgaggtacttaatgccatggaatgtaagtgcagccctcgcaagtgttctaag

SEQ ID NO: 21315 - DNA, 8439 bp, Artificial Sequence
  Description of Artificial Sequence: Synthetic coding sequence
atgatacctgcacggttcgcgggagtgctgctggctctggcgttgatcctgccgggcaccctttgtgccgaagggacccgcggacgctcctcgaccgcgaggtgctcccttttcggatcagatttcgtgaatactttcgacggtagcatgtactccttcgctggctactgctcatacctgctcgcgggcggttgccagaagaggtcgttctcaatcatcggggacttccagaacggtaaacgcgtgagcctgtcagtttaccttggcgagttcttcgacattcatctcttcgtgaatggaaccgtgacccaaggcgaccaaagggtttccatgccttacgcctctaagggcctgtatctggagactgaggccggctactacaaactctccggcgaggcctacggtttcgtagcgcgcattgatggatcaggtaacttccaggtgctgctgtccgatagatacttcaataagacgtgcggactctgcgggaactttaacatctttgcggaggacgacttcatgactcaggaaggcaccctgacttcggacccgtacgactttgccaatagctgggccctgtccagcggagaacaatggtgtgagcgggcctcgccgccttcctcctcatgcaacatttccagcggagagatgcagaagggactgtgggagcagtgtcagctgctgaagtccacttccgttttcgcccgctgtcaccctctggtagaccctgaacctttcgtggctctgtgcgaaaagacgctctgtgagtgcgccggcggactggaatgtgcatgtccggctctgctggaatacgcccggacttgcgcccaggagggcatggtgctgtacggttggacggatcattcagcgtgtagcccggtttgtcctgcggggatggagtatcgccaatgcgtctccccgtgcgcgcggacctgccaaagcctgcacatcaatgagatgtgccaggagcggtgcgtcgacggatgctcgtgccctgaaggacagctgctggatgagggactctgcgtcgagtcgactgaatgcccgtgcgtccactcgggaaaaagatacccgccgggaacctcactctcgcgcgattgtaacacttgcatctgtcggaactcacagtggatctgcagtaacgaagaatgtccaggcgaatgcctcgtcaccggccagtcgcacttcaagagctttgacaaccgctactttactttctcagggatctgtcaatacctgctggcgagagattgccaggaccatagtttctcgatcgtgatcgagactgtccagtgcgccgacgaccgggatgccgtgtgcactcggtccgtgactgtgaggctgccgggactgcataactccctcgtgaagttgaagcacggcgccggggtggcgatggacggacaggatgtgcagcttcccctgctgaagggagacttgagaattcagcacactgtgactgcatccgtgcgcctgtcgtacggcgaagatctccagatggactgggatggacgcggccgcctgctcgtgaaactttcaccagtctatgctggaaagacttgcggactgtgtggaaactacaacggaaaccaaggcgacgactttttgactccgtctggactggctgagccacgggtggaagatttcggaaatgcctggaagttgcacggagactgtcaggacctccaaaagcagcacagcgatccctgcgctctcaaccctcgcatgactaggttttcggaagaggcgtgcgccgtgttgacctccccgaccttcgaagcctgccaccgcgcagtgtcgccgctcccttaccttaggaactgcagatacgacgtgtgctcgtgctcggacggacgagagtgcctgtgtggggcgctcgcatcatacgcggcggcgtgcgccggtcggggtgtgagagttgcatggcgcgagccgggccggtgtgagctcaattgcccgaagggacaggtctacctccagtgcgggactccctgtaacctcacctgcagaagcctttcgtaccctgatgaggaatgcaatgaagcctgcctggagggatgcttctgccccccgggcctctacatggatgagcgcggggactgcgtgccaaaggcgcagtgcccttgctactacgacggcgagattttccagccagaggacatcttctccgatcatcataccatgtgctactgcgaagatggtttcatgcattgtaccatgtcgggagtccccggatcgctgttgccggatgcggtcctgtcgtcgccattgtcgcaccggtctaagcgctccctctcctgcaggccacctatggtcaaactggtctgcccagctgataacctcagggccgaagggctcgagtgcactaaaacctgccaaaactacgatttggagtgtatgtctatgggatgcgtgtccggttgcctgtgcccgcccggaatggtgcgacatgagaaccggtgcgtggcactggaaaggtgcccttgctttcaccaaggcaaagaatacgccccgggagaaactgtgaaaatcggctgtaacacgtgcgtgtgccaggatagaaaatggaactgcaccgaccacgtgtgtgacgcgacctgcagcaccatcggaatggcgcattacctgactttcgacggactcaagtacttgttcccgggagaatgccagtatgtgctcgtccaggattactgtggatccaacccaggaacctttcggatcctcgtcggtaataagggctgttcccacccctctgtcaagtgcaaaaaacgggtcaccatcctggtggagggcggtgaaatcgagctctttgacggcgaagtcaacgtgaagcgccctatgaaggacgaaactcattttgaggtggtcgaaagcggtagatatatcatcctgctcctcgggaaagcgctgagcgtggtctgggacagacacctttcgatcagcgtggtgcttaagcaaacttaccaagagaaagtctgtggtctttgcggtaacttcgacggcatccagaataatgacctcacttccagcaacctgcaggtggaggaggacccggtggactttggcaatagttggaaagtgtcgagccagtgtgccgacactcggaaggtccctttggattcatcgcccgctacctgccacaacaatatcatgaagcagaccatggtggattcgagctgcaggatcctcacttcggatgtgtttcaggattgtaacaagctggttgatcctgagccgtaccttgacgtctgcatttacgatacctgttcgtgcgaatcgatcggagactgcgcttgcttctgcgataccatcgcagcttacgcccacgtctgtgcgcaacatggaaaggtggtgacctggagaaccgcgactctttgcccacagagctgcgaggaacggaatctgcgcgagaacggatacgaatgtgaatggcgctacaacagctgcgcaccggcctgtcaagtgacgtgccagcacccggagcccctcgcctgcccggtgcagtgtgtggaaggatgccatgcccattgccctccagggaagatcctcgacgagctcctccagacgtgcgtggacccggaagattgccctgtgtgcgaggtggcgggccggcgcttcgcctcagggaagaaggtgaccttgaatccatcggacccagagcattgccagatttgccattgcgacgtcgtgaacctgacttgtgaggcgtgccaggagccgggagggctcgtggtgcctcccactgatgcaccggtgtcccccactactctgtacgttgaagatatctcggagccaccgctgcatgacttctactgctcgcgtctgcttgacttggtgttcctgctggacggctcctcacggctgtcagaggcggagtttgaagttctcaaggcattcgtggtggacatgatggaacgcctgaggatctcccaaaagtgggtgcgggtggcggtggtggaataccacgacggatcgcatgcctacatcggcctcaaggatagaaaaagaccctccgagctccggcggatcgcatcccaggtgaagtacgccggaagccaggtggcctcaacctccgaagtgctgaagtacaccctgttccagatcttcagcaagatcgacagaccggaggcctcaagaatcaccctgctgctgatggcgtcccaggaacctcagcggatgtcgcgcaacttcgtccgctacgtgcagggcctcaagaaaaagaaggtcatcgtgatcccggtcggaatcgggccgcacgcaaatctgaagcagatccggctcatcgaaaagcaggccccagaaaacaaagcgtttgtgttgtcatccgttgacgaactggaacaacagcgcgacgagatcgtgagctatctctgcgatctggcacctgaggcaccgcccccaactctcccgcccgatatggctcaggtcaccgtgggtccaggcctcctgggcgtctccaccctgggcccgaagcgcaactccatggtgctggatgtggcgttcgtgctcgagggctctgacaagatcggggaagctgactttaatcgttcgaaggagtttatggaagaagtgatccagaggatggacgtgggtcaggactccatccacgtgaccgtcctgcaatactcgtacatggttacggtggaataccctttctccgaggcccagagcaagggggatatcctccagcgcgtgagagaaatccggtaccagggaggaaacaggaccaacaccggccttgcactgcgctacctctccgatcactcgttcttggtgagccagggtgaccgggagcaggcaccgaacctggtatacatggtgaccggtaacccagcatccgacgaaatcaagaggctgccaggggatatccaggtggtgccgattggagtgggaccgaacgccaacgtccaggagctggagagaatcggctggccaaacgccccgatcttgatccaggacttcgaaactctgccgcgggaagccccggacctggtgctgcagaggtgctgctcaggtgaaggacttcagatcccaacgttgtccccagcccctgattgtagccagccccttgacgtcattttgttgctcgacggatcctcatccttcccggctagctacttcgacgagatgaagtcttttgcaaaggcattcatctccaaagccaacatcgggccaagattgacccaagtctcagtcctccaatacggatcaatcacgaccatcgacgtcccatggaatgttgttcctgaaaaggcgcacctcctgtccctggttgatgtgatgcaaagagagggaggtccatcccagatcggagatgcactgggattcgccgtgcggtacctgacgtcggaaatgcacggtgcgcgcccaggggcctccaaagcggtcgtgatcctggtcaccgatgtgtcggtggactcagtggacgcggcggcagacgcagcccgctcaaaccgggtcaccgtgttccctattggaatcggagacagatacgatgctgcccaactcagaatcctcgccggacctgccggagatagcaacgtcgtgaaattgcaaaggatcgaagatctgccaaccatggttaccctcggcaacagcttcctccacaaactctgcagcggatttgtgcggatctgcatggacgaagatggaaatgagaaaagacccggggacgtctggaccctgccggatcagtgccatactgtcacttgccaaccggatggacaaactctcctgaagtcgcatagagtgaattgcgatcgggggctccgcccatcgtgtcctaactcacagtcgccggtgaaggtggaggaaacctgtggctgccggtggacttgcccatgcgtctgcactggatcttcgactaggcacattgtgactttcgatggacaaaacttcaagttgaccggttcgtgcagttacgtgctgttccagaacaaggagcaggacctggaggtgatcctccacaatggcgcttgctctccgggagcccggcagggctgtatgaagagcatcgaggtgaagcattccgctttgtcggttgaactgcatagcgacatggaggtcactgtgaatggaagattggtatctgtgccttatgtgggcggcaatatggaagtgaatgtctacggagcgatcatgcacgaagtcagattcaatcacctcggtcatatctttacgtttacgccgcaaaacaacgagttccaactccaactcagcccgaaaactttcgcctcgaaaacttacggtctgtgtggtatctgcgacgaaaatggtgctaacgactttatgctgagggacggaactgtgacgacggactggaaaacgctcgtgcaagagtggacggtgcagcgccccggacagacttgtcagccgattcttgaggagcaatgcctcgtgccagattcttcgcattgccaagtgctcttgctgccgctgttcgcagaatgccataaagtactggccccagcaaccttctatgccatttgccaacaggactcatgccaccaagaacaggtctgcgaggtgatcgcgtcttatgcccatctctgtcgcacgaatggcgtgtgcgtggactggagaacccccgacttctgcgcgatgtcatgcccgccgtcgctggtgtataatcactgcgaacatggatgtccgagacattgtgacgggaacgtgagctcatgcggcgaccacccgtcagaaggatgcttctgtcctcctgacaaagtgatgctggaagggtcctgcgtgccggaagaagcatgcactcagtgcatcggagaggacggagtgcaacatcaattcttggaagcatgggtgccggaccaccaaccgtgtcagatctgtacctgtctgtccggaagaaaagtgaactgcaccactcagccttgtccaaccgccaaggccccaacctgtggtttgtgcgaagtggcgcggctgcggcaaaacgcagatcagtgctgcccagaatacgagtgtgtgtgcgatcctgtgtcctgtgaccttccaccggtgcctcactgtgaacgcggactccagccgactctgactaaccccggagaatgccgaccgaactttacctgcgcttgccgcaaggaagagtgcaagcgcgtctcgccaccttcctgccctccacaccggctgccgaccctgcggaaaacgcaatgttgtgacgaatatgagtgtgcatgcaattgcgtcaatagcactgtctcctgcccgctgggatacctggcttcgactgccaccaacgactgcggctgtaccaccactacttgcctgccggataaagtctgcgtgcaccggtcgaccatctatccggtgggtcagttctgggaagagggatgtgatgtgtgtacctgcaccgacatggaagatgcagtgatgggactgcgcgtcgcccaatgctcccagaagccatgcgaggactcctgcaggtcgggatttacttacgtgttgcacgagggagaatgctgcggccggtgcctgccctcggcctgcgaagtcgtgaccggttcgccgcgcggtgactcgcaatcctcttggaagtcagtcgggtcacagtgggcctccccggagaacccgtgcctcatcaatgagtgcgtccgggtgaaggaagaagtgtttatccaacagcgcaatgtctcgtgtcctcagctcgaggtgccggtgtgcccgtcaggattccagctctcgtgcaagacttccgcgtgttgcccgtcgtgccgatgtgaacgcatggaagcctgcatgctcaatggcacggtgatcgggccaggtaagactgtcatgatcgatgtgtgcactacctgccgctgcatggtgcaggtcggtgttatctccggattcaaactcgaatgccgaaaaaccacctgtaatccttgtccgttgggatacaaggaagaaaacaacactggtgaatgttgtggcagatgcctcccgaccgcttgcaccatccagctgcggggagggcagatcatgaccctcaaacgggacgaaactctgcaggatgggtgcgacactcacttttgtaaggtgaatgagaggggagagtacttctgggaaaaaagagtgactgggtgtccgccgttcgacgaacacaagtgcctcgctgagggcggaaaaatcatgaaaatccccggaacttgttgcgacacctgtgaagaacccgagtgtaacgacatcactgcgcggcttcaatacgtgaaggtgggctcctgcaagtccgaggtggaagtggacattcactattgccaaggcaaatgcgcctcgaaagctatgtactccatcgacatcaacgatgtccaggaccagtgttcgtgctgctcaccaacccggaccgaacctatgcaggtggctctgcactgcaccaatggctccgtggtgtaccacgaagtgctcaacgcgatggagtgtaagtgctccccgcgcaagtgttctaaa

SEQ ID NO: 21316 - DNA, 8439 bp, Artificial Sequence
  Description of Artificial Sequence: Synthetic coding sequence
atgattccggccaggttcgccggggtcctgctagccctcgctctaatcttaccgggaacgctgtgtgcagaagggacgcgaggccgctcgtcaacagcccggtgtagcttgtttggatccgactttgtaaatacattcgatgggagtatgtatagttttgcagggtactgcagctacctactggcaggagggtgtcagaaacgatccttctccataattggagacttccagaatggcaaacgggttagcctcagtgtgtatttaggcgagttttttgacatacacctgtttgttaatggcaccgtgacacaaggggaccagcgcgtgtcgatgccctatgccagcaagggactatatttggagaccgaggccggctactacaagctgtcgggtgaagcctacggtttcgtggcgagaatcgacggctctggcaacttccaggtgctgctcagcgacagatacttcaacaagacctgtggattgtgtggcaactttaatatcttcgctgaagatgactttatgactcaggagggtaccctcacgtccgatccatacgactttgcaaattcatgggctcttagctctggtgagcaatggtgcgagagggcctcacccccaagtagttcatgtaatatttcatccggggagatgcagaaaggactttgggagcagtgccagctacttaaaagcactagtgtgttcgccagatgccacccccttgtagatcccgagccattcgtggctttgtgcgagaaaacgctatgcgagtgtgcaggcggtctagagtgcgcctgtcctgccttgctggaatacgctcggacctgcgcacaggaaggcatggtgctgtacggctggactgatcacagcgcatgctcacctgtgtgccccgccggaatggaataccgtcagtgcgtgagcccatgcgcgcgtacatgccaatctcttcatattaacgaaatgtgccaggaaaggtgtgttgacggatgctcttgccctgaagggcagctcctcgatgagggcttgtgtgtcgaaagtactgaatgtccatgtgtgcattcaggtaagcgctatcccccaggaacatccctatccagagattgtaacacttgcatttgccggaacagtcaatggatctgctctaacgaggaatgcccgggggagtgtctggtgactggacagtcacatttcaagagtttcgataacaggtattttaccttctcaggcatttgccagtacctgctcgctagggactgccaggaccacagcttcagcattgtaatcgagactgttcaatgtgcagacgatagggacgccgtttgtacgagatccgtcaccgttagattgcctggtcttcacaactccctggtgaaattgaaacacggagccggggttgctatggatgggcaagatgtgcaactgccgttgctaaaaggggacttgaggatccagcatacagtaactgcctcagtacgtctgagttacggagaggatctccagatggactgggacggccgaggaaggctactggtgaagctttccccggtgtacgctgggaaaacttgcgggctctgcggtaattataatggcaaccagggtgacgacttcttgaccccatcagggttagctgaacctagagtagaagattttggtaacgcatggaagctgcacggcgactgtcaagatctgcagaaacaacattcagatccatgcgcactaaatccgagaatgacaaggtttagcgaggaagcttgtgccgtgctcacaagtcctacttttgaagcgtgccaccgagccgtttcgcccttgccatacctacggaactgtcgttatgacgtctgtagctgtagcgacgggagggaatgcctgtgcggcgcactggcctcttatgccgcagcctgcgctggtcggggggtgcgcgttgcttggcgtgaacccggaaggtgcgaactgaattgtcctaagggccaggtatacctgcagtgtgggaccccatgtaatctgacgtgccgctcattatcctacccagacgaggagtgcaacgaggcctgcctggaaggttgtttttgtccacctggtctgtatatggacgaaagaggagattgcgtgcctaaggcccaatgcccgtgctattacgacggcgaaattttccagccagaggatatcttttctgatcaccataccatgtgctactgcgaggatggattcatgcactgcactatgagtggagtccctggatctctactccctgatgcagtcctgagctctcctctgagccatcgttccaagaggagtttgagctgtcgcccgcctatggtgaagctcgtctgccccgccgataacttacgtgccgaagggctggagtgtacaaagacttgtcaaaactatgatctggagtgtatgagcatggggtgcgtttcggggtgcctgtgccctcccggaatggtgagacatgagaaccgctgcgtcgccctggagagatgtccttgtttccaccagggcaaagagtacgcaccgggcgagaccgtcaaaatcgggtgcaatacatgcgtttgccaggatcgcaagtggaactgtaccgatcacgtgtgtgacgctacctgttcaactatcggtatggctcattacctgacatttgatgggctgaaatatctttttccaggcgaatgccagtacgtactcgtgcaagactactgcgggtccaaccctgggactttcaggattctggtcggaaataagggctgcagccacccttcggtgaagtgcaaaaagcgggtgactatactcgttgagggtggtgaaattgaactgttcgacggtgaagttaatgtgaaaagacccatgaaagatgagactcattttgaggtcgtcgaatccggccggtacattatcctgctgctgggaaaggcgctgagcgttgtctgggaccgtcatctgagtatctctgtggtgctgaaacaaacatatcaagaaaaagtttgcgggctttgcggcaatttcgacggaatacagaacaacgacctgacttcttctaatttgcaagtggaagaagatcccgtcgattttggaaacagctggaaagtcagctcgcagtgtgccgacacccggaaggttccactagattcgagcccagcaacctgccataacaatatcatgaagcagacaatggtggactccagttgtcggattctgacaagtgatgtctttcaggactgtaataaacttgtagatcctgaaccctacttggacgtctgtatatacgatacttgtagttgcgaaagcattggcgattgtgcttgcttttgtgatacaatcgccgcttatgctcacgtgtgtgcacagcacggaaaggtcgtgacctggcgcaccgccacactgtgcccgcaatcgtgtgaggagagaaacctgcgcgagaatggatacgaatgcgaatggcgttacaattcttgtgcgcccgcctgtcaggtaacctgccagcaccccgaacctctggcctgtccagtgcaatgcgttgaagggtgccatgcccactgtccgcctggtaaaatcctggacgagctgctgcaaacgtgtgtggacccagaagattgccccgtgtgcgaggtggccgggcgacgcttcgctagcgggaagaaggtgaccctgaatccgagtgatcccgaacattgccagatttgccattgcgatgtggtgaacctgacctgtgaggcttgtcaggaaccgggtggacttgtggttccaccaacagacgcgcctgtgtcaccaactacactatatgtagaggatatctccgagcctcccctccacgacttttactgtagtaggctgctcgatctggtctttctactggatggttcctctcggctgtctgaagccgaatttgaagtactgaaagccttcgttgttgacatgatggagcgcctccgaatttcccaaaagtgggtgagggtggccgtggtcgagtatcatgacggctcccacgcttatatagggctgaaagatagaaaaaggcctagcgagctgcggcgtatagcaagtcaggtcaaatacgccgggtcccaagtggcttcgacaagcgaggtgctcaagtacacactttttcagatcttcagcaaaatcgacaggcctgaagccagcagaattacgcttctgctgatggcaagtcaggagccgcaacgaatgtctcggaattttgtccgctatgtgcagggactgaagaagaaaaaagtgatagtgattcccgttgggatcggcccgcatgcgaacctcaagcaaatccgattaatagagaaacaggcccctgagaacaaagcttttgtgttgagctctgtggacgagttggaacagcagagagacgagattgtaagctacctttgcgatctggctccagaagccccaccgccgacactgccgcctgatatggcacaggtcacagtaggacctgggctgctgggagttagtactttgggtccgaagcggaactccatggttctggacgtggcctttgtcctcgaaggcagtgacaagataggcgaggctgacttcaaccggtcaaaggaattcatggaggaggtgattcagcgtatggacgtgggccaggactccattcacgtcacagtcctgcagtacagttacatggtaacagtcgaatacccattctctgaggcccagtcaaaaggcgacatcctgcagcgtgtccgggaaatcagataccaagggggcaatcgtacaaatacgggcctcgcactgcgatatctgagtgaccatagcttcctggtgagccagggggatagggaacaagcccccaacctcgtgtacatggtaactggaaatccggccagcgatgaaatcaagagactgcccggagatatacaagtcgtccctatcggagttgggccgaatgctaatgtgcaggaattggaacggatcggatggcctaacgctccaattttaatccaggacttcgaaacattgccgcgcgaagcacccgatttagtgctacagcgatgttgttctggagagggactgcagattcctaccctgtctccagctcctgactgctcccagcccctcgatgtgatactcctgctggatggttcctcatcctttcctgcaagctatttcgatgagatgaaatccttcgccaaggcattcatctcaaaagcgaacatcggccctaggctaacccaggtgagcgttctccagtacgggagcattacaacaatcgacgttccctggaatgttgtacccgagaaggctcatctgctgtccctcgtggatgtcatgcagcgggagggtggacccagccaaatcggagacgccttgggctttgccgtcagatacttgactagcgaaatgcatggcgccaggcctggagcctcgaaggccgtagtgattctggtcacggatgtgtctgtggatagcgtggacgcggctgctgacgctgcccgctccaatagagttaccgtgtttcccatcggtatcggagacaggtacgatgctgcccagttacgaatcttggccggccccgcgggggattccaacgtggtgaaacttcaacgcatagaggatctgccgacgatggtgaccctaggaaacagttttttgcataagctttgttccggattcgtaagaatctgcatggatgaggacgggaatgagaaacggccaggcgatgtgtggacactacctgaccaatgccacacagtcacctgccagcccgatggacagactctactgaagtctcacagagtaaactgtgataggggcctcagaccctcatgtccaaattcacagtcaccagtcaaggtggaggagacttgcggatgtcggtggacatgtccttgcgtatgcactggtagctccacccggcacatcgtgaccttcgatgggcagaactttaaactgacgggcagttgctcttacgtgctctttcagaacaaagagcaggatcttgaggttatacttcacaatggggcttgttcaccaggagcgaggcaaggctgcatgaagagtattgaggtcaaacattccgctctgagtgtggaactgcactcggatatggaagtgacggtcaatggcaggctcgtgtccgtgccatacgtaggcggtaacatggaagttaacgtatatggcgccattatgcatgaggtgaggttcaatcatctgggccacatattcacgtttacgccccagaacaacgaattccaactacagctttcgcccaaaacctttgcgagcaagacctacggcctgtgtgggatctgtgatgagaacggcgctaatgacttcatgttgcgtgatggaacagtcacaaccgattggaagaccttggtgcaggaatggacagtccagcgacctggccagacctgtcagcctatcctggaagagcagtgtctcgtgcccgacagcagccactgtcaggttctactgctacccctattcgccgaatgccataaggtactggcccccgccacattctatgcaatttgccagcaagattcctgtcatcaagagcaggtttgtgaggtgatcgcctcctacgctcatctatgtaggaccaacggggtgtgcgtggattggcggacacccgatttttgtgccatgagctgccccccctctttagtgtacaaccattgcgagcatggctgcccccggcattgcgacggaaatgtgagcagttgcggagaccaccctagcgaaggctgcttctgtcctcccgataaagtgatgttggagggctcttgcgtccctgaggaggcctgtactcagtgcattggcgaggatggcgtgcagcaccagttcctggaggcctgggtcccggatcaccagccgtgccagatctgtacctgtctatcggggcgcaaagtgaattgcaccacccagccatgccctacagcaaaagcccccacatgtggattgtgcgaagttgcccggctcagacagaatgctgaccaatgttgtccagagtacgagtgcgtgtgcgaccctgtttcttgtgatttgccaccagtgccccactgcgagagaggactccagcccacactcactaaccccggagaatgccgcccaaacttcacatgcgcctgccggaaggaggagtgtaagcgagtttcacctcctagctgtccaccgcaccgtttacctacccttcggaagactcagtgctgcgacgagtacgagtgcgcatgcaactgtgtaaacagcacggtgtcttgtccactgggctatctggcctctaccgcgactaatgattgcgggtgcacaaccacaacctgcctgcccgacaaagtttgtgttcacagatccacaatatatcctgtggggcagttttgggaggaggggtgtgacgtgtgtacctgtactgacatggaggacgctgtcatggggttaagggtggcacagtgcagccaaaagccttgcgaggacagttgcaggtcaggcttcacctacgtgcttcacgagggcgagtgctgcggaaggtgtctgccgtctgcctgtgaggtggttaccggtagtccccggggtgactcccagtcctcctggaagtcagtggggtctcaatgggccagtccagagaacccatgtctgataaacgagtgtgtgagagtcaaagaggaggtgtttattcaacagcgtaacgtctcctgtccccaactggaggttccagtgtgtccatccggttttcagctgtcatgcaagacatccgcctgttgtccgagctgccggtgtgaaaggatggaggcatgcatgctgaatggaacagtaattgggcccggtaaaacggtgatgatcgatgtctgcaccacttgtcgatgtatggtgcaagttggcgtcatcagcggtttcaagctcgagtgccggaaaacaacctgtaatccctgccctctgggatacaaagaagagaacaacaccggtgagtgttgcggcaggtgcttgcctacagcatgtacaatccaactcaggggaggacaaattatgacattgaagagggacgagacactccaagacgggtgtgatacacacttctgtaaggtgaacgaacgcggcgaatacttttgggaaaaacgcgtaaccggatgccctccatttgatgagcataagtgtctagcagaaggagggaaaatcatgaagattcccggaacctgttgcgatacgtgcgaggaacctgaatgtaatgatatcactgcacggctgcaatacgtgaaagtcggctcttgcaagagtgaagtcgaggtggatatccattattgccagggaaagtgcgccagtaaagccatgtatagcattgacatcaacgatgtgcaggatcagtgttcttgctgcagtccaacacggacagagcccatgcaggtggccttacactgtaccaacggctccgtggtgtatcatgaggttcttaatgccatggaatgcaagtgctctcctcggaagtgttcaaag

SEQ ID NO: 21317 - DNA, 8439 bp, Artificial Sequence
  Description of Artificial Sequence: Synthetic coding sequence
atgatccctgctaggttcgcaggggtgttgctggccctggccctcatcctgccaggcactttgtgcgcggaaggcactcgggggagatcatccacggctaggtgttctctgtttggctcggatttcgtgaacacctttgacggctctatgtattccttcgcggggtactgtagctacctactcgccgggggctgtcagaagaggtcattttcaatcattggcgacttccaaaacggaaagcgcgtgagtctctcggtgtatttaggtgagttcttcgatatccatttgtttgttaacggaactgtgacgcagggggaccagcgcgtgtccatgccctacgcttctaaaggcctgtatctcgaaaccgaggcagggtattacaagttatctggtgaagcatacggatttgtggcccgaatcgatgggagcggtaattttcaggtactgctctccgaccgttattttaacaaaacctgcgggctctgtggcaactttaatattttcgcagaggacgattttatgacccaagagggcactttaacgtctgacccctacgacttcgctaattcctgggccctgtcgtctggagagcagtggtgtgaaagagcatcacctcccagcagctcatgcaacatctcgtcaggtgagatgcagaagggactgtgggagcagtgccagctgcttaaatcaactagcgtattcgccaggtgtcacccactggttgatcccgagcctttcgtggccctgtgcgagaaaacgctgtgcgagtgcgccggcggtctggaatgcgcctgtcccgctttgctcgaatatgctcggacatgtgctcaggagggaatggtgctctacgggtggaccgaccactccgcatgctcaccagtgtgccctgccggtatggaataccgccagtgtgtgagcccatgtgcgaggacgtgccaatcgctgcatataaacgaaatgtgtcaggaaaggtgcgtggacggttgcagctgcccagagggacagctcctagacgaagggctttgtgtggaatctaccgaatgcccctgtgtccatagcggtaaaaggtacccaccaggaacaagtctgagtagagactgcaacacatgtatttgtcgaaacagccagtggatctgcagcaacgaagagtgtcccggggagtgcttagtgaccggacagtcccatttcaagtcctttgataatagatattttactttttctgggatctgccaatatctcctcgcacgagactgtcaagatcacagcttttctatcgtgatcgaaaccgtacagtgtgccgacgatcgagacgccgtctgtacccggagcgtgacggtgaggttaccaggcctccacaactccctggtgaagctgaaacatggcgctggagtggccatggacggccaagatgtgcagctgcccttgctgaaaggcgacctccggatccaacacacagtgaccgcctctgtcaggctctcctacggtgaggacctgcagatggactgggacgggagaggaagattattggtcaagttaagtccagtctatgccgggaagacctgtggactctgcgggaattacaatggcaatcagggagacgacttcttaacccccagtggactggccgagccccgagtggaagatttcggtaatgcctggaagctgcacggagattgtcaggacttacagaaacagcatagcgacccttgtgctttgaatccccgaatgacccggttctccgaagaagcttgcgccgtgctgacaagccctacgtttgaagcgtgccacagagccgtgtctccattgccatacctgaggaattgccggtacgatgtttgttcctgtagcgacgggagagagtgcttgtgtggcgccttagcctcctacgccgcggcatgcgcaggtcggggagtacgggtggcttggcgggagccaggtcggtgcgagttgaattgccctaagggtcaggtctacttgcagtgtggtacaccgtgtaacttgacctgccggagcttgtcttatcccgatgaggaatgtaatgaagcttgtctggaaggctgtttctgtccccctgggctgtacatggatgagaggggggattgtgtcccgaaagcccagtgtccttgctactacgatggcgagatattccagccggaagatattttttcagatcatcacacaatgtgctactgtgaggacggcttcatgcattgcaccatgagtggcgtaccaggctccctcttgcctgacgccgttttgagtagccctctgagccaccgatcaaagaggagcctgtcttgtaggcccccgatggtaaaactagtgtgcccggcagacaatctcagggcggaagggctggaatgcacaaagacatgccagaactacgatctggagtgtatgtctatggggtgcgtgagcggctgtctgtgcccacccggaatggtgcgccacgaaaaccggtgcgtcgcactagagaggtgtccctgttttcatcagggcaaggagtacgctcccggggagaccgtcaagataggatgcaatacctgcgtctgccaggacagaaagtggaactgcaccgaccacgtgtgtgacgcaacctgttctacaatagggatggcacattatctcacttttgatggattgaaatatctttttccaggtgagtgccaatacgtcctcgtccaggactactgcggctccaatccagggacgttccgtattctggtcggcaacaaaggctgtagccaccctagcgtaaagtgcaaaaaaagggttacaattctcgtggagggcggagaaattgagctcttcgatggcgaagtgaacgtcaagaggccgatgaaggacgaaacgcatttcgaggtggtggaatcaggccgctatatcatccttctgcttggcaaggcactgtcagtcgtgtgggatagacacctgtctataagcgtggtgctgaaacagacctaccaggagaaagtgtgcggtctgtgcgggaacttcgacggaatccagaataatgacctgacttcttccaacctccaggtggaggaggacccagtcgacttcgggaattcctggaaagtgagctctcaatgcgctgacacccgtaaagtgccactggacagctccccagctacctgtcacaacaatatcatgaagcagactatggtggatagcagctgtcgcatcctcaccagtgatgtcttccaggactgtaataaacttgtggatccagaaccctatttggatgtgtgtatctacgacacctgctcctgcgagagcattggggactgcgcatgcttttgtgataccatcgctgcgtacgctcatgtttgcgcccagcacgggaaagttgtgacatggcgcacagcgactctttgcccccagtcatgcgaggagaggaatctccgtgaaaatggctatgagtgcgagtggagatataacagttgcgccccggcttgtcaggtcacttgccagcaccctgagcccctcgcttgtcccgtccagtgcgtggagggctgccacgctcactgccctcctggcaaaatcctggacgagttattgcagacatgcgtggatcctgaggactgcccagtctgcgaagttgctggaaggcgtttcgcttccggtaagaaggtgaccctgaatccctctgaccctgagcattgccagatttgtcattgcgatgttgtgaacctgacgtgcgaagcctgtcaggagccagggggattagtggtgccccccacagatgcccccgtgtctcctaccactctctatgtggaggacatctctgaaccacccctgcacgatttttactgtagcaggctcttggatctcgttttcctcttggatggatccagcagactttccgaggccgagttcgaggtgctgaaggcatttgttgtggatatgatggagcgcctcagaatcagccagaagtgggttcgggttgctgtggtggagtaccacgacggctcacatgcctatatcggcctgaaagaccgcaaacgcccttctgagctgaggaggattgctagtcaggttaagtacgccggcagccaggtggcgtcaacatcggaggtcctgaaatacaccctgttccagattttttccaagattgatcggccggaggccagtagaatcaccctccttttgatggcctcacaggagccccagcgaatgtccaggaatttcgtgagatacgtgcagggcctcaagaagaagaaagtgatcgtcataccagtgggaatcggcccacacgcgaacctaaagcagatcaggttgatcgagaagcaggcccccgaaaataaggcctttgtgcttagcagcgttgacgagctggaacagcagagggatgagattgtgagctatttgtgtgacctggctcccgaggcgcccccgccgaccctccctccagatatggcccaagttaccgtcggacccggcctgttgggcgtctctaccctgggacccaaacgcaattctatggtcttggatgtggcgttcgttcttgaagggagtgataagatcggagaagccgacttcaaccggagcaaggaatttatggaggaggtgatacagcggatggacgtgggtcaggatagtatccatgtcacagtgcttcagtattcttatatggtgactgtcgaatatccatttagcgaagcccagtcgaagggagacattcttcagcgggtaagggagattcgatatcagggcgggaaccggaccaatactggcctcgcactgcggtatctgtccgatcactcttttctcgtgagccaaggcgatagggaacaagcaccaaatctggtttacatggtaaccggaaacccagcttcagatgagatcaaaaggctccccggagacatccaggttgtgccaatcggtgttgggcccaatgccaacgtgcaagaattggagcgaattggatggcctaacgcccctatactgatccaagacttcgagaccttgccccgggaggctcccgacctggtgctacagcgctgctgtagcggcgaaggacttcagatccccactttgtctcctgcaccagattgcagccagcctctggacgtgattctcctcttggatggtagtagtagcttcccagcttcttatttcgatgaaatgaagtcttttgccaaagcattcatcagtaaagcgaatatcgggccccgactgactcaggtgtcggttctccagtatggaagcattacaacaattgacgtcccttggaacgtcgtccccgagaaggcccatctactcagtctagtggacgtgatgcagcgcgaaggcggaccttcccagatcggagatgccctgggctttgccgtacggtatttaactagtgagatgcacggggctagacctggggcatccaaagccgtggtaatactggttaccgatgtttccgtagattccgtcgacgccgcagcagacgctgctagaagtaaccgggtgaccgtttttcctatcggaatcggagatagatacgacgccgcacaacttcggatcctggctggcccagcaggagactctaatgttgtgaaactgcagaggatagaggaccttcccacaatggtgaccctcgggaatagtttcttacataagctctgcagtgggtttgtgcgaatttgcatggatgaagacggcaatgagaaacgcccgggtgatgtgtggaccttgccagatcagtgtcacactgtcacgtgccaacctgatgggcagaccctcttaaagagtcatagagtgaactgtgaccgggggctccgaccgtcctgtcccaactcccagagtccagtgaaagtggaagaaacttgcggatgtcgttggacctgtccatgtgtgtgtacaggctctagcacgcgacatattgtcacatttgacggacaaaatttcaaactaactggctcttgcagctatgtgctgttccagaacaaagaacaggaccttgaggtgattcttcacaatggcgcctgtagtcctggggcgcgacagggatgtatgaaaagcatcgaagttaaacacagcgcactgagtgttgagctccatagtgatatggaggtgacagtgaacggtcggctcgttagtgtgccatacgtcgggggtaatatggaggtcaacgtgtatggagctatcatgcacgaggttcgattcaaccacctgggccacatcttcacctttaccccgcagaacaacgagtttcagctgcaactgagccccaagaccttcgccagtaagacttatggcttgtgcggtatctgtgacgaaaatggggcaaacgattttatgctgcgcgacggaactgtaacaaccgattggaaaaccctcgtccaggagtggaccgtgcaaagaccgggtcagacctgccagccaattctcgaagagcaatgcctggtccctgattcaagtcactgtcaggttctgctgttacccttgttcgcagaatgtcataaggtgctggctcccgcaacattctatgcaatttgtcagcaggatagttgtcatcaggagcaggtctgcgaggtaatagcctcttacgcacacctctgccggacaaacggcgtgtgcgtggattggcgaactcctgatttttgtgcaatgtcatgtccaccttccctcgtgtataatcactgcgagcatggctgcccccggcattgtgacggtaacgtcagctcatgtggcgatcatcccagcgagggatgtttctgtccaccagacaaagtaatgctggaaggcagctgtgtgcctgaggaagcttgcactcagtgcataggcgaggacggtgttcagcatcagttccttgaagcgtgggtgcccgaccatcaaccgtgccagatttgcacatgtctgtcaggtagaaaagttaactgtacaactcagccatgccctaccgctaaagcccccacttgcggactctgcgaggtcgcaaggctgcggcaaaacgccgatcagtgctgccccgaatatgagtgcgtatgcgatcccgtgtcctgcgacctgcctcccgttccgcactgcgagcgcggtctgcaaccaacactgactaacccaggggagtgtagacccaactttacttgtgcatgccgcaaggaagagtgcaaaagggtgtccccaccctcgtgcccaccccatcgcctaccgacactgcgcaagactcagtgctgtgatgagtacgaatgtgcctgcaattgtgtgaacagcacggtgtcgtgtcctctggggtacctcgcctccactgccacgaacgactgtggatgtacaactacgacatgtctgcctgacaaagtatgtgtccacagaagcacaatttatccagtgggccagttctgggaggagggctgcgacgtgtgtacgtgtaccgacatggaagatgctgtgatgggattaagggtagcacagtgttcgcagaagccgtgcgaggacagctgcaggagcggcttcacatacgtacttcacgagggagagtgctgcgggcgatgcctgcctagcgcctgtgaggtggtgactggttcccctcgcggcgactcacaaagcagttggaagtccgttggctcgcagtgggcatctccagaaaatccatgcctaatcaacgagtgtgtgcgcgtgaaggaggaggttttcatccaacagagaaatgtgtcatgtcctcaacttgaagttcccgtgtgtccttctggatttcagctctcttgcaaaactagcgcttgctgccccagctgccgatgtgaacggatggaggcgtgtatgctcaatggtaccgtcatcggccccggcaagacagtcatgatagacgtgtgcactacgtgccggtgcatggtgcaggtgggggtgataagcggcttcaagctcgaatgtcggaaaacgacatgtaacccgtgcccattgggttataaagaggaaaacaacacaggggaatgctgcggacggtgtctacccactgcatgcactatacagctaagaggaggccagatcatgacattaaagcgtgatgaaacattacaagatggatgcgacacgcacttctgcaaggtgaacgaacgaggagaatacttctgggaaaagcgcgtgacgggctgtccaccatttgatgaacataaatgcctcgctgagggcggcaaaatcatgaaaatcccaggcacttgctgtgacacatgtgaagagccagagtgtaacgacataaccgcacgactgcagtatgtcaaggttgggtcgtgcaaatcggaagtcgaggtggacatccattactgtcagggaaagtgtgcatctaaggccatgtattccatagacatcaacgacgtccaggatcagtgctcctgctgctctccaacaagaaccgaacctatgcaggtcgccttgcattgcacaaatggaagcgtggtgtaccatgaagttctgaacgcaatggagtgcaaatgcagtcccagaaagtgcagcaag

SEQ ID NO: 21318 - DNA, 8439 bp, Artificial Sequence
  Description of Artificial Sequence: Synthetic coding sequence
atgataccagcccgctttgcgggagttcttttggcccttgccctcattctccctggcaccctgtgtgcggagggtactcgcggacgatcctctaccgcaagatgctccctgttcggctccgatttcgtcaacacttttgatggttcgatgtacagctttgcagggtactgctcgtacctcctggcgggcgggtgtcagaagcggtcgttttcgatcattggagatttccagaacggaaagagagtctcgctgtcagtgtaccttggcgagtttttcgacatacatctgtttgtgaatgggactgtgactcaaggtgatcagcgcgtgtccatgccttacgcatccaaaggactctatcttgaaaccgaggctggatattacaagttgtcgggcgaagcctacgggttcgtagcaagaatagacggatccggcaacttccaggtgctgctcagcgatcgctactttaacaaaacttgcgggctttgcggaaactttaacatcttcgcagaggacgactttatgacgcaggagggtactttgacctccgatccatacgattttgcaaactcgtgggcgctgtcctcaggcgagcagtggtgtgaaagggcatcacccccatcatcatcctgcaacataagttcgggtgaaatgcaaaaggggctttgggaacaatgtcaactgcttaagtccacttctgtgtttgcaagatgtcatcctttggtggaccctgaaccctttgtggctctctgtgaaaagactttgtgtgaatgcgcaggaggtcttgaatgcgcctgccccgctttgcttgagtacgcgcgaacttgcgcacaagaaggaatggtcctttacgggtggacggaccactcagcttgcagccccgtttgtcccgcaggtatggagtacagacagtgtgtgtctccatgtgcccgaacttgccaaagcctgcatatcaacgagatgtgtcaggaacggtgtgtggatgggtgttcatgccctgaagggcaactcttggacgagggtctgtgtgtggagagtacggagtgcccatgcgtccactcgggaaagcggtacccccctggaacctcgctttcccgggactgcaacacctgcatttgtagaaattcgcagtggatttgttcgaacgaagagtgtccaggagagtgtctggtgaccggtcagtcacacttcaagtcgtttgacaacagatacttcactttttcaggtatatgtcaatacctcctcgcgcgcgattgtcaggaccatagctttagcattgtgatcgaaaccgtgcaatgtgcagatgaccgggacgcagtgtgcactcgatcagtcaccgttcgccttcctggcctgcataacagcctggtgaagctcaagcacggcgctggcgtcgccatggacggccaggacgttcaactgcccctgctcaagggcgatcttaggattcaacatacggttaccgcgagcgtgaggctttcctacggtgaagatctccaaatggactgggatggacgaggacggctcctggtgaaactttccccagtgtacgcagggaaaacctgtggtctgtgcggtaattacaacggaaatcagggtgatgatttcttgactccatcgggccttgcagagcccagagtggaagatttcggaaacgcatggaagctgcatggagactgtcaggatcttcaaaagcaacattcggatccgtgtgcactgaatccacgtatgacgagattttcagaagaagcatgtgcagtcctgacttcccctactttcgaagcatgtcatcgcgcagtctcaccgctgccatacctgcgaaattgtaggtacgacgtgtgtagctgtagcgatggaagagaatgtctgtgtggcgcgcttgcaagctacgcagcagcctgcgcaggacgtggcgttcgtgtggcatggagagagcctgggagatgtgaactgaactgtccaaagggacaagtgtaccttcaatgtggaactccctgcaacctgacctgcaggagcctgtcgtaccctgacgaagagtgtaacgaagcctgcttggaaggatgcttctgcccaccaggcctctacatggacgaacgtggagattgtgtgccgaaagcccaatgcccatgttattacgacggcgagattttccaaccagaagatatcttttcggaccatcatactatgtgctactgtgaggatggatttatgcattgcaccatgtcaggggtgcctggcagcctcttgcctgacgcagtcctgagttcacctctttctcaccgctcgaagagatccctttcttgtagacctcctatggtcaagctggtgtgtcccgcagacaaccttcgcgcagaagggttggaatgtactaaaacttgtcaaaactacgaccttgagtgcatgtcgatgggatgtgtgtcaggttgtttgtgtccacctggaatggtgcgccatgagaataggtgcgtggcacttgaacgatgtccctgttttcatcagggtaaggaatatgcccctggtgaaaccgtgaagattgggtgtaatacttgtgtgtgtcaggatagaaaatggaattgcactgaccatgtgtgtgatgcaacgtgttctactatagggatggcccactatcttacctttgacggactcaagtacctttttcctggtgaatgtcaatacgtgcttgtgcaagactattgcggatcaaaccccggaacttttaggatccttgtgggaaacaagggatgttcgcatccatccgtgaagtgcaagaagagagtgactatcctggtggaagggggcgagattgaacttttcgatggggaagtgaatgtgaagcgccctatgaaggacgaaacccatttcgaggtggtggagtcagggagatacattatccttcttcttggtaaggctctgtctgtggtgtgggatcggcatctcagcatcagcgtggtgctcaaacagacttaccaagaaaaagtctgtggactttgtgggaatttcgatggcattcagaataacgatctcacttcgtcgaacctgcaagtggaagaggatccggtggattttgggaatagctggaaggtttcatcccaatgtgcggatactaggaaggtgccactggatagtagccctgcaacgtgccacaataacatcatgaaacagaccatggtcgactcctcttgtcggatcctcacctcagatgtctttcaagattgtaataagttggtcgatccagaaccttacctggacgtgtgtatctacgatacttgcagctgcgaatcaattggagattgtgcctgtttttgtgataccattgctgcctacgcacatgtctgtgcccagcacggtaaggtcgtgacctggcggaccgcgaccctttgtcctcaatcatgcgaggaacggaacctcagagagaacggttatgaatgtgagtggcggtacaattcatgcgcaccagcatgtcaagtgacttgtcaacatcccgagcctctggcgtgcccggtgcagtgcgtggagggatgccatgcccattgccccccgggtaagatccttgatgaactgttgcagacttgtgtcgaccctgaggattgccctgtctgtgaggtcgccggtagacggtttgccagcggaaagaaggtgactctgaacccttcggatcctgagcattgccaaatttgtcattgcgacgtggtcaacctgacgtgtgaagcgtgtcaagaaccaggaggcctcgtagtgccacccactgacgcacctgtgagcccaacgaccctgtacgttgaagatatctcagagcctccccttcacgatttctattgttcccgtctcctggacctggtgtttctcctcgatggatccagccggctttcggaagcggagtttgaagtgcttaaggcctttgtggtcgacatgatggaaagactgcgtatttcacaaaagtgggtacgcgtcgcggtagtcgaataccatgatggttcccatgcatacataggtctgaaggataggaagcggccaagcgaattgagacgcatcgctagccaggtgaaatacgccggatcccaagtggcgtcgacctctgaagttctcaagtacacccttttccagattttctccaaaatagatcgaccagaggcttcacgtataacccttcttcttatggcctcgcaggaacctcaaagaatgtcgcggaactttgtgagatacgtccagggattgaagaagaaaaaggtgattgtgattccagtgggaataggacctcatgcaaatctgaagcaaattaggttgattgaaaaacaagccccagaaaacaaggcattcgtcctttcctcagtcgatgaactggaacaacaacgcgatgagatagtgagttacctttgcgacctggcacccgaagcgcccccacctacccttcctccagatatggcacaggtgactgtgggcccaggattgctgggtgtaagcactctgggcccgaagaggaactctatggtcctcgacgtggcatttgtcctcgaagggagcgacaaaattggagaagcagactttaaccgctcgaaggagttcatggaagaggtgattcagcgcatggacgtgggccaggactcgatacatgtgaccgtcctgcagtactcgtatatggtaactgtcgaatacccgtttagcgaagctcaatccaaaggggatatcctccagcgtgtgagggaaattaggtaccagggagggaacagaaccaacaccggcctggcacttaggtacttgagcgatcacagctttctcgtgtcacaaggcgatagagaacaagcacctaatcttgtgtacatggtgaccggtaacccagcatcggatgaaatcaagcgcctgcctggggacatccaggtggtgcctattggtgtcggcccaaacgcaaatgtccaggaactggagaggattgggtggcccaatgcaccaatcctgattcaagatttcgaaaccctgccccgtgaggcacctgatctggtgcttcaacggtgttgctcgggcgaaggcctgcaaatccctactttgtcacctgcacctgattgttctcaacctcttgacgtcatactgcttctggatggaagctcgtcatttcccgcatcgtactttgacgaaatgaagagcttcgcaaaggcatttatctcaaaagccaacatcggacccagactcactcaggtgtccgtcctgcaatacggatctatcaccacgatcgatgtcccctggaacgtcgtgcctgaaaaagcgcacctcctgagcctcgtggatgtgatgcaaagagagggtggtccttcccaaattggagatgcactgggatttgccgtcagatacctgacttcggaaatgcatggagcccgccctggcgcgtcgaaagcagtggtgattcttgtgaccgatgtgtcggtggacagcgtcgatgcagccgcagacgcagcaagatcgaaccgtgtcactgtattccccattggaatcggtgacaggtacgacgctgcacagctccggatcctggccgggcctgcaggtgatagcaatgtggttaagttgcaaagaattgaggatctgcctaccatggtgactcttggtaactcctttctgcacaagctgtgttcgggattcgtgcggatctgcatggatgaagatggaaatgagaagcggccaggggatgtctggaccttgcctgaccagtgtcacaccgtcacttgtcaaccagatggtcaaacgctcctcaaatcgcatagggtcaactgtgatcgcggactgcgaccgtcctgccctaactcacaatccccagtgaaggtggaagaaacctgtggatgtagatggacctgcccgtgtgtctgtactggttcgtccactcgccatattgtgacgttcgacggtcagaatttcaaacttaccggatcgtgctcttacgtgctttttcagaataaagaacaagatctggaggtgatcctgcacaatggtgcttgtagcccaggcgctagacagggatgcatgaaaagcatcgaagtcaagcattccgcactgagcgtggaactgcactcggatatggaagtgaccgtgaatggaaggctcgtctccgtgccatacgtcgggggcaacatggaagtaaacgtgtatggtgcgattatgcacgaagtgaggtttaatcatctcggacatatctttactttcactcctcaaaacaatgagtttcagcttcagctttccccaaagacgtttgcatccaaaacctacggactgtgtggtatttgtgacgaaaatggcgctaacgactttatgctgcgggatggaactgtgaccaccgactggaaaaccctggtgcaggagtggactgtccagaggcccggacaaacctgtcaacccatactggaggaacagtgtctggtccctgattcgtcccattgtcaggtgcttcttctccctctttttgcagaatgtcataaggtgctcgcaccggctaccttttacgcaatttgccagcaagattcctgtcaccaagaacaagtgtgcgaggtcattgcctcatacgcccacctttgtcgcaccaacggtgtctgtgttgattggagaaccccagacttctgtgcaatgtcgtgcccgccttccctcgtgtacaaccactgcgaacatgggtgtcctaggcactgcgatggtaacgtatcttcctgtggggatcaccccagcgaagggtgtttctgtccccctgacaaggtcatgctggaaggaagctgtgtccccgaggaagcatgtacgcagtgcattggagaggatggcgttcagcatcagtttctggaggcttgggtgcctgatcatcaaccatgccagatttgtacgtgcctctcagggagaaaagtgaattgtaccacccaaccatgtcctaccgcgaaggcgcctacttgtggcctctgcgaagtggcaagacttcgtcaaaacgcagatcaatgctgtcccgagtacgaatgcgtttgtgatcctgtgagctgtgacctccctccagtcccgcactgcgagcgcggcctgcaacccaccctgaccaacccaggtgaatgtagacctaacttcacctgcgcatgtcgaaaggaagagtgcaagcgggtgtccccgccctcctgtccgccgcatagactgccgactcttcgcaagactcagtgttgcgatgaatacgagtgtgcctgcaattgtgtgaacagcaccgtgagctgcccgctgggttacctcgcatccaccgcgactaacgattgcggatgtactaccaccacctgccttccagataaggtctgtgtgcaccgatccactatttaccccgtgggtcagttttgggaggaaggatgtgacgtttgcacttgtactgatatggaggatgccgtgatgggacttcgggtagcacagtgttcccagaagccttgtgaggatagctgtcgttctggattcacctacgtgctgcacgaaggagaatgctgcggacgttgcttgccatccgcatgtgaagtggtcaccgggtcaccacgcggcgactcgcaatcctcctggaaatccgtcggaagccaatgggcctcacctgaaaatccatgcctgattaacgagtgcgtccgagtgaaagaagaggtctttattcagcagcgaaacgtgtcgtgcccccagcttgaagtgccagtgtgcccaagcggctttcagcttagctgtaagacctccgcatgctgtccctcgtgcagatgtgaaaggatggaggcctgtatgcttaatggaaccgtgattggacctggtaagactgtgatgattgatgtctgcaccacgtgtcggtgcatggtgcaggttggtgtcatctcaggcttcaaactggaatgtagaaagaccacctgtaacccttgtccgctggggtacaaagaagagaacaataccggcgagtgttgtggacggtgccttcctacggcctgtaccatccaattgcggggaggacaaatcatgactctcaaacgggacgaaactcttcaggatggttgtgatacccatttttgtaaggtcaatgagaggggtgaatacttttgggaaaagcgcgtgaccggatgtcctccgtttgatgaacacaagtgtcttgccgaaggaggaaaaatcatgaagattcctggtacgtgttgtgacacctgtgaagagccagagtgcaacgatattaccgccagactgcaatacgtgaaggtcggctcgtgtaaatcggaagtcgaagtcgatattcattactgtcaagggaagtgcgctagcaaggcaatgtactcgatcgacattaacgatgtgcaagaccaatgctcctgttgctcaccaactagaaccgagcctatgcaagtggcactccattgtaccaatggatccgtggtttaccacgaagtgctcaacgccatggaatgtaaatgctcaccacgaaagtgttccaag

SEQ ID NO: 21319 - DNA, 8439 bp, Artificial Sequence
  Description of Artificial Sequence: Synthetic coding sequence
atgatcccagctcgctttgctggggtgctgctggcccttgcgctgatcctgccgggaactttgtgcgcagagggtacccgcgggcgttcatcgaccgcgcgctgttccctgttcggctcagacttcgtgaataccttcgacggatccatgtactcattcgcgggttactgtagctacctcttggccggaggatgccaaaagcggtccttctcgattatcggagatttccagaacggcaagcgcgtctccctgtccgtctaccttggtgaattcttcgacatccacctctttgtgaatggaaccgtgacccaaggcgaccagcgggtgtcgatgccgtacgccagcaagggcctctacctggaaaccgaagccggatactacaagctgtcaggagaagcgtacggattcgtggcgcggatagacggaagcggcaacttccaagtgctcctgtccgaccgctacttcaacaagacttgcggcctgtgcgggaactttaacatcttcgccgaggacgacttcatgacccaggaaggaactctgacctcagatccttacgactttgccaactcttgggcactgtcctccggcgaacaatggtgcgaacgggcctcaccgccgtcctcctcctgcaacatttcctctggcgaaatgcagaagggactctgggagcaatgccaactgctgaagtcgaccagtgtattcgccagatgccacccgctggttgatccggaaccattcgtggccctgtgcgaaaagacgctgtgcgagtgtgcgggaggactggagtgtgcctgcccggccctcctggagtacgcaagaacctgcgcccaagagggcatggtgctgtacggatggactgaccattcggcgtgctcgcccgtttgtccggctggaatggagtatcgccagtgcgtgagcccttgcgcgcgcacgtgccagtccctccacatcaacgaaatgtgtcaggagagatgcgtggacggctgctcctgcccggagggacagctcctggacgagggactgtgcgtcgaaagcactgaatgcccgtgcgttcatagcggcaagaggtatccgccgggaacctcactctcgagagactgtaacacgtgcatctgccgcaatagccagtggatctgctccaacgaggaatgtccgggcgaatgtctcgtcactgggcagtcccacttcaagtcgttcgacaatagatacttcactttcagcggaatttgccaatacctcctggcaagagattgccaggatcatagcttcagtatcgtcatcgagactgtgcaatgcgccgacgatagagatgcagtctgcactcgctcggtgaccgtccggctcccgggattgcacaactcgctggtcaagctcaagcacggagcaggggttgctatggacggccaggatgtgcagctgccactcctgaagggagatctgcgcatacaacatactgtgactgcgtcggtgcggctctcgtacggcgaagatctgcagatggattgggacggacgcggtcgccttctggttaagctgagccccgtgtacgccggtaaaacctgtggcctctgcggtaattacaatggaaaccaaggggacgattttcttaccccttcgggattggcagagccgcgggtggaggatttcggaaacgcatggaaactccacggagactgtcaggacctgcaaaaacaacattcagacccatgcgccttgaacccccgcatgactcggttctcggaggaagcatgtgcggtgctgacttccccgactttcgaagcgtgccaccgcgcagtcagcccgctgccgtacctgagaaattgccggtacgacgtctgctcgtgcagcgatgggagggagtgcctgtgcggggcattggcgtcctacgcggctgcgtgtgcaggcagaggagtgcgggtggcttggcgagagcctggaaggtgcgagctgaattgccctaagggacaggtctacctccagtgcggcactccgtgtaatctcacttgtcgcagcctgtcatacccggatgaagaatgcaacgaggcatgcctggaaggatgcttttgccctccagggctgtacatggacgaacggggagactgcgtgccgaaggcgcagtgtccgtgctactacgacggagagatcttccagccggaggacatcttctcggatcaccatacgatgtgctactgtgaggatggatttatgcactgtaccatgtcgggagtaccgggaagtctcctccccgacgcggtgctgtcaagtccattgagccatcgttctaagcggtcgctttcatgtcgcccgcccatggtgaagctggtgtgcccagccgacaacctgagggcggaaggtttggaatgtaccaagacttgccaaaactacgatcttgaatgcatgtccatgggatgcgtctcgggatgcttgtgcccgccgggaatggtccggcatgagaatcggtgcgtggccctcgaacgctgcccatgcttccatcaaggaaaggagtacgcgccgggggagacggtgaaaattggctgcaacacttgcgtgtgccaggaccgcaaatggaattgcaccgaccacgtgtgtgatgcgacgtgctccactatcggaatggcccattacttgacttttgacggtctgaagtacctgttcccgggtgaatgtcagtacgtcctggtgcaggactactgtgggtccaatccgggaaccttcagaatccttgtgggcaacaagggatgttcacacccgtcagtcaaatgcaagaagagggtgaccatcctcgtcgaaggcggggagatcgaactgtttgacggagaagtgaacgtgaagcggccaatgaaggatgaaacgcacttcgaggttgtggaatcagggcgctacatcatccttctccttggaaaagcgctctccgtcgtgtgggatcgacatctctcgatcagcgtggtccttaagcagacttaccaggaaaaggtctgtgggctgtgcggtaactttgacggcattcagaataacgacctcactagctcgaaccttcaggtagaggaggacccagtggatttcggcaactcgtggaaggtgagctcacaatgtgccgataccagaaaggttccgctggactcgtcacccgcaacctgccacaacaatatcatgaagcaaactatggtggactcgagctgcaggatcctcacctcggacgtttttcaggattgcaataagctcgtagatcccgaaccttacctggatgtttgcatttacgacacttgctcctgcgaatcaatcggagactgcgcttgtttctgcgatacgatcgccgcgtatgctcatgtatgtgcccaacacggaaaggtggtgacctggcggactgccactctgtgtccgcaatcctgcgaggaacggaatcttagagaaaatggttacgaatgcgaatggcggtacaactcatgtgcccccgcctgtcaagttacctgccagcacccagagcccctggcttgccccgtgcagtgtgtggaaggatgccacgcccactgccctccgggaaagatccttgacgagctcttgcagacgtgtgttgaccctgaggattgtccagtttgcgaggtggccggtagacgcttcgcctctggaaagaaagtgactctgaatccgtccgaccctgagcattgtcagatttgccactgtgacgtggtcaatctcacctgcgaagcctgccaagagcccggaggacttgtcgtcccgccaactgacgctccagtgtcccctactaccctgtatgtggaggacatctccgagccgccgttgcatgacttctactgctcgcggctgctcgatctggtttttctgctggacgggtcctctaggctgtcagaagccgagttcgaggttctcaaggcgttcgtggtggatatgatggagcgtctcagaatctcgcaaaaatgggttagagtcgccgttgtggagtaccacgacggaagccacgcttacatcggccttaaagacagaaagcgacctagcgaacttagaaggatcgcctcacaagtgaagtacgccggttcgcaggtggcgtcaactagcgaggtgctcaaatacaccttgttccagatcttttcaaagatcgatcgcccagaagcctcgcgcatcactctgctcctgatggcatcacaggagccgcagcgcatgtctaggaacttcgtccggtacgtccagggcctcaagaaaaagaaggtcatcgtcatcccggtcggcatcggcccacatgctaacctgaagcaaatcagacttatcgagaagcaggcgcccgaaaacaaagcgtttgtgcttagttcagtggacgagctcgaacaacaacgcgacgaaatcgtgagctatctgtgcgatttggcgccggaagcaccaccgccgactctcccgcctgacatggcacaggtgaccgtgggacctgggttgttgggggtaagcaccctgggaccaaaacggaactcgatggtcctggacgtggcgtttgtcctggagggctccgacaagatcggggaggcagacttcaatcgctcaaaggaattcatggaagaagtgatccagcggatggatgtgggccaggattcgattcacgtgaccgtgctgcagtactcctacatggtgaccgtggaatacccgttttccgaagctcaatcaaagggcgacatattgcagcgcgtgagagagatccggtaccaggggggaaacagaaccaatacgggattggctctccgctacctgtctgatcactccttcctggtgtcccagggcgaccgagaacaagcaccaaatcttgtgtatatggtgacggggaacccggcaagcgatgagatcaaacgcctgccgggagatatccaagtcgtgccaatcggtgtggggcctaacgcgaatgtgcaagagctggagaggattggatggccaaatgccccaatccttatccaggacttcgagacgctgccgcgcgaagccccagatctggtgctgcagcggtgttgctcgggcgaggggctccaaatcccgactctgtctccggccccggattgctcgcagccactggacgtgatcctcctcctggacggatcgtcaagtttcccagcgagctacttcgatgagatgaagagtttcgcaaaggccttcatctccaaggctaacattggacctcggctcactcaggtgtccgtcctgcagtacggatcgataaccactatcgatgtgccatggaacgtggtgccggaaaaggcccacctgttgtccctggtggacgtgatgcaacgcgaaggcggaccatctcagatcggagacgccctgggattcgcagtgcggtacctgacgtcagagatgcacggagcgcggcctggggcgtccaaggcggtcgtcatcctcgtgaccgacgtctcggtcgactccgtcgacgccgccgccgatgctgccagatcaaaccgcgtgacggtgttcccgattggcattggcgatcggtacgacgccgcccaactgcgcattctcgccgggcccgccggagattccaacgtggtgaagctccagaggattgaggatctgccaaccatggtgaccctcggaaactccttcctgcacaaactctgttcaggatttgtcagaatctgcatggatgaagatggaaatgagaagcgacctggagacgtgtggactctgccggaccagtgccacacggtgacctgccaaccggacggccaaaccctcctgaagtcccatcgggtaaattgcgatcgcggactgcggcccagctgtcccaattcgcagagccccgtgaaagtcgaggaaacttgcgggtgccgctggacttgtccctgcgtgtgcactggaagctctactaggcacatcgtcaccttcgatggacagaacttcaaactgactggctcatgctcctacgtgctctttcaaaacaaagagcaagatctggaagtgattctccacaacggggcctgtagcccaggcgccagacagggatgtatgaaatctatcgaagtgaaacattccgccctgtccgtggaacttcactcagacatggaggtgactgtcaatggccgcctggtgtcggtaccgtacgtcggcggaaacatggaagtcaacgtctacggggccatcatgcacgaagtgagattcaaccacctgggacatatcttcaccttcactccgcagaacaacgagtttcagctgcagctctcgcctaaaaccttcgcgagcaagacctatgggctttgcggaatctgtgatgagaacggcgctaatgacttcatgctccgcgatgggaccgtgacgaccgattggaaaactctggtgcaggaatggaccgtgcagcggccaggacagacctgtcagcccatccttgaggaacagtgcttggtgccagactcgtcacactgccaagttctgctgctccctttgtttgcagaatgccacaaagtcctcgctccggcgaccttctacgccatatgccagcaggacagctgtcaccaggaacaagtctgcgaggtgatcgcctcgtacgcccacctgtgccggaccaacggtgtgtgcgtggactggcggaccccggacttttgcgctatgtcctgcccgccgtcgttggtctacaaccattgcgaacatggctgccctaggcattgtgacggtaacgtgagctcctgcggtgaccatccaagcgaaggatgcttctgtccaccggataaagtcatgctggaggggtcctgcgtgcctgaggaggcatgtacccagtgtatcggcgaggacggcgtgcaacatcagttcctggaagcctgggtcccagatcaccagccgtgccagatctgtacctgtctgtcgggcagaaaagtgaactgcacgacccaaccttgccctactgcaaaagcccccacctgcggactgtgcgaagttgctcgcctcaggcaaaacgcagaccaatgctgcccggaatacgaatgtgtctgcgacccggtgtcgtgcgaccttccacccgtgccacactgcgagcgtggcttgcagccgactctcacgaatcctggtgaatgcaggccgaacttcacctgtgcttgtcggaaagaagaatgcaagcgcgtgtcacctccatcatgtccgccccatcggctgcctaccctgcgtaagactcagtgctgcgacgaatatgaatgcgcttgcaattgcgtgaattcgaccgtgtcttgccccttgggttacctcgcgtccactgcgaccaatgattgtggttgtactactactacctgcctcccagataaagtgtgtgtgcaccgctccaccatctacccagttgggcaattctgggaagagggatgcgacgtgtgcacttgtaccgatatggaggacgcagtcatgggactgcgcgtcgcacagtgcagccagaagccttgcgaagattcttgcaggagcggttttacttacgtgctgcacgagggcgaatgctgcggtaggtgtctgccttccgcctgtgaggtcgtgaccggaagcccccgcggagactcccagtcctcgtggaagtcggtcggatcacagtgggccagcccggaaaacccctgtttgatcaacgagtgcgtgcgcgtcaaagaagaagtgttcatccagcaacgcaacgtcagctgcccgcaactcgaagtgcctgtgtgcccatccggttttcagctctcgtgcaaaacttcggcgtgctgcccttcatgcagatgcgagcgcatggaagcatgtatgctgaacggaactgtcatcggtcccggaaagactgtgatgatcgacgtgtgtactacctgtcggtgcatggtgcaagtgggagtgatctccggctttaagctggaatgccggaaaaccacctgcaatccatgcccgctcggatacaaggaagagaacaacaccggggagtgttgtgggcggtgtctgccaaccgcgtgcactatccagctgcgaggaggtcagataatgaccctgaaacgtgatgaaacccttcaagatggttgcgatacccacttctgcaaggtgaacgagcggggagaatacttctgggagaagcgcgtcactggttgccctccgtttgacgagcacaagtgcctcgcagaaggaggcaagattatgaagatcccgggtacctgctgtgacacctgcgaagaaccggaatgtaatgacatcaccgcaaggctgcagtacgtcaaggtgggctcgtgcaagagcgaagtcgaagtcgatatccattactgccagggcaaatgcgcttcaaaggctatgtattcgattgacatcaatgatgtgcaggatcagtgcagctgctgctcacctactcggactgaaccgatgcaagtggccctccattgtactaatggatcggtggtctaccatgaggtcctgaacgctatggaatgtaagtgctcgccacgaaagtgctccaaa

SEQ ID NO: 21320 - DNA, 8439 bp, Artificial Sequence
  Description of Artificial Sequence: Synthetic coding sequence
atgatcccagccaggttcgcgggggttctcctagccctcgccctcatcctgcctggaacactctgtgccgaagggacacgagggcggtcttccacagcccggtgttcactatttggatctgactttgtaaatacatttgatgggagtatgtattcctttgcaggatattgtagttatctcctggcaggagggtgtcagaaaagatctttttccatcatcggagattttcagaacggaaaaagggtctccttatcagtctatctgggagagtttttcgatatacacctctttgtgaacggaacagtgactcagggagatcagcgggtgagtatgccatacgctagtaaagggctgtatctggaaactgaagcagggtattataaactatctggagaagcttacggattcgtagcacgaattgatggaagtgggaatttccaggtactgctatcagatcggtattttaacaaaacatgcggactttgcgggaacttcaatatatttgcagaagatgattttatgacacaggaagggacactcactagtgatccctacgatttcgccaattcatgggcattgtcttccggggaacagtggtgcgaacgagcctcccccccctcctcctcatgtaatatatcttctggagaaatgcagaaagggctttgggaacagtgtcagctgctaaaatctacgtcagtctttgccaggtgtcaccctttagtagaccccgaaccattcgttgctctttgcgaaaaaacactctgtgaatgtgcaggagggctagaatgtgcttgccccgccctgctcgaatatgccaggacatgtgcacaagaaggaatggtgttgtacggatggacagatcattccgcatgttcccctgtctgtcccgctgggatggagtaccgacagtgcgttagtccttgtgcaaggacatgtcagagtctgcatataaatgaaatgtgccaggagcgatgtgtagacggatgcagttgtcctgagggacagctcctcgacgagggactatgtgtagagtctactgaatgtccttgcgtccactctggaaaacgatatcctcccggaacatcactctctcgagattgtaacacatgcatttgtaggaactctcagtggatctgttctaacgaggagtgccctggagaatgtctggtgacaggacagtctcattttaagagttttgataacagatatttcacattttccggaatatgtcagtatcttctcgctcgagattgtcaggatcattcgttctctatcgttattgaaacagtgcagtgtgctgatgatcgggatgccgtgtgtactcgctcagtgacagtacgactcccaggattacataacagtctggtaaaactgaagcatggagctggagtcgccatggatggacaggatgtccagctccctctactgaaaggggatttaaggatacagcatactgtgacagctagtgtgagattgtcgtacggggaagatttacagatggactgggatggaaggggaaggctgcttgtgaaattgtcacctgtgtatgctggaaaaacatgcgggctgtgtgggaattacaatgggaaccagggagacgattttctgacaccttctgggctcgccgaacctagagtggaagattttggaaacgcctggaaactccacggagattgtcaagatctgcagaagcagcatagtgatccttgtgctctgaatcctcggatgacgcgatttagtgaagaagcctgtgccgtgctgactagtcctacattcgaagcctgtcatagggctgtttctccacttccttacctgcgaaattgccgatatgatgtctgttcttgttcagacgggcgagaatgtctctgcggggccctcgcatcctatgctgccgcttgtgccgggcggggggtacgcgtcgcatggcgggaaccaggacgatgcgaacttaattgccctaaaggacaggtgtatctacagtgcgggactccgtgcaatctcacgtgtagaagtctctcataccctgatgaggagtgcaatgaagcttgtctggaagggtgtttctgtccacctggactatacatggatgaacgcggggattgtgtgcccaaagcacaatgtccctgctactatgatggagaaatctttcagcccgaagatatcttctcagatcaccatacaatgtgttattgtgaagatgggttcatgcactgtactatgtccggggtccctgggtcgcttcttccagatgccgtgctgagtagtccactctcccacagatcaaaacggtctctcagttgccggcctccaatggtgaaattagtctgtccggccgacaatctgcgagctgaggggctggaatgcactaaaacatgtcagaattatgatcttgaatgcatgtccatggggtgtgtgagtggatgtctctgtccacctgggatggttaggcatgaaaatcggtgcgtggcactggaacggtgtccctgttttcatcagggaaaagaatatgccccgggggaaacagtgaaaatagggtgtaacacttgtgtgtgtcaggatcggaaatggaactgtacagatcatgtttgcgatgccacttgttctactattggaatggcccattatctcacttttgatggactaaagtatctctttcctggagaatgccagtatgttttagttcaggactattgcggatctaatcctggaactttcagaatactcgttggaaacaaagggtgtagtcatccttcggtaaagtgcaagaaacgggtgactattcttgtggagggaggagaaatagaacttttcgatggggaagtgaatgtgaaacgacccatgaaggatgagactcattttgaagtagtcgaatctgggcggtatattattctactcttgggaaaagctttgtccgttgtttgggataggcatctgtctatctcagtggtcttaaaacagacttatcaggaaaaagtgtgcgggttatgtgggaactttgatggaattcagaacaatgatctcacttcgtcaaatttacaggttgaggaggatcctgtagacttcggaaactcctggaaagtatcttctcagtgtgccgatactaggaaagtcccactggatagttcacccgctacatgccataataacatcatgaaacagacaatggttgattcttcttgtagaatcctcacttctgatgtattccaggactgcaataaactagtcgatcctgagccatatcttgatgtgtgcatctacgatacttgttcctgcgaatcaatcggggattgtgcctgtttctgtgatactattgcagcctatgcccacgtgtgtgctcagcacggaaaagtagtaacatggagaacagcgactctgtgtccacaatcgtgtgaagaacgcaacctgcgggaaaacggatacgaatgcgagtggagatacaacagttgcgctcctgcctgccaggtgacgtgccagcatcccgagcctctcgcatgtcccgtccagtgtgtagaggggtgtcacgcccattgtccccctgggaaaatcctggacgaactactacaaacttgcgtagacccagaagactgccccgtttgcgaagtagctgggcgccgcttcgcctctgggaaaaaagtcacacttaatccttctgatcccgaacattgccagatctgccactgtgatgtggtcaatctcacatgtgaggcctgtcaggaaccaggggggctagtggttccccctacagatgcccctgtatcgcctacaactttatatgtggaggatatttctgaaccccccctccacgatttctattgctctagactactggatctcgttttcttgctggatgggtcttctcgcctgtcagaagcggagtttgaagtgctcaaggcattcgttgtggatatgatggaacggctcaggatatcgcagaaatgggttcgggtggccgtggtagaatatcacgatggaagtcatgcctacatcgggctgaaagataggaagcggccatcagagttgcggaggattgcatcacaagtgaaatatgccggatctcaggtcgcctctacgtccgaagtcttgaaatacactttgttccagatattcagtaaaatagaccggcccgaagcttctcgcatcactctgcttctcatggcatcccaggaacctcagagaatgtctcgaaatttcgtgcggtacgttcagggactcaaaaaaaagaaagtgatcgttattccagttggaatcggacctcacgctaatttgaagcaaatccgactaatcgaaaaacaggcccctgagaataaagcctttgtgctgtcctcagtggatgaattagaacagcagagggatgaaatcgtatcttatctctgcgaccttgccccagaagcgccacctcccacactgcccccagacatggcacaggtgactgtgggacccgggctgttgggggtgagtactctcgggcctaagcgtaattccatggtgctggatgtggcgttcgtactggaaggatccgataaaatcggagaagcagattttaaccggtccaaagaatttatggaggaggttattcagcggatggacgtgggacaggatagtatacacgtaacagtactgcagtattcatacatggtaacagtagaatatcctttctcagaagctcagtctaaaggggatatacttcagcgcgtgcgggaaatccgctatcagggagggaaccggacaaatacaggactggctttacgatatctgtctgatcattccttcctggtctcccagggagatagagagcaggccccaaatctcgtgtacatggtgactgggaatccagcatctgatgaaatcaaacgactccccggggatatccaggtcgtaccaataggggttggacccaacgcgaatgtccaggaactggagcgaatcgggtggcctaatgctcctatactaatacaggatttcgaaacactacctagagaagcccccgatctcgtccttcagagatgttgttctggggaagggcttcagatccctactctgagtccagctcctgattgttctcagccccttgatgtaatcctgctcctcgatgggtcatcttcctttcccgcatcctacttcgatgagatgaaatcttttgcaaaagctttcatcagtaaagctaacataggaccccgactcacacaggtatctgttctgcagtatggatctataacaactattgatgtcccatggaatgtggtgccagaaaaagcccacctcttgagtctcgtggatgtgatgcaaagagaaggggggccttcccagataggagacgccctagggttcgctgttcgctatctgacttctgagatgcatggggcacggcctggggcatccaaagccgtggtgatcttggtcacagatgtgagtgttgattcggtagatgccgcagcagatgccgctaggagtaatcgcgtcacagtctttcccataggaatcggagatagatatgatgctgcacagttgaggatcctcgccgggcccgccggggacagtaatgtcgtgaagcttcagcgaatcgaagatctgcctacgatggtaacattggggaactcatttctgcacaaactctgctcaggattcgtcaggatatgtatggacgaagatgggaatgaaaaacgaccaggagacgtttggactctgcccgaccagtgtcatactgtgacttgccagcccgacgggcagactctcctaaaatcacatagggtcaattgtgatcgggggctcaggccaagttgccctaactcacagtccccagtaaaagtcgaagaaacttgtggatgtagatggacatgtccctgtgtttgtacaggaagttctacaagacatattgtgactttcgacggacagaattttaaactcacagggtcttgctcatatgtgctgtttcagaataaagaacaggatttagaggtaatcttgcacaacggagcatgctccccaggagctaggcagggatgcatgaaaagtatcgaggtgaaacactctgcactgagtgtcgagctacattctgatatggaggtgacagttaatggaaggctggtgagtgtaccctatgtaggggggaatatggaggtgaacgtttatggggctattatgcatgaagtccgcttcaaccaccttgggcatatctttacttttactccccagaataacgagtttcagctgcagctctctcctaagacgtttgcctcaaagacttatgggctctgcggaatttgtgatgaaaacggggcaaacgatttcatgctccgggacggaactgttacaacagattggaaaactcttgtacaagaatggacagtgcagagacccggacagacttgccagcctatcctcgaagaacagtgtctcgttccagatagttcccattgtcaggtgctcctgctaccactttttgcggaatgccacaaagtgctggcccccgcaactttttacgccatctgtcagcaggactcatgccatcaggaacaggtttgtgaagttatcgcctcctatgcccacctttgtaggactaatggggtttgtgttgattggagaacacctgacttttgtgctatgtcctgtccaccttccctagtgtacaaccattgcgaacatgggtgccctcgacactgcgacgggaatgtctcctcttgtggagatcacccatccgaaggatgcttttgtcccccagataaggtaatgcttgaaggatcttgtgtgccagaagaggcctgtacacagtgtattggagaagacggggtccagcatcagttcctcgaagcttgggtgcccgatcatcagccttgtcagatatgcacgtgtctatccgggaggaaagttaactgcactacacagccttgccccactgccaaagcccctacttgtgggctctgtgaagtcgcaaggctcagacagaacgcagatcagtgctgcccagaatacgaatgtgtctgcgatccagtttcctgtgatttacctcctgtgcctcactgcgaaagggggcttcagcccactctgactaaccccggagaatgtagaccaaatttcacatgtgcctgccggaaagaagaatgtaaaagagtctctcctcccagttgcccccctcatagattgcctactcttcggaaaacacagtgttgtgatgaatacgaatgcgcctgcaactgtgtaaattctacagtgtcatgcccactgggatatctcgcttctacagcgacaaacgattgcgggtgcacaacgactacttgtctccctgataaagtgtgtgtccaccggtcaactatttatcctgtggggcaattttgggaagaaggatgcgatgtttgtacttgcactgatatggaagatgcagtgatgggattacgtgtagctcagtgttctcagaaaccctgcgaagattcctgtagaagtggatttacatacgtcctgcacgaaggggagtgctgtgggagatgcctgccttctgcttgtgaagtggtgacagggtccccaagaggagattctcagtctagttggaagtcggtggggagtcagtgggcatcccccgagaacccatgcctaattaatgaatgtgtgagggtcaaggaagaagtatttatccagcagcgcaacgtgtcttgtccccagttagaagtacctgtatgtccttccgggttccagcttagttgtaaaacttctgcctgctgtcccagttgcagatgcgagagaatggaggcgtgtatgcttaacggaactgtgatcgggcctgggaagacagtaatgatcgatgtctgtacaacatgccgctgtatggtccaagtgggggttatctcagggtttaaactggaatgcaggaaaactacatgtaacccatgccccttagggtataaagaagagaataacacaggggaatgttgcggacggtgcctgcccactgcctgtactatacagctcaggggggggcagatcatgactctcaaacgcgatgaaactcttcaagacgggtgcgatactcatttttgcaaagtgaatgaaaggggagaatacttttgggagaaaagggtgactgggtgtcctcctttcgatgaacataagtgtcttgcagagggagggaaaataatgaaaatcccgggaacttgctgcgatacatgcgaagaaccagaatgcaacgatattacagcgcgcctacagtacgtgaaggttggatcttgcaaatctgaggttgaagtggatatacattactgccagggaaaatgtgcttcaaaagccatgtacagtatagatatcaatgatgttcaggatcagtgctcctgttgctctcctacacggactgaaccaatgcaagttgccctccactgtactaacgggtctgtagtttatcacgaagtgcttaacgccatggaatgcaaatgctcaccaaggaaatgctctaaa

SEQ ID NO: 21321 - DNA, 8439 bp, Artificial Sequence
  Description of Artificial Sequence: Synthetic coding sequence
atgattccggcgcgttttgccggcgtcctcctcgcactggccctgatcctgccgggaactctgtgtgcggagggaaccagaggtcggtcaagcactgcaaggtgctccctctttggatccgacttcgtgaacactttcgacggatccatgtactcgttcgctgggtactgctcctacctgttggccggaggatgccagaaaaggagctttagcatcatcggtgatttccagaacggaaaaagagtgtccctttccgtgtaccttggagaattctttgacatccacttgttcgtcaatgggactgtcactcaaggtgaccaacgcgtctcaatgccatacgcatccaaaggactctacctcgagacggaagctggctactacaagctgtcgggagaagcctacggattcgtggcgcgcatcgacggctctggcaacttccaagtgctcttgtcagatcgctacttcaacaagacttgcgggctctgcggtaactttaacattttcgcggaggacgacttcatgactcaagaaggaacgctcacttccgatccatacgacttcgctaactcgtgggcactctcatccggagagcagtggtgtgaaagagcttcgccgccgagctcgagctgtaatatctcgtctggtgaaatgcagaaggggctttgggagcaatgtcagttgctgaagtcaacttcagtgttcgcgagatgccacccgctggtcgacccagagccatttgtcgcactgtgtgagaaaactctgtgtgaatgcgcgggcggtctggagtgcgcctgtccagcgctcctcgaatacgcccggacttgcgctcaggagggaatggtcctgtatggatggaccgatcactccgcatgctctccagtttgtcctgctggaatggaataccgccagtgtgtctccccgtgcgctcgcacctgccagtccctgcacataaatgagatgtgccaggaacgctgtgtcgacggatgttcatgcccggagggacagcttctcgacgaagggctctgtgtggaatccaccgaatgtccatgtgtgcactcaggtaaacggtacccacctggaacttcgttgtcgcgcgattgcaacacctgcatctgccgcaactcccagtggatttgtagcaacgaggagtgcccgggcgaatgtcttgtgaccgggcaatcacacttcaagtccttcgacaaccggtactttacgtttagcggcatctgtcagtacctgctggcgcgcgattgccaagatcatagcttctccatcgtgatcgagactgtgcaatgcgcggatgatcgagacgccgtctgtaccagatctgtgacggtgcgcctgccaggcctccataattcgttggtgaagctgaagcatggcgcgggggtcgctatggatggacaggacgtgcagctgccattgctcaagggggatctgcggatccagcacaccgtgactgcgtcagtgcggctgtcgtacggcgaagatcttcagatggattgggacggacgcggccgcctcctggttaaactgtccccggtgtacgcgggaaagacttgtgggctgtgcgggaactacaatggaaaccagggggatgattttctgacccccagcggactcgctgagccaagggttgaggattttggaaacgcatggaaattgcacggtgactgccaagatctccaaaagcagcattccgacccctgcgccctcaatccgcgcatgacccggttcagcgaagaagcatgcgcggtgctcacctcaccaacgttcgaagcctgtcacagggccgtctcgccactgccctacctgcgcaactgccggtacgatgtctgtagctgcagcgacgggcgcgagtgcctctgcggcgcactggcctcgtacgcggccgcatgcgcaggccgcggcgtgcgggttgcttggcgcgagccaggtaggtgcgaacttaattgcccgaagggccaggtgtacttgcaatgcggaacgccgtgcaacctgacttgccgttccctctcttacccggacgaggagtgcaatgaggcatgtctggaaggatgcttctgcccgcctggattgtacatggacgagcgaggcgactgcgtgcccaaggcccaatgtccgtgttactacgatggtgagatttttcagccggaggatatcttctccgaccaccacaccatgtgttactgcgaagatggattcatgcactgtactatgtcgggtgtcccaggttcgctgctgcccgacgctgtgctgtccagccccctctcacaccggtccaagcgctccctcagctgccggcccccgatggtcaaacttgtctgccccgctgacaacctcagagctgaagggcttgagtgtaccaagacttgccaaaactatgatctggagtgcatgtcgatgggatgcgtgtcgggatgcctgtgcccaccgggcatggtcagacacgaaaataggtgtgttgccctggaacgttgtccatgctttcaccagggcaaggaatacgcccccggggagacggtgaaaatcggctgtaatacctgcgtgtgccaggaccgcaagtggaattgcactgaccatgtttgtgatgctacttgctcaaccataggaatggcccattacctcacgttcgacggtctgaaatacctctttccgggagagtgccagtacgtcctggtgcaagactactgcggatcaaatcccggtaccttccgcatccttgtgggtaacaaaggttgcagccacccatcggtgaaatgtaagaagcgcgtgactatcctggttgaaggaggcgagattgagctgtttgatggagaagttaacgtcaaacgccccatgaaggacgaaacccatttcgaagtcgtggaatccggacgctacatcatcctgttgcttggaaaggcactgtcagtggtctgggaccgccatttgtcgatttcggtggtgctgaagcagacctaccaggagaaggtctgcggcctttgcggaaacttcgacggtatccaaaacaatgacctcacctcctcgaatctgcaagtcgaggaagatccggtggatttcggaaactcatggaaggtcagctcccaatgcgccgacaccaggaaggtcccgctggattcatcgccggcaacctgccataacaacattatgaagcaaactatggttgactcgtcgtgccgcatcctgacctcggacgtctttcaagactgcaacaaattggtggacccagaaccctatctggacgtgtgcatctacgacacctgcagctgcgagtccatcggagactgcgcgtgcttctgtgacaccatcgcggcctacgcccacgtgtgcgctcagcacggaaaagtggtgacttggcgtactgccaccctgtgcccgcagtcgtgtgaagagcggaatctgcgggagaacgggtatgaatgcgaatggcggtacaactcatgcgcccccgcgtgccaagtgacctgccaacatcctgaaccgctggcatgtcccgtgcagtgcgtggagggctgccacgcccactgccctcccggcaagatactggacgaactgctccagacctgcgtcgatccggaggattgtccggtctgcgaggttgccgggcggagattcgcgagcggaaagaaggtcaccctgaacccgtctgatcctgagcattgccaaatctgtcactgcgacgtggtgaacctgacgtgtgaggcctgccaggaaccgggcggactggtggtgccaccgaccgacgccccagtctcaccgaccaccctgtacgttgaggacatttcggaaccaccactccacgatttctactgctcgagactcctggatctcgtgttcctcctggacgggtccagccggctgtccgaagcggagttcgaggtgctgaaagcattcgtcgtggacatgatggaaagactcaggatctcacagaaatgggtcagagtcgctgtggtcgagtaccacgatggcagccatgcgtatatcggtttgaaggatcgcaagcgaccgagcgagctgcgccgcatcgcttcgcaagtgaaatacgccggcagccaggtggcgtcgacttccgaagtcctcaagtataccctgttccaaatcttctcaaagattgaccggccggaggcatcaaggatcaccctcttgcttatggcgtcgcaggaacctcagcgaatgagcagaaactttgtccgatacgtgcagggacttaagaagaaaaaggtgatcgtgatcccagttggaattgggcctcatgctaatctgaaacagatcaggctcatcgagaagcaggctccggaaaacaaggccttcgttttgtcgtcggttgacgaactggagcagcaacgcgacgagatcgtgtcttacctctgcgacctggctccggaggcaccgccgcctacgctcccccctgacatggcacaggtgactgtgggaccgggattgctgggcgtgtcgacgcttggtccaaagaggaattcgatggttctggacgtggcgttcgttctggagggtagcgataagatcggcgaagccgacttcaaccggtcaaaggaattcatggaagaggtcatccagcgcatggacgttggtcaggatagcattcatgtgactgtgctccagtactcgtatatggtgaccgtcgaatacccattcagcgaggcccagtccaagggggatatcctccaaagggttcgggaaatcaggtaccaaggtgggaacagaactaatactggcttggcacttagatacttgtctgaccatagcttcctcgtgagccagggagacagggagcaagcccctaaccttgtctacatggtgaccggcaacccggcgtccgacgagattaaacggctcccgggcgacatccaagtggtcccgatcggagtgggacctaacgcaaacgtgcaggaactggagcggattgggtggccgaatgcacctatcctgatccaggacttcgaaacccttccgcgggaagccccggacttggtcctccagagatgctgcagcggggaaggactgcaaatccctactctttcaccggctccggattgtagccagccgctggacgtgatcctcctcctcgatggatcatccagcttcccggcctcgtactttgacgagatgaaatccttcgccaaggctttcatctcgaaggccaatatcggaccacgtctgactcaggtgtcagttctccagtatggttccatcaccaccatcgatgtgccgtggaacgtcgtgccggaaaaggcacatctgctttcgctggtcgatgtgatgcaacgggaaggcggaccctcacagattggagacgcccttggatttgccgtgcggtacctgacttcggaaatgcacggagcgaggccgggagccagcaaggcggtggtcatcctggtcaccgatgtgtcggtggactctgtggacgcagccgccgacgcggcgcgctccaatcgggttaccgtgttcccgatcggaatcggagacaggtacgacgcagcccagctgagaattctggccggaccggcaggggactccaacgtggtgaagttgcagcgcatcgaggacctgccaactatggtcactctcggcaattcgtttcttcacaagctgtgttccgggtttgtgcgaatctgcatggatgaggacggcaacgagaaacgcccgggagatgtgtggaccttgccggatcaatgtcacactgttacctgccagccagacggacaaactctgctgaagtcgcaccgggtgaattgcgatcgggggctgcgaccatcgtgtcctaattcacagagccccgtcaaggtcgaagagacttgcgggtgccggtggacctgtccttgtgtgtgcaccggctcctccacccgccacatcgtgacgttcgatggacaaaacttcaagctgaccggatcctgcagctacgtgctcttccagaacaaagaacaagacctcgaagtgatcctccacaatggcgcctgtagcccaggagcccgccaaggctgtatgaaatccattgaagtgaagcactccgcgctgtcagtggaactgcattcagacatggaagtcaccgtcaatggccggctggtgagcgtgccatacgttggaggaaacatggaagtgaatgtgtacggggctatcatgcatgaggtccgcttcaaccacctgggtcacatctttaccttcaccccgcaaaacaatgagttccagctgcaactgagcccaaaaaccttcgcctccaagacgtatggactttgtgggatctgcgacgaaaacggcgcgaatgatttcatgctcagagacggcactgttaccactgactggaaaacgctggtccaagagtggaccgtgcaacgcccgggacagacctgtcaacccatacttgaagagcagtgcctcgtgccggactcgtcccattgccaagtgctgctcttgccgctcttcgcagagtgccacaaggtgctggcgccggcgaccttttatgccatctgccagcaagattcatgccatcaagaacaagtgtgcgaggtcatcgccagctacgcccatctgtgcagaacgaacggggtgtgcgtggactggcgcactccggatttctgcgccatgagctgcccgccatcgctcgtgtataatcactgtgaacacgggtgcccgcggcactgcgatggaaacgtctcctcctgcggtgaccaccctagcgaaggctgcttttgccctcctgacaaagtgatgctcgagggaagctgcgtccccgaagaggcatgcactcagtgtatcggcgaagatggagtgcagcatcagttcctcgaagcatgggtccccgaccatcagccctgccagatctgtacttgtctctcgggacggaaagtgaactgcactacgcaaccgtgcccgactgccaaggcgccaacctgcggtttgtgtgaagtcgcccggctgcgacagaatgcggatcagtgctgtccggagtacgaatgtgtgtgtgaccccgtctcatgcgatctgccgccagtgccgcactgcgaaagaggactgcaacctaccctgaccaatccaggggagtgcaggccaaacttcacttgcgcgtgccgcaaggaagaatgcaaacgggtttccccgccttcctgtccacctcatagactcccgactttgcgcaagacgcagtgctgcgacgaatacgagtgcgcctgcaactgcgtgaacagcactgtgagctgccctctgggctacctggcctcgaccgctaccaatgactgcggatgtactaccactacctgcctccctgacaaggtgtgcgtccaccgttcaactatctacccagtgggacaattttgggaagagggctgcgacgtgtgtacttgcaccgacatggaggacgccgtgatgggcttgagagtggcgcagtgctcgcagaagccgtgcgaggattcgtgtcggtcgggattcacgtatgtgctgcacgaaggagaatgctgcggacggtgcttgccctccgcgtgcgaggtggtgacgggaagcccaagaggagattcacagtctagctggaagtcggtcggatcccagtgggcctctcccgagaacccgtgtctgatcaacgaatgtgtgagagtcaaggaagaagtgttcatacagcagcgcaatgtctcctgtccccaactggaagtgcctgtgtgcccttccggattccagctgagctgcaagacttccgcctgttgcccttcctgccggtgcgagcggatggaagcctgtatgttgaacggaaccgtgatcggtccgggcaagaccgtgatgatcgatgtgtgcacgacgtgccggtgcatggttcaggtgggagtcatctcgggcttcaaacttgaatgccgcaagaccacttgcaatccttgtccactgggatacaaggaggaaaacaataccggagagtgttgtggtcggtgcctgccgactgcgtgcaccattcagctgcggggtggccagatcatgactctcaagagggatgaaactctccaagatggatgcgacacccatttttgcaaagtcaacgaacggggagaatacttctgggaaaagcgggtgaccggatgcccaccgttcgacgaacacaagtgcctcgcggagggaggtaagattatgaagattccaggaacttgctgcgatacttgtgaggagcctgaatgtaatgacatcacggcgcggcttcagtatgtgaaggtcggatcgtgcaagtccgaagtggaagtcgatatccattactgccagggcaagtgtgcaagcaaggcaatgtactcgatcgatatcaacgatgtgcaggatcagtgctcttgctgttcccctactcgcactgaacctatgcaagtcgccttgcactgcaccaacgggtcagtggtgtaccatgaggtgctgaatgctatggaatgtaagtgctcccctcggaaatgctcaaaa

SEQ ID NO: 21322 - DNA, 8439 bp, Artificial Sequence
  Description of Artificial Sequence: Synthetic coding sequence
atgatccccgcccgttttgcgggggtactgctggccctcgcactgatcttgccaggtactctctgcgctgaaggaacgcgcggccgctcgagcactgcccgatgctcactcttcggatccgatttcgtgaacactttcgacggatccatgtactcattcgccggatactgctcttacttgctcgccggcggatgccagaagagatcgttctccattatcggcgattttcagaacggaaagagagtgtcgctttcagtgtacttgggagaattcttcgacatccatctgttcgtcaacggaaccgtcacccaaggggaccagcgggttagcatgccctacgcttccaaaggactttacctggaaacggaagctgggtactacaagctgtcgggggaagcgtacgggttcgtggcacggatcgatggaagcggaaatttccaggtactcctctcagacagatacttcaacaaaacctgtgggctgtgcggaaatttcaatatcttcgcggaggacgatttcatgacccaagaaggtactctgaccagcgacccatatgacttcgcaaattcgtgggctctgtcatcaggcgaacagtggtgcgagcgggccagcccgcccagctcttcctgcaacatctctagcggagagatgcagaagggtctttgggaacagtgccaactgttgaagtcgacgtccgtattcgcacgctgccatcctctggtggacccggaaccattcgtggcactgtgcgagaaaacgttgtgcgaatgcgccggaggcctcgaatgcgcttgcccggcccttctggagtatgcccgtacctgcgcccaggagggcatggtgctgtacggctggactgaccattcggcttgctccccggtatgcccagccggcatggaatacaggcaatgtgtctcgccgtgcgctagaacttgccagtcgctgcacatcaacgaaatgtgccaggaacgctgcgtcgacggctgctcctgccccgagggtcagctgttggatgaaggtttgtgtgtggagtcaaccgaatgcccgtgtgttcatagcggaaagcgctacccaccggggacttccctgtcacgggattgcaatacctgcatctgccgcaattctcaatggatctgcagcaacgaagaatgcccgggtgagtgcctcgtgaccggacagagccactttaagtcattcgacaaccgctacttcactttctccgggatctgccagtacctgctggccagggattgccaggaccatagtttttccatcgtgatcgaaaccgtgcagtgcgcagatgaccgcgacgcggtctgcactaggtccgtgaccgtgcgcctgccaggacttcataacagcctggtgaagctcaagcacggagcaggggtggctatggacggacaagatgtgcagctgccactgctgaagggtgatctgaggatccagcatactgtcacggcctcagttcgcctgtcctatggcgaggacctgcagatggactgggacggacgagggcggttgctcgtgaaactgtcgccagtctacgcgggcaagacttgcggcttgtgtgggaactacaacggaaaccagggcgacgatttcctcaccccatcgggactcgctgagcctagagtggaagatttcggaaatgcctggaagctgcacggggactgccaagatttgcaaaagcaacactcggacccctgcgcgctcaatccaagaatgacccggttctccgaggaggcgtgcgccgtcctgacctcaccgacttttgaagcatgccaccgcgccgtcagtcctctcccatacctgaggaactgcaggtacgacgtctgctcttgcagcgatggaagggagtgtctgtgtggggccctggcatcatacgccgccgcctgcgccggccgcggcgtaagggtggcatggcgcgaacccggtcggtgcgaactgaactgtccgaagggacaagtctacttgcagtgcggcactccttgcaatcttacttgcagatccctgtcctaccctgacgaggagtgcaacgaagcctgccttgaaggatgtttctgcccgccgggactgtacatggacgagcgcggcgactgtgtgccgaaggcacaatgcccttgctattacgacggggagatctttcagccggaggacatcttctccgaccaccacaccatgtgctattgcgaggatggctttatgcactgtacgatgagcggagtccctggaagccttctgccagacgccgtcctctccagcccactctcgcacagatccaagagaagcctgtcatgccggccgcctatggtgaaactcgtgtgcccggccgataatctgcgcgcggagggactggaatgtaccaagacgtgccagaattatgatctggagtgtatgagcatgggttgcgtcagcgggtgcctgtgtccgccgggaatggttcgccacgaaaaccggtgtgttgcactcgagagatgcccttgcttccaccagggaaaggaatacgcgcccggcgagactgtgaagatcggctgcaatacttgtgtgtgtcaggataggaagtggaactgcactgaccacgtgtgtgatgcaacctgttccacgatcggaatggcacactacctgaccttcgacggcctgaaatacctcttcccgggagaatgccagtacgttctcgtccaggactactgcggatctaatccagggactttccggatccttgtggggaacaaaggctgctcgcatccatcggtgaaatgcaaaaagcgggtcacgatcctggtcgaaggaggagagatcgagctgttcgacggcgaagtgaacgtcaagcggccgatgaaggacgagactcactttgaggtggtggaatcaggaaggtacatcatcctgcttcttggaaaggcgctgagcgtcgtctgggatcgccatctgtccatctcggtcgtgttgaagcagacttaccaggaaaaagtgtgcggactgtgcggaaacttcgatggcatccagaacaacgacctcacttcgtcgaacctccaggtggaagaagatcccgtggactttgggaactcctggaaggtgtcctcccaatgcgcggataccaggaaggtgccgctggatagctcaccggcaacttgccataacaacatcatgaaacagacgatggtggatagctcgtgcaggatcctcacctccgacgtgttccaagactgtaacaaactcgtcgatccggagccctacctggacgtgtgcatttacgatacgtgctcatgtgaatccattggagattgcgcttgcttctgtgacaccatcgcagcgtacgcgcatgtgtgtgcccaacacggaaaagtggtcacgtggcgcaccgccactctgtgtccgcagtcatgcgaggaacggaacctcagagagaacgggtacgagtgtgagtggcggtacaattcctgtgccccggcgtgccaggtgacctgtcaacatccagagccgctggcttgcccagtgcaatgtgtggaaggatgccatgctcactgccctccgggtaaaatcctggacgaattgttgcaaacttgcgtggatccagaggattgcccggtgtgcgaagtggctggacggcgctttgccagcgggaaaaaggtcaccctcaacccttccgacccagaacactgccaaatctgtcattgcgatgtcgtgaacctgacctgcgaggcatgtcaggaacctggaggtttggttgtcccaccaactgatgctcctgtgtcgcccaccaccctgtacgtcgaagatatctccgagccgccgctccatgacttttactgtagccgcctgctggaccttgtgttcttgttggacggttcgagtcggctgtctgaggcggaattcgaagtccttaaggctttcgtcgtcgatatgatggagaggctgaggatctcgcaaaagtgggttcgtgtcgccgtggtcgaataccatgatggttcgcacgcgtacatcggactgaaggatcgcaaacggccgtcagaactgcgacggatcgcctcacaggtgaagtatgccggatctcaggtggcgtcgacgagtgaagtgcttaagtataccctcttccagattttcagcaagatcgaccgccccgaagcgagccggatcactctgctcctgatggcgtcccaggaaccacagcgcatgtccaggaattttgttcggtacgttcaaggtcttaagaaaaagaaggtcatcgtcattccggtgggcatcgggccacacgctaatctcaagcaaatccggctgattgaaaaacaggccccagaaaacaaggccttcgtgctctcgagcgtggatgaactggagcaacagcgggacgaaatcgtctcgtacctgtgtgacctggccccggaagcccctccgccgaccctgccacctgatatggcccaggtaacggtgggaccaggactgctgggagtgtcaacgcttggaccgaagaggaattcaatggtcctggatgtcgcattcgtccttgagggatccgacaaaatcggagaggctgacttcaaccgctcaaaggagttcatggaagaggttatccagcggatggatgtgggccaggacagtattcatgtcactgtcctccagtactcctacatggtgactgtcgaatacccgttctcggaagcccagagcaagggggacatcctgcaaagagtgagagaaatacggtaccagggagggaaccggaccaataccggactggcattgagatacctctccgaccactcgttcctcgtgtcgcaaggtgaccgtgaacaagcgcccaacctcgtgtacatggtgacgggcaatccggcctcagacgagatcaagcggctcccgggagacatacaggtggtgccaatcggcgtgggccccaatgccaacgtgcaagagctggaacgcatcggttggcctaatgcgccgattctgatccaggattttgaaactctcccaagagaggcgccggatctcgtgctccagaggtgttgttccggagaggggctccaaatcccgaccttgagccccgcgcctgattgctcgcagccgctggacgtcattctgctgctggatggatcctccagcttcccggcttcgtactttgatgaaatgaaatcgtttgcaaaggcctttatctccaaggccaacatcggtccacgcttgacccaagtctcggtcctccaatacggtagcattaccactattgacgtcccatggaacgtggtgccggaaaaagcacacctgctgtccctggtggacgtcatgcagcgggagggaggaccatcccaaatcggggacgctctgggtttcgccgtgaggtacctgactagcgaaatgcacggcgcgcgaccaggagcgagtaaggcagtcgtgatcctggtcaccgacgtttccgtggattcagtggacgcagctgccgacgctgcgcgatcgaatcgcgtaactgtgttcccgatcggcatcggagatcggtacgatgccgcgcagttgaggatactcgccggacctgccggagacagcaacgtggtgaagctccagcggatcgaggatctgccgaccatggtgaccctgggcaatagcttcctccacaaactttgttccggcttcgtgcgaatctgtatggatgaggacggaaacgagaagcgccctggcgatgtgtggactttgcccgaccaatgtcacaccgtgacttgtcagccggatggacagactctgctcaaatcgcaccgcgtgaactgcgacaggggactccgccccagctgtcccaattcacagagcccggtgaaggtcgaggaaacctgcggctgccggtggacctgtccgtgcgtctgcaccggatcatcgacccggcatattgtgacttttgatggccaaaacttcaagctgacggggtcgtgctcgtacgtgttgtttcagaataaggagcaggacctcgaagtcatcctccacaacggggcctgttcccccggagcccggcagggatgtatgaagtccattgaagtcaagcattcggccctgtccgttgagctgcattcggacatggaagtcaccgtcaatggacgcctcgtgagcgtgccatacgtcgggggcaatatggaagtgaacgtgtacggagcgattatgcatgaagtgcgtttcaatcacctgggacacattttcacctttaccccccaaaacaacgagttccagctgcagctctcccctaaaacttttgcctcaaaaacttatgggctctgcgggatttgtgacgagaacggagccaacgacttcatgctcagggacggaaccgttactaccgactggaaaactcttgtgcaagagtggaccgtgcaacggccgggacagacctgccagcctattttggaagaacaatgccttgtgccggactccagccactgccaggtgctgcttcttccgcttttcgctgagtgtcacaaagtgctcgcccctgcaactttttacgctatttgccagcaggactcctgccaccaggaacaggtgtgcgaggtgatcgcctcgtacgcgcacctctgccggaccaatggagtgtgcgttgactggagaactccggatttttgcgccatgtcatgcccgccatcgctcgtgtataatcactgtgaacatggttgccctcgccattgcgatggcaatgtgagcagctgcggcgatcatccgtcggaaggatgcttctgtccacccgataaggtgatgctcgaggggtcatgcgtccccgaagaagcctgcactcagtgcattggcgaggacggggtgcaacaccagttcctggaagcatgggtgccggatcatcagccatgccagatctgtacctgtctgtctggaagaaaagtcaactgtactactcaaccctgccctaccgcaaaggcccctacttgcgggctgtgtgaggtcgcaagactgcggcaaaacgcggaccaatgctgtccggaatacgaatgcgtatgtgacccggtgtcgtgtgatctgccaccggtcccgcattgcgagcgaggtttgcaacccaccctcaccaatccaggcgaatgcagaccaaatttcacttgtgcctgccgcaaggaagaatgtaagagagtgtctccgccgtcgtgtccgccgcaccgcctgccaaccttgaggaaaacccaatgctgtgacgagtacgagtgcgcatgtaattgcgtgaactccactgtcagctgtccactgggctacctggcgtcgaccgcaactaacgactgcggatgcacgactactacgtgccttccggataaggtgtgcgtgcaccgaagcactatatacccggtgggacagttttgggaagaaggctgtgacgtgtgcacttgcaccgatatggaggacgccgtgatgggcctgcgggtggcacagtgctcgcaaaagccatgtgaggacagctgcaggtcaggatttacgtacgtgcttcacgagggtgagtgctgcggccgctgtttgccatccgcctgcgaggtcgtgaccggatcacctagaggcgactcacaatctagctggaagagcgtgggctcgcagtgggcgagccccgagaacccatgcctcatcaacgagtgcgtccgcgtgaaggaggaggttttcattcaacagcgaaacgtgtcgtgccctcagctggaagtccccgtgtgccctagcgggttccagctgtcatgcaaaaccagcgcatgctgcccatcgtgccggtgcgaaagaatggaggcctgcatgctgaacgggaccgtgatcgggcctggaaaaaccgtgatgattgacgtctgcaccacttgccgctgcatggtgcaagtcggagtgatctccggtttcaagctggaatgccgcaagaccacctgtaacccgtgtccactcggatacaaagaagagaacaacacgggcgaatgctgcggtcggtgtctgccgactgcgtgcaccatccagctgagaggaggccaaatcatgaccctgaagcgcgatgaaactctccaggacgggtgcgacacccacttctgcaaggtcaacgagagaggcgaatacttctgggagaaacgggtgaccggatgccctccatttgatgaacacaagtgtctcgcagaaggcggaaagatcatgaagatcccgggaacctgctgtgacacgtgtgaggaaccagagtgtaatgacatcactgccaggctgcaatacgtgaaggtgggaagctgcaaatccgaagtggaggtcgatatccattactgccaaggaaagtgcgcatccaaggctatgtactcaatcgacatcaatgatgtgcaggaccagtgctcgtgctgttcacctacccggaccgaacctatgcaggtggcccttcactgcaccaacggttcagtcgtgtaccatgaagtgctgaacgcgatggaatgcaagtgctcgccgcgcaagtgctcgaaa

SEQ ID NO: 21323 - DNA, 8439 bp, Artificial Sequence
  Description of Artificial Sequence: Synthetic coding sequence
atgatcccagctaggttcgctggtgtgcttctggccctggcactgattcttccaggaacgctgtgtgccgaggggacccggggtagatcaagcactgcaagatgctctttgttcgggagcgatttcgtcaacaccttcgacggctctatgtacagttttgctgggtattgtagctatctattagctggtggatgccagaaacgctccttctctatcattggggattttcaaaatggaaagcgtgtctcactaagcgtctatctgggggaattcttcgatatccacttgttcgtaaatgggaccgttacccaaggagaccaaagagtgagcatgccatacgccagtaagggcttgtacctggagaccgaagccggatactataagctgagtggagaggcatatggcttcgtcgcacgcatagacggctcgggcaattttcaggtgttgctgtccgatcgctactttaacaaaacatgtggtttgtgcggaaacttcaacatctttgcagaagacgactttatgacccaggaggggactctcacaagtgatccctacgacttcgccaacagctgggctctgtctagcggagagcagtggtgcgaaagagcgagtccacccagttcctcttgcaacatctccagcggggagatgcagaaaggcctgtgggaacagtgtcagttgcttaagagtacgagtgtgtttgcccgttgccaccccctggtagatcccgaacctttcgtggctctatgcgaaaagactctctgcgagtgtgcgggcggcctggagtgtgcatgccctgcgctcctcgagtacgcaaggacctgtgctcaggaggggatggttttatacggctggacagaccattcagcctgttcgcccgtgtgtcccgcaggaatggaatatagacagtgtgtttcaccttgtgcaaggacctgccagtctcttcacattaacgagatgtgtcaggagaggtgtgtggacggctgttcttgtccggagggtcagttgttggacgaggggctttgtgtcgagagcacagagtgtccttgcgtccatagcggtaagcgttaccctcctggaacttctctctctcgagattgcaatacttgcatttgccgaaattcgcaatggatctgcagcaacgaggagtgccctggagagtgcttggtgactgggcaaagccattttaagtctttcgacaatcgttacttcaccttctccggaatatgtcagtatctgctcgcccgagactgtcaggaccacagcttctccattgtgattgaaaccgtccagtgtgccgatgaccgggacgccgtgtgcactcgctccgtgacagtgcgcctccctggtcttcataattcacttgtgaagctgaagcacggagcaggagtagcaatggatgggcaggacgtccagctgccactgctaaagggtgatctgagaatccagcacaccgtcacagccagtgtgcggctctcttacggagaggacttgcagatggattgggacggccgcggacggttgcttgtaaagttgtccccggtctacgctggaaagacttgtggtctttgcggtaattacaacgggaaccagggcgatgattttctgacacccagcgggctagctgaacctagagtggaagatttcggtaatgcttggaaactccacggagactgccaggacctgcagaagcagcactccgacccgtgtgcattgaaccctaggatgacacgattctctgaggaagcatgtgcggtgttaactagtccaacctttgaagcgtgccaccgggctgtgtcacccctgccataccttcgaaactgcaggtacgatgtttgtagttgcagcgacggcagggagtgcctgtgcggggcgttggcaagctatgctgccgcatgtgccgggagaggggtgagggtggcctggagagaaccaggccgatgcgagctgaactgccctaaggggcaggtgtacctgcagtgtgggactccatgtaacctcacctgcagatccctgagctacccagacgaggaatgtaacgaggcatgtttggagggttgtttttgtccccccggactctacatggacgagaggggggactgtgtacccaaggcccagtgtccatgctactatgacggggaaatctttcagccagaagacattttttcagatcaccatactatgtgttactgtgaagatggtttcatgcactgcaccatgagtggagttccagggtccctgctaccagacgccgtgctgagctcaccactcagccaccgatccaagcggtccctgagctgtcggcctccaatggtgaagctggtatgccctgcagacaacctaagagcggaaggcctggagtgtacaaagacgtgtcagaattacgacctggagtgcatgtctatgggatgtgtgtctggctgcctgtgcccacccggaatggttagacacgagaacaggtgcgtcgcccttgaacgctgcccatgctttcatcagggcaaagaatacgctccaggcgaaaccgttaaaatcgggtgcaatacttgcgtgtgccaggaccgcaaatggaactgtacagaccatgtctgtgatgctacgtgcagtacaattggtatggcccactatctcactttcgatgggctcaagtatctgttcccaggggaatgtcagtatgttctcgtgcaagattactgcgggtccaacccagggactttccggatcctggtgggcaacaagggatgctcccacccttccgtaaaatgtaagaaaagagtaaccatccttgtggaggggggagaaatcgagctgttcgacggagaggtgaacgttaagaggccaatgaaagacgagacgcactttgaggtcgtggaatccggtcgatacatcatcctcctgttgggaaaggccttaagcgtcgtttgggatcgacatctgagcatatccgtagtgttgaaacagacttatcaggagaaagtgtgtggactctgtggaaatttcgacggtatccagaataatgacttgacatcttcaaatttacaagtcgaagaagatcccgttgactttggcaacagctggaaggtgtcatcgcagtgcgctgataccaggaaggtgccactcgattcctcccccgcgacatgccacaataacatcatgaaacagacaatggtggatagctcctgcagaattttgacctcagacgtcttccaggattgcaataagctggtcgatcctgagccatatctggacgtgtgtatctacgatacctgttcttgcgagagcataggcgactgtgcatgtttttgtgacacaatcgcggcatatgcacacgtctgcgcccagcacggcaaggtggtgacctggcgcacagccacattgtgtccgcagagctgcgaggagcgaaacctgagagagaatggctacgaatgcgagtggcggtacaactcctgcgcccccgcctgtcaggttacctgccagcaccctgaaccactcgcctgccccgtgcagtgtgtagagggttgtcacgcccactgtccccccggaaaaatcttggacgagctgcttcaaacctgcgttgacccagaggattgtccagtgtgcgaggtggccgggcggaggtttgccagcggcaagaaggtcacacttaatccctccgaccccgaacattgtcagatttgccattgtgatgtggtgaatctgacgtgtgaggcctgccaggagcctggagggctggtcgtaccacctacagacgctccagtcagtccaaccaccctgtacgttgaggacattagtgagccccctctacatgatttctattgctccaggttattggacctcgtgtttctcctggacgggtcctccagacttagcgaagctgagtttgaagtgctgaaggcctttgttgtagacatgatggagcgccttaggatatcccagaaatgggttagggtcgcagtggtcgaatatcacgacggcagccatgcgtacatcggcctgaaagataggaagcgcccttctgagcttagaagaattgcatcccaggtgaaatacgcgggttcccaggtcgcgtccacgtcagaggtactgaagtacactctgtttcagatcttcagcaaaatagatcgtcccgaggcttcacgtatcaccttgctgctgatggcatcccaagagccccaacgaatgtctcggaacttcgtcaggtacgtccagggcctgaaaaaaaagaaagtaattgtgatcccagtggggatcgggccacatgccaatctcaagcagatccgcctgattgaaaaacaagcgcctgaaaacaaggcttttgtcctcagtagtgttgacgagctggagcaacagcgtgacgaaatcgtcagctatctttgcgatcttgcacctgaagcacctccacctaccctgcccccagatatggcccaggtgaccgttgggcccgggctgctgggagtatcaacactcggcccaaagcggaatagtatggtgctggatgtggcgtttgtgcttgagggctctgataaaatcggggaagccgatttcaatcggtcaaaagagttcatggaggaagtcattcagaggatggacgtcggtcaagattcaatacacgtcaccgtgctccagtactcctacatggtgacagttgagtaccctttctccgaggcccagagcaagggagatatcctccagagagtgagagaaattaggtaccaggggggtaacaggacaaacacgggcttagcccttagatacttgtctgatcattccttcctagtctcgcaaggtgatcgggaacaagcccccaatctcgtatatatggtaaccggaaatcccgcaagcgatgaaataaaaaggctccccggcgacattcaggttgtgcccatcggggtcgggccaaacgcaaacgtgcaggaactggaacggattggctggcctaacgcccccatacttattcaggactttgagaccttacctcgtgaggcccctgacctcgttctgcaacggtgctgctctggcgaaggcttacagatacccacactctctccagcacctgactgcagccagcctctcgatgtgatcctgcttctcgacgggtcttcgtccttccctgcctcctacttcgatgagatgaagtcgtttgccaaggcgttcatcagcaaggcgaacatcggaccccggcttacccaggtcagcgttctgcagtatggtagcataaccacgattgacgtcccatggaacgtggtgcccgagaaggcgcacttgttatccctcgttgatgtgatgcagagagagggtggaccatcacaaataggtgatgccttaggattcgccgtccgctacttgacgtcagaaatgcatggtgctagacccggcgcatcaaaagccgtggtaatcttggtcaccgatgtaagtgtggacagcgttgacgctgccgccgatgccgcgcgttccaaccgtgtaaccgtgtttccgatcggaatcggcgataggtatgacgccgcccagctgcgcatactcgctggaccagccggagacagtaacgtggttaaactgcagcgcattgaagacctccccaccatggtaacattgggtaacagctttctccacaagctctgcagcggtttcgtcaggatttgtatggacgaggatggcaacgaaaagaggcccggagatgtctggaccttgccagatcagtgtcacactgtaacctgtcaacctgatggacagactctgctgaagagtcaccgggtcaactgtgaccgaggactccgccctagttgtccgaacagccagtctccagtgaaggtggaggagacatgcggctgtcggtggacctgtccttgcgtttgtactggctcatcaacccggcacatcgtgacattcgacggtcaaaacttcaaactgactgggtcatgctcctatgtgttgtttcagaacaaggaacaggatttagaggtcatcctgcacaatggggcttgcagccccggggcccgacagggatgcatgaagtccattgaagtgaagcacagcgctctctctgtggagctgcattctgacatggaggtcaccgtgaatggccggctggtgtcagttccatacgtaggagggaatatggaagtcaacgtttatggcgccattatgcatgaagtccgattcaatcatctgggccacatcttcacatttaccccccagaataacgagtttcagcttcagctaagtccaaaaacttttgcctctaagacttacggcctgtgtggtatctgcgatgaaaacggcgctaacgattttatgttgagagatggtactgtcaccacagattggaaaactttagttcaggaatggacagtacagagaccgggtcagacctgccagccgattttggaggaacagtgtctggtgcctgacagctcccattgccaagttcttctcttgccactgttcgccgagtgccataaggtgctcgctcccgctactttctatgctatttgccagcaagattcctgtcaccaggagcaagtgtgcgaggtgatcgcttcatatgcccacctttgtagaacaaacggcgtgtgcgttgattggcggaccccagatttttgtgccatgtcttgtcctccctctctcgtctataatcactgcgagcacgggtgcccacgccattgcgatggcaacgttagctcatgtggcgaccatccatctgagggctgcttttgtccaccagataaggtgatgctggagggttcatgtgtcccggaggaggcctgtacccaatgtatcggcgaagacggcgttcaacaccagttcctggaagcatgggtcccagatcaccagccgtgtcagatctgcacgtgtctctccggaaggaaggtgaactgcacaacacagccctgccccacagctaaagctcccacttgtggattgtgtgaagttgcccggctgaggcaaaacgccgaccagtgttgccccgagtatgagtgcgtctgtgaccccgtttcttgtgatttgcctccagtccctcattgtgagaggggcctgcagcccacactgactaaccccggcgagtgccggccaaactttacctgcgcttgtcgcaaggaggaatgtaagagggtaagtcctccttcgtgtccgcctcacagactgcccacactccgtaaaacacagtgttgtgacgaatacgaatgtgcatgcaactgcgtgaactctaccgttagttgccccctcggttatctcgcgtccacagccacaaacgattgtggctgcacaacaactacctgtttaccagataaggtatgcgtgcataggagcaccatatacccggtgggtcagttctgggaggagggatgtgacgtgtgtacctgtactgatatggaggacgccgtgatggggctgcgcgtggcgcagtgctctcaaaaaccctgcgaagattcctgtagaagcgggttcacatacgttttgcacgaaggagaatgttgcggccggtgtctgccatcagcttgcgaggtggtaacgggtagcccccgcggggacagccagtcctcatggaaatcagtgggtagccaatgggcgagtcctgagaatccgtgcctaattaacgaatgtgtacgggtaaaggaggaagttttcatacagcaacgaaacgtgtcttgtccccagcttgaggtcccagtgtgcccgtccggctttcagctcagctgtaagacgagcgcgtgctgcccctcgtgtagatgcgaacgtatggaggcctgtatgctgaatgggacagttattgggcctggaaagaccgtcatgattgacgtctgtacaacctgtaggtgtatggttcaggtgggcgtgatcagcgggttcaaactggagtgcaggaagaccacttgcaatccatgtcctcttggatataaggaggagaacaataccggcgaatgctgtggtcgctgtctgccaaccgcctgtactattcagctgaggggcggccagatcatgaccttgaagagggacgagacattgcaggacggatgcgatacgcatttttgcaaagtgaatgaacgtggagagtacttctgggagaaacgagtcactggctgtccaccctttgacgagcataagtgcctcgccgagggtggtaagatcatgaagatccccggtacatgctgtgacacttgtgaagagcctgagtgcaacgacattacggcacgactgcaatacgtaaaggtgggcagttgtaaaagtgaggtagaagtcgacatccactactgccaggggaaatgcgcctctaaggctatgtacagtatcgatattaacgatgtccaggatcagtgtagttgttgctcccctacacgaaccgagccaatgcaggtggcattgcattgcactaacggctctgtagtctaccatgaagtactgaacgcaatggaatgtaagtgctcacctcgcaaatgttccaag

SEQ ID NO: 21324 - DNA, 8439 bp, Artificial Sequence
  Description of Artificial Sequence: Synthetic coding sequence
atgatccccgcccgatttgcaggtgtgctattggccctcgccttgatcttgccgggtaccctgtgcgcggagggaacgcggggccgctcctccaccgcacgctgcagtctttttgggagcgactttgtgaatacctttgatggctcaatgtatagcttcgcaggatactgctcgtacctactcgctggcggctgccagaagcggtctttctccataattggcgacttccagaatggcaaaagagtgtccctgtccgtgtacctaggagagttcttcgatatccatctgtttgttaacggcacagtgactcaaggagaccagcgggtgagcatgccatatgcatccaagggcctgtacctggagaccgaggcaggctactataagttgtctggcgaggcgtacggcttcgttgctagaatcgacgggtcaggaaattttcaagtcctcctctccgatcgttacttcaacaaaacatgtggcttgtgcggcaacttcaatatattcgccgaggacgatttcatgacacaagaggggacgttgacttcggacccctacgatttcgcgaacagctgggctttgagcagcggcgaacagtggtgtgaacgtgcctctccaccgtccagcagctgtaacatttcgagtggagagatgcagaagggcctgtgggagcagtgccagctcttgaagtccacgtcggttttcgctcgctgccatccattagttgacccagagcccttcgttgccttgtgcgagaagacactgtgtgagtgcgccggcggactggagtgtgcctgccccgccttactggaatacgctcgcacatgcgcacaagagggcatggtgctctatggctggaccgaccactcggcctgttcccccgtgtgtccagctggcatggagtaccgacagtgtgtatcaccgtgcgcccgtacctgtcagtcgctgcatatcaacgagatgtgtcaagaacggtgcgtcgacggttgcagctgccccgaaggccagctgctagatgagggcttgtgcgtggaatccacggaatgtccttgcgtgcactctggaaagcgttaccctcctggaacgtcgctatcccgcgactgcaatacctgcatttgcaggaacagccagtggatatgctcgaatgaagagtgccctggcgagtgcctggtgaccggacagagccacttcaaaagtttcgacaatcggtattttacgttttcaggaatctgtcagtacctactggctcgtgactgccaggaccatagctttagcatagtgatcgagaccgtgcagtgtgccgacgatcgagatgccgtatgtacgaggagtgtgactgtcaggctgcccggcctccataatagcctagtaaagctgaagcatggcgcaggtgtggcaatggacggacaagatgtccaattgccgttgcttaaaggagatctgcgcatccaacacaccgtgactgcatcagtgcgcctctcctacggcgaggatttgcaaatggactgggacggtaggggtaggcttctcgtgaagctgagtccggtctacgcgggtaaaacttgcggtctgtgcggcaactacaatggcaatcagggagatgactttttgaccccgtcgggactggccgaaccacgcgttgaggattttggaaatgcgtggaagctgcacggggactgtcaggatctgcagaagcagcactctgacccatgcgctctaaacccacgcatgactcggttcagcgaggaagcctgcgccgtgctcaccagtcctacgtttgaggcctgccatagggcggtgtcccccctgccttacctcagaaattgccggtatgatgtttgttcgtgcagtgatggtcgagagtgtctttgcggcgctttggcttcgtatgcggcggcatgtgcaggccgcggcgtgcgggtggcatggcgtgaaccgggacgctgcgaattgaattgtcccaaaggccaggtatacctgcagtgcggcactccgtgcaacctgacctgccggtccctgagttacccagatgaggagtgcaatgaggcgtgcttggaggggtgcttctgcccaccgggtctctacatggacgagcgaggcgattgcgtacctaaggcacagtgcccatgctactacgatggagaaatctttcagcccgaggacatcttctccgaccatcatactatgtgctactgcgaagacggcttcatgcactgcactatgtccggcgtgcctggctccctgctgccagatgcggtgctgagctctccgctgtctcaccggagtaaacgatctctgagctgccgccccccgatggtgaagctagtttgccctgccgataatcttcgtgccgagggattagagtgcacgaaaacgtgtcagaactacgatctggagtgcatgtcaatgggttgcgtgtcgggatgcttgtgtccacctggaatggtgcgacacgagaatcggtgtgtcgcgctggagcgatgcccctgtttccaccagggtaaggagtacgcacccggcgaaacagtcaagatcggctgcaatacctgtgtttgccaggatcgcaagtggaattgcaccgatcacgtgtgtgatgctacctgctccactatcggcatggcacattaccttacgtttgatggcctaaagtatctgtttcccggagagtgtcagtacgtgttggtgcaggattactgcggcagtaacccgggcacgttccgtattctggttggcaacaagggctgctcccacccgagcgtgaagtgcaagaaacgtgtcacaattttggtcgagggtggcgaaatcgaattattcgatggtgaggtgaacgttaagcgtccgatgaaggatgagacgcactttgaagtggtcgagagtggccgttacatcatactattactcggtaaggctctgagtgtggtgtgggaccgacacctgtcaatcagcgtagtattgaaacagacctaccaggaaaaagtgtgcggtttgtgtggaaacttcgacggcatccagaataacgatctgaccagtagcaacttgcaggttgaggaggatccagtagattttggcaacagctggaaagtaagttcacagtgtgccgacacacgcaaggttccccttgactcgtccccggccacgtgccacaacaatatcatgaagcagaccatggtcgatagttcctgccgaattttgacgtccgacgtattccaggactgcaataagctcgtagatccagaaccatacctggatgtatgtatctatgatacgtgtagctgcgagagcattggagattgcgcctgcttttgcgacacgatcgcagcctacgcacatgtgtgcgcgcagcatgggaaggtcgtgacctggaggacggccacgctatgccctcaatcctgcgaggaacgtaaccttcgagagaatgggtacgagtgcgaatggcgctataattcctgcgctccggcctgccaggttacctgccaacacccagaacccctggcatgccccgtacaatgcgtagaaggctgccatgcccactgcccgccgggaaagatactagatgagttgttgcagacgtgcgtggatccggaggactgtccggtctgtgaggtggctggccggcgtttcgcctccggcaaaaaggtaaccctgaatccgtcggatccagaacattgccagatatgccactgcgacgtcgtgaacctcacatgtgaggcctgccaggagcctggcggcctcgttgtgccaccaacagacgccccggtatcgccgaccactctgtacgtcgaggacatctccgagccgccgttgcacgacttctactgttcaaggttgctggacttggttttcctactcgatggtagctccagactgagtgaggccgaatttgaggtgctgaaggcttttgtcgtggacatgatggaacggctacgcatctcccaaaagtgggtacgggtggccgtcgttgagtaccacgatggttcccatgcgtacatcggactcaaggaccgcaaacgaccaagtgagttgcgccgtatcgcctcgcaggtgaaatacgccggcagccaggttgcttccacgagcgaggtgttgaagtataccctatttcaaatattctccaaaatcgatcgtccggaagcttcgcgcatcacgttgctcttgatggccagccaggagccacaacgaatgtcccgtaatttcgtccgctacgtccagggcctgaagaagaaaaaggtcatcgtaatacccgtcggaattggtccacacgccaatcttaagcagattcgactaatcgagaagcaggcaccggagaataaggccttcgtcctgtcatccgtagacgagctcgagcagcaaagggacgagatcgtgagctacctgtgcgatctcgcgcccgaagcgcccccaccgacgctgccgcccgatatggcacaagtgacggtggggcccggcctccttggtgtttccacgctaggcccgaaacgtaattccatggttttggacgttgctttcgtactggagggctctgacaagatcggagaggctgacttcaatcgcagcaaggaattcatggaggaggtcattcagaggatggacgtgggccaggactctatccacgtaacagtgctccaatactcctacatggtcactgtggaatatcccttcagcgaagcgcagagtaagggtgatatattacagcgcgttagggaaatccgctatcaaggaggaaatcgcactaacacaggtcttgccctccgatatctatcagatcactcttttctggtgagccaaggcgatagggaacaggccccaaatctagtgtacatggtcactggcaatccggcctccgacgaaatcaagcgcctcccaggagatatacaggtggtgccgatcggtgtaggtcctaacgcgaacgtccaggagctggagcgaattggatggcccaatgcacccatcctgattcaggacttcgagacactgccacgggaagcaccagatctggtgttacaaaggtgctgtagtggcgaaggactccagatcccgacgctgtccccggccccggattgctcacagccgctggatgtgattcttctcctggacggcagttcaagcttccctgcttcgtattttgacgagatgaaatcgtttgccaaggccttcatttcaaaggccaacataggccccagactgacccaagtttcggtactccagtacggtagcataaccaccattgatgttccgtggaatgtggtgcccgagaaggcccacctcctatcattggtcgacgtgatgcaacgcgaaggcggtccgtcacagatcggcgatgcgctcggttttgcggtgcgctacctgacttccgaaatgcacggcgcgcgtccaggagcgtccaaagcagtggttatcttggtcaccgatgtttcggtggactcggttgatgctgcggctgatgcagcacggtcgaacagagttactgtcttcccgatcggcattggcgaccggtacgatgccgcgcagctacgcatccttgccggacccgccggtgattcgaatgtggtcaagctccagcgcatcgaggatctccccaccatggtgactctgggtaattcattccttcataagctctgctccggattcgttagaatatgcatggatgaagatggcaatgaaaagcgaccaggcgatgtctggaccttaccggatcagtgtcataccgtgacctgtcaaccagacggtcaaacgttgctgaagagtcacagggtcaattgcgataggggccttcgtccctcatgcccgaactctcaaagtcctgtgaaggtcgaggagacttgcggttgccgttggacgtgcccctgcgtctgcacgggctccagcacgcgccacattgtcaccttcgatggtcagaactttaaattgacaggatcgtgctcctacgtactctttcagaacaaggaacaagatctggaggtcattttgcataatggagcgtgttctcccggcgcccgccagggatgtatgaagagtattgaggtcaagcactcggctctcagtgtggagctgcacagcgacatggaggttaccgttaatggccgtctggtgtccgtgccatacgtaggcggaaacatggaagttaatgtatatggcgccatcatgcatgaggtgcgcttcaaccatctgggccacatcttcactttcaccccacagaataatgagttccagctacagctgtccccgaaaaccttcgcctctaagacctacggcctctgcggcatatgcgacgagaatggtgccaatgattttatgcttcgtgacggaacagtgacaacggattggaagacgctggtccaggagtggacggtgcagaggcccggccagacttgccagcccatattggaggaacagtgcttggtcccggactcgtcgcattgtcaggtgctgctactgccactgttcgccgagtgtcacaaggtgctggccccagccacgttttacgcaatttgccaacaagacagctgtcaccaggaacaggtgtgcgaggttatagcctcctacgctcatttgtgtcgtaccaatggtgtctgcgttgattggcgaacaccggatttctgcgcgatgtcgtgcccgccatcattggtgtataaccattgcgagcatggctgcccacggcattgcgatggcaatgtctcgtcgtgcggcgatcatccgagcgagggttgtttctgcccaccagacaaggtgatgctggagggatcctgtgtcccagaggaggcatgcacacagtgcatcggagaggatggagttcagcatcagtttctggaggcatgggttcccgatcatcagccatgccagatctgcacctgcctgagcgggcggaaagtgaactgtaccacccagccttgccccacggcaaaggctccaacatgcggcctgtgcgaggttgctcgactacgccaaaacgccgatcagtgctgcccagaatatgagtgtgtctgtgaccccgtctcctgcgatctgccgccagtccctcattgcgagcgtggactgcagcccactctgacaaaccctggcgagtgccgccccaatttcacgtgcgcatgtagaaaggaagaatgcaagcgcgtgtcccccccatcctgtccgccacaccgtctcccaacccttcggaaaacgcagtgctgcgatgagtacgagtgcgcctgcaattgcgtgaactcaactgtttcgtgcccgctcggatacctggcctcgacggcaacgaacgattgcggctgtacgactacgacatgtttgcccgataaggtatgcgtgcatcggtccactatttatcccgtgggacaattttgggaggagggatgcgatgtgtgcacctgcacggacatggaggatgctgttatgggcctccgcgtggcgcagtgcagtcagaaaccatgcgaggattcttgccgatcgggctttacctatgtgctgcacgagggcgagtgctgcggacggtgcctgccaagcgcgtgcgaggtcgtgacaggcagcccccgtggtgactcccagagctcgtggaagagcgtcggatctcaatgggcaagcccagagaatccctgcctcatcaacgagtgcgtgcgcgtcaaggaagaagttttcattcagcagagaaatgtgtcctgtcctcagctcgaagttccagtttgcccctctggcttccaactatcctgcaagacaagtgcctgttgcccatcttgcaggtgcgagcgcatggaggcctgcatgttgaacggaacggtgatcggccccggtaagacagtcatgatagatgtttgcaccacgtgccgttgcatggtgcaggtgggcgtaatcagcggtttcaaattggagtgccgtaagaccacgtgcaacccctgcccactgggatacaaggaagaaaacaataccggcgaatgctgcggccgctgcttgccgacggcgtgcaccatccagctccgaggaggtcagattatgacgctgaagagagatgagacactgcaggacggctgcgatacccatttttgtaaggtcaacgaacgcggtgaatatttctgggagaagcgagtgacgggatgtccgccatttgacgagcacaaatgtctggcagaaggaggaaagattatgaagattccggggacctgctgcgacacatgcgaggagcccgagtgcaatgatattaccgcaaggctgcaatatgttaaggtgggaagctgtaaaagcgaggtggaggtcgacatccactactgccagggcaagtgcgcgtccaaggctatgtatagtatcgacatcaacgatgtgcaagaccagtgttcctgctgcagcccgacccgcacggaaccaatgcaggtggccttgcattgcacgaatggcagcgtggtgtatcacgaagtgctgaacgccatggagtgtaagtgctcgccgcgcaaatgctccaag

SEQ ID NO: 21325 - DNA, 8439 bp, Artificial Sequence
  Description of Artificial Sequence: Synthetic coding sequence
atgatccctgctcgctttgccggtgtattactggcccttgctttgattctgccaggcactctgtgcgccgagggaacccgcggcagatcctcaaccgcccgctgttctttatttggcagcgattttgtcaatacattcgatggaagcatgtacagctttgctgggtactgttcatatctcctggccgggggttgtcagaagagaagcttcagcatcatcggtgacttccagaatggcaaaagggtaagcctgtccgtgtacctgggcgaattctttgacatccatctcttcgttaatggcactgtcactcagggggaccagagggtgtctatgccatacgcctccaagggactgtacctggagaccgaagcaggctattataaactgtcaggcgaggcctatgggtttgttgccagaattgatggctctggaaactttcaggtgcttttgagcgacagatattttaacaagacttgtggcttatgcggcaacttcaacatatttgccgaagacgattttatgactcaggagggcactctgacatcagacccctacgacttcgccaactcctgggcgctcagttctggcgaacagtggtgtgaaagggcttcaccaccaagcagctcttgtaacataagttccggcgagatgcagaaggggctttgggagcaatgccagttgctcaagtcaacaagcgtgttcgcgcgctgtcacccgctcgtggaccccgaacccttcgtcgctctctgtgagaagacattgtgcgagtgcgcaggtggcctggaatgtgcgtgtccagcactcttagaatatgctcgcacttgtgctcaagaaggcatggtcctttacggctggacagatcacagtgcctgtagccctgtttgtccagcaggaatggaatatcgacagtgtgtcagcccatgtgccaggacctgccagagcctccatatcaacgaaatgtgtcaggagcgttgtgtcgatggttgctcatgcccggagggacagcttctcgacgagggtttgtgtgtcgagagcaccgaatgcccttgtgtgcactctggtaagcggtaccctccggggacttcactgagcagagattgcaatacctgcatctgtcggaactcgcagtggatctgctccaatgaggagtgtcctggcgagtgcctcgtgacaggacagagccactttaaatccttcgataacaggtattttacattctccgggatctgtcaatacctcctcgctcgggactgccaggaccactccttttccatagtcatcgaaaccgtgcagtgtgcggatgacagagacgccgtatgcacacgttcagtgactgtgagactgccgggacttcacaacagccttgttaagctgaagcacggagcgggagtcgctatggacggtcaggatgtgcaactgcctcttctaaaaggggacctcagaatccagcatacagttactgcgtcagtgcgcctgtcctacggagaggacttgcagatggattgggatgggaggggcagacttttggtgaaactctcccctgtctatgcaggcaaaacctgtggactctgcgggaattataatggtaaccagggcgatgactttctaacacctagcggtctggctgaaccccgggttgaagactttgggaatgcctggaaactccacggggactgccaagacttgcagaagcaacactctgatccatgcgccctgaacccgaggatgactaggtttagcgaggaagcttgcgcagtgttaacttcccctacattcgaggcgtgccatcgggctgtgagtcccctgccttacttgcggaattgtcggtacgacgtctgttcatgcagtgacggaagggaatgcctgtgtggtgctttggcatcctatgctgcagcctgtgcgggacgcggcgtccgcgtggcctggagggagccaggaaggtgcgaattgaactgtccaaaggggcaggtgtaccttcaatgtggcactccttgcaacttgacatgtcggagcctgagttatcccgacgaggaatgtaatgaagcatgtcttgaaggctgtttctgtccgcctgggctctatatggatgagcgcggagactgtgtccctaaagcacagtgtccttgttattatgatggtgagatcttccaacctgaagacattttctcggaccaccacaccatgtgttactgtgaggacgggttcatgcattgcaccatgtctggtgttcctggtagtctattgcccgacgccgttctctccagtcccctgtcccaccgctcgaaacggtctttgagctgtcggcctccaatggtgaagctcgtttgtcctgccgataatctccgcgccgagggattagagtgcactaagacctgccagaactatgacctcgaatgtatgtcgatgggatgcgtgagcggatgtctgtgcccacctggcatggtgaggcacgagaatcggtgcgtagcactggaaagatgcccctgttttcaccaagggaaggaatatgcccctggtgaaacagtcaagatcggatgtaatacttgcgtgtgccaggataggaagtggaactgcaccgaccatgtgtgtgatgccacatgttcaacaattggcatggcacactatctcacattcgatgggctgaagtacctttttccaggcgaatgccagtacgtgctggttcaggactattgcgggtccaatccaggcacgtttcggatcctggtgggtaacaaggggtgcagtcatcctagcgtgaaatgtaagaagagagtcacaattcttgtagaaggtggggaaattgagctgtttgatggtgaagtaaatgttaaacgcccaatgaaagacgaaacgcatttcgaggttgtggagagcgggcgctatatcatcctgctgctgggcaaggcgctttcagttgtctgggatcgacatctgtctatctctgtcgtgctgaagcagacctaccaagagaaggtgtgcggtctttgtgggaactttgacgggatacagaacaatgacttgacgtcatccaatctgcaggtcgaggaagatccggtggatttcggcaactcctggaaagtatcttcccagtgtgctgacacccggaaagtacccctcgacagttcacctgccacatgtcacaataatattatgaagcaaaccatggtggattcttcgtgccgaatccttacatccgatgtcttccaggattgtaataagctcgttgatcccgaaccttacttggatgtctgtatatatgacacctgttcgtgcgagtctattggcgactgcgcgtgtttttgtgataccattgctgcctacgcccacgtctgcgcccagcacggcaaggtggtgacatggcgtacggccacactttgcccgcagtcttgtgaggaaagaaacttaagggagaacggatacgagtgtgagtggcggtacaattcttgtgcaccagcttgccaggtgacatgccagcatccagaaccactggcatgccctgtacagtgcgtcgaagggtgccacgcgcattgccccccaggtaagattttggatgagcttcttcaaacatgtgtggaccccgaagactgccctgtctgcgaagttgctggccggcggtttgcaagcggcaagaaagtgactctgaatcctagtgatcctgaacattgtcaaatctgccactgcgacgtggtgaacctgacctgcgaggcttgccaggaaccgggaggactggtggtgccgcccacagatgcaccggtgtccccaaccacgctctacgttgaagatatatccgagccacccctacatgatttctactgctctagactgctggatctggtattcttgttggatggttcctctcggctctccgaagcagagttcgaggtcctgaaggcctttgtcgtggacatgatggagaggctgaggatctctcagaagtgggtccgggtcgctgtggtagaataccatgacggaagccatgcatacatagggcttaaggataggaaaaggccctctgagcttcgaagaatcgccagccaggtaaagtacgcaggttcgcaggtcgcttctaccagcgaggttctcaagtataccctgttccagattttctcaaagatcgacaggcccgaagcaagccgaattactctgctacttatggcttcccaagagcctcagagaatgagcagaaattttgtccgttatgttcaggggctgaaaaagaaaaaagtgattgtcataccagttgggatcggcccccacgctaacctcaaacaaattagactcatcgaaaagcaggcccctgagaataaagcgttcgttctgtcctcagtggacgagttggaacagcagagggacgagattgtctcctacctatgcgatctggcgcccgaagctccaccgcctactctgccacctgacatggcccaagtgactgtgggtccaggacttttgggggttagtacactcggcccaaagcgtaacagcatggtgctggacgtggcgttcgtacttgaggggagtgataagatcggagaggccgattttaatcgaagcaaagaatttatggaggaggtcatccaacgcatggacgtggggcaggatagcatccatgtaactgtcctgcagtattcatatatggtgaccgtggagtaccccttttcggaggcccaaagtaaaggtgatatactgcagcgcgtacgggagattcgctaccagggaggaaaccgaactaatactggtctggcgctgaggtatctttccgaccactcctttctggtgagccaaggcgatcgtgagcaggcccccaatcttgtttatatggttactggcaacccagccagtgacgaaattaagaggctgccgggggacatccaggtagttccgattggcgtaggccctaatgctaatgtgcaagagctagagaggattggatggcccaatgccccgatcctcatccaggattttgagacgcttccaagggaggcccctgacctggtcctacagcgctgttgctccggggagggattgcagattcctacactgtcccccgcccctgactgtagccagccacttgatgtcatcctgctgttagacgggtccagcagttttcccgctagttatttcgatgaaatgaagagttttgcgaaagcctttatttccaaagcaaacatcggcccacggctgacgcaggttagcgtgctgcagtacggctccattacaaccatcgatgtgccatggaatgttgtgcccgagaaggcacacctgttgagtctcgttgacgtcatgcagagagaaggcgggccttcacaaataggggatgctctcggtttcgccgtgcgctatctgacatccgaaatgcacggggccaggccaggcgcttcaaaggctgtcgtgatcttggtgacagatgtgtccgtggattctgttgacgccgcagcagatgcagctcgcagcaatcgtgttacagttttcccaattgggattggcgacagatacgatgccgcccagttgcgcatacttgccggtccagcaggcgattccaatgtcgtgaagttgcagcgcattgaagaccttccaactatggtcaccctgggaaacagtttcctgcataaactgtgctcaggattcgtccgcatctgtatggacgaagacggcaacgagaaaagacccggcgatgtatggaccctgcctgaccaatgccacaccgtgacgtgtcaacctgacggacagacactgctgaagtctcaccgggtaaactgcgaccgcgggctgcggccgtcttgcccgaattcacagtctcctgtgaaggtagaagaaacgtgcggatgtagatggacgtgcccctgtgtatgcactggctcctctacacggcacattgtgaccttcgatggccagaacttcaaattgaccggctcttgctcctatgtcctttttcagaacaaggaacaggatctggaagttatcctgcataacggggcatgttctccaggggcccgccaaggttgcatgaaatcaatcgaggtgaaacatagcgctctctctgtggagctgcactcagacatggaagtgacagtaaacggtcggcttgtcagtgtgccgtacgtgggcggcaatatggaagtgaatgtatacggcgccataatgcatgaggtccggttcaatcatcttggtcacattttcaccttcaccccacagaataacgaattccagctccaacttagtcctaagacgtttgcgtccaaaacctatgggctctgcgggatctgcgatgagaatggagctaatgacttcatgcttcgagatggcaccgtgaccacggattggaaaacccttgtacaggagtggacggtgcagagacccgggcagacttgtcaaccgattttggaagagcaatgtctggtgccagattcctctcactgtcaggttctcctgctgcctctattcgccgagtgccataaggttctcgctcctgccacattctatgcaatatgtcaacaagactcctgccaccaggaacaggtgtgcgaggtaatagcctcgtatgcccacctatgtagaacaaacggagtctgcgttgattggcgaacaccggatttctgtgctatgagctgcccacccagtcttgtctataaccattgtgagcacgggtgccctagacattgcgatggtaacgtgagttcctgtggggatcaccccagcgaaggctgcttttgtccacctgacaaagttatgctcgaaggctcctgcgttccagaagaggcttgcacccagtgtatcggtgaggacggcgtccaacatcagttcctagaggcctgggtccccgatcaccaaccgtgtcagatttgcacttgcctttctggccgtaaagtgaactgtaccacacaaccatgtccgactgctaaggcgcctacctgtggtttgtgcgaggtggcacgcctgcgccaaaacgctgaccagtgctgccctgagtatgagtgtgtctgcgatcccgtcagttgcgacttgccccccgtgccccattgcgaacgcgggctgcaacctaccctcacgaaccccggtgaatgtaggcctaactttacttgtgcatgtcggaaggaagagtgcaagagggtctcccccccctcttgccccccacaccgactccccactctgcggaaaactcagtgttgtgacgagtacgaatgcgcatgtaattgcgtgaattctaccgtttcctgtccactcggatatctggcatctaccgctactaatgattgcggctgcaccaccaccacctgtttgccggataaagtgtgtgtgcaccggtcaacgatttaccccgttggacagttctgggaagaaggatgcgacgtttgcacctgtacggatatggaggatgctgttatgggcttgcgcgtcgctcaatgctcccaaaagccctgtgaagatagctgccgaagcgggttcacttacgtgttgcacgagggcgaatgttgtggccgctgcctaccttcagcctgtgaagtggtaacaggctccccgcggggggatagccagtcgtcttggaagagcgtgggaagccagtgggcttctccagaaaacccatgcttgattaacgaatgtgtgcgagtgaaggaagaagtgtttatccagcagcgcaacgtgagctgtccccagctagaggtccctgtctgtccctcgggctttcagcttagctgcaaaactagcgcctgttgcccgtcctgtcgatgcgagcgaatggaggcttgcatgttgaacggaactgtgattggtccaggcaagacagttatgatcgatgtttgtaccacgtgcagatgtatggtgcaggttggcgtaatttcaggtttcaagctggagtgtcgtaaaactacatgcaatccatgcccgttaggatacaaagaggagaataacaccggcgagtgctgcggaagatgtctccccacggcatgtaccattcagctgcgcggcggtcagatcatgacgctgaaaagagatgaaacgctccaggacggatgcgacacacacttctgcaaggttaacgaaagaggggagtatttttgggaaaagcgcgtgaccggctgccctccctttgatgagcataagtgtctagcagagggcggaaagattatgaagattccaggcacatgttgcgatacttgtgaggaaccagagtgcaacgacatcaccgcgcggctgcagtatgtgaaggtcgggtcctgcaagtcagaagtcgaggtggacatccattattgccaagggaagtgtgcttcaaaagccatgtacagcattgacattaatgatgtacaagaccaatgctcttgttgctcaccaaccagaactgagccaatgcaagtggccctccactgcacaaacggcagtgtggtctatcatgaggtgctcaacgccatggagtgcaaatgcagcccccgcaaatgcagtaaa

SEQ ID NO: 21326 - DNA, 8439 bp, Artificial Sequence
  Description of Artificial Sequence: Synthetic coding sequence
atgattccggctcggttcgccggagtgctcctggccctggctctgatcctgcctggcactctctgcgctgaaggaacccgcgggagaagctctaccgccaggtgctcactgttcggctccgattttgtgaacacgttcgacgggtctatgtattcattcgctggctactgcagctacctcctggccgggggatgtcagaagcgcagcttttccatcattggtgactttcagaatggaaagcgagtgtccctgagcgtctacctgggtgaattcttcgacattcacctgttcgtcaacggaacggtcacccagggcgaccagcgcgtgtcgatgccatacgccagcaaaggcctgtacctggaaaccgaggcgggctactacaaactgagcggcgaggcctacggattcgtcgccagaatcgatggatcggggaacttccaggtcttgctctcggatagatacttcaacaagacctgcggtctgtgcggcaactttaacatcttcgcggaggacgatttcatgactcaggaaggaactttgacctccgatccgtacgattttgcaaattcgtgggcactgtcaagcggagagcagtggtgcgaacgggcttccccaccgtcgtcaagctgtaacatcagctccggagagatgcagaagggactgtgggaacagtgtcagctgctcaagtccacctcggtctttgcccggtgccacccgctggtcgatcctgaaccgttcgtggcgctgtgcgaaaagaccctctgcgaatgcgcgggaggcctggagtgtgcgtgcccggccctcctggagtacgccagaacttgtgcgcaggaaggaatggtgctgtacggttggactgaccattcagcgtgctcgccggtgtgcccggccggaatggagtaccggcaatgcgtgagcccgtgcgcccgcacttgccagtcacttcatatcaatgagatgtgtcaagaacgctgcgtggacggttgctcgtgcccggaaggccagctgctcgatgagggcctgtgcgtggaatcaactgaatgtccgtgtgtgcactccgggaaacgatacccgccggggacgtccctgagccgggactgtaatacctgcatctgccggaacagccagtggatttgctcaaacgaggaatgtccgggggaatgcctggtgaccggacagtctcactttaagagctttgataacagatacttcacctttagcggaatctgccagtacctcctggcgcgggattgccaggaccacagcttcagcatcgttatcgagactgtgcagtgcgccgacgacagagatgcggtgtgcaccagaagcgtcactgtccggctgccgggactgcataactctctcgtgaagctgaaacatggagctggcgtggcaatggacggacaggatgtgcagttgccgctgctgaagggggacctcagaatccagcataccgtgaccgcttccgtgcgcctctcctacggagaggacctgcaaatggactgggacgggcgcggccggctgctggtgaaactctcgccggtctacgcaggaaagacctgtggactgtgcggaaactacaacggaaaccagggagacgactttctgactcctagcggactggctgagccaagagtggaggactttggaaacgcctggaagctccacggagattgccaggatctgcaaaagcagcactcggacccatgcgctctcaatccacgcatgactaggttctccgaagaggcttgtgcagtcttgacctcccctacctttgaggcctgccaccgcgctgtgtcgccgttgccgtacctcagaaattgccggtacgacgtctgttcctgctccgatggacgggaatgcttgtgcggagcactcgctagctacgcggccgcatgcgccgggagaggagtgcgtgttgcctggcgggaaccgggaagatgcgaactgaactgtcccaagggccaagtgtacctgcagtgcggcaccccgtgtaatctcacttgtagaagcctgagctacccagatgaagaatgcaacgaggcctgccttgaaggctgcttctgtccgcctggattgtacatggatgagaggggagactgtgttccgaaggcgcagtgcccttgctactacgatggagagatcttccagcctgaggacatcttttccgaccatcacaccatgtgctactgtgaggacggattcatgcattgcactatgtccggagtgcctggatcactgctgccggacgcggtcctgagctcgccactgtcccacagatcgaagaggtccctctcctgccggccgccaatggtcaagctggtgtgccccgccgacaatttgagagccgagggactggagtgcacgaaaacgtgccagaactacgacctggagtgcatgtctatgggttgcgtgagcggttgtttgtgcccgcctgggatggtgcgccacgagaaccggtgcgtcgctctggaaaggtgcccgtgtttccatcagggcaaagaatacgcgcctggtgagactgtaaagataggatgcaacacctgcgtgtgtcaggaccggaaatggaattgcactgatcacgtgtgtgacgccacttgttcgactatcggcatggcccactatctgacctttgacggactcaaatatctgtttccgggggagtgtcaatatgtgctggtgcaggattactgcggatcgaaccctggaacgttccgcatccttgtgggaaacaagggatgttcgcatccaagcgtcaaatgcaaaaagagagtcactatcctcgtggagggcggggaaatcgaactgttcgacggagaggtcaatgtgaagcggccaatgaaggatgaaactcattttgaggtggtggaaagtggacgatacattatcttgctcctcggtaaggcactgtctgtggtgtgggaccgccacctgtctatctcggtggtgctgaagcaaacctaccaggaaaaggtgtgtggcctttgcgggaactttgacggaatccaaaacaacgacctcactagctccaacctgcaggtggaagaagatccagtggattttggaaacagctggaaggtgtcatcacagtgcgctgatacccggaaggtgccgctcgactcatcaccggccacttgccacaataacattatgaagcagaccatggtcgactcgtcatgcaggatcctgacttcggacgtgtttcaggattgcaataagctggtggatccggaaccgtatttggacgtgtgtatctatgacacctgctcttgtgagtccattggggactgtgcatgcttctgcgacactatcgcggcgtacgcacatgtgtgcgcacagcacgggaaggtggtaacctggcggactgctaccctgtgccctcagagctgcgaggaaagaaacctccgggaaaacgggtacgagtgcgagtggcgctacaatagctgcgccccggcgtgccaggtcacctgccagcacccagagccgttggcgtgtccagtgcaatgcgttgaggggtgccatgcgcattgccccccaggaaagatcctggacgaactgcttcagacttgcgtcgatccagaggactgcccagtgtgtgaggtggccggccgtaggttcgcctccggtaaaaaggtaactctcaacccctcggaccctgaacactgccagatttgccactgtgacgtcgtgaacttgacctgtgaagcatgtcaagagccggggggcctggtggttccgccaactgatgcccctgtgtcgcccactactctctacgtcgaagatatcagcgaacctccgttgcacgacttttactgctcgagactccttgacttggtgtttctcctggatgggtcgtcgcggctgagcgaagctgaattcgaggtgctcaaggcatttgtggttgacatgatggaaagactgcggattagccaaaagtgggtgcgggtggctgtggtcgaataccacgacggatcgcacgcctacatcggcctgaaagatcggaagcgtcctagcgagctcagacgcatcgccagccaggtgaaatacgctggatcccaggtcgccagcacttccgaggtcctcaaatacaccctcttccagatcttttcaaaaatcgatcgcccagaggcatcgcggattaccctgctgctgatggcgtcccaggagccacaaagaatgtcgcggaacttcgtccgctacgtgcaggggcttaagaaaaagaaggtgatcgtgattcccgtgggaatcggccctcatgccaatctgaagcaaattaggctcatcgaaaaacaggcgcctgaaaacaaggctttcgtgctgtcatcggtggatgagctggagcagcagcgcgatgaaatcgtgagctacctttgtgacctggccccggaagcgccgccgcctactctgccgccagatatggcgcaggtgaccgtgggtcccggtttgctgggcgtgagcaccctgggaccgaagcggaacagcatggtgctggatgtggcgttcgtgttggaaggctcggataagatcggcgaagctgacttcaatcggtccaaggagttcatggaggaagtgatccaacgcatggatgtcggacaagactccatccacgtgactgtgctccagtacagctacatggttactgtggagtacccatttagcgaggcccaatctaagggtgatatcctccagcgcgtcagagaaatccggtaccagggagggaatagaactaatactggactggcgctccggtacctgtcagatcactcgttcttggtatcccaaggcgaccgcgaacaagcccctaaccttgtctacatggtgaccggaaatccagcgtccgacgagatcaagcgccttccaggagacatccaggtcgtcccgatcggggtcggaccaaacgctaacgtccaagagctggaacggatcggatggccaaatgccccaatcctcatccaggatttcgagactctgccgcgggaagcaccggatctcgtgcttcagcggtgttgctcaggggagggcctgcagatccccactctctctccggcgcccgattgctcccagccactggatgtgatcctcctgctggacggatcctcatcgttcccggccagctattttgacgagatgaaatccttcgcgaaagcatttatcagcaaggcgaacatcggacctagactcactcaagtgtccgtgctgcaatacggctcaattactactatcgacgtgccatggaacgtggtcccggagaaagcgcatttgctcagccttgtggatgtcatgcaacgcgagggtgggccttcgcaaattggagatgccctcggattcgccgtgcggtaccttacgtcggagatgcacggggcaaggcccggagcatccaaggcagtggtcatcctggtgacggacgtgtcagtggattcggtggatgccgcagcggacgcagctcgctcgaatagggtgacggtgttcccaatcggaatcggggatagatacgatgcggcacagctccgcattctcgctggcccagccggggactctaacgtggtgaagctgcagcggatcgaggacctgccgactatggtgaccctgggtaactcctttctgcataagctctgttccggcttcgtgcggatctgtatggacgaggatgggaacgagaagcgacccggcgatgtttggaccctgccggatcagtgccatacggtgacctgccagccggacggacagactctgctcaagtcgcatagagtgaactgcgatcgcgggcttagacctagctgtccgaacagccagtcgccagtgaaggtcgaagaaacctgtggatgccgatggacctgcccttgcgtgtgcactggaagctctactcgccacattgtcactttcgatggtcaaaactttaaactgaccggaagctgttcctacgtgcttttccagaacaaggagcaggatctggaagtgatcctgcacaacggggcctgcagcccgggagcccgtcagggatgcatgaagtccatcgaagtgaagcattccgccctttcagtcgaactgcactcggatatggaggtgaccgtcaacggaaggctcgtgagcgtgccctacgtcggaggaaacatggaagtgaacgtgtacggcgctatcatgcatgaagtgcggttcaaccatctggggcacatattcaccttcactccccagaacaacgaattccaactgcaactgtcgccgaaaaccttcgcttccaaaacttatggactttgcgggatctgcgacgagaatggagcgaacgatttcatgctgcgcgacggtactgtcaccactgattggaaaacgcttgtgcaagaatggaccgtccagcgcccgggccagacctgtcagcctatcctcgaagaacagtgcctcgtaccggactcgtcccactgccaggtgctgctccttccgctgttcgccgagtgccacaaggtcctggcgcccgccactttctacgccatttgccaacaggactcctgtcaccaggaacaagtttgtgaggtcatcgcatcgtatgctcacctgtgcagaactaacggtgtctgcgtcgactggcggactcccgatttttgcgccatgagctgccccccgagccttgtgtacaaccattgtgaacacggttgccctcgccactgcgacggaaacgtgtcgtcgtgcggggatcacccgtcggaaggatgcttctgcccccctgataaggtcatgctggaggggtcctgcgtgccggaagaggcgtgcactcagtgtatcggtgaagatggagtgcagcaccagttcctggaagcatgggtcccagaccatcaaccgtgccagatctgcacctgcctgtcgggccgcaaggtcaactgcaccactcaaccatgccccaccgccaaggccccaacctgcggtttgtgcgaagtggcccggttgaggcagaacgccgaccaatgctgcccagagtatgaatgcgtgtgcgacccagtctcatgcgacttgccaccggttccgcactgtgagcgggggttgcaaccaaccttgactaacccgggtgaatgccggccgaacttcacctgtgcgtgccgcaaggaggaatgcaagcgggttagcccaccgtcgtgccctccacatagattgccaacccttcgcaagacccaatgctgtgatgaatacgagtgtgcttgcaactgcgtgaactccactgtgagctgccctctgggttacctggcctcgactgcgactaatgactgcggatgcaccaccaccacttgtttgcctgacaaagtctgcgtgcaccgctcgactatctacccggtggggcaattctgggaagaaggttgcgatgtctgcacttgcactgacatggaagatgctgtgatgggcctgcgcgtggcccagtgcagccagaagccctgcgaagattcctgtagatccggattcacctacgtgctgcacgagggtgaatgctgcggacggtgcttgccttctgcatgcgaagtggtcactggctcgcctcgcggagattcacagtcatcctggaagtcggtcggatcacaatgggcatcccctgaaaacccatgcctcatcaatgaatgcgtgcgggtgaaggaagaagtgttcatccaacagcgcaacgtgtcatgcccgcaacttgaagtgccggtgtgtccttcgggattccaactgtcctgtaagacttccgcgtgttgtccgtcgtgccggtgcgagcgcatggaggcctgcatgctgaatggaaccgtcattggacccggcaaaaccgtgatgatcgatgtgtgcaccacctgccggtgcatggtgcaagtgggagtgattagcggattcaaactcgaatgtaggaaaacgacttgcaatccttgccccctcggatacaaggaggaaaacaacacgggagaatgctgcgggaggtgcctccctacggcctgtaccatccagttgcggggaggacaaatcatgacgctgaagcgcgacgaaaccctgcaagatggctgcgacactcacttttgcaaagtgaacgaacggggcgagtacttctgggagaaacgcgtgaccggttgcccaccgttcgacgaacataagtgtctggcagaaggcgggaagatcatgaagatccccgggacgtgctgcgacacctgtgaggagccggaatgtaacgatattactgcccgcctgcaatacgtcaaggtgggatcgtgcaagtccgaagtggaggtggacatccactactgccaaggaaagtgcgcctccaaagcaatgtactcgatcgacatcaatgacgtgcaggaccagtgctcgtgctgttctccgacccgcactgaaccgatgcaggtcgcgcttcattgcaccaacggaagcgtggtgtaccatgaggtgctgaacgcaatggaatgcaaatgttcaccgcgcaagtgctcgaag

SEQ ID NO: 21327 - DNA, 8439 bp, Artificial Sequence
  Description of Artificial Sequence: Synthetic coding sequence
atgattcctgctcgatttgcaggtgttttattagcacttgcattaattttaccaggaactttgtgtgcagaaggtacaagaggaagatcttctactgctagatgtagtttattcggttctgatttcgtaaacacatttgatggatctatgtattcatttgctggttattgctcttatcttttagctggaggttgtcaaaaaagatcattttcaattattggagattttcaaaatggaaaaagagtaagtctatctgtttatcttggagaattttttgacatacatctttttgttaacgggactgtcacacagggagatcaaagagtgtcaatgccatatgcatcaaagggactttatttggagactgaagcaggatattataaattaagtggagaagcatatggatttgttgctagaattgatggaagtggaaatttccaagttttactaagtgatagatattttaataaaacatgtggactttgtggaaattttaatatatttgccgaagatgactttatgacacaagaaggaactcttactagtgatccttatgactttgcaaatagttgggcccttagtagtggagaacaatggtgtgaaagagcttcaccaccaagttcttcatgtaatatttcatctggagaaatgcaaaaaggattgtgggaacaatgtcaattattaaaaagtacatcagtttttgcaagatgtcatccacttgttgatcctgaaccatttgttgcattatgtgaaaagacattatgtgaatgtgctggtggtttagaatgtgcatgtcctgctttattagaatatgcaagaacatgtgcacaagaagggatggtcctttatggatggacagatcattcagcttgttctccagtttgtccagctgggatggaatatagacaatgtgtttcaccatgtgcaagaacatgtcaatcattacacataaatgaaatgtgtcaagaaagatgtgttgatggatgttcttgtcctgaaggacaacttcttgatgaaggtttatgtgtggaatctacagaatgtccttgtgttcattcaggaaaaaggtatccaccaggaacttcattaagtcgtgattgtaatacatgtatatgtagaaattctcaatggatttgttctaatgaagaatgtccaggagaatgtcttgttactggacaatcacattttaaaagttttgacaatagatattttacattctcaggtatttgtcaatacttacttgctagagattgtcaagatcattctttctctattgtaatagaaactgttcaatgtgcagacgatagagacgcagtttgtactagatcagtcactgttaggttaccaggattacataattctttagttaaattgaaacatggtgcaggagttgctatggatggacaagatgttcaacttccacttcttaaaggtgatcttagaattcaacatacagttactgcttcagttcgactaagttatggagaagatttacaaatggattgggatggaagaggtagattactagttaaattatcgccagtatatgctggaaaaacatgtggactttgtggaaattataatggaaatcaaggagatgattttttaactccatcaggtcttgctgaaccaagagttgaagattttggtaatgcatggaaattacatggggattgtcaagatcttcaaaaacaacattcagatccatgcgcattaaatccaaggatgacaagatttagtgaagaagcatgtgcagtattaacatccccaacatttgaagcatgtcatagggcagtttcaccattaccttatttaagaaactgtagatatgatgtatgttcctgtagtgacggaagagaatgtttatgtggagcattagcttcatatgcagcagcatgtgcaggaagaggagttagagttgcttggagagaaccaggaagatgtgaacttaattgtccaaaaggacaagtttatcttcaatgtggaactccttgtaatttaacatgtagaagtttatcttatcctgatgaagaatgtaatgaagcttgtcttgaaggatgtttttgtccaccaggtttatatatggacgagagaggagattgtgttccaaaggctcaatgtccttgttattatgatggagaaatttttcaacctgaagatatttttagtgatcatcacactatgtgctattgtgaagatggattcatgcattgtactatgtccggagtaccaggatcattattaccagatgcagtacttagttcaccactttcacacagatctaaaaggtcattatcgtgtagacctccaatggttaaattagtatgtcctgcagataatttaagagctgaagggttggaatgcacaaaaacatgtcaaaattatgatttagagtgtatgtctatgggttgtgtttctggttgtttatgcccacctggtatggttagacatgagaatagatgtgtggctttagaaagatgtccatgttttcatcaaggaaaggaatatgcaccaggagaaactgttaaaataggatgtaatacttgtgtttgtcaagatagaaaatggaattgtacagatcatgtttgtgacgcaacttgtagtactatcggaatggctcattatttaacatttgatggtttaaaatatctttttccaggtgaatgtcaatatgtgttagttcaagattactgtggatcaaatcctggaacttttagaatacttgtcggaaataaaggatgttcacatcctagtgtaaaatgtaaaaaaagagtaacgattcttgttgaaggaggtgaaatcgaactttttgatggtgaagttaatgttaaaagaccaatgaaagatgaaacacattttgaagttgttgagtcaggtagatatattattcttttgttaggaaaagcacttagtgttgtatgggatagacatctttcaatatcagtagtattaaaacaaacatatcaggaaaaggtttgtggattatgtggaaattttgatggaattcaaaataatgatttaacttcatcaaatttgcaagtcgaagaagatccagttgattttggtaattcatggaaagtttcttctcaatgtgctgatactcgaaaagtgccattagatagttctcctgctacatgtcataataatataatgaaacaaactatggttgactctagttgtagaattttaacttctgacgtttttcaagattgtaataaacttgttgatcctgaaccatatctagatgtttgtatttatgacacatgttcatgtgaaagtattggtgattgcgcttgtttttgtgatactattgcagcatatgctcacgtttgtgcacaacatggaaaagttgtaacatggagaacagctactctttgtccacaaagttgtgaagaaagaaatttaagagaaaatgggtatgaatgtgaatggagatataattcttgtgctcctgcttgtcaagttacttgtcaacaccctgaacctttagcatgtccagttcaatgtgtagaaggatgtcatgcacattgcccaccaggtaaaattcttgatgaattattacaaacttgtgttgatccagaagattgtcctgtttgtgaagttgctggaagaagattcgcaagtggtaaaaaggttactttaaatccatcagatccagagcattgtcaaatttgtcattgtgatgtagtaaatcttacatgtgaagcatgtcaagaacctggaggattagttgttccaccaacagatgctccagttagtccaacaacactttatgttgaagatatttcagaaccaccactacatgatttttattgctcaagacttttagatcttgtatttttattggatggttcaagtagattgtcagaagcagaatttgaagttttaaaagcatttgtagtagacatgatggagcgattaagaattagtcaaaaatgggttagagtagcagtggttgaatatcatgatggttcacatgcatatataggattgaaagatcgaaagcgtccatctgaattaagaagaattgcttctcaagttaaatacgctggatcacaagtggcttctacatctgaagttttgaaatatacactttttcaaattttttctaaaatcgatagaccagaagcaagtagaattactttattacttatggctagtcaagaaccacaaagaatgtcacgtaattttgttagatatgtccaaggattaaaaaaaaaaaaagttattgtaatcccagttggtattggaccacatgctaacttaaaacaaattagacttattgaaaaacaagctccagaaaataaagctttcgttttaagttctgttgatgaacttgagcaacaaagagatgaaattgtatcatacctttgtgatttagcaccagaggcacctccaccaacacttccaccagatatggctcaagttactgttggtccaggattattaggagttagtacgttaggacctaaaagaaattctatggtattagatgtagcatttgttcttgaaggatctgataaaatcggtgaagctgactttaatagaagtaaggaatttatggaagaggttattcaaagaatggatgtaggtcaagattcaattcatgtcactgttttacaatattcatatatggtaacagttgagtaccctttttcagaagctcaatctaagggagatattttacaaagagttagagaaattagatatcaaggaggaaatcgaacaaatacaggattagcattaagatatttatctgatcactcatttcttgtttcacaaggggaccgtgaacaagctccaaatttggtttatatggtaactggtaatccagctagtgatgaaattaagcgtttaccaggagacattcaagtagttccaattggagttggaccaaatgcaaacgttcaagaattagaaaggattggatggccaaatgcaccaattcttatacaagattttgaaactcttccaagagaagcaccagatttagttcttcaaagatgttgctctggagaaggtttacaaatacctacattatcaccagctcctgattgtagtcaaccattagacgttatactacttttagatggttcatcatcatttccagctagttactttgatgaaatgaaatcttttgcaaaagcttttatatcaaaagcaaatataggtccaagacttacacaagtttcagtattgcaatatggttcaataactactatcgatgttccatggaatgttgtaccagaaaaggcacatcttctttctttagttgacgtaatgcaaagagaaggtggaccatcacaaattggagatgccttaggatttgcagttagatatttgacatcagaaatgcatggagcacgacctggagctagtaaggcagtagttattttagtaacagacgtatcagttgattcagtagatgcagctgcagatgctgctagatctaaccgtgttacagtttttccaattggaattggtgatagatatgatgcagctcaattaagaattcttgcaggacctgcaggtgattcaaatgtagttaaattacaaagaattgaagatttaccaactatggtaacattgggtaattcatttcttcataaattatgttctggtttcgttagaatttgtatggatgaagatggtaatgaaaagagaccaggtgacgtttggactttgcctgatcaatgtcatacagtaacttgtcaaccagatggtcaaacattattaaaaagtcatagagtgaattgtgatagaggattaagaccatcttgtccaaattcacaatcaccagtaaaagttgaggaaacttgtggatgtagatggacatgtccatgtgtttgtacgggatcatccacacgtcatattgttacatttgatggacaaaattttaaacttacagggtcatgttcatatgttttatttcaaaataaagaacaagatcttgaagttatattacataatggagcatgttctccaggagcaagacaaggatgcatgaaaagtattgaagtaaaacattctgctttatcagtggaattacatagtgatatggaagttacagtaaatggaagacttgttagtgtaccatacgtcggaggaaatatggaggttaatgtttacggggctattatgcacgaagttcgttttaatcatcttggacatatatttactttcacaccacaaaataatgaatttcaattacaattatcaccaaagacatttgctagtaagacttatggtctttgtggaatatgtgatgagaatggagcaaacgacttcatgttacgagatggaacagttacaactgattggaaaactcttgtgcaagaatggacagttcaaagaccaggtcaaacatgtcaaccaattttagaagaacaatgcttagtaccagattcaagtcattgtcaagttttattacttccactttttgcagaatgtcataaagtattagctccagctactttttatgcaatttgtcaacaagattcttgtcatcaagaacaagtatgtgaagtgattgctagttatgctcatttgtgtagaacaaatggagtttgtgttgattggagaacaccagatttctgtgctatgagttgtcctccaagtttagtgtataatcattgtgaacacggatgccctaggcattgtgatggaaatgtaagttcatgcggagatcatccttcagaaggatgtttttgtccaccagacaaagttatgttagaaggttcttgtgtaccagaagaagcatgtacacaatgtattggagaagatggggttcaacatcaatttttagaagcatgggttccagatcatcaaccatgtcaaatttgtacttgtctatcaggtagaaaggttaattgtactactcaaccatgtccaacagctaaagctccaacatgtggattgtgtgaagttgctagattacgtcaaaatgctgatcaatgttgtcctgaatatgaatgtgtatgtgatccagtatcgtgtgatttaccaccagttccacattgtgaacgaggattacaaccaactttgacaaatcctggagaatgtagaccaaattttacatgtgcttgtagaaaggaagaatgtaaaagagtcagtccaccaagttgtccaccacatagattaccaacacttagaaaaacacaatgttgtgacgaatatgaatgtgcatgtaattgtgttaatagtactgtttcatgtccattaggatatttagcaagtactgctaccaatgattgtggatgtacaactacaacatgtttaccagataaagtttgtgttcatagatcaactatatatccagttggacaattttgggaagaaggatgtgatgtttgtacatgtacagatatggaagatgctgttatgggtttaagggttgctcaatgtagtcaaaagccttgtgaagattcttgtagatcaggtttcacttatgttcttcatgaaggagaatgctgtggtagatgtttaccatctgcatgtgaagttgttacaggaagtccaagaggagatagtcaaagttcatggaagtcagttggttctcaatgggcaagtccagaaaatccttgtttaattaatgaatgtgttagagttaaagaggaagttttcatacaacaaagaaacgtttcatgtccacaattagaagttccagtatgtccatcaggttttcaactttcttgtaaaacaagcgcttgttgtccaagttgcagatgtgaaaggatggaagcttgtatgttaaatggtacagttattggtcctggaaaaacagttatgattgatgtttgtacaacttgtcgttgtatggttcaagtaggggtaatttcaggatttaagctagaatgccgaaaaacaacatgtaatccatgtccattaggatataaagaagaaaataatacaggtgaatgttgtggaaggtgtttacctacagcttgtacaattcaattaagaggaggacaaattatgacattaaagagagatgaaacgcttcaagatggatgtgatacacatttttgtaaagttaatgaaagaggagaatatttttgggaaaaaagagttactggatgcccaccatttgatgagcataagtgtttggctgaaggaggaaaaattatgaagatcccaggaacttgttgtgatacttgcgaagaaccagagtgtaatgatattacagcaagattacaatatgtcaaagttggttcatgtaaatcagaagttgaagttgatatacactattgtcaaggtaaatgtgcatcaaaggcaatgtactctattgacatcaacgatgttcaagaccaatgctcatgttgttctccaacaagaacagaaccaatgcaagttgcattacattgtacaaatggatcagttgtgtatcatgaagtacttaatgctatggaatgtaagtgttctccaaggaagtgttcaaaa

SEQ ID NO: 21328 - DNA, 8439 bp, Artificial Sequence
  Description of Artificial Sequence: Synthetic coding sequence
atgatccctgcacgatttgctggcgtgcttcttgcccttgcactgatccttccgggaactctctgtgctgaaggtaccagaggtcggtcgtcaaccgcacgatgtagcctctttggtagcgattttgtgaacaccttcgatggatccatgtacagcttcgcgggatactgcagctacctcctcgccggagggtgccagaagagatcctttagcattatcggtgacttccaaaacggtaagagggtcagcctcagcgtgtatctgggagagttttttgacattcatctcttcgtgaatgggaccgtgactcaaggtgatcagcgtgtgtcaatgccgtacgcatccaagggtctttacttggaaaccgaagcaggttactacaaactttctggagaagcctacggattcgttgcaagaattgatggctcgggcaactttcaagtgcttctgtcggatcgttactttaacaagacctgtggcttgtgtgggaacttcaacattttcgcagaagatgatttcatgacccaggaagggactctcacctcggatccctacgattttgccaactcatgggccctgtcctccggagaacagtggtgtgaaagggccagcccaccaagctcatcatgtaacatctcatccggagagatgcaaaagggcctttgggagcagtgtcagctgcttaagtcgaccagcgtgtttgcacggtgtcaccctctggtggatccagaaccatttgtcgccctttgtgaaaagactctctgtgaatgtgcaggaggccttgaatgtgcgtgccctgcacttcttgagtacgcccgcacgtgcgctcaggaaggaatggtcctgtacgggtggacggatcattccgcctgtagccctgtctgtccagccggaatggagtaccgtcagtgtgtgtccccatgtgcaagaacgtgtcaatccctccatatcaatgagatgtgccaagaaagatgtgtcgacggatgctcgtgcccggaagggcagctcttggatgagggattgtgcgtggaatcaaccgagtgcccttgtgttcatagcgggaagaggtatccgcctggaacctcactttccagagactgtaacacctgtatttgtaggaactcccaatggatctgctccaacgaagagtgtccaggtgaatgcctggttaccggtcaatcgcactttaagtcctttgacaatcgttacttcacttttagcggtatctgccagtacctgcttgcccgcgactgtcaggatcattctttttcaatagtgattgaaaccgttcagtgtgcggatgaccgcgacgcagtgtgtacgcgaagcgtgaccgtgagacttcctgggcttcacaatagccttgtgaaactcaagcatggtgcaggcgtggcaatggatgggcaggatgtccagctcccccttctgaaaggggatcttagaattcaacataccgtgactgcctcggtgaggctctcctacggagaagatctccagatggattgggatgggcgaggaaggcttctggtcaagctgtccccggtctacgcgggaaagacgtgcggactgtgcgggaactacaatggtaaccaaggggacgactttctgactccatcaggtcttgcagagcctagggtggaggatttcggaaacgcgtggaaactgcatggtgattgtcaggatcttcaaaagcagcactctgacccatgtgcgctcaaccctcgcatgactcgtttctcagaagaagcatgcgcagtgctgacctcgccaaccttcgaagcctgtcacagggccgtctcccccctgccctatctgagaaactgtcgctacgatgtctgcagctgttccgacggacgggaatgcctgtgtggagcgctcgcatcgtacgcagcagcatgtgcaggccgcggtgtccgagtggcatggcgtgaacccggcagatgtgagctgaattgtcctaagggccaagtctacctgcaatgtggaactccctgtaatcttacttgtaggtccctttcctacccggacgaggaatgtaacgaggcatgtctggaaggatgtttttgtccaccgggtctttacatggatgaacgaggagactgtgtgccaaaggcccagtgcccatgttactacgacggtgagatctttcaaccagaagatatcttttcagatcatcacactatgtgttactgtgaagatggatttatgcattgtaccatgagcggagtgcctggctcactgctgcctgatgcagtcctgtcatccccgctgtcccataggtccaaaagatctcttagctgccgccctccaatggtcaaactggtgtgtcccgcggacaaccttagggcagaagggcttgaatgcactaaaacttgtcaaaactacgatctggaatgtatgtcaatgggttgtgtgtcggggtgtctctgtccacctggaatggtgcggcatgagaatcgatgtgtcgcactggagcgatgtccatgttttcatcaaggtaaggaatacgctccaggcgaaaccgtcaagattggatgcaacacctgcgtgtgccaagacagaaagtggaactgcactgaccacgtctgcgatgctacttgttcaacgataggaatggcacattacctgactttcgatggactgaagtatctgtttccgggcgaatgccagtacgtgcttgtgcaagattactgtgggtcgaatcccggaacctttaggatactggtgggtaacaagggctgttcccacccatcggtgaaatgcaaaaagagagtcactatccttgttgaaggtggtgaaatcgaactctttgacggtgaagtgaatgtgaagcggcctatgaaggacgagactcattttgaagtggtggagtccggtcggtacataattcttctcctgggtaaagccctgagcgtggtgtgggaccggcatctgagcattagcgtcgtcctcaagcagacctaccaagaaaaggtttgtggtctgtgcgggaattttgacggaattcaaaacaatgaccttacgtcatccaatctccaagtcgaagaagatccggtggactttggtaactcgtggaaggtgtcaagccaatgcgcggatacgcgcaaggtgcctctcgattcctcccctgccacctgtcataacaacatcatgaagcaaactatggtggattcctcgtgtagaatcctcaccagcgacgtgtttcaagactgtaataagctcgtggacccagaaccgtacctggacgtgtgtatctacgatacgtgtagctgcgagtccataggtgattgcgcatgtttttgtgacactattgccgcatacgctcatgtgtgtgcgcagcacggaaaggtggtgacctggcgtaccgcaaccttgtgtccacaaagctgtgaagaacggaaccttagagagaacggatacgagtgtgagtggcgttacaactcttgtgcacctgcatgtcaagtcacctgccaacatccggaacctctcgcatgtccagtccaatgcgttgaaggatgtcacgcccattgtccacccggcaagatactcgacgagctgcttcaaacttgtgtcgatccagaagattgtccagtttgcgaggtggcggggagaaggttcgcttcgggtaagaaggtgactctcaatccatcagatccagagcattgtcagatctgtcattgtgacgtggtgaatctgacttgtgaagcctgtcaggagcccggaggtctggtggtcccacctaccgatgcacctgtgtcaccaaccaccctgtacgtggaggatatttcggagccacctctgcatgacttctactgttcacggctgcttgatctcgtgtttttgctggatggttcgtcgcgcctttctgaagctgaatttgaagttctcaaagcatttgtggtggacatgatggagcggttgcgcatttcgcagaagtgggtgcgggtcgcggtggtggagtaccatgatggttcgcatgcatacattggattgaaggatagaaaaagaccatcggaactgcggaggatcgcgtcgcaggtgaagtacgccggatcccaagtggcatccacttccgaggtgctgaaatacacgctctttcagatattctcgaaaattgatcgcccggaagcgtcccgcattaccctgcttctcatggcatcccaagaaccccaaagaatgtcccggaatttcgtcagatacgtgcaagggttgaaaaagaagaaggtgatagtcattccagtgggaattggtccacacgcaaacctcaagcagatccggctcattgaaaagcaagccccagagaataaggcattcgtccttagctccgtggatgaacttgaacaacagcgggacgagattgtgtcgtacctctgcgatctcgctccagaagcacctcctcccactcttccacctgacatggcgcaagtgactgtgggtccaggccttttgggcgtgtcgactctcggaccaaagcgtaattcgatggtgcttgacgtcgctttcgtgctcgaaggctccgataagatcggcgaagcagacttcaatagatcaaaagagttcatggaagaggtgatacagcgcatggatgtgggtcaagattccattcatgtgactgtcctgcagtactcgtacatggtgactgtcgaatacccttttagcgaagcgcaatcaaaaggagacattcttcagagggtgagagaaattaggtaccaaggaggaaatcgaaccaacactggcctggccctccgctacctgtccgaccactcgtttctggtgtcgcagggagatagggaacaagcacccaaccttgtctacatggtcacgggtaatcccgcgagcgatgagatcaaacgtctgccaggcgacatccaggtggtcccgataggtgtcggcccaaacgcaaatgtccaagaacttgaaaggatcgggtggcctaacgcgccaatattgattcaagactttgagactcttccacgggaagccccagatcttgtgttgcaaagatgttgcagcggggaggggctccaaattcctacgctgtcccctgcacctgattgttcgcagcctcttgatgtgattctcttgcttgatggaagctcgtcctttccagcatcctactttgatgagatgaagagctttgcaaaggcgttcatctcaaaggctaatatcgggccaagactgactcaggtgtcggtccttcagtacggcagcatcaccactatcgacgtcccctggaacgtcgtcccggaaaaggcgcatcttctgtcactggtggacgtgatgcaaagggaaggtggccctagccagatcggggatgcactggggttcgcggtgcggtacctgacttccgaaatgcatggtgcgaggccaggagcgtccaaggcagtcgtcattcttgtgaccgatgtgtcagtggattcggtggatgctgcggccgatgccgcaagatctaatcgagtgaccgtgtttccaattggcatcggcgacagatacgatgcagcgcagctgaggattctggccggaccagccggggactctaatgtcgtgaaactgcaacgtatcgaagatctgcctactatggtgactctgggaaacagcttccttcacaaactttgctcgggattcgtgcggatctgcatggacgaagatggtaacgaaaaaagaccgggagatgtgtggacccttcctgatcaatgtcatactgtgacttgccaacctgacgggcagaccctgcttaagtcacaccgagtgaattgcgatagagggctcagacctagctgtcctaacagccagtcgccagttaaggtggaagaaacctgcggttgtcgctggacttgcccctgtgtgtgcacggggtcctccactagacatatcgtcacttttgatggccagaactttaagctcactggaagctgttcgtatgtgttgtttcaaaacaaggagcaagatttggaggtgattctgcacaatggggcatgctcccctggtgcacgccagggatgtatgaagtccattgaagtcaaacattccgctctgtctgtggaacttcacagcgatatggaggttaccgtgaacggacgcctggtcagcgtgccttacgtgggcggaaacatggaagtgaacgtctacggggctatcatgcacgaagtgcgattcaatcaccttggacatatctttactttcactcctcagaacaacgagtttcagctgcaactgtcccctaaaaccttcgcttcaaagacctatgggctgtgtggaatttgcgatgaaaacggcgccaacgatttcatgctgagagatggaactgtgactacggattggaaaacgcttgtccaggaatggaccgtccagcgaccaggacagacgtgccagccgattctggaagagcagtgtcttgtgcctgacagctcgcactgtcaagtgctgctcctccctctgtttgccgaatgtcacaaagtgcttgcaccagcgaccttctacgcaatctgtcaacaagactcctgtcatcaagaacaagtgtgtgaagtgatagcaagctacgctcatctttgtcggaccaatggagtgtgcgtggattggagaacccccgatttttgtgcgatgtcctgccctccttcgttggtgtataaccactgtgagcatggctgccctcgacactgtgatggcaatgtttcgtcgtgcggcgaccatcctagcgaagggtgcttctgtccaccagacaaggtgatgcttgaaggtagctgcgtgcccgaagaggcatgtactcagtgcatcggtgaggatggagtccaacatcaatttcttgaggcttgggtgccagaccatcagccatgccaaatctgtacttgcctttccggacgcaaggtcaactgtactactcagccttgccctaccgcaaaggcccccacgtgtggactgtgcgaagtcgcgagactcaggcaaaacgcagaccagtgttgcccagagtacgagtgtgtctgcgatccggtgtcatgtgacctccctcctgtgccgcactgtgaacggggacttcagccaaccctgactaatccgggagagtgtcgacccaacttcacttgtgcatgtagaaaggaggagtgtaagagggtgagccccccttcctgtccaccccatagattgcctacgctgcgcaagacccagtgttgtgacgaatacgagtgtgcatgcaattgtgttaactccaccgtgtcttgcccgctgggttacctggcatctactgcaaccaacgattgtggctgcaccaccactacctgtctgcctgacaaagtctgcgtccaccgctcgactatctaccctgtcggacaattctgggaagaaggatgtgatgtgtgcacttgcaccgacatggaagatgcagtgatgggactgagggtcgcacaatgctcacagaagccttgcgaagattcctgtcggagcgggtttacttatgtgcttcacgagggtgaatgctgtggcaggtgtctgcctagcgcatgtgaagtggtgaccggcagcccgcgtggtgatagccagtcgagctggaagtccgtgggttcacagtgggcttcgccggaaaacccatgtcttatcaacgaatgcgtccgtgtcaaagaggaagtgtttatccaacaacgcaatgtgtcgtgcccccagcttgaagtgcccgtgtgtccgagcggctttcagctgtcgtgcaagacctccgcctgctgtccttcatgtagatgtgaaagaatggaggcatgtatgctcaacggtactgttattggtcccggaaagacggtgatgatagatgtctgtaccacgtgccgatgtatggtccaagtcggggtgattagcggattcaagctggagtgccgtaaaaccacttgtaacccttgtccactcggatacaaggaggaaaacaacacgggagagtgttgtggtcgatgcctccctaccgcgtgcaccattcaacttagaggaggccagataatgacccttaagagggatgaaactctgcaagacggatgtgacactcatttttgtaaagtcaacgagaggggcgaatacttttgggagaagcgtgtgaccggatgtcctccattcgatgaacataagtgtctcgctgagggagggaagattatgaagatccctgggacttgttgtgatacgtgtgaagagcctgaatgcaacgatatcacggccagactccaatatgtcaaagtcggtagctgcaagtccgaagtggaagttgacattcactactgccaagggaaatgtgcatcgaaggctatgtactcaattgacattaatgatgtgcaggatcaatgttcgtgctgttcgcccactcggactgaacctatgcaagtggcactccattgcaccaacggatcagtggtgtaccatgaagtccttaatgcaatggaatgcaaatgtagcccacgaaaatgctcgaag

SEQ ID NO: 21329 - DNA, 8439 bp, Artificial Sequence
  Description of Artificial Sequence: Synthetic coding sequence
atgatcccggccagatttgctggagtgcttctcgcgctggcgctgatcctgccagggaccctctgcgcagaaggaacccggggccgaagtagcactgccagatgctccctgttcggttcggacttcgtcaatactttcgacggatcaatgtattcgttcgctggctactgttcctacctcctggccggaggatgccagaagcgctccttctcgatcataggagacttccagaacggaaagcgcgtgtcactgagcgtctacctgggggaattcttcgacattcacctcttcgtgaacggcaccgtgacgcaaggcgaccagagagtgagcatgccgtacgcttccaagggcttgtatcttgaaactgaggctggatactacaaactgtccggagaagcgtacggatttgtggcccgcatcgacggcagcggcaactttcaggtcttgctgtcggacagatacttcaataagacgtgcgggttgtgcggaaatttcaatatctttgccgaggatgactttatgactcaggagggcactctgacgtccgacccatacgatttcgcaaactcctgggccctctcctccggtgaacagtggtgcgagcgcgcatcacccccttcatcatcgtgcaatatctcgtccggagaaatgcaaaaggggctctgggagcagtgccagctgctgaaatcaacctcagtgttcgccaggtgccatcctttggtcgatcccgagccattcgtggccctgtgcgaaaaaacgctctgtgagtgtgctggaggactcgagtgtgcttgcccagccctccttgaatacgcccggacgtgtgcccaggagggaatggtgctttacggctggaccgaccactcagcctgcagccctgtgtgtccggccggcatggagtaccggcagtgtgtgtccccgtgtgctcgaacttgccagagcttgcatatcaatgagatgtgccaggaacgctgtgttgacggatgcagctgccccgaaggccagctgctggatgaaggcctctgcgtggaatccactgaatgtccttgcgtgcattcggggaaacgttatcctccaggcacgtctctgtcacgggattgtaacacgtgtatctgcagaaattcacaatggatctgctcaaatgaagaatgccctggagagtgtctggtgaccggtcagtcgcatttcaagagctttgacaatcggtacttcactttctcgggtatctgccagtacctcttggccagggactgtcaggaccattcgttctcgatcgtgatcgagacggtgcagtgcgcagacgacagggatgcagtgtgcacccggtcagtgactgtgcggcttccgggactgcacaatagcttggtcaagctcaagcacggagccggcgtggccatggacggccaagacgtccagctgcccctgctcaagggcgacctgcggatccaacacactgtgaccgcgtcagtccggctgagctacggcgaagatctgcaaatggactgggacgggaggggacggcttctggtgaaattgagtcctgtctacgcgggaaagacctgtgggctgtgcggcaattacaacgggaatcagggagacgacttcctcaccccgtccggactggcggaaccgcgggtggaagatttcggaaatgcttggaagctgcacggcgattgtcaagaccttcaaaagcaacacagcgacccctgcgcgctgaatccgagaatgacccggttttccgaagaagcctgtgctgtgctcaccagcccaaccttcgaagcatgtcatcgggcagtgtcgccgctgccttaccttagaaactgccgctacgatgtttgctcgtgcagcgacggtcgcgagtgcctgtgcggagccctggctagctacgcggcggcatgcgccggccggggggttcgcgtcgcttggcgggaaccgggccgctgcgagttgaactgcccgaaaggccaggtttacctgcaatgcgggactccttgtaaccttacctgccggtcactgtcgtacccagacgaagaatgcaatgaggcctgtctggaaggatgcttctgcccgccgggactgtacatggacgagagaggggattgcgtgccaaaagcccagtgcccatgttactatgacggagagatcttccaaccagaggacatcttttcagaccatcacaccatgtgttactgcgaggacggattcatgcattgcacgatgtccggagtgccgggatcgctgctcccagacgcggtcctgagcagccccctgtcgcatagatccaaacgctcgttgtcgtgccgcccacctatggtcaaactcgtctgcccagcggacaatctgagagcagaaggactggaatgcaccaagacctgccaaaactacgacctggagtgtatgtccatgggatgcgtctccggctgcctctgcccgcctggtatggtcaggcatgaaaataggtgcgtcgctttggaacgctgcccatgcttccatcagggcaaagaatatgcaccgggggagactgtgaagatcggatgtaatacctgcgtatgccaggatcgtaagtggaactgcactgatcacgtgtgcgatgcgacctgctcgactatcggaatggctcactacttgaccttcgatgggctcaagtacttgtttccaggagaatgtcaatacgtcttggtgcaggattactgtgggtccaatccgggcaccttccggatcctcgtgggaaacaagggctgtagccatccctcagtgaagtgcaagaagcgggtcaccattctggttgaaggcggagaaatcgagctgttcgatggggaagtgaacgtgaaaaggccgatgaaagatgaaactcactttgaagtggtggagtcgggaaggtacatcatcctgctcctgggcaaagccctctcggtcgtgtgggacagacacctcagcatcagcgtcgtgctcaaacaaacttaccaagaaaaggtctgcggcctgtgtggtaactttgacggaatccagaacaatgatctgacctcctccaacttgcaagtcgaagaggatcctgtggatttcggcaactcctggaaggttagcagccaatgcgcggacactagaaaggtgccgctcgactcgagcccggctacgtgtcataacaacatcatgaagcagactatggtcgactcctcatgccgcatcctcaccagcgacgtgtttcaggattgtaataagttggtggatccggagccgtacctggatgtgtgcatttacgacacctgctcatgcgaaagcatcggagactgcgcgtgcttctgcgacactatcgccgcatacgcccacgtgtgcgcgcagcacggaaaggtcgtgacctggagaaccgcgaccctctgtccccaatcctgcgaagagaggaacctgcgggaaaatggatatgagtgtgagtggaggtacaacagctgcgcacctgcctgccaagtgacgtgccagcatccggaaccgctggcatgcccagttcagtgcgtggaaggatgtcacgctcactgcccccctgggaagatcctggacgagctgctgcagacttgcgtggacccggaagattgccctgtctgtgaggtcgccggaaggcggtttgcctccgggaagaaagtgaccctgaacccatcggacccggaacactgtcagatctgccattgtgatgtcgtgaatctgacctgcgaagcctgtcaagaacctggaggtctggtcgtgccgccgacggacgcgcctgtgtcaccgacgaccttgtacgtggaggatatcagcgaaccgccgctgcacgacttctattgtagtcgactgctggatttggtgttcctgctggacgggtccagccgactttcagaagcggagttcgaggtcctgaaggccttcgtagtggatatgatggaacggctgcgtatcagccagaagtgggtgcgggtggcggtggtggagtaccatgacggatcgcacgcttacatcggattgaaggacagaaagcgtccttctgagctgagacggatcgcctcgcaggtgaaatatgccggaagccaagtggcgtccacttcagaagtgctcaagtacactctgttccaaatcttttcaaagatcgacagaccggaggcttctcggatcaccctgctgctgatggctagtcaggaaccacagagaatgtcgaggaatttcgtgagatacgtgcagggactcaaaaagaagaaggtcatcgtcatccccgtcggtattggacctcacgccaatttgaagcagatccgcctgatcgagaaacaagctcccgagaataaagcatttgtgctgagctcggtcgacgagctggagcagcagcgggacgaaattgtgtcatacctctgcgatctcgctccggaagcaccgccgcctaccctgcccccagatatggcacaggtgaccgtggggccaggactgctcggcgtcagcactttgggaccaaagcgcaacagcatggttctcgacgtcgcgttcgttctggaaggatccgataagataggagaggcagactttaacagatccaaggaattcatggaagaagtgattcagcgcatggacgtcggccaggattcgatacacgtgactgtgttgcagtacagctatatggtcacggtggaataccctttcagcgaagcccagtccaagggcgacatcctgcaacgcgtgcgcgaaatccgctaccaaggggggaaccgaactaacactggacttgcactgagatacctgtcggaccactcgttcctcgtctctcagggcgaccgggaacaagctcccaatttggtctatatggtaactggaaatcctgcaagcgatgaaatcaaacggctcccgggagatattcaagtcgtgccgatcggagtggggccaaacgcgaacgtccaggaactggaaaggatcggttggcctaacgcccctatcctgatccaggacttcgaaaccctgccacgcgaagcaccagacctggtgctccagcggtgctgctcaggagaaggactgcagatcccgacgctgtctcctgccccagactgtagccagccgctggacgtcatcctcctcctcgacggaagctcatccttcccagcgagctacttcgacgaaatgaagtcgtttgccaaggctttcatttccaaggcaaacatcggtccccggttgacccaagtctcggtgctgcaatacggatcaatcactaccattgacgtgccgtggaatgtggtgccagaaaaggcgcacctgctgtcactggtggatgtcatgcaacgggaagggggcccaagccagattggggatgctcttgggttcgcagtccgatacctgacttccgagatgcacggagctcgcccgggagccagcaaggcggttgtgattctggtgacggacgtgagcgtggatagcgtcgatgccgcggccgatgctgcacgctcgaaccgggtgaccgtgttcccgatcggtattggagatcgctacgacgcggcacaactcagaatcctggcgggaccggccggcgacagcaatgtcgtcaaactgcaacgcatcgaagatctgccaactatggtcaccttgggcaactccttcctccacaagctgtgctcgggcttcgtgaggatttgtatggacgaggacggaaacgagaagcggcccggggacgtctggacccttccagatcagtgccataccgtgacttgccagccggacggtcaaacccttctgaagtcgcaccgggttaactgcgacagaggcctgaggccttcctgtccaaactcacagtcgccggtgaaagtggaagaaacctgtggctgtagatggacttgtccatgcgtgtgcactggatcgtctacccgccatattgtgactttcgacggccaaaactttaagctcactggctcctgctcatacgtgctgttccaaaacaaagagcaagatctggaagtgatcctgcataacggtgcctgctccccaggggcaagacagggttgcatgaagtccattgaggtaaaacactccgcgctgagcgtggagctccatagcgacatggaagtgaccgtgaatggcagactcgtgtcggtgccgtacgtgggaggcaatatggaggtgaatgtgtacggtgccatcatgcacgaggtccggttcaaccacctgggacacatattcaccttcaccccgcagaataatgaatttcagctccagctctcaccaaagactttcgccagcaagacttacggtctgtgcggaatctgcgatgagaatggcgctaacgacttcatgctcagggatggtactgtcaccacggactggaaaaccctggtgcaggaatggactgtgcagcggccgggacaaacttgccagcccatccttgaggaacaatgcctcgtgccagactcctcacactgccaggtgctcctgctgccactgttcgcggagtgccataaggtgctcgccccggccacgttctacgccatctgccagcaggattcgtgccatcaagaacaggtatgcgaagtgatcgcgtcttatgcacacctctgccgcaccaacggcgtttgcgtcgactggcggacgccagacttctgcgcgatgtcttgcccgccgtcccttgtgtataatcattgcgagcacggatgcccacgccactgcgatggaaacgtctcgtcatgcggcgaccaccccagcgagggttgtttctgccccccggataaagttatgctcgagggaagctgcgtgccagaagaggcttgcactcaatgcataggggaagatggggtccaacaccagtttctcgaggcctgggtcccggatcaccagccatgccaaatctgcacttgtctgtcgggaaggaaggtcaattgcactacccagccgtgtccgactgcaaaggcacctacttgcggcctgtgcgaagtggcacggctgcgccagaatgccgaccagtgctgcccagaatatgagtgtgtctgtgacccggtgagctgtgatctgccgccagtgccgcactgcgaaagggggctccagcccactctcaccaacccgggcgagtgtaggcctaacttcacctgtgcttgccgcaaagaggagtgcaagcgcgtctcaccaccatcctgcccgccgcaccgattgccgaccctccggaaaacgcagtgttgcgacgaatacgagtgcgcatgtaactgtgttaattcaaccgtgtcgtgcccactgggatacctggccagcaccgcgaccaacgattgcggatgcactacgaccacctgcctcccagataaggtgtgtgttcaccgctcaacgatctaccccgtcggacaattctgggaagagggatgcgatgtgtgcacctgcaccgatatggaggatgccgtgatgggactgcgcgtcgcacagtgcagccaaaagccgtgcgaggactcatgtaggtcaggattcacttacgtgctccacgagggtgaatgctgcggacggtgcctgccaagcgcgtgcgaagtggtgactggatccccgaggggcgactcgcagtcgagctggaagtcggtggggagccagtgggcatccccagagaacccatgcttgatcaacgagtgtgttagagtcaaggaagaagtgttcattcaacagcgcaacgtgtcgtgtccacagctggaagtcccggtctgtccgtccggattccaactctcctgcaagacttcagcctgctgccctagctgtcggtgcgagagaatggaggcatgcatgctcaacggaacggtgatcggcccaggcaagactgtcatgatcgatgtgtgtaccacctgccggtgcatggtgcaggtgggagtgatttccggattcaagctcgagtgccgcaagaccacgtgcaacccatgcccgctgggatacaaagaggagaacaacactggtgagtgctgtggtcggtgcctgccgaccgcctgcaccatccagcttagaggcggccaaatcatgacgctcaaacgagacgagacgctccaggacggctgcgacacccacttttgtaaagtgaacgagcgcggcgaatacttctgggaaaagcgcgtgaccggctgtccgccgttcgatgagcataaatgcctggctgaaggaggtaagattatgaaaatcccgggaacctgctgcgatacctgcgaagagccggaatgcaacgacatcaccgcccgcctgcaatacgtcaaagtgggtagttgcaaaagcgaggtggaggtggacattcactactgccaggggaagtgcgcttccaaagctatgtacagcatcgacatcaatgatgtgcaagaccaatgcagctgctgctcgccgacgcgcaccgagccgatgcaggtggccctgcactgtactaatggatccgtggtgtaccatgaggtcctcaacgccatggagtgcaaatgttccccgcgcaaatgctcgaaa

SEQ ID NO: 21330 - DNA, 8439 bp, Artificial Sequence
  Description of Artificial Sequence: Synthetic coding sequence
atgatccccgcaaggttcgctggcgtgctcctggcgctagcactaatcctccccggaaccttgtgcgcggagggaactcgtggcaggagctccaccgcacgatgttcgctattcggatctgacttcgtcaacactttcgatggatctatgtattctttcgctggctactgctcgtacctccttgccggcggttgtcagaagcgctcattttcgattataggagattttcaaaacggtaagagagtgagcctgtctgtctatcttggggaatttttcgatatccacttgtttgtgaatggaaccgtgacccaaggtgatcagcgcgtaagcatgccctacgcgagtaaaggcctgtacttggagactgaagcgggctattacaaactatccggagaggcgtacggttttgtcgcacggattgatggctccggcaatttccaggtcttgttatcggatcggtacttcaataaaacgtgcggcctatgtggtaactttaacatcttcgccgaggatgatttcatgactcaggagggcacactaacgtctgatccttacgacttcgccaactcatgggcattgtcctcaggtgagcagtggtgtgagcgagctagccccccgagctcgtcgtgtaacattagttcgggcgagatgcagaagggcttgtgggagcagtgccagcttcttaaatcgacgtccgtgtttgcacgttgtcatcctttggtggatccggaaccgttcgtggctctgtgcgaaaagacgttgtgcgagtgtgcagggggtttggagtgcgcctgccctgcgctcttagaatacgcccgaacctgtgctcaagagggtatggtcttatacggatggactgaccactctgcatgctccccagtctgcccagcaggaatggaataccgccagtgcgtcagtccctgtgctcgaacctgtcagtccttgcatatcaacgaaatgtgtcaagaacggtgcgttgatggttgcagctgtccggagggccaattacttgatgaaggattgtgtgtcgaaagcacagaatgcccttgtgtccactccggcaagaggtatcctcctgggacttcactaagccgggattgtaacacctgtatctgtcgcaactcgcagtggatctgttctaacgaggagtgtcctggggaatgtctagtaaccggccagagtcacttcaaatccttcgacaatcgttactttactttctccggtatatgccaatatctcctagccagagattgtcaggaccatagcttttcgatcgtgatcgaaaccgttcagtgcgcagacgatcgcgacgcagtctgtacgagatcagttacagtccgtctgcctggcctgcataacagcctggttaagctgaagcacggagcaggtgtggcaatggatggccaggatgtccagttacctctcctgaagggagacctgcggattcagcacacagttacagcttcagtccgcctgtcgtatggagaggacctacagatggattgggatggtaggggcaggcttcttgtcaagctgagccctgtgtatgccggtaagacgtgtggcctttgcggaaattataacggcaaccagggagatgacttcctcaccccctctggccttgccgagccgcgtgtggaagatttcggtaacgcatggaagttgcacggcgactgccaagacctgcaaaagcagcatagtgacccttgcgctcttaatcctaggatgactcgtttctcggaggaggcctgtgctgttctaacctcgccaacatttgaagcatgtcaccgggcggtctctccgctaccatacttgcgtaattgcaggtatgatgtatgctcttgttcagatggccgggagtgcctgtgtggtgcccttgcctcctacgcagctgcttgcgctggacgcggcgtgcgagtggcctggagggagccgggaaggtgtgaactcaactgtcctaagggacaggtctacctccagtgcggcaccccatgtaatctgacgtgccggtccctgtcttatccagacgaagagtgcaacgaggcctgtctcgagggatgcttttgtcccccgggtctctatatggacgaacgcggtgactgcgtcccaaaagcccagtgtccctgctattatgatggtgaaattttccagccggaggacatcttctctgaccatcatacaatgtgctattgtgaggacggatttatgcattgtactatgtccggcgtaccgggatccttgctacctgatgcggtccttagtagccctttatcgcatcgtagcaagcgttctctttcttgtcgaccccctatggttaagctggtctgcccagcagacaacttacgagcggagggtttggagtgtaccaagacctgccagaactacgacttggaatgtatgtcaatgggctgtgtgagcggctgtctgtgcccgccgggaatggtccgacacgaaaataggtgtgtggccctggaacgttgtccctgttttcaccaaggtaaggagtatgcacctggcgaaaccgtgaagatcggatgtaatacgtgtgtgtgtcaagaccgtaagtggaactgcaccgaccacgtttgcgatgccacttgttccaccatcggcatggcgcactacctaacattcgacggacttaagtacctctttccgggggaatgccagtatgtcctggtgcaagattactgtgggtccaatccaggcacttttcggattctagtcggcaacaaggggtgctcgcatccgtctgtaaagtgcaagaagagagtaacgattctcgtcgaaggtggggaaattgaactgtttgatggtgaggtcaacgtcaaacgccccatgaaggatgagacccattttgaagtcgtcgaaagtggcaggtatatcatactattgctcgggaaggccctctccgttgtgtgggatcggcatctaagcatcagtgtcgttctaaagcaaacatatcaggaaaaagtgtgtggcttatgcgggaactttgacggtattcagaacaatgatctgacttcttcaaacctccaagtagaggaggacccagttgactttggcaactcttggaaggtatcgagtcaatgtgcggataccaggaaagtgcccctggatagttcccccgccacgtgccacaacaatattatgaagcagaccatggtggattctagctgcaggatcttgacctccgatgttttccaggattgcaacaagctggttgatccggagccgtacctggatgtgtgtatatacgatacctgctcctgcgagtctattggtgattgcgcttgcttctgtgatacgattgccgcttatgcccacgtgtgcgcccaacacggcaaggtcgtgacgtggcgaacagccacactttgcccgcagagctgtgaggagcgcaatttgcgcgagaacggctatgagtgcgaatggcgttataattcgtgcgctcccgcatgccaggtcacgtgccaacatccggaacctctcgcatgtcccgttcaatgtgtagagggttgccatgcacattgccctcctggtaagatcctggacgagcttctacagacatgcgttgacccagaggactgccccgtctgcgaagtagccggtcgcagattcgcgtccggcaaaaaggtcactctgaatcctagtgacccagaacactgccaaatctgtcactgtgatgtggttaatctgacttgcgaggcatgccaagaacctggcggactggtggtgccacctacagacgcgccagtgagtcccacaacgttatatgtagaagatatttcggagccccctttgcacgacttttactgttcccggttgctagatcttgtattcctccttgacggttccagtcgattaagtgaggccgagttcgaggttctgaaagccttcgtcgtggacatgatggaaaggttacgaatttcccagaagtgggtcagagttgcagtcgttgagtaccatgatggttctcacgcttacattgggttaaaagacaggaagaggccctccgaattaaggcgaatcgcatcccaagttaaatacgcgggcagccaggttgcttctacatcggaggtactgaagtataccctttttcaaatcttcagtaagattgacaggccggaggcaagtcgaattactctactgttgatggcaagccaggagccgcaaagaatgagtcgcaacttcgtccgttacgtccaggggcttaagaagaagaaagtcattgtgatacctgtgggcatcggtccacacgccaatctgaaacaaattcgcctgatcgaaaagcaggcaccggagaacaaggcatttgtgttatcatcggtggatgagctcgagcagcaaagagacgagatcgtctcatatctctgcgatctagccccagaagctcctccacctactcttccacctgatatggcgcaagttaccgtcggaccgggtcttctcggcgtgagcaccttgggaccgaagaggaacagtatggtattagatgtggcgttcgttctggagggctccgacaagatcggtgaggctgacttcaacagatcgaaggagtttatggaggaagttatccaaaggatggatgttggccaagactcgatccatgtcacggtgctgcagtactcctatatggtgacggttgagtaccccttctccgaagcccagagcaaaggcgatattctgcagcgcgtgcgtgagattaggtatcagggtgggaaccgtacaaatacggggttggccctccgctatttgtcggatcacagcttcctagtttcacaaggcgatcgtgagcaggctcctaacttggtgtacatggtcaccggcaacccggcttcggacgaaattaaaaggctgcctggtgatatacaagtggttccaatcggggtcggtccaaacgctaatgttcaggaacttgagcgcataggctggcccaacgcgcctattttgattcaggatttcgaaacacttccacgggaagcgccagacctggtcctgcagaggtgttgctcaggcgaaggattacagattccaacgctgtctccagcgcctgattgtagccaacctctagacgtaattctacttcttgacggaagttcgtcttttcccgccagctacttcgacgaaatgaagagcttcgcgaaggctttcatcagtaaggctaatatcggccccagactgacccaggtgtcggtacttcagtacggctcgattacaacaattgacgtcccttggaatgttgtccctgaaaaggcgcatttgctaagccttgttgatgtcatgcagcgggaagggggccctagtcaaatcggagacgcacttggatttgcggtgcgttacctaacctctgagatgcacggagcccggcccggagcctcaaaggctgtcgttattctcgttactgatgtgagtgttgactccgttgatgcggcagctgatgctgcccggtccaaccgagtcactgtgtttcccatcggaatcggcgaccgatacgatgccgcacaattgaggattttggctggaccagcgggagattcgaatgttgttaagctccaacggattgaggacttgcctactatggtgactctgggtaactcgtttttgcataaactgtgttcaggcttcgttaggatctgcatggatgaggacggaaatgagaagagaccgggagatgtatggacactaccggaccaatgccataccgttacgtgccagcctgatggacagacgttgctgaaaagccatcgggtgaactgtgataggggattgcgccccagttgccctaatagccaatccccggtgaaagttgaagaaacatgtgggtgccgatggacctgtccctgtgtctgcacggggagcagtactcgacacattgtaacctttgatggacagaattttaagctgaccggatcgtgctcttatgtcctatttcagaataaggagcaggatctggaggtgatcttgcataatggggcctgctcaccgggcgcgcgtcaggggtgcatgaagtcgatcgaagtcaaacatagtgcgttgagcgtagaattacactcggatatggaggtaacggtaaacgggagattggtgtcggtcccgtacgtgggtggtaacatggaggtcaatgtttacggcgcgattatgcatgaagtgcgatttaaccatttggggcacatctttacatttacccctcagaataatgagtttcaactacaactttcgcccaagacttttgcttcaaagacatatggtctgtgtggaatctgtgatgaaaatggggcaaacgatttcatgttgagggacggcactgtcactacagactggaagacgttagtgcaggagtggacagttcagcggccgggacaaacctgtcagcctatccttgaggaacagtgtctagtacccgattcatctcattgtcaagtgctactgttgcctttgttcgctgaatgccataaagttctggctccggccacgttctacgcaatctgccagcaggattcttgccaccaggaacaagtctgtgaagttattgcctcatatgctcacctctgtcgcacaaacggcgtttgtgttgactggcgcacccctgatttttgtgcgatgtcttgccccccaagccttgtttacaaccactgtgaacatgggtgtcctcggcactgcgacggtaacgtcagttcttgtggggaccacccctccgagggttgtttttgcccgcccgacaaggtaatgctcgaagggagttgcgtgccggaggaggcatgtacccaatgcattggagaggatggagtccaacatcaattcctggaagcatgggttcccgaccaccagccatgtcagatttgtacttgcctaagcggccgtaaagttaattgcacaacccaaccttgccctacggccaaggcccccacatgcgggctctgtgaggtcgcacgacttcgccagaacgctgatcagtgctgtcccgaatacgaatgtgtgtgcgaccctgtatcatgtgatcttccgcctgtcccacattgcgaacgcggtctgcaacctacgctaactaatcctggcgaatgtcggccaaattttacatgtgcttgccggaaggaagagtgcaagcgggtgtccccaccatcctgccctcctcatagactacccacactgcgtaagacgcagtgctgcgacgaatacgaatgtgcttgcaactgcgtcaatagtacggtgagctgcccccttggttacctcgcctccacagctacgaacgactgcggttgcactacaaccacatgtttgccggataaggtctgcgtgcatcggtcgactatttaccctgtgggtcaattttgggaagaggggtgcgacgtatgcacctgtacagacatggaagacgctgtaatgggccttagagtggcacaatgcagtcaaaaaccatgtgaggattcatgtcgaagcgggttcacatacgtgttgcatgaaggcgaatgctgtggacgctgcttgccctctgcctgtgaggtcgtcactggatcgccacgcggcgacagccagtctagctggaaatctgtcggatcgcaatgggcttcccccgaaaatccgtgtttaatcaacgaatgtgttagggtgaaggaggaggtattcattcagcagcgcaacgtgtcgtgtccacaactggaggttcctgtttgtcccagtggatttcagctttcgtgcaagacaagcgcatgctgtccatcatgtaggtgcgagcggatggaagcgtgtatgttgaatggtacagttattggccctggcaagaccgttatgatcgacgtctgtactacgtgccgttgcatggttcaagttggtgtcatttcgggatttaaattggagtgccgtaagacaacttgtaacccatgccccctgggttacaaggaggagaataatacaggtgagtgctgtggccgctgcctgcccacggcttgcaccattcagctacggggcggacaaatcatgaccttgaagagagacgaaacactccaggacggatgcgacacgcatttctgcaaagttaatgagcgaggggagtacttctgggagaagcgagtcactggctgtcccccattcgacgagcacaaatgcttagccgagggaggaaagataatgaagataccggggacctgctgtgacacctgcgaggaaccagaatgtaatgatataacagcccgtctacagtacgttaaggtgggctcgtgcaagtccgaggtggaagtcgacatccactactgccaggggaagtgcgcatctaaggctatgtacagcatagacataaacgatgtgcaagatcaatgttcatgttgctcaccaactcggactgaaccgatgcaagttgcgttgcattgtactaacggatccgtcgtgtaccatgaggtgttaaacgccatggaatgcaagtgcagtccgcgcaagtgttcaaag

SEQ ID NO: 21331 - DNA, 8439 bp, Artificial Sequence
  Description of Artificial Sequence: Synthetic coding sequence
atgattccggccaggtttgcaggcgtgctgctggcacttgcactcatcttgccaggaactctctgtgcagaggggaccaggggtcgatcctccactgcacggtgtagcctgttcgggtcagatttcgtgaacacttttgacggttcgatgtactcgttcgcaggatactgcagctatctgctcgctggcggatgccagaaacgctcgttttccataatcggagactttcagaatggtaaaagggtgtcgctgtcggtgtacctcggcgagttttttgatattcacttgttcgtgaacggtacggtcacccagggcgatcaacgtgtgagcatgccatatgcctccaaaggactgtatctcgaaaccgaggcggggtactacaaactttcgggggaagcatacggatttgtggcccgtatagacggttccggcaactttcaggtgctcctttcagaccgctactttaacaagacctgtggcctctgcggtaatttcaacatctttgctgaggacgactttatgacccaggaaggaaccttgacctctgatccttacgactttgcaaactcctgggcactctccagcggtgagcagtggtgcgaacgggcaagcccaccctcatcgtcgtgtaatatctcgtcgggtgaaatgcaaaaaggattgtgggagcaatgccagctccttaagtccacgtcggtgtttgcccgatgtcatcctcttgtggatcctgagcctttcgtggcactttgtgaaaagaccctgtgtgaatgcgccggagggctggaatgtgcctgcccggcgctcctcgaatacgcgcgtacctgcgcacaagaagggatggtcctgtacggatggaccgatcactccgcatgctcgcccgtgtgtcctgccggcatggagtaccgccagtgcgtctcaccctgcgcacgtacttgtcagtcgctgcacattaacgaaatgtgtcaagaacgctgtgtggatggatgtagctgtcctgaaggtcaactcctggatgagggtttgtgcgtggaatccacggaatgtccctgcgtccatagcggtaagcgctaccctccaggtactagcctgtcgagagattgcaacacctgtatctgtaggaattcgcaatggatttgttccaatgaggaatgccctggtgaatgcctggtgaccgggcagagccactttaagtcatttgataaccgatactttaccttctccggcatatgtcaataccttctggctagagactgtcaggatcactcattctccattgtgatcgagacggtgcaatgtgccgatgatcgggatgcagtttgtactcgctccgtcaccgtgagactccccggccttcataatagtctcgtgaagctgaagcatggagcgggagtcgcaatggatgggcaggatgtgcagctgcccctgctgaagggtgaccttcgaatccaacatactgtgacggcctcagtgcgactgagctacggcgaggatttgcaaatggattgggatggaagaggacggctgctggtcaaacttagcccagtgtacgcaggaaaaacctgtggactttgcggaaattacaacggcaaccaaggggatgatttcctcaccccaagcggccttgcagagccaagagtggaagatttcggtaacgcttggaagctccatggagattgccaagaccttcagaaacagcattccgacccatgcgcgctgaatccccggatgacccggtttagcgaagaagcctgtgcagtgctgacctccccaacgtttgaggcctgtcaccgtgctgtgagccctctcccctaccttcgcaattgtagatacgacgtttgtagctgctcggacggacgggagtgtctttgcggagcactggcgtcgtacgcagcagcctgtgccggcagaggagtgcgggtcgcgtggagagagcccggacgatgtgaactgaattgtccaaagggccaagtctacctgcagtgcggaacgccttgcaacctgacctgtagatccctgtcctaccctgacgaggaatgtaacgaggcatgtttggagggttgtttttgtcctccaggactctatatggacgaacgcggtgactgtgtgcccaaagctcaatgcccttgttactacgatggtgagatattccagccagaggacatcttttccgatcaccataccatgtgctactgtgaggacggttttatgcattgtaccatgtccggcgtgcctggctcccttctcccagacgcagttttgtcgtccccactctctcacaggagcaagagatcccttagttgccgtccccccatggtgaagctggtgtgccccgcggataacctgcgagccgaaggtcttgaatgtactaagacctgccagaactacgatctggagtgtatgtccatgggctgtgtgagcggatgcctgtgtcctcctggtatggtccggcatgagaatagatgcgtcgcacttgaaagatgtccgtgctttcatcagggtaaagaatatgctcctggagaaaccgttaagattggctgcaatacctgtgtgtgtcaagatagaaaatggaactgtactgatcacgtgtgtgatgcaacctgttccaccatcgggatggcacattacctgaccttcgatgggcttaagtacctcttccctggtgagtgtcaatacgtcctggtgcaggactattgtggatcaaacccaggtacttttcgtatccttgtgggaaataagggttgcagccatccatcagtaaaatgtaagaagagggtcaccatcctcgtggaaggaggagagattgagctgtttgatggggaagtcaacgtgaaaagacctatgaaggacgaaacgcactttgaagtggtggagtcgggtcggtacattatcttgcttctcgggaaggccctttccgtggtgtgggatcgacatctgagcatttccgtcgtccttaagcagacctatcaggaaaaagtgtgtggtttgtgcggcaacttcgatggtattcagaataacgatctgacctcgtctaatcttcaagtggaagaggacccagtggatttcggaaactcctggaaagtttcatcccagtgcgcagacacccggaaggtgccccttgatagcagcccagccacctgccacaacaacatcatgaagcagaccatggtggattcctcatgtagaattctgacctcggatgtgtttcaggattgtaataagctcgttgatcccgaaccttatcttgacgtttgcatctacgatacttgctcatgcgagtcgattggagattgtgcatgcttttgcgataccattgcagcatacgcacatgtgtgtgcgcaacatggcaaagtggtcacctggaggactgccactctctgccctcaatcgtgtgaagagagaaatctgcgcgaaaatggctacgaatgtgaatggcgatacaactcgtgcgcccctgcttgtcaggtcacctgtcaacaccctgagcctctggcatgtcccgtccagtgtgtggaagggtgtcatgcgcattgtccacctggtaagattctggatgagcttcttcaaacctgtgtggaccccgaagattgtcctgtgtgcgaggtggcaggacgccgatttgcatcgggaaagaaggtcactctgaacccatctgatcccgaacattgtcaaatctgtcattgtgatgtcgttaacctcacttgtgaagcctgtcaagaacctggtggtttggtggtgcctcctaccgatgctccagtgtcgccaactaccctctacgtggaggacatctcggaaccaccactccatgatttctactgttctcgcctcctcgacttggtgttcctcctggatggatcatctcggctgtcggaggccgaattcgaagtcctgaaagcatttgtggtggatatgatggagcggttgcgcatttcgcagaaatgggtgagggtggctgtggtcgaataccacgatggatcccatgcatacattgggcttaaggaccggaagcgcccgtccgaactgagaagaatcgcatcgcaagtgaagtacgccgggtcacaggtggcgagcactagcgaagtgcttaagtacaccctgtttcagatctttagcaagatagaccggcctgaagcatctcgcattactctcctgcttatggcctcacaagaaccacaaagaatgtcgagaaactttgtgcgatacgtgcagggccttaagaaaaagaaggtgattgtcattccagtgggtattggtcctcatgcaaacctcaagcaaattaggctgatcgaaaagcaagcaccagagaataaggccttcgtcctgtccagcgtggacgagctggaacaacagcgtgacgaaattgtctcctacctgtgcgacctggcacctgaagcgcctccgccaaccctccctcccgatatggcacaggtgacggtgggccctggactccttggggtgtcaactctgggtcctaagagaaactcgatggtgctggatgttgcatttgtcctggagggatcggacaagattggagaagctgactttaacagatccaaggaattcatggaggaggtgatccagcgaatggatgtggggcaagacagcatacatgtgaccgtgctgcaatactcgtatatggtcaccgtggaatacccattttcggaggcacaaagcaaaggagatattctgcagagagtgcgcgagattaggtaccaaggaggtaacaggactaataccggcctcgcactgaggtacctttccgaccacagcttccttgtgtcgcaaggagatagggagcaagcacctaacctggtctacatggttaccgggaaccctgcttctgatgagattaagagacttcccggcgacattcaagtggtgcctattggagtgggtccaaacgcgaatgtgcaggaacttgagcgcattggctggcctaatgcacccattctcatccaagatttcgaaacccttcctagggaggccccggatttggtccttcaaagatgttgctcgggagaaggactccaaatcccaactctctccccagcacccgactgttcccaaccgcttgatgtcattttgctgcttgacggcagctcatccttccctgccagctactttgatgaaatgaagagcttcgcgaaggcattcatatcgaaggccaacatcggtccacggctgacgcaggtgagcgtccttcagtacggttcaatcactactatcgatgtgccatggaacgtggtgcccgaaaaggcccatctcctctcgttggtcgatgtgatgcaacgggagggcggaccctcgcagatcggcgacgctttgggattcgccgtgagataccttacttcagagatgcatggagcacggccaggagcgtcgaaggccgtggtaattcttgtgactgatgtgtcggtggactccgttgatgcagcagcagatgccgcaaggtcaaatagagtgactgtgtttccaatcggaattggcgaccggtacgatgccgcgcagcttcgtatcctggcaggacctgccggagattcgaatgtggtcaaactccaacgtatagaggatctgcccaccatggtgaccctgggaaactcgtttcttcataagctctgctcgggattcgtcaggatttgtatggacgaggacggtaacgaaaaaagaccaggtgacgtgtggaccctccctgaccaatgtcacaccgtgacttgccaaccagatggacagaccttgctgaaatcccatcgcgtcaattgtgaccgcggtcttaggccatcatgtcctaattcgcaatcccctgtgaaggtggaggaaacttgcggttgcagatggacctgtccttgtgtgtgtactggtagctctacccgacatatcgtgactttcgatgggcagaactttaaacttacgggctcctgtagctacgtgctttttcaaaacaaggaacaggacttggaagtcattctgcataacggcgcatgttcaccaggagctagacaaggctgtatgaagagcatcgaagtgaaacacagcgcacttagcgtcgaacttcattcagatatggaagtcacggtcaatggtcggctcgtgagcgtgccctacgtgggtggaaacatggaagtgaatgtctacggagcaattatgcacgaagtccgctttaatcatcttggacatatcttcacctttacgccacaaaacaatgaatttcagcttcagctgtctcctaaaacttttgcatcaaagacgtacgggctgtgtggtatctgtgatgaaaacggggcaaacgactttatgctccgggatggtaccgtgaccaccgactggaaaacgctcgtccaggaatggactgtgcaaagacccggacaaacctgtcagccgattctcgaagagcaatgccttgtgccggattcctcccactgtcaggtccttctgctgcccctgtttgctgagtgccataaggtgctcgcgccagccactttctatgcgatttgtcaacaggactcatgccaccaggaacaggtctgtgaagtcatagcatcatacgcgcatctgtgtcgcaccaatggtgtgtgtgtcgattggcggacccctgatttctgtgctatgtcgtgtcctccctccctcgtgtacaaccattgcgaacatgggtgccccaggcattgtgacggaaatgtttcgtcctgtggggaccatccatccgaagggtgtttctgtccacctgacaaggtgatgctcgaaggatcctgcgttcctgaggaagcgtgcacccagtgtattggagaggacggggtgcaacatcaatttctggaagcgtgggtgcccgaccatcagccgtgtcaaatctgcacttgcctttccggtcgtaaagtgaactgtaccacccagccttgtcccaccgcaaaggcacctacttgtggactgtgtgaggttgcacgtctgaggcaaaacgccgaccagtgttgccctgagtatgaatgtgtctgtgatccagtgtcgtgtgatcttcctcctgtcccacattgtgagagaggacttcaacccaccctcacgaacccgggtgaatgtcgcccaaactttacctgtgcatgcaggaaagaagaatgtaagagagtgagccccccttcatgtccaccccacagacttcctaccctgcgcaagacccaatgctgcgacgagtatgagtgtgcatgcaattgcgtgaattcaactgtgtcctgccctctgggataccttgcttcaactgcaactaacgattgtggctgcactactaccacctgcctgcccgacaaggtttgtgtccatagatcaacgatttaccccgtgggccaattctgggaagaaggatgtgacgtgtgtacttgtacggatatggaggatgcagtcatgggtcttagagtcgcacaatgttcacagaagccttgtgaagattcatgtagatccggttttacttacgtcctgcatgagggagaatgctgtggaagatgtctcccatcagcttgtgaagtggtgactggctcacccagaggagacagccaatctagctggaagtcagttgggagtcagtgggcttcgcccgaaaacccctgtctgatcaacgaatgtgtgcgagttaaggaggaagtgtttattcaacagcggaatgtcagctgtccgcaattggaagtgccagtgtgtccatcgggcttccaactctcctgcaaaacttcggcctgttgccctagctgtcgctgtgaaagaatggaggcttgcatgctgaacggtaccgtcatcggacccggaaagaccgtgatgattgatgtgtgtacgacttgtcggtgtatggtccaggtgggggtgatttcggggtttaagttggagtgtcggaaaacgacttgtaatccatgcccactggggtacaaggaggagaacaataccggggagtgctgtggccgctgtctccctaccgcttgtaccattcagctgagaggtggtcagataatgacgctgaagcgcgatgaaactctgcaggatggatgcgacacccacttctgtaaggtgaatgagagaggcgagtacttttgggaaaagagagtaactggatgtcctccattcgacgaacataagtgtctggcggaaggtgggaagattatgaagatccctggcacctgttgtgatacctgtgaggaacctgaatgcaacgatatcacggccagactccagtacgtgaaagtcggatcgtgcaagtcggaagtggaggtcgatattcactactgccaaggaaagtgtgcctccaaggccatgtattccatcgacattaacgacgtgcaggatcagtgtagctgttgttcacctacccgcactgaaccaatgcaagtggcactccattgtaccaatggcagcgtggtgtaccacgaggtgttgaacgctatggaatgcaagtgcagccctcgaaaatgttccaaa

SEQ ID NO: 21332 - DNA, 8439 bp, Artificial Sequence
  Description of Artificial Sequence: Synthetic coding sequence
atgataccggcgcgatttgcgggtgttttactagcgttagcgttaatattaccgggtacgttatgtgcggaaggtacgcgaggtcgttcgtcgacggcgcgttgttcgttatttggttcggattttgttaatacgtttgatggttcgatgtattcgtttgcgggttattgttcgtatttactagcgggtggttgtcaaaaacgatcgttttcgataataggtgattttcaaaatggtaaacgtgtatcgctatcggtatatttaggtgaattttttgatatacatctatttgtaaatggtacggttacgcaaggtgatcaacgtgtatcgatgccgtatgcgtcgaaaggtttatatttagaaacggaagcgggttattataaattatcgggtgaagcgtatggttttgttgcgcgtatagatggttcgggtaattttcaagttttattatcggatcgatattttaataaaacgtgtggtttatgtggtaattttaatatatttgcggaagatgattttatgacgcaagaaggtacgctaacgtcggatccgtatgattttgcgaattcgtgggcgttatcgtcgggtgaacaatggtgtgaacgagcgtcgccgccgtcgtcgtcgtgtaatatatcgtcgggtgaaatgcaaaaaggtctatgggaacaatgtcaattactaaaatcgacgtcggtatttgcgcgatgtcatccgttagtagatccggaaccgtttgttgcgttatgtgaaaaaacgctatgtgaatgtgcgggtggtctagaatgtgcgtgtccggcgttattagaatatgcgcgtacgtgtgcgcaagaaggtatggttctatatggttggacggatcattcggcgtgttcgccggtttgtccggcgggtatggaatatcgtcaatgtgtatcgccgtgtgcgcgaacgtgtcaatcgctacatataaatgaaatgtgtcaagaacgatgtgttgatggttgttcgtgtccggaaggtcaattattagatgaaggtctatgtgttgaatcgacggaatgtccgtgtgtacattcgggtaaacgttatccgccgggtacgtcgttatcgcgagattgtaatacgtgtatatgtcgaaattcgcaatggatatgttcgaatgaagaatgtccgggtgaatgtttagtaacgggtcaatcgcattttaaatcgtttgataatcgttattttacgttttcgggtatatgtcaatatttactagcgcgtgattgtcaagatcattcgttttcgatagttatagaaacggttcaatgtgcggatgatcgagatgcggtatgtacgcgttcggtaacggtacgtttaccgggtctacataattcgctagttaaactaaaacatggtgcgggtgtagcgatggatggtcaagatgtacaactaccgctattaaaaggtgatttacgtatacaacatacggtaacggcgtcggttcgtctatcgtatggtgaagatctacaaatggattgggatggtcgtggtcgtctattagtaaaactatcgccggtatatgcgggtaaaacgtgtggtctatgtggtaattataatggtaatcaaggtgatgattttttaacgccgtcgggtttagcggaaccgcgtgttgaagattttggtaatgcgtggaaactacatggtgattgtcaagatttacaaaaacaacattcggatccgtgtgcgttaaatccgcgtatgacgcgattttcggaagaagcgtgtgcggtattaacgtcgccgacgtttgaagcgtgtcatcgtgcggtatcgccgttaccgtatctacgtaattgtcgttatgatgtatgttcgtgttcggatggtcgagaatgtttatgtggtgcgctagcgtcgtatgcggcggcgtgtgcgggtcgtggtgttcgagtagcgtggcgagaaccgggtcgatgtgaattaaattgtccgaaaggtcaagtttatctacaatgtggtacgccgtgtaatttaacgtgtcgatcgctatcgtatccggatgaagaatgtaatgaagcgtgtttagaaggttgtttttgtccgccgggtctatatatggatgaacgtggtgattgtgtaccgaaagcgcaatgtccgtgttattatgatggtgaaatatttcaaccggaagatatattttcggatcatcatacgatgtgttattgtgaagatggttttatgcattgtacgatgtcgggtgtaccgggttcgttactaccggatgcggttctatcgtcgccgctatcgcatcgatcgaaacgttcgttatcgtgtcgaccgccgatggttaaactagtttgtccggcggataatctacgagcggaaggtttagaatgtacgaaaacgtgtcaaaattatgatctagaatgtatgtcgatgggttgtgtatcgggttgtttatgtccgccgggtatggtacgacatgaaaatcgatgtgttgcgttagaacgttgtccgtgttttcatcaaggtaaagaatatgcgccgggtgaaacggtaaaaataggttgtaatacgtgtgtttgtcaagatcgaaaatggaattgtacggatcatgtatgtgatgcgacgtgttcgacgataggtatggcgcattatttaacgtttgatggtctaaaatatttatttccgggtgaatgtcaatatgttctagtacaagattattgtggttcgaatccgggtacgtttcgtatattagtaggtaataaaggttgttcgcatccgtcggtaaaatgtaaaaaacgtgttacgatattagtagaaggtggtgaaatagaattatttgatggtgaagttaatgtaaaacgtccgatgaaagatgaaacgcattttgaagttgtagaatcgggtcgatatataatattactactaggtaaagcgttatcggttgtatgggatcgtcatctatcgatatcggttgttttaaaacaaacgtatcaagaaaaagtttgtggtttatgtggtaattttgatggtatacaaaataatgatttaacgtcgtcgaatctacaagtagaagaagatccggtagattttggtaattcgtggaaagtatcgtcgcaatgtgcggatacgcgtaaagtaccgttagattcgtcgccggcgacgtgtcataataatataatgaaacaaacgatggtagattcgtcgtgtcgtatattaacgtcggatgtatttcaagattgtaataaattagtagatccggaaccgtatctagatgtatgtatatatgatacgtgttcgtgtgaatcgataggtgattgtgcgtgtttttgtgatacgatagcggcgtatgcgcatgtttgtgcgcaacatggtaaagttgttacgtggcgtacggcgacgctatgtccgcaatcgtgtgaagaacgaaatttacgagaaaatggttatgaatgtgaatggcgttataattcgtgtgcgccggcgtgtcaagttacgtgtcaacatccggaaccgttagcgtgtccggtacaatgtgttgaaggttgtcatgcgcattgtccgccgggtaaaatactagatgaactattacaaacgtgtgtagatccggaagattgtccggtttgtgaagtagcgggtcgtcgatttgcgtcgggtaaaaaagtaacgttaaatccgtcggatccggaacattgtcaaatatgtcattgtgatgtagtaaatttaacgtgtgaagcgtgtcaagaaccgggtggtctagtagttccgccgacggatgcgccggtatcgccgacgacgttatatgttgaagatatatcggaaccgccgttacatgatttttattgttcgcgtttactagatttagtatttctactagatggttcgtcgcgtttatcggaagcggaatttgaagttctaaaagcgtttgttgtagatatgatggaacgtctacgtatatcgcaaaaatgggtacgagtagcggtagtagaatatcatgatggttcgcatgcgtatataggtttaaaagatcgtaaacgaccgtcggaactacgtcgtatagcgtcgcaagtaaaatatgcgggttcgcaagtagcgtcgacgtcggaagtattaaaatatacgttatttcaaatattttcgaaaatagatcgtccggaagcgtcgcgtataacgctactactaatggcgtcgcaagaaccgcaacgtatgtcgcgaaattttgttcgatatgtacaaggtttaaaaaaaaaaaaagttatagtaataccggtaggtataggtccgcatgcgaatctaaaacaaatacgtctaatagaaaaacaagcgccggaaaataaagcgtttgtactatcgtcggtagatgaactagaacaacaacgtgatgaaatagtatcgtatctatgtgatttagcgccggaagcgccgccgccgacgctaccgccggatatggcgcaagtaacggtaggtccgggtttattaggtgtttcgacgctaggtccgaaacgaaattcgatggttttagatgtagcgtttgttttagaaggttcggataaaataggtgaagcggattttaatcgttcgaaagaatttatggaagaagtaatacaacgtatggatgttggtcaagattcgatacatgtaacggttttacaatattcgtatatggtaacggtagaatatccgttttcggaagcgcaatcgaaaggtgatatattacaacgtgttcgtgaaatacgatatcaaggtggtaatcgaacgaatacgggtttagcgctacgttatttatcggatcattcgtttttagtttcgcaaggtgatcgtgaacaagcgccgaatttagtatatatggtaacgggtaatccggcgtcggatgaaataaaacgtctaccgggtgatatacaagttgtaccgataggtgttggtccgaatgcgaatgtacaagaactagaacgtataggttggccgaatgcgccgatattaatacaagattttgaaacgttaccgcgtgaagcgccggatctagtactacaacgttgttgttcgggtgaaggtctacaaataccgacgctatcgccggcgccggattgttcgcaaccgttagatgtaatactattactagatggttcgtcgtcgtttccggcgtcgtattttgatgaaatgaaatcgtttgcgaaagcgtttatatcgaaagcgaatataggtccgcgtttaacgcaagtatcggtattacaatatggttcgataacgacgatagatgtaccgtggaatgttgtaccggaaaaagcgcatttattatcgttagtagatgttatgcaacgtgaaggtggtccgtcgcaaataggtgatgcgctaggttttgcggtacgttatctaacgtcggaaatgcatggtgcgcgtccgggtgcgtcgaaagcggttgtaatattagttacggatgtttcggtagattcggttgatgcggcggcggatgcggcgcgttcgaatcgagtaacggtatttccgataggtataggtgatcgttatgatgcggcgcaactacgtatattagcgggtccggcgggtgattcgaatgtagtaaaattacaacgtatagaagatttaccgacgatggttacgttaggtaattcgtttttacataaattatgttcgggttttgttcgaatatgtatggatgaagatggtaatgaaaaacgaccgggtgatgtatggacgttaccggatcaatgtcatacggttacgtgtcaaccggatggtcaaacgctattaaaatcgcatcgtgtaaattgtgatcgaggtttacgaccgtcgtgtccgaattcgcaatcgccggtaaaagtagaagaaacgtgtggttgtcgttggacgtgtccgtgtgtttgtacgggttcgtcgacgcgacatatagtaacgtttgatggtcaaaattttaaactaacgggttcgtgttcgtatgttttatttcaaaataaagaacaagatctagaagtaatactacataatggtgcgtgttcgccgggtgcgcgtcaaggttgtatgaaatcgatagaagtaaaacattcggcgctatcggtagaactacattcggatatggaagtaacggttaatggtcgtttagtatcggtaccgtatgtaggtggtaatatggaagtaaatgtttatggtgcgataatgcatgaagttcgatttaatcatttaggtcatatatttacgtttacgccgcaaaataatgaatttcaactacaactatcgccgaaaacgtttgcgtcgaaaacgtatggtctatgtggtatatgtgatgaaaatggtgcgaatgattttatgctacgtgatggtacggtaacgacggattggaaaacgttagttcaagaatggacggtacaacgaccgggtcaaacgtgtcaaccgatattagaagaacaatgtctagtaccggattcgtcgcattgtcaagtattactattaccgctatttgcggaatgtcataaagtactagcgccggcgacgttttatgcgatatgtcaacaagattcgtgtcatcaagaacaagtttgtgaagtaatagcgtcgtatgcgcatctatgtcgtacgaatggtgtatgtgtagattggcgtacgccggatttttgtgcgatgtcgtgtccgccgtcgttagtttataatcattgtgaacatggttgtccgcgacattgtgatggtaatgtatcgtcgtgtggtgatcatccgtcggaaggttgtttttgtccgccggataaagtaatgttagaaggttcgtgtgtaccggaagaagcgtgtacgcaatgtataggtgaagatggtgttcaacatcaatttttagaagcgtgggttccggatcatcaaccgtgtcaaatatgtacgtgtctatcgggtcgaaaagttaattgtacgacgcaaccgtgtccgacggcgaaagcgccgacgtgtggtctatgtgaagttgcgcgattacgacaaaatgcggatcaatgttgtccggaatatgaatgtgtatgtgatccggtatcgtgtgatctaccgccggtaccgcattgtgaacgaggtttacaaccgacgctaacgaatccgggtgaatgtcgaccgaattttacgtgtgcgtgtcgtaaagaagaatgtaaacgtgtttcgccgccgtcgtgtccgccgcatcgtctaccgacgctacgtaaaacgcaatgttgtgatgaatatgaatgtgcgtgtaattgtgttaattcgacggtatcgtgtccgctaggttatttagcgtcgacggcgacgaatgattgtggttgtacgacgacgacgtgtttaccggataaagtatgtgtacatcgatcgacgatatatccggtaggtcaattttgggaagaaggttgtgatgtatgtacgtgtacggatatggaagatgcggttatgggtttacgtgttgcgcaatgttcgcaaaaaccgtgtgaagattcgtgtcgttcgggttttacgtatgttctacatgaaggtgaatgttgtggtcgatgtctaccgtcggcgtgtgaagttgttacgggttcgccgcgaggtgattcgcaatcgtcgtggaaatcggtaggttcgcaatgggcgtcgccggaaaatccgtgtttaataaatgaatgtgtacgtgtaaaagaagaagtttttatacaacaacgtaatgtatcgtgtccgcaattagaagtaccggtatgtccgtcgggttttcaattatcgtgtaaaacgtcggcgtgttgtccgtcgtgtcgttgtgaacgaatggaagcgtgtatgttaaatggtacggtaataggtccgggtaaaacggttatgatagatgtttgtacgacgtgtcgttgtatggttcaagtaggtgttatatcgggttttaaattagaatgtcgaaaaacgacgtgtaatccgtgtccgttaggttataaagaagaaaataatacgggtgaatgttgtggtcgttgtttaccgacggcgtgtacgatacaattacgaggtggtcaaataatgacgctaaaacgagatgaaacgttacaagatggttgtgatacgcatttttgtaaagtaaatgaacgaggtgaatatttttgggaaaaacgtgttacgggttgtccgccgtttgatgaacataaatgtttagcggaaggtggtaaaataatgaaaataccgggtacgtgttgtgatacgtgtgaagaaccggaatgtaatgatataacggcgcgtttacaatatgtaaaagttggttcgtgtaaatcggaagttgaagtagatatacattattgtcaaggtaaatgtgcgtcgaaagcgatgtattcgatagatataaatgatgtacaagatcaatgttcgtgttgttcgccgacgcgtacggaaccgatgcaagtagcgttacattgtacgaatggttcggtagtatatcatgaagttttaaatgcgatggaatgtaaatgttcgccgcgtaaatgttcgaaa

SEQ ID NO: 21333 - DNA, 8439 bp, Artificial Sequence
  Description of Artificial Sequence: Synthetic coding sequence
atgatcccagctcggttcgcaggagtgctgcttgccctggcactcatcttgccagggacgctgtgcgcggaaggaacccgcggacgcagctcaacggccaggtgttcattgttcggatcagactttgtgaacaccttcgatgggtccatgtattcattcgccggctactgttcatacctgctcgccgggggatgccagaagagatccttttcaatcatcggcgacttccaaaatgggaaacgcgtgtcgctgtcagtgtacctcggtgaattctttgacattcatctcttcgtcaacggaaccgtgacccagggagatcaacgggtttcaatgccatacgcttccaagggcctttacctggagactgaggctggatactacaagctgagtggagaagcgtacgggttcgtcgcgcgcattgatggatcgggaaatttccaagtgctgctctcagaccgctatttcaataagacctgtggactgtgtggaaactttaacatcttcgccgaagacgatttcatgacgcaagagggaaccctcacttcagatccgtacgactttgccaactcctgggcactgagctcgggagaacaatggtgtgagcgggcaagcccgccttcgagctcgtgtaacatctcttcgggagaaatgcaaaagggcctctgggaacagtgtcaattgcttaagagcacttcggtcttcgcccgatgccatcctctcgtggatccggagccctttgtcgcgctgtgcgagaagacgttgtgtgaatgcgctggtggactggagtgtgcatgtcctgcgcttctggagtacgcccgtacttgcgctcaggaggggatggtgctctacggctggactgaccattcggcctgctcgccagtgtgtccggctggcatggaatatcgacagtgcgtcagcccgtgtgctcgcacgtgccaatcattgcacatcaacgagatgtgccaggagcggtgcgtcgacggatgctcctgtccagaaggacagctcctggatgaaggactgtgcgtggaatcaactgaatgcccatgtgtgcactcaggcaagcggtacccccctggaaccagcctctcgagagactgcaatacttgtatctgtcgcaactcgcagtggatttgttcgaatgaagaatgcccaggggagtgtcttgtcaccggacaatcgcatttcaagtccttcgataaccgctattttacgttctccggaatctgccagtacctcctggctcgcgactgtcaggatcactcattctccattgtgatcgaaaccgtgcaatgcgcggacgatcgggatgcagtgtgcaccaggtcagtgactgtgcgacttcccggcctgcataactcgctggtgaagctgaaacatggtgcgggcgtggcaatggacggacaggatgtgcagctgccactcctgaagggggaccttcgcatccaacataccgtgaccgcatccgtccgcctctcctacggcgaagacctccagatggactgggatggaagaggacgcttgttggtgaagctgtcgccggtgtacgccggcaagacttgtggattgtgcggtaactacaacggcaatcagggggatgattttctcaccccgagcgggctcgcggagccgcgggtcgaggactttggaaatgcatggaaactccacggagactgtcaagatcttcagaagcagcatagcgatccgtgcgccctgaaccctcgaatgaccaggttctccgaagaggcctgcgccgtcctgacttccccgaccttcgaagcctgtcaccgtgccgtctccccgctgccttacctgagaaattgcagatatgatgtctgttcttgctccgatggccgcgaatgcctgtgcggcgccctggctagctacgcggctgcgtgcgcgggacgcggagtgcgggtagcctggcgcgagcccggtcgatgcgagctgaactgcccgaaggggcaggtgtacctgcagtgcggaactccttgtaatctgacctgtcggtcactctcataccccgatgaggagtgcaatgaggcatgccttgaggggtgcttttgcccgccgggcctctacatggacgaacgcggagactgcgtgccaaaagcccagtgcccgtgctactacgacggtgagattttccagccagaggacatcttctcggaccaccacaccatgtgctactgtgaggatggattcatgcactgcactatgtcgggggtgccaggatcgttgctgccggatgcggtcttgtcatccccgctgtcccaccggagcaagagatcgctgtcttgtcggcctcccatggtgaagttggtctgcccagcggataacctgcgggccgaaggactcgaatgcaccaagacctgccaaaactacgacctggaatgcatgtcaatgggatgcgtcagcggctgcctgtgtccccctggaatggtgcgccatgaaaatcgctgcgtggcactcgagcggtgcccatgcttccatcagggaaaagaatacgcgccaggagaaaccgtgaaaatcggctgtaatacctgtgtgtgccaggatagaaaatggaattgcaccgaccacgtgtgcgacgcgacgtgctcgaccattggaatggcccattacctgactttcgacggactgaaataccttttccccggtgagtgccagtatgtcctcgtccaagactactgcggctcaaatccgggcaccttcaggatcctggtcggaaacaagggatgctcccacccgtccgtcaaatgcaagaagcgcgtcaccatactggtggaaggcggtgagatcgaactcttcgatggggaggtgaacgtgaagcggcctatgaaggacgaaacccacttcgaagttgtggagagcggacgttatatcatcctgctgctgggaaaggcgctgtcagtggtgtgggaccgccacctgtccatcagcgtggtcctgaagcagacttaccaggaaaaagtgtgtggactgtgcggcaacttcgacggaatccaaaacaacgatcttacttcttcgaacttgcaagtggaggaagaccctgtggactttggcaattcgtggaaggtgtccagtcaatgcgcagacactaggaaagtcccgttggacagctcgcctgcaacctgtcacaacaacatcatgaagcagaccatggtggactcgtcctgtcggatacttacctcggatgtctttcaggattgcaacaagctggtggacccagaaccatacctcgacgtgtgtatttacgacacctgctcatgtgagtcgatcggagattgtgcttgtttctgcgacactatcgcggcctacgcccacgtgtgcgctcaacacggaaaggtcgtcacttggaggactgccaccctgtgccctcaaagctgcgaggaacgtaacttgcgcgagaacggatacgaatgcgaatggcggtacaacagctgtgccccggcgtgccaggtgacctgtcagcaccctgaacctctcgcctgccccgtgcagtgcgtggaaggatgccacgcccactgcccgcccggaaaaatcctggacgaattgctccagacgtgcgtcgacccagaagattgcccggtctgtgaagtggctggaaggagattcgcctccggtaagaaggtgactctgaacccatccgacccagagcactgccagatctgccactgtgacgtcgtgaacttgacctgtgaggcctgccaggaaccggggggcttggtggttccgccgactgatgcgccggtgtcaccaactactctgtacgtggaggatatcagcgaaccaccactccatgatttttactgttcccggctgttggatctcgtctttctgcttgatgggagctcccggctctctgaagctgaatttgaggtgttgaaagcattcgtggtcgacatgatggagcgcctgcggattagccaaaaatgggtccgggtcgccgtcgtcgagtatcacgatggaagccatgcttacataggcctgaaagatcggaagcgtccatccgaactgagacggatcgcctcgcaagtgaagtacgctggctcgcaagttgcctccacgagcgaggttctcaagtacactctttttcagattttttctaaaattgatcgcccggaggcttcgagaatcaccctcctgctgatggcctcccaggagccacagcggatgagcaggaacttcgtgcgctacgtgcaggggctgaagaaaaagaaagttatcgtgatccctgtgggaatcggtccgcatgcgaaccttaagcaaatcagactcatcgaaaagcaggcgccggagaataaggcttttgtgctttcgtccgtcgacgagctggaacaacagagagatgaaatcgtgtcgtacctgtgcgacctggcgccagaagccccaccgcctactctgcctccggacatggcacaggttactgtgggaccaggactgctgggagtgagcaccctcggaccgaagaggaattccatggtgttggacgtcgccttcgtgctggaaggttcggacaagatcggagaagctgacttcaatagatcaaaggagttcatggaggaggtcatccagcgcatggacgtgggacaagactccatccatgtgaccgtgctgcagtactcctatatggtgacggtggaataccccttctcagaggcacagtcaaagggagacattctgcagcgggtgcgcgagatccgataccagggaggcaaccgcactaatactgggctggcactccggtacctcagcgaccactcgttcctggtgtcacagggcgatcgggagcaggcgccaaacctcgtttacatggtcaccggcaacccggccagcgatgagattaagagactgcccggtgacatccaagtcgtgccaatcggagtcggaccgaacgctaacgtccaggaattggaacgcataggatggccaaacgctccaatcttgatccaggattttgaaactctcccacgagaagcacctgacctcgtgctccagcgctgctgcagcggagagggactccagattccgaccctgagcccggcccctgactgctctcagcctctcgacgtcatcttgctgctcgatggctcatccagttttccagcgtcctactttgatgaaatgaaatccttcgcaaaggcctttatctcgaaggccaatattggtccgagactgacccaggtgtccgtgctccagtatggatcgatcaccaccatcgatgtgccttggaatgtggttcctgagaaggctcatctcctgagtctggtcgacgtgatgcagcgcgagggtggaccgtcacaaatcggagacgcgcttggtttcgctgtccgctacttgacttcagaaatgcacggtgcacgcccgggcgcatcgaaggcggtcgttattctggtgaccgacgtttcagtggactcggtcgatgctgccgccgatgcggcgagaagcaatcgcgtgactgtgttcccgatcggaatcggggatagatacgacgccgctcagctgagaatcctcgctggacctgccggcgattcaaacgtcgtgaagctgcaacgaatcgaagacctgccgactatggtcactctgggaaactccttcctgcacaagctgtgctcaggtttcgtgcgcatctgcatggatgaagacggaaatgaaaagcggccgggcgatgtgtggaccctgccggatcagtgtcacactgtcacgtgccagcctgacggtcaaactttgctcaaatcgcatcgggtaaattgcgatcggggtctgcggccgtcctgcccgaactcccagagcccggtgaaagtggaagaaacctgcggctgccgctggacgtgtccgtgcgtttgcactggctcatctactcggcacatcgtgaccttcgatggtcaaaatttcaagctcactggaagctgctcgtacgtgctgttccagaacaaagaacaggacctggaagtgatcctccacaacggtgcttgctcacctggtgcccgccagggctgcatgaagtcgatcgaggtcaaacatagtgcactctcagtcgaactgcattctgatatggaagtgaccgtcaacggacggctggtgtccgtgccatacgtgggaggcaacatggaggtgaatgtgtacggggctatcatgcacgaagtcaggttcaatcaccttggacatattttcacgttcactcctcagaacaatgaattccagctgcagctctcgcctaagacttttgcgtcgaaaacttacggcctctgcggaatctgcgatgaaaacggagcgaacgactttatgcttcgggacggtactgtgaccactgactggaagacgctggtccaggaatggaccgtccagcgcccggggcagacctgccaacccatccttgaagagcaatgtctggtgccagactcttcacactgccaagtcctcctgctcccgctcttcgccgagtgccataaggtcttggcgccggctactttctacgctatctgccagcaggattcgtgtcaccaggagcaagtgtgcgaggtgatcgcctcatacgctcatctgtgccgcaccaacggagtgtgcgtggactggcggactcctgacttctgcgcgatgagctgccctccgtctcttgtttacaatcactgcgaacacgggtgcccgagacattgcgacggcaatgtgtcatcgtgcggcgatcacccgtcagaggggtgtttctgccctccagataaggttatgctcgaaggctcatgcgtcccagaggaagcctgcactcaatgcatcggcgaggacggagtgcaacaccagttcttggaagcctgggtcccggaccaccaaccgtgccaaatctgcacgtgtctcagcggacgcaaggtcaactgcactacccagccgtgcccgactgccaaagcccctacctgcgggctgtgcgaggttgcaagactgaggcaaaacgcggatcagtgctgcccggaatacgaatgtgtgtgtgatcccgtgagctgcgacctgccgcctgtcccgcactgcgagcgcggtctgcaaccgactttgaccaatccgggtgagtgtcgacctaatttcacctgcgcgtgcaggaaagaagaatgtaaaagggtgtcgccgccatcgtgcccaccacacaggctgccgactctgcggaagacccaatgctgcgacgaatacgagtgcgcctgtaactgcgtgaactccacggtttcgtgccctctgggatacttggcgagcactgcaaccaacgattgcggatgcaccactactacttgcctgccggacaaggtgtgcgtgcacagatcaactatctatcctgtgggccaattttgggaggaaggatgcgatgtgtgcacctgtactgacatggaggatgcagtgatgggactgcgggtcgctcagtgctctcaaaagccgtgtgaggactcctgcaggtcggggttcacctacgtgcttcatgagggggaatgttgcggcaggtgtttgccatcagcttgcgaagtggtcacgggctcgccgcggggtgacagccaatcatcttggaagtccgtcggttcccagtgggcctcccctgaaaatccatgtctcatcaatgaatgtgtccgggtcaaggaagaagtgtttatccagcagagaaacgtgtcctgtccccaacttgaggtcccggtttgcccaagcggattccaactctcgtgcaaaaccagcgcctgctgcccatcctgtcgctgcgagagaatggaggcctgtatgctgaatggtactgtgattggtccaggaaaaaccgtgatgatagacgtgtgcaccacgtgtcggtgcatggtacaggtcggtgtgatctcggggttcaaacttgagtgccgcaagaccacctgcaacccctgcccgctgggatacaaagaagagaataataccggggagtgctgcggcagatgcttgccaacggcgtgcaccatccagctgcgcggcggccaaatcatgacgctgaagcgggacgagactttgcaggacggatgcgacactcacttctgcaaggtgaacgaacggggtgagtacttctgggaaaagagggtcactggatgtccgcccttcgacgaacataagtgcttggctgaaggcggaaagataatgaaaattcctggcacctgctgcgacacttgcgaagaaccggagtgcaacgacatcactgctcggctccagtacgtgaaggtcggaagctgtaaatctgaagtcgaagtggacatccattactgccaaggcaagtgcgcttccaaggccatgtactccatcgacatcaacgacgtgcaagatcagtgctcatgctgtagccctactcggactgaacctatgcaggtggcactgcattgcactaacggatcggtggtttaccatgaagttctgaacgccatggagtgcaaatgcagcccgaggaagtgctctaag

SEQ ID NO: 21334 - DNA, 8439 bp, Artificial Sequence
  Description of Artificial Sequence: Synthetic coding sequence
atgatcccggccaggttcgcgggggtgctgctggctctggccctcattctgcctggaaccctctgcgctgaaggcacccgaggcagatcatctacggctagatgttctcttttcggcagcgatttcgttaatacattcgatgggtccatgtactcttttgctggatattgttcgtacctgctagccgggggctgccagaagcgcagtttttccatcataggcgatttccagaatggaaaaagagtctcactctcagtatatctaggggagttctttgatatccacctattcgtcaacggcacagtcacccaaggtgaccagagggttagtatgccctacgcatcaaagggtctgtaccttgagacagaggccggatactacaaattgtctggggaggcgtatggcttcgtggcacggattgacggaagcggaaatttccaggtgctcttgagcgaccggtattttaataagacgtgcggactgtgcggaaacttcaacatttttgcagaagatgactttatgacacaggagggcacgttaacgtcagatccgtacgacttcgctaactcctgggcgctgtccagcggggaacaatggtgtgagcgggccagccccccaagctcttcctgcaacatttcaagtggagagatgcagaaaggcctctgggagcagtgccagctcttgaagtcaacatctgtctttgcccggtgccacccattagtggaccccgagccgttcgtggctctctgtgaaaagacattatgtgagtgtgcaggtggtctcgagtgcgcctgtccagccctcttggaatacgcgagaacatgcgcacaggaaggtatggttctctacggctggacagatcacagtgcctgtagccccgtgtgccctgctggaatggagtaccgacagtgcgtctcgccctgtgccaggacgtgtcagtccctgcatataaatgaaatgtgccaagaacggtgtgtcgatggctgctcatgccctgagggccagctgttagatgagggattgtgcgtcgaaagcacagagtgtccctgtgtgcacagtggcaagagatatccaccaggaacctccctttctagagattgtaacacttgcatttgccggaatagccagtggatatgttctaacgaggaatgccccggggagtgccttgtgactggacagagccatttcaaatcctttgataatcggtacttcacgttctccggaatatgtcagtacttactggcgagagactgccaggatcatagcttttcgattgtcatagaaaccgtgcagtgtgcagatgatagggacgcggtttgtactaggagtgtaactgttcgtctgcctggattacacaactccctggttaagctgaaacacggggccggagttgccatggatgggcaggatgtgcagttaccactccttaagggggacctgcggattcagcacacggtgacggcaagcgtacgcttgagttacggtgaagatctccaaatggactgggatggcaggggcagacttctggtcaaattatccccagtgtacgcaggcaagacatgtggactatgcggcaattacaatggaaatcagggcgatgactttctgacgccctccggactggctgagcctcgagttgaggactttggcaatgcttggaagctgcacggtgactgccaggatttgcagaagcagcatagtgacccatgcgctcttaacccccggatgacacgcttttccgaggaagcgtgtgcggtgctgacgtcacccacatttgaggcttgccaccgggcagtgagcccattgccctatctgcgtaactgcaggtacgatgtttgctcctgcagcgacgggcgcgagtgcctttgtggcgctctcgcctcctacgccgctgcatgtgctggccgtggagtgagggtggcttggagagagccaggccgctgtgagttaaactgcccgaaaggacaggtttatcttcagtgtggaaccccatgtaacctgacttgtcgatcactgtcctacccggatgaggagtgcaacgaggcttgtctggagggatgtttctgtcctccaggactgtacatggacgaacggggcgactgcgttcccaaagcacagtgcccatgttactacgacggcgagattttccagccggaggatatctttagcgatcatcacaccatgtgttactgcgaggacggatttatgcactgcacaatgtccggggtgcctggttccttgcttccggacgcagtgctttcatctccactctcccatcggtctaaacgatccctctcctgccgtccacctatggtgaagctagtgtgcccagctgacaatttaagggccgaaggcttggaatgtaccaagacgtgccagaactacgatctggaatgtatgtctatgggctgcgtgtccggctgtctgtgtcctccaggcatggtgcggcacgagaaccggtgcgtggcattagaacgctgcccctgtttccaccagggcaaggagtatgctcccggcgaaaccgtcaagattggttgcaatacctgtgtctgtcaagaccgcaaatggaattgcaccgaccacgtatgtgatgccacctgttctaccatcggtatggcccactacctcactttcgatggcctgaaatatttgtttcctggggaatgccagtacgtgctggtgcaggattattgtggatcaaatccaggtacctttcgaatcctggtagggaataagggctgcagccaccccagcgttaaatgcaagaaaagggtgacgatcttagtcgagggcggggaaatcgagctctttgacggcgaagtcaacgtgaaacgacccatgaaggatgagacacacttcgaagtggtcgaaagtggaagatacatcatcttgctgctgggcaaagcactgagcgtggtttgggaccgccacctgtcaataagtgtggttctcaaacagacataccaggaaaaagtttgtggtctgtgtggcaattttgatgggattcagaacaacgatttgactagctctaacctgcaagtggaggaagatcccgttgactttggcaactcctggaaagtgagtagtcagtgtgcggatacccgtaaagtgcccctggactccagccccgcaacctgccataataacatcatgaagcagacaatggtggatagctcgtgtcgtatcctcacgagcgacgtgtttcaggattgcaataaactggttgatcccgagccatacctggatgtctgcatatacgacacatgctcttgtgagtcgatcggagattgcgcctgtttttgtgatactattgcggcttatgctcacgtctgcgcgcagcatggcaaagttgtcacttggcggacagccacgctgtgcccccagagctgcgaggaaaggaacctcagagagaatgggtacgaatgtgagtggaggtacaactcatgtgccccagcctgccaggtgacatgtcagcatcctgagcccctcgcttgccctgtgcagtgtgtcgaggggtgtcatgcccattgtccgcccggcaagattctcgatgagctgctccagacttgcgtcgatcctgaggactgccccgtgtgtgaggtagcaggaaggcggtttgctagcggtaagaaagtaaccttgaacccttcagaccctgaacactgccagatctgtcactgtgatgttgtcaacctgacttgtgaagcttgccaagagcctgggggcctcgtggttcctccaacagacgcccccgtatctccgacaactctgtacgtcgaagatattagtgaaccccccctgcacgatttctattgttcacgccttttggatctggtgtttttgttggacgggagtagccgattgtctgaagccgagtttgaagtcttgaaggcgtttgtggtggacatgatggagaggttgagaatcagccaaaagtgggttagagtcgccgtagtggagtatcatgatggctctcacgcctatattgggctcaaggacagaaaacgccccagcgagcttcgacgcatcgcctcacaggtgaaatacgcaggatcccaggtcgcgagcacttccgaggtgctcaaatatactttattccagattttctcaaaaatcgatcgccccgaagcttcccggatcacactgctgctcatggccagccaggagcctcaaaggatgtctcggaactttgtgaggtacgtgcaaggactgaaaaagaaaaaggttattgtgatccctgtcgggattggaccccacgcgaatcttaagcagattcggttgatcgagaagcaagcaccggagaacaaggcctttgtcctttcttcagtggacgagctggaacaacagcgcgacgagatagtgtcttacctgtgcgacttggcacccgaggcaccgccccctactttgcctccagacatggcccaggtgacggttggccccggtctgttgggcgtttcaactctcgggccaaaacgcaattcaatggtcctggatgtagcttttgtactcgagggctccgacaagatcggggaggctgatttcaacaggtcaaaagagttcatggaagaggttatccagcggatggatgttggacaggacagtatacacgtcaccgtgttgcaatattcatatatggtcacggtggagtaccccttctcggaagcccagagtaaaggggatatactgcagcgcgtacgggaaatccgctatcagggcggcaatcggactaataccggcttagcgctgagatacctgtcagatcacagcttccttgtgagccagggcgaccgggagcaggcgccaaacctcgtgtacatggtgacaggaaacccggcctctgacgagattaaacgcctgcctggtgatatccaggtggtacctataggagtgggcccaaacgccaacgtccaggagttagagcggatcggctggccgaacgcacccatattaatccaagacttcgaaactctacctcgcgaggcccccgatcttgtgttgcagcgctgctgtagcggggagggtttacagattcccaccctgagccctgccccagattgctcacaaccactggatgtcatcttgctcttagacggctcatcaagcttcccagcatcttatttcgacgagatgaaatccttcgccaaagcctttatcagcaaggcgaatatcggcccacgccttacccaggtgagcgtcctgcaatatgggagtataactaccatcgacgtgccctggaacgtggttccggaaaaggctcatctgctgtctcttgtcgatgtgatgcagagagagggtgggcccagtcagattggcgacgctctaggttttgctgtcagatacctgacgtccgagatgcatggggcccgacccggtgcctccaaagcagtggtgattctggtgaccgatgtgtccgtcgattcagtggacgccgcggccgatgctgctaggagcaaccgagtgacagtatttccgattgggataggagatcgttatgatgctgcccaattgaggatcctggctggcccagcaggggacagcaacgtcgtgaagctccagcgtatagaagatctcccaacaatggtgacgctggggaattcgttcttgcacaagctttgttcaggctttgttagaatttgcatggatgaagatggcaacgaaaaaaggccaggggatgtgtggacactccctgaccaatgtcacactgtgacgtgccagcccgacggccagaccctgttaaaatcgcaccgcgtgaattgcgataggggattgagacccagttgtcccaactcgcagagtccagttaaagtcgaggagacctgtggttgtagatggacctgcccctgcgtgtgtaccggctccagtaccaggcatatagtcacattcgacgggcagaatttcaaacttacaggaagctgttcatatgtactgttccagaacaaagaacaggatctggaagtgattcttcacaatggggcttgctcgcccggcgctagacaaggttgcatgaaaagtatagaagtgaagcacagcgccttgtccgttgaactgcacagcgatatggaagtgactgtcaacggaaggctggtctcggttccctacgtggggggtaatatggaagtaaacgtgtatggagcaatcatgcatgaggtaaggttcaatcacctgggtcatatatttacctttactccacagaataacgaattccagctacagttgagtcctaaaacgttcgcctcaaaaacatatggattatgtggaatctgcgacgagaacggtgccaacgactttatgctgcgcgatgggacagtgaccaccgactggaagactttagtccaggagtggaccgtgcagcggcccggacagacatgccaaccaatcctcgaagagcagtgcttagtgcccgattcatcccactgccaagtgctccttctccccttgttcgcagagtgtcataaggtcctggcccctgctacattctatgcaatctgccagcaagactcctgtcaccaagagcaggtgtgcgaggtgatagcttcttacgctcatctgtgcagaaccaacggcgtgtgtgtcgattggcgtactccagacttctgtgctatgagttgccccccaagtttggtgtataaccactgtgaacacggttgcccccgtcactgcgacgggaatgttagtagctgtggtgaccatccctcagagggctgcttttgtcccccagataaagtgatgttggagggcagctgtgttcctgaggaggcctgcacacagtgcattggcgaggatggcgtacagcatcagtttctcgaagcctgggtgcctgaccatcagccatgtcagatctgtacttgtttatctgggagaaaagtgaactgcactacacaaccttgccccaccgccaaagcccccacttgtggcctgtgcgaggtggccaggctgagacagaacgcggaccagtgctgtccggaatacgagtgcgtgtgcgacccagtgagctgcgacctaccaccagtgccccactgtgagcgggggttgcaaccaaccctgacaaaccccggggaatgcagaccaaacttcacatgcgcttgccgcaaggaggagtgtaaacgcgtcagccctcccagttgcccccctcatagactgcccaccctcaggaagacacagtgttgcgacgaatatgaatgcgcctgcaactgcgtgaatagtacggtgtcttgccctcttggatatctggcaagtaccgcgactaacgactgcgggtgcactaccacaacgtgtctgcctgacaaggtgtgtgtacaccgctctactatctatcccgtgggtcagttctgggaggagggatgtgacgtctgtacatgtacggatatggaagatgccgttatgggacttagggtggcgcagtgctctcagaagccttgcgaagactcctgtaggtcaggctttacatacgttctgcatgaaggcgaatgttgtgggcgctgtctgccaagcgcttgcgaagtggttaccggctctcccagaggcgacagccagagctcctggaaaagcgttggcagccagtgggctagccccgagaacccctgcctgattaacgagtgtgtgcgggtgaaggaggaagttttcatccagcaacgaaatgtgagctgcccacagttggaggtgcccgtgtgtcctagtggcttccagctgtcctgtaaaacttcagcgtgctgtccatcctgccggtgcgaacgcatggaggcgtgcatgctgaacggcactgtaatcgggccagggaagaccgtcatgattgatgtctgtaccacgtgtaggtgtatggtccaagtaggagtaatttcgggtttcaagctcgaatgcagaaagaccacatgtaacccttgcccacttggttacaaggaagaaaataacaccggggaatgctgcgggcgatgtctacccacagcatgcacaatacagctgcgcggaggacagatcatgacgcttaagagagatgagacactgcaggacggctgtgatacccacttttgcaaggtgaacgagaggggggagtacttctgggagaaacgggtgactgggtgccctccctttgacgaacataaatgccttgccgagggaggaaagatcatgaagatccccggaacatgttgtgacacttgtgaggagccagaatgtaatgacattacagcacggttacaatatgtaaaagtcgggagctgcaagagtgaagtggaagtggacatccattattgccagggcaagtgcgcctctaaagctatgtattccatcgatataaatgatgtgcaggaccagtgttcttgctgttctcctacgagaacggaacccatgcaggtggcgttgcactgcaccaatggatcagtggtttatcatgaggtgcttaacgcaatggagtgcaagtgttcgcctcgcaaatgtagtaag

SEQ ID NO: 21335 - DNA, 8439 bp, Artificial Sequence
  Description of Artificial Sequence: Synthetic coding sequence
atgattcccgccagattcgccggagtgctgttggcacttgcactgatcttgccgggcacgctctgtgctgaaggtaccagaggacgctcctccaccgctcggtgctcgctgttcgggtcagactttgtgaacacttttgacggatcaatgtactcgtttgctggatactgctcatacctcctggccgggggatgtcaaaagcggtcattctcgatcatcggagattttcaaaacggaaagagagtcagcctcagcgtgtacctgggagagttctttgacatccatctgttcgtgaatggaaccgtcactcagggcgaccagagagtgagcatgccttacgccagcaaaggattgtacctcgaaaccgaggcaggctactacaaacttagcggtgaagcctacggattcgtggctcggatcgatggcagcggtaactttcaagtcctgctgtcggatcggtatttcaacaagacttgcggcctgtgcggaaacttcaacatcttcgcggaagatgacttcatgacccaggagggcactctgacttccgacccatacgatttcgccaactcgtgggccctgtcatcaggcgaacaatggtgtgaaagggcgtcacccccatcgtcatcatgcaacatcagctctggtgaaatgcagaagggcctgtgggagcagtgccagctcttgaagtcgacctccgtgtttgcaagatgtcacccgctggtagatccagaaccgttcgtggctctgtgcgaaaagaccctctgtgaatgcgcaggcggccttgagtgcgcttgcccggccctgctcgagtacgctcggacttgcgcacaagagggaatggtgctgtacggatggactgaccattcagcctgctccccggtgtgtcctgcaggaatggaatacagacagtgtgtctcaccgtgcgccagaacgtgccagtcgctccacatcaatgagatgtgccaagaacgctgcgtggatggctgctcatgcccagagggccagctcctcgacgaggggctgtgcgttgagtccaccgagtgcccgtgtgtgcattccggcaagagatacccgcctgggaccagcctcagcagggattgcaacacgtgtatttgccgcaactcacagtggatctgctcgaacgaagaatgcccgggagagtgcctggtcacgggacagagccatttcaaatcattcgacaacaggtatttcacgttctcaggaatctgccagtacttgctggccagggattgccaggaccattcctttagcatcgtgatcgaaaccgtgcagtgcgctgatgaccgggacgcggtgtgtactagatcagtcaccgtgaggctgccaggactccataactccctcgtgaagttgaagcatggcgcgggcgtggcaatggatgggcaggacgtgcagctccctctcctgaaaggagatctgcgcattcagcatacggttaccgcgagcgtccgcctgtcctacggcgaggacctgcaaatggactgggatggacgcggaaggctgctcgtcaaactgtcgccagtctacgccggaaagacctgcggactgtgcgggaactacaacggaaatcaaggcgacgatttcctgacgccttcaggattggccgaaccgcgagtggaagattttgggaacgcgtggaagctccacggagattgccaggatctgcaaaagcagcattccgatccgtgcgcactcaatccccgcatgaccagattctccgaggaagcatgtgccgtgcttacgtcaccgacctttgaggcttgtcatagagccgtctcaccgctgccttacctgcggaattgccgctacgacgtgtgctcctgttctgacggacgtgaatgcctgtgtggcgcgctggcctcctacgccgctgcttgtgctggccggggagtgagagtggcgtggcgggaacccggccgatgcgaactgaactgcccgaagggccaggtctacctccagtgtggaactccttgtaatcttacttgcagatcactgtcgtacccggatgaggagtgtaatgaggcgtgcctggagggttgcttttgccctccaggactctatatggacgagcgcggtgactgcgtgccaaaggcgcagtgcccatgctactacgatggggagattttccagccggaagatatctttagcgatcatcacactatgtgctactgcgaagatggcttcatgcactgcaccatgtcaggagtgccagggagccttctccccgacgccgtgctttcatcgccgctctcacaccggtcgaaacgcagcctctcatgccggccgccgatggtgaaacttgtgtgcccagccgacaacttgcgcgcggagggcctggaatgcaccaagacttgccagaattacgacctggaatgcatgtcaatgggatgcgtgagcggatgcctgtgtcccccggggatggtccggcacgaaaatcggtgcgtggcactcgaacgctgtccatgctttcaccaggggaaggaatacgcgccgggtgaaaccgtcaagatcggttgtaatacttgcgtgtgccaggatagaaagtggaattgcaccgaccacgtgtgcgacgccacgtgcagcaccatcggcatggcccactacctgacttttgacggccttaagtatctctttccgggagaatgccagtacgtgctggtgcaggattattgcggttcaaacccaggaaccttcagaatccttgtgggaaacaagggatgctcccatccatccgtcaaatgtaagaaaagagtgaccatcctcgtggagggaggcgaaatcgaactgttcgacggagaggtgaacgtcaagcgccccatgaaagacgaaactcacttcgaggtggtggaatccggaaggtatatcatcctcctcctgggaaaagcactctccgtggtgtgggaccggcacctctcaatctccgtcgtgcttaagcagacctaccaggaaaaggtgtgcgggttgtgtggcaatttcgacggcatccagaacaacgacctcacctctagcaatctgcaggtggaggaggacccagtcgacttcggtaactcatggaaagtgtcaagccagtgcgcggacacgaggaaagtgcctctggacagctcccccgccacctgccataacaatatcatgaagcaaaccatggtcgactcatcgtgccgcattcttacctccgatgtgttccaggattgcaacaagctggtggatccagagccttaccttgacgtgtgcatctacgacacctgcagctgcgaatcgatcggagattgcgcttgcttctgtgacactatcgcagcctacgctcatgtgtgcgcccagcatggaaaggtggtgacctggcgcaccgccaccctgtgccctcagtcatgcgaggagcgcaatcttcgcgaaaacggatatgaatgtgaatggcgatacaacagctgcgctccagcttgccaagtgacctgccaacatccagagccgctggcatgtcctgtccagtgtgtggaaggatgtcacgcccactgcccaccgggaaagattcttgacgagctccttcaaacttgcgtggatcccgaggactgtcctgtgtgcgaagttgccgggcgcagattcgcctccggtaagaaagtgaccctgaacccaagcgacccggagcactgccagatttgtcactgcgacgtcgttaacctcacctgcgaagcctgccaagaacctggcggactcgtggtgccgccaaccgacgcgcctgtcagcccgaccactctgtatgtcgaagatatctcggagccacctctgcacgacttctactgctcgagactcttggatctggtgttcctgctcgacggatcgtcgaggctctcggaggcggaattcgaggtgctgaaggcttttgtggtggatatgatggagcgcctccgcataagccaaaagtgggtccgcgtcgcagtcgtggaataccacgatggctcccatgcttacatcggactgaaagaccgcaagcgcccgtccgagctgcggagaatcgcttcacaggtgaagtacgcgggttcccaagtggcatccactagcgaagtcttgaagtacaccctctttcagatcttctcaaagatcgacaggccagaggcgtcgcgcatcaccctgctgctgatggcgtcgcaagaacctcagagaatgtcccggaacttcgtccggtacgtgcagggcttgaaaaagaagaaggttatcgtgattccagtcggtatcggcccacacgctaatctcaagcagatccgcctcatcgagaaacaagccccagagaataaggcctttgtcctctccagcgtcgacgagttggagcaacagcgcgatgagatcgtctcctatctgtgtgatttggcacccgaggccccaccgccaactctgccaccagatatggcgcaggtgactgtgggcccgggtctgctgggtgtgtcgacgcttgggccgaaaaggaactcaatggtgctggacgtggccttcgtgcttgagggatcagacaaaattggagaggcagatttcaaccgcagcaaggaattcatggaagaagtgatccagaggatggacgtgggtcaggactcaattcacgtgaccgtacttcaatactcgtacatggtcacggtggaataccccttctccgaagctcaaagcaaaggtgatatcctgcagcgcgtgcgggaaatccggtaccagggcggaaatcgcaccaataccggactggcactccggtacctgtccgaccactcgtttctggtgtcacaaggcgaccgggaacaagcccctaatctggtgtacatggtgactgggaacccagccagcgatgagatcaagaggctgcctggagatatccaagtggtgccaatcggagtgggccctaatgccaacgtccaggagctcgaacggatcggatggccgaatgccccgatcctgatccaggacttcgaaacgctccctcgagaggcaccagacttggtgctgcaacggtgctgctccggggaaggactccagatcccaactctctcgccagcaccggattgttcgcaaccgctggatgtgatcctgctgctggacggatcctcctcattccctgcctcgtacttcgatgaaatgaagagttttgccaaagcatttatctccaaagcgaatatcggaccgcggttgacgcaggtgtccgtgctccaatatggatcgattaccacgatcgatgtgccttggaacgtggtgcctgaaaaggcccaccttctgagcctggtcgacgtcatgcagagggagggaggaccatcccagatcggagacgcgctggggttcgccgtccgctacctgacttcagagatgcacggagcccgccccggagcctccaaagccgtggtgatcctggtcaccgacgtgagcgtggattcggtggatgcggcggccgatgctgctcggtcgaacagggtcactgtctttccgatcgggataggagacaggtacgacgccgctcagcttcggatcctggcgggtccggcgggggactcaaatgtcgtgaagctgcagcgcatcgaagatctcccgaccatggtgactctcggtaattcgttcctgcataagttgtgtagcggtttcgtgaggatctgcatggacgaggacgggaacgagaagcggccaggagacgtgtggactttgccagaccagtgccacactgtcacctgccaacccgatggacagactttgctcaagtcacatagagtgaactgcgaccgcggactccgcccttcctgccccaactcgcagtcgccggtcaaggtcgaagaaacctgcggatgtagatggacctgcccctgtgtctgcactggatcgtctaccagacacatcgtcaccttcgacggacagaacttcaagctcaccggcagctgtagctacgtgctgttccagaataaggagcaggaccttgaggtgattctccacaacggcgcttgcagcccgggagcaagacagggatgcatgaagtcaatcgaggtgaaacattccgccctgtctgttgaattgcattccgacatggaagtgactgtgaatggtaggctcgtgtcagtcccttacgttggcggtaatatggaagtgaacgtctacggagctatcatgcacgaggtccggttcaatcacttgggccacatctttaccttcactcctcagaacaacgagtttcagctgcaactgtctccaaaaacgttcgccagcaagacctatggactgtgtggcatctgtgatgaaaacggcgccaacgactttatgctgcgggacggcaccgtgactactgactggaaaactctggtccaagaatggaccgtccaaagaccggggcaaacctgtcagccgattctggaggagcagtgcctggtgccggacagctcgcactgtcaagttctgctgctccctctgttcgctgagtgccacaaagtccttgccccagctaccttctacgcgatctgccagcaagacagctgccaccaagaacaagtgtgcgaagtgatcgctagctacgcacacctgtgccgcacgaacggggtgtgtgtggactggcggaccccggatttctgcgctatgtcgtgcccaccgtcgctggtctacaaccactgcgagcatggctgcccgcgccattgcgacggaaacgtgagctcgtgcggagatcatcctagcgaaggctgcttctgcccgcccgataaagtgatgctggaaggatcatgcgttccggaggaggcatgcactcagtgtatcggtgaggatggggtccagcaccagttcctggaggcttgggtaccggaccatcagccttgccaaatctgcacctgtctgtcaggacgcaaggtgaattgcaccacccaaccgtgtccgactgcgaaggcaccgacttgcggactgtgtgaagtggctcgcttgagacagaatgccgatcagtgctgcccagaatatgaatgcgtgtgcgacccggtgtcctgtgacctgccaccggtccctcattgcgaaaggggactgcaaccgactcttactaaccccggcgaatgccgcccgaatttcacttgcgcctgtcgcaaggaagaatgcaagcgggtcagccctccgtcctgcccgccgcacagactcccgaccctccgcaagacgcagtgttgcgatgaatacgaatgcgcatgtaattgcgtgaatagcactgtgagctgcccactgggataccttgcgagcactgcgactaatgattgcggttgcactaccacgacctgcctgccagacaaggtttgcgtccacagatccactatttaccctgtgggacaattttgggaagagggctgcgacgtgtgcacttgtacggatatggaggatgccgtcatgggtctgcgggtggcacagtgctcgcagaagccttgcgaggactcatgtagatcaggcttcacctacgtgctccacgaaggtgaatgctgcgggcggtgcctcccaagcgcatgcgaagtcgtgactggcagcccaaggggagactcacagtcatcatggaagtcggtgggtagccagtgggcatcaccggagaatccttgcctgattaatgaatgcgtccgcgtcaaagaggaggtgtttatccagcagcgcaatgtgtcctgcccacagctggaggtgccagtgtgtccgtcaggcttccagcttagctgtaagacttccgcgtgctgcccgtcatgccgctgcgagcgcatggaggcttgcatgctgaatggaactgtgatcgggccgggaaagactgtgatgatcgatgtgtgcacgacctgcagatgcatggtccaggtgggcgtgatttcgggattcaaactggaatgtagaaagaccacttgcaacccatgcccactgggctacaaggaggaaaacaataccggagagtgctgcggtcgctgcctcccaactgcttgtaccatccagctcagaggaggacagatcatgaccctgaagcgggatgaaaccttgcaggatgggtgtgacacccacttctgcaaggtgaacgaacggggagagtacttttgggaaaaacgagtgactggctgccccccttttgacgaacataaatgcctcgccgaaggcgggaagatcatgaagatccccggcacctgttgtgatacttgcgaggaaccggagtgtaacgacattacggcccgcctgcagtacgtgaaagtggggtcatgcaagtcagaagtcgaagtcgacatccattactgccagggcaaatgtgcttccaaggccatgtactccatcgatatcaacgatgtgcaggaccaatgctcgtgttgcagtccgacccgcactgagccgatgcaagtggcgctccactgcactaatggttcggtggtttaccacgaagtgttgaatgctatggagtgcaaatgtagcccccgcaagtgcagcaag

SEQ ID NO: 21336 - DNA, 8439 bp, Artificial Sequence
  Description of Artificial Sequence: Synthetic coding sequence
atgatcccggcaaggttcgctggtgtgctgctcgcactggccttgatcctccctggaaccttgtgcgcggaaggcactcgcggacgttcctcaactgcgcggtgctccctgtttggatccgacttcgtgaacaccttcgacggcagcatgtacagcttcgcgggatactgctcgtacctgctggcgggaggatgtcagaagaggtcattctcaatcatcggcgatttccagaacggaaagcgcgtgagtctgtcagtgtacctgggagagttctttgacatccatctgttcgtgaacggcactgtaacccaaggagatcagcgcgtctccatgccgtacgcttccaagggcctgtacctcgaaaccgaagccggctactacaagctgtccggcgaggcctacgggttcgtcgctaggattgatggctccggaaacttccaggtgcttctgtccgacagatacttcaataagacctgcggactctgtggcaacttcaatatcttcgccgaggacgattttatgactcaggagggaaccctgacctcagacccatacgacttcgccaacagctgggccctttcttcgggagagcaatggtgcgaaagagcttccccgccctcatcgtcgtgcaatattagttcgggggagatgcaaaaaggactgtgggaacaatgccaactgcttaagtcgacctcagtgttcgcacggtgccatccgctggtcgatccggaaccatttgtcgcactgtgcgaaaagactctgtgtgagtgcgcaggaggactggaatgtgcgtgcccggctctgctcgaatatgcccgaacctgcgcccaagaaggaatggtgctttacggatggaccgaccattccgcttgctcgccagtttgcccagcagggatggaataccgccaatgcgtgagcccttgcgccagaacctgtcaatccctgcatatcaatgaaatgtgccaggagcggtgcgtggacggatgctcctgcccagaaggccagctcctggacgagggcctgtgtgttgaatcgactgagtgcccatgcgttcactccggcaagagatacccacccgggacctcgctgtccagggactgcaacacttgcatttgccggaattcccagtggatctgcagcaacgaagagtgcccaggggaatgtctcgtgaccggacagtcacacttcaagagcttcgataatagatactttacttttagtggaatttgccagtacctgctcgcgagagattgtcaggaccattcgttctcgatcgtgatcgagactgtgcagtgcgcggacgacagggacgcagtgtgcacccggagcgtgaccgtcagacttcccgggctgcataactccctcgtgaagctgaagcacggagctggcgtggctatggatggccaggacgtgcagcttccgctcctgaaaggagatctgcgcatccaacacaccgtcaccgcctccgtgagactgagctacggggaggatcttcagatggactgggacggacggggccggctgctcgttaaactctccccagtgtacgccggaaagacctgtggattgtgtggaaattacaatggaaaccaaggagacgattttctcactccatccgggctggcagagccgagggtcgaggacttcggtaacgcgtggaaactgcacggtgattgccaggacttgcaaaagcagcatagtgatccgtgcgcactgaacccccggatgacccgcttctccgaagaggcttgtgccgtgctcacctcgcccactttcgaagcgtgccaccgcgctgtgagcccgctgccgtacctccgcaattgccggtacgatgtatgctcgtgttccgacggtcgggaatgcctgtgtggtgccctggccagctacgcggcggcgtgcgccggaaggggcgtgcgggtggcctggcgcgagcccggacggtgcgaactgaactgcccgaagggacaggtgtaccttcagtgcggaaccccttgcaatctcacttgtcgctcgctctcctatccggatgaggagtgcaatgaagcctgtctggaggggtgtttttgtcctccgggtctgtacatggatgagcgcggagattgcgtgccgaaggcccaatgtccctgctactacgacggtgaaatctttcaaccggaagatattttctcagatcaccacaccatgtgctattgcgaggatggattcatgcactgtactatgtcaggagtgccaggatcccttctccctgacgccgttctgtcgtcgccgctgtcgcacagatcaaagcgctccctttcatgccgaccaccgatggtgaagctcgtctgtccggccgacaatctgcgcgccgaggggctggaatgtactaagacttgccaaaactacgacctggaatgcatgtctatgggctgcgtgtccggatgcctttgccccccagggatggtgcgccatgaaaaccgctgcgtggccctggaaagatgcccatgttttcaccaggggaaggagtacgccccgggggaaactgtgaagatcggatgtaacacctgtgtatgccaggacagaaagtggaactgcaccgatcacgtttgtgacgccacgtgctcgactatcggaatggcccactacctgacgttcgacggtttgaaatatttgttcccaggagaatgccaatacgtgctggtgcaggactactgcggatcaaaccctggaacttttagaatacttgtcggaaacaaaggatgctcccacccctcggtgaagtgcaagaaacgcgtgactatcttggtggaaggaggcgaaattgaactgttcgacggagaagtcaatgtgaagaggccaatgaaggacgagactcactttgaagtggttgaaagcggtcggtacatcatactgctccttggcaaggcgctgagcgtggtgtgggatcgccatctgtccatctccgttgtgctcaagcagacttaccaggagaaggtgtgcgggttgtgtggtaacttcgacggtatccaaaacaatgatcttacctcctctaacttgcaggtcgaggaagatccagtcgacttcgggaacagctggaaggtgtcgagccagtgcgccgacacgagaaaagtccctcttgattcgtcgccagctacctgccataacaacatcatgaaacagactatggtcgactcatcgtgtcggatcctgactagtgacgtgttccaagattgcaacaagctggtcgaccccgaaccttacctcgacgtgtgcatctatgacacttgcagctgcgaatcaatcggggattgtgcatgcttctgcgacaccatcgcggcgtacgcacatgtctgcgcccagcacgggaaggtcgtcacctggaggacggccactctctgcccccagagttgtgaggaaagaaatctgcgggagaatgggtatgagtgcgagtggcggtacaactcgtgcgccccggcgtgtcaggtcacctgccagcaccctgaacctctcgcatgcccagtgcaatgcgtcgaaggatgccatgctcattgcccgccgggtaagatcctggatgagctgctgcaaacttgcgtggacccggaagattgccccgtgtgcgaagtggctggacggcgctttgcttcaggtaaaaaggtgaccctcaacccgtccgaccccgagcactgtcaaatttgccattgcgacgtcgtgaacttgacttgtgaggcatgtcaggaaccaggcggcctggtggtgccgccgaccgacgcgccggtgtcaccgaccaccctctacgtggaggacatctccgaaccacctctccacgatttctactgttcccgcctcttggacctggtgttcttgctggatggatcgtcgcgactgtcagaggccgaatttgaggtgctcaaagcattcgtggtggatatgatggaacggctgagaataagccagaagtgggtccgggtcgcagtcgtggagtaccacgacggatcgcatgcctacatcggtcttaaggaccggaagcgcccaagcgaattgaggcgcattgcaagccaagtcaaatacgctggatcccaggtggcaagcacctcggaggtgttgaaatataccctcttccagatcttttccaaaatcgaccgaccagaagctagccgcatcaccctcctgctgatggcgagccaggaaccgcagagaatgagccgcaacttcgtgaggtacgtgcagggactcaagaagaagaaggtgattgtcatcccggtgggaatcggtcctcacgcaaatctgaagcagatcagactcatcgagaagcaggcaccggaaaacaaggccttcgtcctgtcgagcgtggatgaactggagcagcaacgggatgagattgtgtcatacctttgtgacctcgctccggaggctccgcctccgaccctcccgcctgatatggcccaagtgaccgtcggccctggactgctgggcgtcagcaccctcggaccgaagagaaactcgatggtgctggatgtcgccttcgtactggaaggctcagacaagatcggagaggccgactttaaccgctctaaagagtttatggaggaagtgatccaaaggatggatgtgggacaagactcgatccatgttaccgtgctgcaatactcgtacatggtgaccgtggaatacccgttctcggaggcccagtcgaagggcgatatcctccagcgggtgcgggagattagataccaaggaggaaaccggacgaacaccggtctggctttgcggtacctgtctgaccacagctttctcgtgagccaaggcgaccgagaacaggccccaaatctggtgtacatggtcactggaaacccggcctcagatgaaatcaagcgcctgcctggagacatccaagtcgtccccatcggcgtggggccaaacgcaaacgtgcaggagctcgaacgcattgggtggccaaatgctccgatcctgattcaggacttcgagactctccctcgggaagcaccggatttggtcctgcagcggtgttgctccggcgaaggactccagatccctaccctgtcaccagccccggattgctctcagcctctcgacgtgatcctcctgctcgatggaagctccagcttcccagcctcatacttcgacgaaatgaaatcattcgcgaaagccttcatcagcaaagccaatatcggcccacggctcacccaagtgtccgtccttcaatacggctcgatcactaccatcgatgttccgtggaacgtggtccctgagaaggctcacctcctctcgctggtggatgtgatgcagcgcgaagggggaccatcacagatcggcgacgctctgggatttgccgtgcgctacctgacttcggaaatgcacggtgcacggccgggggcctcgaaggcggtcgtgatcttggtcaccgacgtctcggtggactcagtggatgcggccgccgatgcggcgaggtccaaccgcgtcacggtgttcccaatcggtatcggagacagatatgacgccgcccaactgcgcattctggccggacccgccggagactcgaacgtggtgaaactgcagcgcatcgaggacctgccgacgatggtgactttgggcaattccttcctgcacaagctctgcagcggattcgtccggatctgtatggacgaggatggcaatgaaaaacggccgggagacgtctggaccctgccggaccaatgccacacggtgacgtgtcaaccggacggtcagaccctgctgaagagccacagggtcaactgtgaccggggactccgcccctcttgcccgaactcccaaagccctgtgaaggtcgaagaaacgtgtggatgccgctggacctgcccttgtgtgtgtaccggttcctccactcgtcacatcgtgactttcgacggccagaacttcaagctcaccgggtcatgctcatacgtgttgttccagaataaggagcaggatctcgaagtgatcttgcataacggggcgtgcagccctggagcacgccaaggatgtatgaaatcgatcgaagtgaaacatagcgcgctgtctgtggaacttcacagcgatatggaggtcaccgtcaatggcagactcgtgtccgtgccttacgtcggaggcaacatggaggtgaatgtgtacggagcgatcatgcacgaagtcagattcaatcatctcggacatatcttcaccttcaccccacagaacaacgaattccaattgcagctgtcgccgaaaactttcgcatcaaaaacgtacggactttgcggcatttgcgacgaaaacggcgctaatgacttcatgctccgggacggaaccgtcactactgattggaaaacgctcgtgcaggaatggaccgtgcagcggccggggcagacgtgtcagcccatcctggaggaacagtgtctcgtgccggatagcagccactgccaggtcctcttgctgccacttttcgccgaatgtcacaaggtgctggctccagcgactttttacgctatctgccagcaagattcctgccaccaggaacaagtgtgcgaggtgatcgcatcatacgcacacctgtgccgcacgaatggtgtgtgcgttgattggcggacgccggacttctgcgccatgtcgtgccctccaagtctggtctacaaccattgcgagcacggatgtccacggcactgcgatggtaacgtgtcgtcctgcggggatcatccgtcggaggggtgcttttgtccgccggacaaggtaatgctggaaggatcctgcgtgcctgaagaagcgtgcactcagtgcatcggcgaggacggcgtgcaacatcaattcctcgaagcctgggtgccggatcaccagccgtgtcagatctgtacttgcctgtcgggacgtaaggtgaattgcactacccagccgtgcccgactgccaaagcgcctacctgtggcctctgtgaagtcgccagactgagacagaacgcggaccagtgttgcccggagtacgaatgtgtctgcgatcctgtgtcctgcgacttgccgccggtgccgcactgcgaaagggggctccaacccacgcttactaacccaggcgagtgccgccctaatttcacttgcgcctgccggaaggaagagtgcaagcgtgttagccctccatcctgtccgccgcaccgcctgcccaccctgaggaaaactcaatgctgcgacgaatacgaatgcgcatgtaattgcgtcaattcgactgtctcatgcccgctgggctacttggcctcgaccgctacgaacgactgcggatgtaccactaccacttgcctcccagacaaggtctgcgtccataggtcaaccatctaccccgtgggccaattttgggaggagggttgcgatgtctgtacctgcaccgacatggaggatgcggtgatgggactgcgcgtggcacagtgcagccagaaaccatgtgaggactcatgtcgctcgggatttacttacgtgctgcacgaaggtgaatgctgcggtcgctgcctgcctagcgcatgcgaggtcgtgactggttcaccgcggggagactcccagagctcatggaagagcgtgggaagccaatgggcatccccagagaacccctgcttgatcaacgaatgcgtgcgcgtcaaggaggaggtttttattcagcagagaaacgtgagctgcccgcaacttgaggtgccggtctgcccgagcggtttccaactctcctgcaaaacctcggcgtgctgcccatcatgccgctgcgagcggatggaggcgtgcatgctcaacggcaccgtgatcggcccgggcaagaccgtgatgatcgacgtctgcaccacgtgccggtgcatggtccaggttggagtgatctcgggcttcaagttggaatgccgtaagaccacctgcaatccatgcccactggggtataaagaagagaataacactggagagtgctgcggaagatgccttccaactgcctgcactatccagctgagaggagggcagatcatgactctgaagcgcgatgagactctgcaagacggatgcgacactcatttttgcaaagtgaacgagcgaggagaatacttctgggaaaagcgagtcaccggatgccctcctttcgacgaacataagtgcctggccgagggcggcaagattatgaagattcccggaacttgctgtgatacctgtgaagaacccgaatgtaatgacatcacggcccgcctgcagtacgtcaaagtgggatcctgtaaatcggaagttgaggttgatattcactactgccagggaaaatgcgcgagcaaggcgatgtactcgatcgatatcaacgacgtgcaagaccagtgctcgtgctgtagccctactcgcactgagccgatgcaagtcgcgctccactgcactaatggctcggtggtgtaccatgaagtgctgaacgcaatggaatgtaagtgctccccgagaaagtgctcgaag

SEQ ID NO: 21337 - DNA, 8439 bp, Artificial Sequence
  Description of Artificial Sequence: Synthetic coding sequence
atgataccagcaaggtttgccggggtgctgctagcactggccctcatcctgcctggcaccttgtgtgcagagggtacaagagggcgttcatcaacagcacggtgctcgctgttcggctcagacttcgtaaacactttcgatggatccatgtatagctttgccggatactgctcttatctgctagcaggaggttgtcagaaaagatctttttctattatcggtgatttccaaaacggaaaaagggtctctctctcggtgtatctgggtgaattcttcgacatacatctgttcgttaacggcaccgtgacccagggggatcagcgcgtgtccatgccctatgcatccaaggggctgtatctcgagaccgaggctggatactacaaactgagcggcgaggcctatggctttgtggcacgtattgatggctcagggaactttcaagtgctgctgagtgataggtatttcaataaaacatgtgggttgtgtgggaattttaatatttttgccgaggacgacttcatgacccaggagggaaccctgacctcggacccttatgactttgcaaattcctgggctctgagcagcggggagcagtggtgcgagcgggccagtcccccgtcctcaagctgcaatatttcttctggcgagatgcagaagggactatgggagcagtgtcaacttctgaaatctaccagcgtcttcgcgcggtgtcatccacttgtagacccggaacccttcgtagctctgtgtgaaaaaacactgtgcgaatgcgccggtggactggagtgcgcctgcccagccctcctggaatatgctcgaacatgtgctcaggagggaatggttctttacggctggaccgaccacagtgcctgtagtccggtatgccctgccggaatggagtataggcagtgcgtgtccccatgtgcacgaacttgtcaatctctccatatcaatgagatgtgccaggagaggtgcgtcgatggatgttcatgccccgaaggtcagctgctggacgagggcctctgtgttgaatcgaccgagtgcccttgtgtccatagtggcaagaggtatccacctggcacaagtctgtcacgagattgtaatacctgcatctgtagaaactctcagtggatctgctccaacgaagaatgccctggcgaatgcctcgtgacaggacagtcacactttaagtcctttgataatagatattttaccttcagcggaatctgccagtatctgctcgctagagattgccaggaccatagcttctctattgtgattgagactgttcagtgtgctgatgatagggacgccgtgtgcactaggtcagtgaccgtaagactacctggcctgcacaatagcctggtgaaactgaagcatggtgcaggcgtggccatggatggacaggacgtgcagctcccactgctcaagggagacttacggattcagcataccgtgaccgcctcggtacggttatcttatggtgaggacctacaaatggactgggatggtaggggcaggctgctggtaaagctttcccctgtctacgcggggaagacctgtggattgtgcggaaattataacggcaaccaaggggacgactttctgacccctagcggcctggctgaaccaagagtagaggatttcgggaacgcctggaagctgcacggagactgccaagatctgcagaagcagcattctgacccatgtgctctgaaccctcgaatgacaaggtttagtgaggaggcgtgcgctgtgcttactagccctacttttgaggcatgccatcgagccgtttcgccgttgccatatctcaggaactgtcgctacgacgtatgtagctgctcagacgggagagagtgcctctgcggtgctttggcttcttacgctgcagcatgcgcaggaagaggagtgcgcgtagcatggagggagcccggcaggtgcgagctgaattgccctaaagggcaagtttatctgcaatgtggtaccccctgcaacttgacctgtcgatccttgagctacccagacgaggagtgcaatgaggcctgtctggaaggttgtttctgcccccccggcctctatatggatgaaaggggagactgtgtcccaaaggcgcagtgtccctgttactatgacggagaaatatttcagccagaggacattttttctgatcaccataccatgtgttactgtgaggatggatttatgcactgtacaatgtcgggcgtaccgggctcacttctccctgatgctgtgctatccagtcccctgagtcacaggagcaagaggagcttgtcctgtagaccgcctatggtgaaactggtctgtccggctgacaatcttcgagccgagggcctggagtgcaccaaaacttgtcaaaactatgacctggaatgcatgagtatggggtgtgtttccggctgtctctgccctccaggcatggtcaggcacgaaaatcggtgtgtggccctggagcggtgcccttgtttccaccaggggaaagagtacgcccctggggagactgtgaaaatagggtgcaacacatgcgtgtgccaggacagaaaatggaattgtacagaccatgtgtgcgatgctacgtgtagcaccatcggaatggctcattatttaacctttgatggtctgaaatacctattccctggtgaatgccagtatgtcttagtgcaagattactgtggtagcaacccaggtactttcaggatcctcgtgggcaacaagggttgcagccacccctccgtcaaatgcaagaaaagggtgaccatcctagtggagggcggagagattgagctgttcgacggagaagtcaatgtgaaacgcccaatgaaagatgagacccactttgaagtggtggagagcgggagatacatcattctgttgctgggaaaagcattgagcgtagtgtgggatcgccacctctctatttcagtggtactgaagcagacataccaggaaaaggtctgcggcctctgtggtaattttgatggaatccagaataacgaccttacatcatctaacctccaggtggaagaagatcccgtagactttgggaacagctggaaggtttccagccagtgcgccgacacccgcaaagttccacttgacagctcgccagccacctgccacaataatatcatgaagcaaacgatggtggattcttcttgtaggatcctgacatcagacgtctttcaggattgcaataagctagtggacccagaaccctacctggatgtttgtatatatgacacctgctcctgtgagtcaatcggagactgcgcctgtttctgtgatacaattgcggcatatgctcacgtgtgtgcgcagcacggcaaggttgtcacttggcgcactgccaccttatgtccccaatcatgtgaggagcgtaatttgcgtgaaaatggatacgagtgcgaatggagatataattcatgtgccccggcttgtcaggtgacctgccaacatcctgagcctctggcatgtcccgtgcaatgtgtggagggctgtcatgctcactgtccacctgggaagattctggacgagcttctccagacatgtgtggacccggaggactgtcccgtttgcgaggtggccgggagacgttttgcatcgggcaagaaggtcactttgaatccatccgatccagaacattgtcagatctgccattgcgatgtggtcaacctgacttgtgaagcatgtcaggaaccaggcggattagtggtaccgcctacagatgcccccgtctctcccaccaccctgtatgttgaggatatctccgagccacccctccatgatttctattgctcacgcctgctagacttagtgttcctgctggatggaagtagtcggttgtccgaggcagagttcgaagtgctgaaggccttcgttgtggacatgatggaacgtttacggatatctcagaagtgggttagagtggctgttgttgaatatcacgacggctcccacgcatacattgggcttaaggatcggaagcgaccctccgagctgcgacggattgcgagccaggttaagtatgctggtagtcaggtggcatcaacttccgaggttctgaaatacacactctttcagatcttcagcaaaattgatcggcccgaggcttcaagaattaccctgttactgatggcaagccaagagccacagcggatgtctcgcaactttgtgcgctatgtgcagggcttgaagaaaaagaaagtgattgtgattcctgtcggaatcggacctcatgccaacctgaaacagatcaggctgatagaaaaacaggctccagaaaataaagcattcgttctttcatctgtggatgagcttgagcagcagagggacgagatagtttcatatctgtgtgacttggcacctgaagccccccctccgacgcttcccccggatatggcacaggtgacagtgggacctggcttgctgggcgtgagcaccctgggccccaagcggaactctatggttctcgacgttgcattcgtcctcgagggttcggataagattggtgaggctgactttaacagatctaaagagttcatggaagaggttatccaaaggatggatgtgggacaggattccattcacgtgaccgtgctccagtactcttatatggtgacagtcgagtacccgttttctgaagcacagtctaaaggggatatcctgcaaagagtcagggagattagataccaaggtgggaacagaactaataccgggctggccctgcgttatctatctgatcactcctttctagtgtcacagggcgatcgcgaacaggcgcccaatctggtttacatggtgacgggaaatcctgctagtgatgagattaagagactgcccggcgatatccaggtcgtacccatcggagtgggccccaacgccaacgtccaagagctggagcgaattggatggcccaacgcacccattctgatccaggatttcgagacccttcccagagaggcacccgacttggtgctgcagagatgctgctccggggagggcctgcagatcccgaccttgtcacctgctccggactgttcgcagccactcgacgtcattctcctgctagatggctcatcatccttccccgcgtcctacttcgacgaaatgaaatccttcgcaaaagcttttatctcaaaggccaacattggtcccagactgacacaggtatctgtgttgcagtacggctccatcaccacaattgatgtgccctggaacgttgtgccagaaaaggcccacttattatcacttgtggacgtcatgcaacgggaggggggcccttcccaaattggggatgccctggggttcgctgttcggtacttgacatccgaaatgcacggagcccgccctggagcgtctaaagctgtggtaatcttagtcactgacgtttcggtggatagtgtggacgcagcggccgatgcagcccggagcaaccgggttactgttttccctattggcattggcgacaggtacgatgctgcccaactcagaatccttgctggacctgccggtgattcaaacgttgtgaaactgcaaagaatcgaggatctgccaacgatggtgacccttggtaattcgttcctgcataaattgtgttctggtttcgtgcggatatgcatggacgaagacggtaatgagaaaaggccgggagacgtgtggacactgcctgatcagtgccacacggtcacctgccagcctgatggccaaacactcctgaaatcccacagggtcaattgcgatagaggacttagaccgtcctgccctaattctcagtctcccgtgaaggtcgaggagacctgcggctgtcgatggacatgtccttgtgtctgtaccggctcgtccacacgtcacatagtgacttttgacggacaaaactttaagctcaccgggtcatgtagctacgtactgtttcagaacaaagaacaagacctggaggttatcctgcataatggcgcttgtagtcctggagcaaggcaagggtgtatgaagtcaatagaggtgaagcactcagctctgtcagttgaactccacagtgacatggaggtgaccgtgaacgggaggctggtgtcagtgccctacgtgggcggaaatatggaggtgaatgtgtatggcgccatcatgcatgaggttcggtttaatcacttggggcatattttcacatttacccctcaaaacaacgagttccagctgcagctcagtccaaagaccttcgcttccaaaacttatggactgtgtggcatctgtgatgagaacggggcaaacgatttcatgctgcgggatggcacagtcacaacagattggaagactctggtccaggagtggacggttcagcggcctggccagacctgtcagccaatcctggaagagcagtgtctggttcccgactcctctcactgtcaggttctgctgctaccactattcgctgaatgccataaggtgctagcccctgccacgttctatgcaatctgccagcaggattcctgtcaccaggagcaggtgtgtgaagtaattgcctcctatgctcacttgtgtcgaactaacggggtctgcgtggattggcggacccccgatttttgcgccatgagctgccccccatctctggtctataaccattgcgaacacggctgcccccgacactgcgacggtaacgtcagctcgtgcggtgaccatccaagtgagggctgcttttgtcctcccgacaaagtcatgctcgaggggtcatgcgtgcccgaggaggcctgtactcagtgcattggtgaggacggtgtacagcaccaatttcttgaggcttgggtgcctgaccaccagccatgtcagatttgtacttgcctgtctggacgtaaagtgaattgcacaactcagccctgtccaacagccaaggcccccacatgcggactctgcgaagtcgcccgcctacgacaaaatgcagatcagtgctgccctgagtatgaatgtgtgtgtgatccagtcagttgcgatctgccccctgttcctcattgtgaaagaggcttacaacccacactaacgaaccctggggaatgccgacccaactttacctgtgcctgccggaaggaggaatgcaaaagagtgagcccaccctcatgccccccccatcgtttgccaacacttcggaaaacccagtgttgtgacgagtacgaatgtgcttgcaactgcgtcaattccactgtgtcctgccctctggggtacctagcatctaccgctacaaacgattgtggatgtacgactactacgtgccttcctgacaaagtgtgtgtccacaggtccacaatataccctgttggtcagttttgggaggagggctgtgacgtgtgtacttgcaccgacatggaagacgcagtcatggggctgagggtggcccagtgcagccagaaaccgtgcgaagattcttgtagatcaggtttcacttacgtgcttcatgaaggcgaatgttgtggccgctgcctcccctctgcctgcgaagtcgtgactggttctcctcgcggggactcccaaagttcctggaagagcgtaggatcccagtgggcatcccccgaaaatccctgcctgataaatgagtgtgtccgtgtaaaagaggaggtttttattcagcagcggaacgtttcctgcccacagttggaggtaccggtgtgccccagcggatttcagctatcttgtaagacatccgcctgttgtcccagctgccgatgtgagaggatggaagcctgtatgttgaatgggaccgtgatcggtccaggcaagacagtgatgatcgacgtttgtactacatgccgatgtatggttcaggtgggcgtgattagtggctttaaactggagtgtagaaagaccacctgtaatccttgtcccctcggctacaaggaggagaataacacaggagagtgctgcggtagatgcctgccgactgcgtgtactatccagctccggggggggcagatcatgacactgaagcgggacgaaaccctacaagacggctgcgatacacatttctgcaaggtgaacgaacggggcgagtacttctgggaaaaaagagttaccggctgccccccttttgatgagcataaatgtctcgccgagggcggaaaaattatgaagatacccggaacttgctgcgatacctgtgaggaaccggagtgtaacgacatcaccgcccggctgcagtacgttaaagtcggaagctgcaaatccgaggtggaagtggacatccactactgtcagggaaaatgcgcaagtaaggctatgtactcaatagacattaatgacgtgcaggaccagtgcagctgttgttccccgacacggacagaaccgatgcaggtggctcttcattgtactaatggctccgtggtataccacgaggtgctgaacgctatggagtgcaagtgctctccacgcaagtgtagcaag

SEQ ID NO: 21338 - DNA, 8439 bp, Artificial Sequence
  Description of Artificial Sequence: Synthetic coding sequence
atgattcctgcaagattcgctggggtcctcctggctctcgcgctcatcttgccaggaaccctttgcgcggaaggaacgcgcgggaggagctccaccgcgaggtgctcactgttcggcagcgacttcgtgaatacattcgacggctctatgtacagctttgcaggatattgcagttacctgctggctggaggctgccagaaaagatcctttagtattatcggagactttcaaaacgggaaaagagtgagcctgtctgtgtacctcggagagttctttgacatacatttgttcgtgaacggtaccgtgacacagggcgatcagcgcgtgtcaatgccatacgctagcaaaggcctctacttggagacagaagccggctactataaactctccggcgaagcatacgggtttgttgctaggatcgatggctcaggtaattttcaggtcctcttgtcagatcggtactttaacaaaacatgcggactgtgcggaaatttcaacatcttcgctgaagacgatttcatgacacaggaaggaaccttaacaagcgatccatacgacttcgcaaattcatgggcattatcaagcggagaacagtggtgcgaaagggcctctcccccctctagttcttgtaacatttcctctggtgagatgcaaaaggggctgtgggaacagtgccaactgctgaagtctacctctgtgtttgcacgatgccatccactggtggaccctgagccctttgtcgctctgtgtgagaaaaccctgtgcgagtgtgcaggagggttggaatgcgcctgccccgcactgctcgagtacgcacgtacctgcgcgcaggaaggcatggtcttgtatgggtggaccgatcatagtgcttgcagccctgtgtgccccgccgggatggaataccgccagtgcgtctctccctgcgctaggacctgccagtctctgcacattaacgagatgtgccaggagagatgcgtggacggctgctcatgccccgaagggcagctgcttgacgaaggactttgtgtggaaagcacagaatgcccatgcgtccatagcggcaaacgatacccacccggaacctcactttcgagagattgcaacacctgtatctgcagaaactctcagtggatttgttctaacgaagagtgtcccggggagtgcctggtgacaggccaaagtcattttaaaagcttcgacaacaggtattttacgttcagcggcatctgccagtaccttctggcaagagactgtcaggaccactctttctcgatcgtcatcgagaccgttcagtgcgcagatgatagggatgcggtttgcacaaggagtgtgacggtccgcctgccaggccttcacaactccttggtgaagctgaaacatggtgcgggcgtcgcaatggacggccaagacgttcagcttccgctgctgaagggagacctgcgcatccagcacacggtgacggcctccgttcggctttcctacggagaagatctgcaaatggattgggatgggaggggccgtctcttagtgaaactgtcccctgtttacgccggaaaaacctgtggcctgtgtggaaactataacggaaaccaaggcgatgactttctgaccccttctggtctggctgagcctcgggtggaggactttggaaacgcatggaaactgcatggagactgtcaagatctgcagaaacagcattctgatccatgcgcactcaacccacgcatgacacgtttttcagaggaagcatgcgcagtgctgaccagcccaacttttgaggcgtgccatagagcggtcagccccttgccttatctgaggaactgcaggtacgatgtctgtagctgctcggacggaagggagtgcctgtgtggagcactggcctcatacgcagccgcctgtgctggacgtggagttcgcgtggcttggcgggagccagggaggtgcgaattaaactgtcccaaggggcaagtatacttgcagtgtggcacaccttgcaatctcacatgccggagtctgagctatccagacgaggaatgcaatgaggcatgcttggagggatgcttttgtccccctggcctgtacatggacgagcgtggcgattgcgtgcccaaagctcagtgtccgtgctattacgatggagagatttttcagccagaagatatattctctgatcaccacaccatgtgctactgcgaagacggatttatgcactgcacaatgtctggagttcctgggtccctgctccctgacgctgtcttgagttccccattgtcccataggtctaagagatccttgtcttgtagaccaccaatggtcaaacttgtgtgcccagctgacaatctccgtgcagagggactggaatgtactaaaacgtgccaaaactacgatctggaatgcatgagtatgggctgcgtgtccggttgtctgtgtcctccaggaatggtcagacacgaaaaccgctgcgtggctcttgagaggtgcccttgctttcaccagggtaaagagtacgctcctggagaaaccgtcaagattggctgtaatacttgcgtctgtcaggatagaaaatggaattgcaccgatcacgtctgtgacgctacttgctcgactataggaatggcgcattaccttacatttgacggtctgaagtatctcttcccgggtgagtgccagtatgttctcgtgcaagattactgcggatctaaccccggaacctttagaattctggtgggaaacaaaggctgtagccatccttctgtcaaatgcaagaagagggttactatcctggttgaagggggcgaaatcgagctgttcgacggcgaagtgaatgtgaagaggccgatgaaggacgagacccactttgaagtggttgaaagcggaaggtacatcatcttgctcttgggaaaagctttatccgtagtgtgggacagacacttgtctatcagcgtcgtcctgaagcagacataccaagagaaagtatgcggcctctgtggcaattttgatggtatacaaaacaacgacctcaccagtagcaacctgcaagtcgaggaagacccggtggacttcggaaacagttggaaggtcagttctcaatgcgctgatactaggaaggtccctcttgattcctctccagctacctgccacaacaacatcatgaagcaaaccatggtggactccagctgtcggatcctgacaagcgacgtcttccaggattgtaacaaactcgtggacccagaaccgtacctggatgtttgcatctatgacacttgcagctgcgaaagcatcggggactgtgcctgcttctgtgatacaatcgccgcatatgcacacgtctgtgcacagcacgggaaagtggtgacctggagaactgctactttgtgcccacagagctgcgaggaacgtaaccttcgcgagaacggatatgagtgcgaatggaggtacaactcttgcgctccagcttgccaagtgacgtgtcaacacccagagccactggcgtgtccggtgcaatgcgtagaagggtgccacgctcactgcccgccggggaagatattagatgagttactccagacatgcgtcgacccagaggactgccctgtgtgcgaagtggcaggaagaaggtttgcaagcggaaagaaggtgacactcaaccccagcgacccggaacactgccagatttgccattgcgatgtcgtcaacctgacatgcgaggcatgtcaagagcctggagggctggtcgtcccaccaaccgacgcacctgtatctcctactacattgtatgtggaagatatctctgagcctccattgcatgatttctattgctcaaggctgctggatttagtcttcctgctagacggatcctcgcgacttagcgaagctgagttcgaggtccttaaagcattcgttgtggatatgatggaaagacttcgcattagccaaaaatgggtgagagtcgctgtggtcgaatatcacgacgggagccatgcctacattggcttgaaggaccggaaacggccaagcgagctgagaaggatcgcttctcaagttaaatacgctggctcacaggtcgccagcacgagcgaggtccttaagtacaccctgtttcaaatctttagcaagattgatcgcccggaagccagtaggatcaccctgctgctgatggcctcacaggagcctcagaggatgtcccgcaattttgttagatacgtacagggactcaaaaaaaaaaaggtgatcgtgatacccgtcggcattggcccccacgcaaacctgaaacagattagacttatcgaaaagcaggcaccagaaaacaaggcttttgtgcttagctccgtggatgagcttgaacaacaaagggacgagatcgttagttacctctgcgatctggcgcctgaggctccccccccgacactgcctccagatatggctcaagtcaccgtcggtcccggactgctgggagtcagcacattgggacccaaaagaaactcaatggttctggatgtcgcattcgtgttggagggaagcgacaaaatcggagaagccgattttaataggagcaaggagttcatggaagaagtcatccagaggatggatgtcggccaagactctatccatgtcaccgtgttacagtatagttacatggtcaccgtcgaataccccttttctgaagcacagagtaaaggcgacatactgcagcgcgttagggaaatcaggtatcaagggggaaatagaacgaacaccggacttgccttgagatacctatccgaccacagcttcctggtaagccaaggcgacagagagcaagcaccgaacttggtttatatggttaccggaaaccctgctagcgacgaaatcaaaaggctcccgggcgacatccaagtggtgcctatcggcgtaggcccaaatgcgaatgtgcaagaactcgaacgcatcgggtggcctaatgcaccaatcttgatccaagatttcgaaaccctcccacgggaagcccctgatctggtgctgcagaggtgctgctccggcgaaggccttcagattccaactctgagccccgcccctgattgcagccagcctttagatgttatcctgctgttggatggcagctcctcatttcccgctagttacttcgacgaaatgaaaagctttgccaaggctttcatttccaaggctaacatcggacccaggttgactcaagtatccgttttgcaatatgggagcatcaccactattgatgtgccatggaacgtagtccccgaaaaagcacaccttctgtccctggtcgatgtgatgcagagggagggaggtccttcccagattggtgatgcactgggctttgctgttaggtatttaacgagtgagatgcatggggctaggccaggagctagtaaggctgtggtgatcctcgtgaccgacgtgtctgtggacagtgtggatgcagccgctgatgctgctcgctctaaccgtgtcaccgtatttcctatcggaatcggagataggtacgatgctgcccagctccgaattctggccggccccgcgggcgattcaaacgtggtgaaactgcagcgaattgaggatctcccaaccatggtaactctggggaattcctttttgcacaaactgtgcagcggcttcgtcagaatctgcatggatgaggatggcaatgaaaaacgccccggcgatgtctggaccctgccagatcaatgccacaccgtgacgtgtcagcctgacgggcaaacgctgctgaagtcacatagagttaactgcgatcgcggtctccgcccctcctgccctaactcccaaagtccggtaaaggtggaagaaacatgtggttgcagatggacgtgcccatgcgtctgcaccgggtcttctactaggcacatcgttaccttcgatggacaaaacttcaagctgactgggagttgcagctacgtgttgtttcaaaataaagaacaagacctggaagtcattcttcataatggtgcatgcagtccaggcgctagacaagggtgtatgaaatcgattgaagtcaagcacagcgcactgtcagtggagctgcacagcgatatggaggtgaccgtgaatggcaggctggtgtccgtgccctatgtgggcggtaacatggaagtgaacgtgtacggtgcaatcatgcatgaagttcggttcaaccacctgggacacatcttcactttcaccccccagaacaacgagttccagctgcagctgagtcctaagacctttgctagcaagacgtacggcctgtgtggaatctgtgacgaaaacggcgcaaacgactttatgctgagggacggaacagtgacgaccgattggaaaacactcgtacaggagtggactgtccagaggcccggacagacctgccaacctatcctagaggaacagtgcctggtgcccgattcctcccattgccaagtactgttgttaccactcttcgctgagtgtcacaaagtgctggcccctgccacgttctatgcaatatgccagcaggattcctgccaccaggagcaggtgtgcgaggtcatcgctagctacgcccacctctgcagaaccaacggagtgtgcgtagattggaggacacctgacttctgtgccatgagctgcccgcctagcctggtctataaccactgtgaacatggatgccctcgacactgcgatgggaacgtgagttcctgcggcgatcatccatctgaaggctgcttctgccctcccgacaaggtgatgctcgagggctcctgcgtgcccgaggaggcttgcacacaatgtatcggagaagacggagtccagcatcagttcctggaggcttgggtgcccgatcatcagccgtgtcaaatttgcacctgcctgtctgggagaaaggttaattgcaccactcaaccttgccccacagcaaaagcccccacctgcggattgtgtgaagtggccaggctcaggcagaacgcagatcaatgttgccccgagtatgagtgtgtctgcgacccagtatcatgcgatctgccccccgtccctcattgcgagagggggcttcaaccaacactcaccaaccctggcgaatgcagacctaatttcacatgcgcatgcagaaaggaggagtgcaaaagagtgagcccaccgagctgcccgccccatagactgcctacactcaggaagactcagtgctgtgatgaatatgagtgcgcatgtaattgcgttaatagtaccgttagctgcccactcggttatctggccagtacagccaccaacgactgcggatgcaccacaacaacctgcctccccgacaaggtatgcgtgcacagatcaaccatctatcctgtggggcaattttgggaagagggttgtgacgtctgcacctgtacggatatggaggatgctgtcatgggacttcgcgtggctcaatgctcccagaagccatgtgaagattcctgccgcagcggattcacatatgtgttgcacgaaggcgaatgctgcggccggtgtctgccctcagcgtgtgaggttgttactggctctcccaggggagacagccagtcttcgtggaaatctgtgggctcccagtgggcatcccccgaaaatccttgtttaataaacgagtgcgttcgcgtgaaggaggaagtctttatccaacaaagaaacgtcagttgcccacagctggaagtcccagtttgtccatctggattccaactgtcctgcaaaacatccgcctgctgtccaagctgcaggtgcgaacgcatggaagcatgcatgctcaacggcacagtcatcgggcccggtaagactgtgatgatcgacgtttgtactacttgccgctgcatggtgcaagttggcgtcatcagcggcttcaaactcgagtgtcgcaaaacaacctgcaacccatgtcctcttgggtacaaggaggaaaacaacacaggagagtgttgtggccggtgcctacccaccgcatgtacaattcagttgcgaggcggtcaaatcatgaccttaaagcgcgatgaaactctgcaagacggttgcgacacccacttctgcaaagtcaacgagcgcggcgagtatttttgggaaaagagggtgactggttgtcccccgttcgatgagcacaagtgtttggctgaggggggcaagataatgaagatcccaggcacttgttgcgatacttgtgaagagcctgagtgcaatgacattaccgcgaggctgcagtacgttaaagtggggtcttgtaagagtgaagtagaggtcgatatccattactgccagggcaagtgcgcgtcgaaagccatgtatagcattgacattaacgatgttcaggatcaatgtagctgctgctctcctaccaggactgagcctatgcaggtggcactccactgtactaacggcagcgtagtgtatcatgaagtgctcaatgccatggaatgcaagtgttcaccccgcaaatgttcaaag

SEQ ID NO: 21339 - DNA, 8439 bp, Artificial Sequence
  Description of Artificial Sequence: Synthetic coding sequence
atgatcccagctaggttcgctggagtcctgctggcactggcattgatcctccctggtaccctctgtgccgaaggtactcgcggaaggagttccacggcaaggtgttctctctttggatccgattttgtgaacacatttgacggcagcatgtactcctttgctggatattgcagttaccttctggctggtggctgtcagaagcgctctttctcaatcataggagactttcagaatggtaagcgcgtttcactttccgtctatcttggagaattcttcgatatccacttgtttgtgaacggcaccgtcacccagggcgatcagcgcgtctctatgccttacgctagtaagggcctctacttggagactgaggcaggctattacaaactgagcggcgaagcctacggctttgtcgcaaggatcgacggtagcggaaatttccaggtccttttgtctgaccgctactttaataagacctgcggcctgtgtggtaacttcaatatcttcgcggaggacgacttcatgactcaagagggcactctgacaagtgacccctacgacttcgccaactcctgggctctgagttccggtgagcagtggtgcgagagagcctcacccccttcttcctcttgcaacattagttctggagagatgcaaaagggcctgtgggaacaatgccagctgctcaaaagcacctcagtgttcgctcgctgtcatccactcgtagatccagaaccttttgttgcgctgtgtgagaaaaccctgtgcgaatgtgctggcggcctggaatgtgcctgtcccgccctcctggaatacgctcgcacctgcgctcaagagggcatggttctttacggctggaccgatcacagcgcatgcagccccgtgtgccctgccggaatggaatacagacagtgtgtctctccatgcgctaggacttgccagagcctgcatatcaatgagatgtgccaggaacgctgcgttgacggatgctcttgcccagagggtcagctccttgacgaaggtctctgcgttgagtccaccgaatgcccatgtgtccactcaggtaagagataccctccaggtaccagcctgagccgcgattgtaacacatgcatctgtcgcaacagccagtggatctgcagtaatgaggagtgccccggagaatgccttgtgacaggacagagccattttaagagtttcgacaaccgctatttcaccttctccggaatctgccagtacctgcttgctagagactgtcaggaccactcttttagtatcgtgatcgaaaccgtgcaatgcgccgacgacagggacgccgtgtgtacccgctccgtcacagtgaggctgccgggtcttcacaacagcctggtgaagctgaagcatggagcaggcgtggccatggacggccaagacgtgcagcttccgctcctgaagggtgacctgcgcatccagcacactgtgacagcatctgttaggttgtcctatggagaggatttgcagatggattgggacggaagaggcaggcttctcgtgaagctgtctcccgtttacgctggcaagacctgcggattgtgcggcaactacaacggcaaccagggtgacgatttcctgacaccttcaggactcgcagaaccaagggtcgaagacttcggaaacgcctggaaacttcacggagattgccaggacctgcagaagcaacactcagatccttgtgctctgaatccaagaatgacgaggtttagtgaggaggcctgtgccgtactgacaagccccacgttcgaagcctgtcaccgcgcggtgagcccccttccgtacctcaggaattgccgctacgatgtgtgttcatgttctgatggtagggagtgcctgtgtggcgctctggcatcctacgcggcggcctgcgccggtcgcggcgtgcgcgttgcttggagggagccaggtaggtgcgagctcaattgtcctaagggtcaggtgtacctccagtgtggaaccccgtgtaacttgacttgccgctctctctcatatccagacgaagagtgcaatgaagcttgcctggagggatgcttttgccctcctggattgtacatggatgaacgcggtgattgcgtgcctaaagcacagtgcccctgctattacgatggagaaatcttccagccggaggacatcttttcagatcaccacaccatgtgctactgtgaggatggcttcatgcactgtacgatgtccggagtgcccggctcattgctgccagatgctgtcctgagttcacccctcagtcaccgctcaaagaggtcactgtcctgcagaccccctatggtcaaactggtatgcccggccgataaccttagggcagagggactcgagtgcaccaagacttgccagaattacgacttggaatgcatgagcatgggctgcgtttctggttgcctctgcccccccggtatggtgaggcacgaaaacagatgcgtcgcgcttgaacgctgtccatgcttccatcagggcaaggagtatgcccccggcgagactgtcaagatcggctgtaatacttgcgtatgtcaggaccgcaagtggaactgtacagatcacgtgtgcgacgctacctgcagtactataggaatggcccattatctcacattcgatggcctgaagtacctgtttccgggcgagtgccaatacgtgctggttcaggactactgtggttctaaccctggaacttttaggatcttggtgggtaacaagggatgtagtcacccaagtgtaaagtgtaaaaaaagagtcaccatcctcgtagaaggaggagagatcgaactcttcgacggtgaagtgaatgtgaagcgccccatgaaggacgagacacacttcgaagtcgttgaatccggccgctacatcattctgctcctgggaaaggcactgagcgtcgtttgggatagacacctgtctatctctgtggtgcttaagcaaacataccaggagaaagtgtgtggtctgtgcggcaatttcgacggcatccaaaacaacgatttgacctcttcaaatttgcaggtggaagaggacccagttgatttcggcaacagctggaaagtaagtagtcagtgtgccgacacccgcaaagttcccctcgactcttcccctgcaacatgccacaacaatatcatgaaacagaccatggtggactcatcttgcagaattctcacttctgacgtgttccaggattgcaataaactggttgaccccgagccctacctcgatgtatgcatctacgatacttgttcctgcgaatccatcggcgattgtgcatgcttctgcgacacaatcgccgcctatgcccacgtctgcgcacagcacggcaaggttgtgacatggaggaccgccactctctgccctcagtcctgcgaagaacgcaacttgcgcgagaacggttacgaatgcgaatggaggtataactcatgtgcgcccgcgtgtcaagtcacatgccagcaccccgagcctttggcgtgccctgtgcaatgtgtcgagggctgccacgctcattgcccgcccggcaagatcctcgacgagttgctgcagacatgcgtcgacccggaggattgccctgtgtgcgaggtagccggtagaagatttgcttctggtaagaaggtcactctgaacccatcagaccctgaacactgtcagatctgccactgcgacgttgtgaacctgacctgtgaggcatgccaagaaccaggaggccttgtagtcccgcctaccgatgcaccagtatctcctaccacgctttacgtggaggatataagcgagccaccactccatgacttctactgcagcagacttctggacttggtattcctcctggacggaagttctaggctgagcgaggcagagtttgaggtcttgaaggctttcgtggttgatatgatggagaggcttaggatctcacaaaaatgggtccgcgtggctgtggtggaataccatgatggcagccacgcctacattggactgaaagaccgcaaaagaccatccgagcttaggaggattgcctcccaagtcaaatacgccggatcccaggtagcatcaacgtccgaagtgctgaagtacaccctgttccagatcttcagcaaaatcgatagaccggaagcgtctcgcatcaccctccttttgatggcctctcaggagcctcagcgcatgagcagaaatttcgtcagatacgtgcagggactgaagaagaaaaaggtgatcgtgattcccgtgggaattggaccgcacgctaacctgaaacagattaggctgatcgagaagcaggctccagagaataaagccttcgtgttgtcttctgtggacgaacttgagcaacaacgcgacgaaattgtgtcatacctgtgcgatctggctcctgaggcaccaccacctactttgcctcccgacatggcacaagtgacagtgggccctggactgctcggcgtttcaaccctgggcccaaagcgcaatagtatggttctggacgtggctttcgttctcgagggctctgataagataggtgaggcagatttcaataggtctaaggaattcatggaagaggtgatccagaggatggacgtcggccaggacagcattcatgtcaccgtgctgcaatactcctacatggtgacagtcgagtaccccttttccgaggctcagagcaagggcgatatcctgcaacgcgtgagagagatcagataccaaggtggcaacagaaccaatacgggactggctctgcgctacttgtccgatcattccttcttggtgtcccagggagacagagagcaggctcctaatctcgtgtatatggtcactggcaatccagcctcagacgaaataaaacgcttgccaggtgatatccaagtggttccaatcggtgtgggtcctaacgctaacgttcaggaactcgagagaatcggttggccgaacgcgcccatcctcattcaggatttcgagactctccccagagaagcccccgacctcgtattgcagcgctgctgcagtggcgaaggactgcaaatccccactctgagtccagctcccgactgcagccagccgttggatgtaattcttttgctggacggtagtagctctttcccagcctcctactttgatgagatgaaatccttcgccaaggcgttcatttccaaggctaacatcggaccaaggttgacacaggttagcgtactgcaatatggttcaataactacgattgatgtcccatggaatgtcgtccccgagaaagcacacctgctgagccttgtggatgtcatgcagagggaaggaggccctagtcaaattggcgacgcactcggcttcgctgtgcgctatctgacctccgagatgcatggtgctcgccccggcgcaagtaaagcggtcgtgatcctggtcactgatgtttccgttgactctgtcgacgccgctgctgatgctgcccgcagtaaccgcgttacagtgtttcccatcggtattggagaccgctacgacgcagcccagctgaggatcctggctggtccagctggagatagcaatgttgttaagctgcagcgcatcgaggatctgccgaccatggtaactctgggaaactctttcctccacaagctttgttccggattcgtaagaatttgcatggacgaggatggaaacgagaagaggccgggtgacgtgtggacactgccagatcagtgtcacacggtcacttgtcagccagacggacaaactctgctgaagtcccacagagtgaactgcgaccgcggattgcgcccttcttgccccaactctcaaagccctgtgaaagtagaggagacttgcggatgtcgctggacctgcccttgtgtgtgcacgggcagttctacccgccacatagtcacctttgatggtcaaaattttaaacttactggtagctgttcatacgttttgttccagaacaaagagcaggacctcgaggtgatattgcataatggagcttgctcacctggtgcaaggcaaggatgcatgaagagtatcgaggtgaaacactctgcattgagcgttgagttgcacagcgacatggaagtcacagtgaacggacgcctggtgtccgtgccgtatgttggcggtaacatggaagtgaatgtgtatggcgccatcatgcacgaggtccgctttaaccacctcggacatattttcaccttcaccccccagaacaacgagttccaattgcagttgtccccaaagaccttcgcctccaagacttacggcctctgcggtatctgcgacgaaaatggcgccaacgacttcatgcttagggatggaacagttaccactgactggaagactctggtccaggaatggacggtccagaggcctggacaaacctgccaacccattcttgaagagcaatgtctggtgcctgattcctctcactgccaagtgctgctgctgccactgtttgcggagtgccataaagttctggcgcctgcgaccttttacgccatttgtcaacaagacagctgccaccaagaacaggtgtgcgaagtgattgctagttacgctcatttgtgcagaactaacggagtctgcgtcgattggaggacgccagacttttgcgccatgtcctgccccccgtcactcgtgtataaccactgcgagcacggttgccctcgccactgcgacggaaatgtctcctcctgcggtgaccacccttccgagggatgcttttgcccacctgacaaggtgatgctcgaaggttcttgtgttccagaggaagcttgtacacagtgcataggtgaggatggtgttcagcaccaatttctggaagcatgggtgcccgaccatcaaccttgccaaatttgtacttgtttgtctggaaggaaggtaaattgcaccactcagccatgcccgactgcgaaggctcctacatgtggcctctgcgaagttgctcgcttgaggcaaaacgctgaccagtgctgcccagagtacgagtgtgtttgtgatccagtaagctgcgacttgcctcccgtcccgcattgcgagagaggcctgcagcctaccctgacaaatcccggcgagtgccgcccgaatttcacttgcgcttgcaggaaagaggaatgcaagcgcgtctccccaccaagctgcccaccacacagactgccgactctcaggaaaacccagtgttgtgacgagtatgaatgcgcttgtaactgtgtgaacagcacagtttcatgtccccttggttacctggcctcaaccgctaccaacgactgcggatgtactacgacaacatgcctcccggataaagtgtgtgtgcaccgctctactatatatcccgtgggacagttttgggaggagggctgtgacgtgtgtacttgtactgacatggaagatgcggtcatgggcctcagagtcgcacagtgctcccaaaaaccgtgcgaagactcttgcaggagtggctttacatacgtcttgcacgaaggcgagtgctgcggtcgctgccttccctccgcatgcgaagtcgtgaccggctcacccaggggcgactctcagtcaagctggaagtcagtcggctcccaatgggcgagtcctgagaatccatgcctgatcaacgagtgcgttagggtgaaggaagaggtgtttatccaacagaggaacgtctcctgcccgcagttggaggtccccgtctgcccaagcggattccagttgtcatgtaagacaagcgcatgctgcccctcttgtaggtgcgagaggatggaggcctgcatgctcaacggtacggtgatcggtccaggcaagaccgtcatgatcgacgtgtgcaccacatgcaggtgtatggttcaggtgggcgtgatctctggtttcaagcttgagtgtaggaagaccacatgcaatccttgtcctttgggttataaagaggagaataatacgggcgaatgctgcggaaggtgcctgcccacggcctgtacaatccagctcaggggcggccagatcatgacactgaagcgcgacgaaaccctccaagacggatgcgatactcacttctgtaaggtgaacgaaagaggtgagtatttttgggaaaaacgcgtgaccggttgtccaccgttcgacgagcacaagtgtttggccgaaggtggtaaaataatgaagattcctggtacctgctgcgacacatgcgaggaacccgagtgtaacgacatcacagccagacttcaatacgtgaaggtgggctcttgcaagtccgaagtggaagtcgacatccactactgtcagggtaagtgtgcttccaaggctatgtattccatcgacatcaacgacgtccaggaccaatgttcctgttgctcccctacccgcacggaacctatgcaggttgcactgcactgcacaaacggaagcgttgtttatcacgaggtcctgaatgcgatggaatgtaagtgctctccaaggaagtgtagcaaa

SEQ ID NO: 21340 - DNA, 8439 bp, Artificial Sequence
  Description of Artificial Sequence: Synthetic coding sequence
atgattccagctagattcgccggtgtcctcctggccctcgctctgatcctacccgggacgctctgcgctgaggggacacgggggcggtcatccacagctcggtgtagtctgttcggttcagacttcgtcaatacattcgacggctccatgtacagtttcgctggctactgttcttatctgctcgccgggggctgtcagaaacggagctttagcattattggggacttccagaacgggaagcgagttagtctttctgtgtaccttggtgaattcttcgacatacaccttttcgtgaacggcacagtgacacagggggaccagcgggtgtctatgccctatgcttcaaaaggcctgtatttggaaactgaagccggttactacaaactttccggggaggcttacggctttgttgccaggatagacgggagcggcaacttccaggtactcttgagcgatcggtacttcaataagacttgcgggctctgtggcaacttcaacatcttcgctgaagacgactttatgacccaagagggcactctaacgagtgatccatacgacttcgctaatagttgggcactgtcctcaggcgagcagtggtgcgagcgggctagtccgccaagtagctcttgcaatattagttctggggagatgcaaaaggggttatgggaacagtgtcagctgttgaaatccacatccgtgtttgccaggtgccatcccctggttgatccagagccatttgtcgctctgtgcgagaaaacgctatgcgagtgcgccggaggccttgagtgcgcctgccccgccttgctggagtacgctaggacttgtgcccaagagggcatggttctgtacggctggactgaccattctgcctgctctcctgtctgtccggccggcatggaatatcgccagtgcgtatcaccgtgtgctaggacctgtcagtcccttcacatcaacgagatgtgtcaagaaagatgtgtggatggttgttcctgccctgaggggcaattgttggacgaaggactgtgcgtcgaatcaacagaatgcccatgcgtccactccggaaagcgctaccccccaggcacatccttaagtcgagattgcaatacgtgtatctgtaggaatagtcaatggatatgcagcaatgaagaatgtccaggtgaatgccttgtgactgggcagagccactttaaaagtttcgacaatcgctatttcacattctctgggatctgccagtatctcttagcacgcgattgtcaggaccatagcttcagcatagttatcgagacagtgcaatgcgccgacgaccgagatgctgtctgtaccagatctgtcacggtaaggctgcctggacttcacaattctttggttaaactcaaacacggcgctggggttgccatggacggtcaggacgtacagctacccctgcttaagggggatcttcgaatacaacacacggtgaccgcttcagtgcgcttgagctacggggaggatctgcagatggattgggatggaagaggccgccttcttgtaaagctgtcaccagtgtacgcgggtaagacttgcgggctttgtggcaattataacggtaatcagggagacgactttctcactccttccggcttggccgaaccacgtgtcgaggattttggaaacgcttggaagctgcacggtgattgccaagacttgcagaagcagcactctgatccctgcgcgctgaatccccgaatgacccgttttagtgaggaggcctgtgctgttctgacttcaccaacctttgaagcctgccaccgcgctgtatctccattgccttacctgaggaactgcagatacgatgtttgctcatgtagcgacggtagggaatgcctgtgtggcgccctggccagttatgcagccgcttgtgcaggccgtggagttagggtggcctggcgagagcctgggcggtgtgagcttaattgtccaaaaggccaggtttatctgcagtgtgggacaccttgcaacctgacatgccgcagtctgagctatccagatgaggagtgcaacgaggcctgcttggaaggttgtttttgtcctccagggctgtacatggacgaacggggggattgtgtccctaaggcccaatgcccctgctattacgacggcgaaatctttcagccagaggatatcttcagtgaccaccataccatgtgctattgcgaggacgggtttatgcactgcaccatgagtggggtgccaggatccttgctccctgacgctgttctatccagcccactttcacataggtcaaagagatccctaagttgtagaccaccgatggtgaaactggtgtgccccgccgacaacctgagagctgagggactggagtgcacaaaaacgtgtcagaactacgacttagagtgtatgtctatgggatgtgtcagcggatgcctctgccctccaggaatggttcgccacgaaaatcgatgtgtggctcttgaacggtgtccgtgcttccaccaaggaaaagagtatgcgcccggcgaaaccgtgaagataggctgcaacacttgcgtgtgccaggaccgcaagtggaattgcactgatcacgtgtgtgacgctacctgttcaactattgggatggcgcactacctgactttcgacgggttgaaatacttattccccggggagtgccagtatgtgcttgtacaggactattgcggttccaaccctgggacctttaggatcctggtcgggaacaagggctgtagtcacccctccgtcaaatgtaagaaacgcgttactatactggtggaaggtggggaaattgagctgttcgacggggaggtgaatgttaagcggcccatgaaggacgagactcactttgaggtggttgagagcggccgctacattatcctgcttctcggcaaggctctgtccgtggtgtgggaccgacacctgagcatctctgtggtgctaaaacagacataccaggaaaaagtgtgtggactgtgcggcaactttgacggaatccaaaataacgacctgacgtcatccaatctccaggttgaggaagatcccgtagatttcgggaactcttggaaggtttcctcccagtgcgccgatactcgcaaagtccctctcgatagttcccccgctacatgccataacaacattatgaagcagacaatggtagactcatcttgtcggatcttgacctcagacgtgttccaggactgcaataaacttgtggatccagagccctatctggacgtgtgcatttacgatacgtgctcctgtgagtctattggcgactgtgcctgcttctgtgacaccatcgctgcttacgctcacgtttgtgcccagcatggcaaggttgtaacttggcgcactgccactctatgccctcaatcatgcgaggaacgcaacctgcgggagaacggttatgagtgtgaatggagatacaattcctgcgcccctgcctgtcaagttacatgccagcatcctgaacccctggcatgtccagtccaatgcgttgaaggatgccacgcgcactgtccacctggcaaaatactcgacgaactcctccaaacttgcgttgatcctgaagattgcccagtgtgtgaggtcgcaggacgaagatttgcgtcaggtaagaaagtcaccctgaatcccagtgatcctgagcactgccagatttgccactgcgacgtcgtgaacctgacatgcgaagcttgtcaggagcccggggggctggtagttcctcctacagacgcaccagtgtcccctactaccttgtacgtggaagacatttccgagccacccctccatgatttctactgttccaggctccttgatctagtgtttctattggacgggtctagccgactctcggaagctgaattcgaagtgctgaaggcatttgttgtagatatgatggagcgattacgcatcagccagaagtgggtccgggtggcagtggtggagtaccacgacggctcccacgcttacataggcttgaaggaccggaagcgcccctcagagttacgccggatcgccagccaagttaagtacgctggctctcaagtagccagtactagcgaagtgctaaagtacacactatttcagattttttcaaaaatcgataggcccgaagctagtcggatcacactcttgttaatggcctcccaggagccccagaggatgtctcggaatttcgtgagatacgtgcagggactaaaaaagaaaaaggttatcgtgatacccgtcgggattggcccacacgcaaacctgaagcagatacgcttaatagagaagcaggcccccgagaataaggccttcgtgttaagttcagtggacgaactggaacagcagagggacgagattgtctcctacttatgcgatttggcgcccgaggcacctccacctacccttcctcccgatatggcccaggtgaccgtggggcccggactcctgggcgtgagcacactgggcccaaaaaggaacagtatggtcctcgatgtggccttcgttttggaaggcagcgacaagatcggcgaggccgactttaataggtccaaggagttcatggaggaggtgatccagaggatggatgtcggacaggattccattcacgtcaccgtcttgcagtacagttatatggtgacagtggaataccctttcagtgaggctcagagtaagggggatattctgcaacgcgtgcgggagatcagataccaggggggcaatcgcacgaatacgggcctggcccttcggtacctgtcggaccactcatttttggtttcccagggcgatcgcgaacaagcccccaacctagtttatatggtcactggtaacccagccagcgatgaaataaaaaggctccctggggatatccaagttgtgccaataggtgttggcccgaacgcaaatgtccaggagctggagaggatcggctggccgaacgcgccgatcctgatacaggactttgaaaccctaccccgtgaggcccctgacttggtgttacaaagatgctgtagcggtgaagggctgcaaattcctacgctgtctcctgcacctgattgttcacagcccctcgatgttatcttgctgctggacggctcctcctctttccccgcttcctattttgacgagatgaagtctttcgccaaggcctttatctctaaggccaatattggcccgcgcctgacacaggtgagcgttctccagtacggctcaataactaccatagacgtgccttggaatgtggtgcccgaaaaggctcaccttctctccctggtggatgtcatgcaaagagaagggggtcctagccagataggggacgctctgggattcgcagtccgatacctgacaagcgagatgcacggcgctcgacccggagcctctaaggcagtagttattctcgttacggacgtatcagtggatagcgttgacgccgccgcggatgccgcaagaagcaaccgggttaccgtcttcccaatcggaatcggggatcgttacgacgccgcgcagcttcggattctggccggtcctgccggagacagtaacgtagtcaaactccagaggatagaggatttgcccaccatggtgaccctcggtaactcttttctacataagttatgttcaggatttgtgaggatctgtatggatgaggacggtaacgagaaacggcctggggatgtgtggaccctgccagaccagtgccataccgtgacctgtcagccagatggccagaccttgcttaaatcacaccgggtcaactgtgaccgaggactgaggccaagttgtccgaacagccagtctccggtgaaggtggaggagacgtgcggctgcaggtggacgtgtccctgtgtgtgtaccgggtcttcaaccaggcatattgttacgtttgacgggcagaactttaagctgaccgggtcatgtagttatgtcctgtttcaaaacaaggaacaagacctcgaagtaatccttcacaacggtgcatgcagccccggcgccaggcaggggtgcatgaaaagtatcgaggtcaaacactccgcattgtcagtagagctccacagtgacatggaagtgaccgtgaacggccgtttggtgtccgttccctacgtcggaggcaacatggaggttaatgtctacggtgccatcatgcacgaagtccggttcaaccacctggggcatatttttacatttacacctcagaacaacgagttccagctccaactaagtcccaagacgtttgcgagtaaaacatatggactttgtggaatctgcgatgaaaatggggcgaacgacttcatgctccgagacgggacagttactaccgactggaagactctggtgcaagaatggactgttcaacgacctggacagacttgtcagcctatcctagaggagcagtgtctggtacctgactcctctcactgccaggtgctcctgcttcccttgtttgctgagtgccacaaggtgttggcaccggccactttttatgcaatctgccaacaagatagctgccatcaggagcaggtatgcgaggttatcgcttcttatgcacatttatgccgaactaacggtgtgtgtgtggattggagaactccggacttctgtgcaatgtcttgtccccccagcctggtgtacaatcattgcgagcacggatgcccccgccactgtgatggaaacgtcagtagctgcggcgatcacccaagcgaggggtgtttctgcccacccgataaggttatgctagagggtagctgtgtgccggaggaagcatgtacccaatgcattggcgaggacggcgtccaacatcagtttctcgaggcctgggtgccggatcaccaaccgtgtcagatttgcacgtgcctttcagggcggaaggtgaattgcactacgcagccctgccccacagctaaggccccaacttgcggcctgtgcgaggttgccagattgcgacagaatgccgatcaatgctgccctgaatacgagtgtgtctgcgatcctgtatcttgcgatctgccgccagtaccacattgtgagagaggattgcaacccaccttgacaaaccctggcgagtgccgtccaaattttacctgcgcttgccgaaaggaggaatgtaagcgggtgtccccgccaagctgtcccccccatcgcctgcctactttacgaaagacccaatgttgcgatgagtacgaatgcgcttgcaattgcgtcaactccaccgttagctgtccactaggttacctcgcctctaccgctaccaacgactgcggatgcacaaccactacatgcctacccgacaaagtttgcgtgcacaggtccactatttatccggtgggacagttctgggaagaagggtgtgatgtgtgcacttgtacagacatggaagatgccgtgatgggcctccgggtggcccaatgcagccagaaaccatgtgaggatagctgtaggtccggtttcacgtatgtcttgcacgaaggtgagtgttgtgggagatgtctgccgtccgcttgtgaggtcgttaccggcagccctcgtggtgatagccagtccagttggaagtccgtggggtcccaatgggcctccccagaaaacccatgtctaatcaacgagtgtgtcagggtgaaggaggaggtgttcatacagcagcgtaatgtctcctgtcctcagctcgaggtgcccgtttgccccagtggctttcagctctcctgcaagacctcagcctgctgtcccagctgccgctgcgaacgcatggaggcctgcatgttgaatggtacggtgatcggtccaggtaagactgtgatgatagatgtgtgtactacctgccgatgtatggtgcaggtgggagttatcagtggttttaagcttgagtgccggaagaccacatgtaacccctgccctctgggttacaaggaggaaaataacactggcgagtgctgtggccgatgcctgcctacggcgtgcactatccagttacgcgggggccagatcatgactcttaaacgcgatgagactctgcaggatggctgtgatactcatttctgcaaggtgaatgaacgcggcgaatacttctgggagaagcgggttacagggtgtccaccattcgacgagcataagtgtctggccgagggcggcaaaatcatgaaaattcctggaacctgctgcgacacatgtgaagaaccagaatgtaacgacatcaccgcgcggctgcagtatgtgaaagtcggaagctgtaaatccgaggtcgaggtcgacattcattactgccagggcaagtgtgctagcaaagcaatgtatagcatcgacatcaatgatgtgcaggaccaatgttcatgctgcagcccgaccagaacagagccgatgcaagttgcattgcactgtaccaacggctctgtagtgtaccacgaggttctgaacgccatggagtgtaagtgctccccacgcaagtgttcaaaa

SEQ ID NO: 21341 - DNA, 8439 bp, Artificial Sequence
  Description of Artificial Sequence: Synthetic coding sequence
atgatcccagcaagatttgcaggcgtgctccttgctcttgcacttatcttgccaggaactctctgtgcagaaggtactaggggtcggagttcgaccgcacgttgctccctgtttggatccgactttgtgaacacctttgatggatctatgtactcgttcgcgggatactgttcgtatcttcttgcaggaggatgtcagaagcggagcttttccattatcggtgatttccagaatggaaaaagggtgagcctctcggtctacttgggcgagttttttgacattcatctgttcgtgaacgggaccgtcacccagggggatcagcgggtgagcatgccttacgcgagcaagggactgtatctggagactgaagcaggctactacaagctgagcggtgaggcttatggatttgtggcaagaatagatggatcaggaaatttccaggtgctgctttccgaccgctactttaacaagacctgcggcctctgcggcaatttcaatatctttgcggaggacgactttatgacccaggaaggaaccctcacgtcggacccttacgatttcgcaaacagttgggccctttcgtccggggagcagtggtgcgaacgcgcatcgccaccatcttcgtcgtgtaacatttcgtctggtgaaatgcaaaagggactctgggagcagtgtcaattgctgaagtcaacttcggtgttcgcccgatgccatccgcttgttgatcctgagccctttgtggcactctgtgaaaagactctgtgtgaatgcgctggcggcctcgaatgtgcgtgccctgcacttctggaatatgcacggacctgcgcccaagaggggatggttctgtatggttggacggaccatagcgcctgttcgcccgtgtgtcctgcgggaatggaatatcgccaatgtgtgtcaccgtgcgcccggacctgtcaatcgttgcatatcaacgaaatgtgtcaagagagatgcgtggatggttgttcctgcccggaagggcaactgctcgacgaggggctttgcgtggaatccactgaatgtccgtgtgttcactccggaaagagatacccaccgggaacctcactctcaagagattgtaacacttgtatctgcagaaacagccaatggatctgttcaaatgaagaatgcccgggagaatgtcttgtgactggtcagagccacttcaagtcctttgataatagatacttcaccttttcgggcatttgtcaatacctgctggccagggactgccaagatcattcatttagcatagtcatcgaaactgtgcaatgcgcagatgaccgcgatgctgtgtgcactaggagcgttaccgtgcggcttccaggactgcataattcgctcgtgaaactcaagcatggggcaggcgtggcaatggatggacaagatgtgcagcttccacttctgaagggtgatctgagaatccaacacactgtgacggcttccgtgcgcctttcgtacggtgaggaccttcagatggattgggacggaagagggagactgcttgtgaagctgtccccggtctacgcaggaaagacctgtggactgtgcggaaactacaacggaaatcagggagacgactttttgacgccctcaggtcttgccgagccgagagtggaagatttcgggaacgcttggaaacttcacggtgattgtcaagatctgcaaaagcagcatagcgacccatgtgcactgaatcctcgcatgactaggttttccgaggaggcatgtgcagtcctgacttctcccacctttgaagcatgccaccgcgccgtgtcacctctcccttacctgcgaaactgtcgatatgacgtgtgttcatgttcagatggccgggagtgcctgtgcggagcacttgccagctacgctgcagcttgtgccgggcgcggtgtgagggtggcatggcgggagccaggcaggtgtgaactcaactgtccgaagggacaagtctaccttcagtgtggcacgccctgtaacctgacttgtcggtcactgtcgtacccagatgaagaatgtaatgaagcctgtctggaggggtgcttttgtcctcctggactgtacatggatgagcggggagattgtgtgcctaaggcacagtgcccctgttactacgacggtgaaatcttccagccagaggacattttcagcgaccatcatactatgtgctactgcgaagatggatttatgcactgcaccatgagcggcgtccccgggagcctccttcctgatgctgtcctgtcgtcgccacttagccaccgtagcaaaagaagcctgtcatgccggcctccaatggtgaagctggtgtgtccagccgacaacctccgggcagaggggctggagtgtaccaagacctgccagaactacgatcttgagtgtatgtcgatgggctgcgtgtcgggttgtctgtgccctccaggaatggtgagacatgaaaatagatgtgtcgcactggagcggtgtccatgttttcatcaggggaaagagtacgcccccggtgaaaccgtgaagatcggatgcaacacttgcgtttgtcaggacagaaaatggaactgcactgatcacgtctgcgatgcaacgtgtagcactatcggtatggcacactaccttacctttgatggtcttaagtacctgtttccaggtgaatgtcagtacgtccttgtgcaagactactgtgggtcaaatcctggtacctttaggattctcgtggggaacaaaggatgcagccatccgtccgtcaagtgtaagaagcgtgtcaccattctggtggagggtggagaaattgaactcttcgatggcgaagtgaacgttaagcgcccaatgaaggatgaaacccattttgaggtggtcgaaagtggacgctacattatcttgcttctgggaaaagcgttgtcagtggtgtgggatagacatctgtcaatatcggtggtgcttaagcaaacctaccaggaaaaggtctgcggattgtgtgggaactttgatggaattcagaacaatgatctgactagttcgaatcttcaagtggaagaggaccctgtggattttgggaacagctggaaggtgagctcccagtgtgcggatacccgaaaggtgccacttgattcgtccccagcaacttgtcacaataacattatgaagcaaaccatggtggattcaagctgtagaattttgacctccgatgtgtttcaagattgtaacaaactggtagatcctgaaccataccttgatgtctgcatctacgacacctgtagctgcgaatcgattggtgattgtgcatgtttctgtgacacgattgctgcatacgcacatgtctgcgcccaacatggaaaagtggttacttggcgaaccgcgacgctgtgtcctcagtcctgcgaagaaagaaatctccgtgaaaatggctacgaatgtgagtggagatacaactcgtgtgcacctgcgtgtcaggtgacgtgtcagcatcctgaacctcttgcctgcccagtgcagtgcgtcgagggttgccatgcccactgcccacctggtaagatactggatgaactgctccaaacttgcgtggacccagaagattgccctgtctgcgaggtcgcaggccggaggtttgcgtccggaaaaaaggtgactctgaaccctagcgatccagaacattgccaaatatgccactgcgatgtggtcaacttgacctgtgaggcatgccaagagcctggaggactggtcgtgccaccaaccgatgcgccggtgtcccctaccaccctctatgtggaggacattagcgaaccaccactgcatgacttttactgttctcggctgcttgacctggtctttctcctggacggatcatcgcggctgtccgaagccgaattcgaagtcctcaaggcttttgtcgtggacatgatggaacgcttgaggatttcacaaaaatgggttcgtgtcgcagtggtggaataccacgatgggtcacacgcatacattggactcaaggatcggaagcgaccttcggagctccgcaggattgcctcgcaagtcaagtacgccggatctcaagtcgcatcaacttccgaggttcttaagtataccctgtttcaaatcttctccaagattgatcgaccagaggcatcacggattactctcctcctgatggcgtcccaggagccacaacggatgtcacgaaactttgtcagatacgtgcaaggccttaagaagaagaaggtgatcgtcatccctgtaggaataggacctcatgcaaatctcaaacaaattcgacttattgaaaaacaagcgcctgagaacaaggcattcgtgctgtccagcgtggatgaactggagcagcaaagagacgagattgtgtcgtacctctgtgacttggcccctgaagcaccacccccaactcttccacctgacatggcccaagtgaccgttggaccgggacttctcggtgtgtcgactctgggaccaaaacggaactcaatggtgctggatgtcgcgttcgttctggaaggctccgacaagatcggagaggcggatttcaacaggtcaaaggagtttatggaagaggtgattcagagaatggatgtcggacaagactcaatccatgttactgtgcttcagtactcgtacatggtgaccgtcgaatacccgttttccgaagcacaatccaagggagatattctgcagcgagtcagagagatccgttaccagggaggtaatcggaccaatactgggcttgcactccggtacctgtccgatcattcctttcttgtcagccaaggagatagagaacaggcacccaacctggtctacatggtcaccggtaaccctgccagcgatgaaatcaaacgactcccaggagacatccaagtggtgccaattggtgtgggacctaacgccaacgtccaagaacttgaacgaataggttggccaaacgctccaattctgatccaagattttgaaaccctgcctcgggaggcacccgatctggtgctgcagagatgctgttccggagagggacttcagatcccgaccctttcccctgccccggactgttcccaacccctcgacgtgattctgctgctcgatggatcatcgtcatttcctgcaagctactttgacgaaatgaaatcgtttgcgaaagcgttcatctccaaagccaatattggtccgcgtctcacccaggtgtctgtgctccaatacggaagcattaccaccatcgacgtcccttggaatgtggtcccggagaaggcacatcttctctcattggtggatgtcatgcaacgtgaaggaggtccttcgcaaataggggacgcactgggattcgcagttaggtacctgaccagcgaaatgcatggagcacgtcccggagcatcaaaggcggtcgtcattctggtgactgacgtgtccgtggattccgtggacgcagccgcagacgctgcgagatcgaaccgggtgaccgtgtttccaattggtataggagacagatatgatgcggcacagctccgcattctggctgggcctgccggagatagcaacgtggtgaaactccagcgaatcgaagatctgccaaccatggtaactttggggaactcattcctgcataagctctgctcggggttcgtcagaatttgcatggatgaagatggtaacgaaaagcgtcctggagatgtgtggactctgccagaccaatgtcataccgtgacgtgtcaacccgatgggcaaactcttctgaagtcacatagagtgaattgtgacagaggtcttagaccttcatgtcccaacagccagtcgcccgtgaaagtggaagaaacctgtggatgccggtggacttgtccctgtgtgtgtactggaagcagcacgagacatatcgtgactttcgatgggcagaactttaagctcactggctcgtgttcgtacgtgctgttccagaataaagagcaagacttggaagtcattctgcacaacggagcatgttcccccggcgcgagacaaggttgcatgaagagcattgaggttaagcattcagcactgtcggtggaacttcactccgatatggaagtgacggtgaacggtcgccttgtgtcagttccatacgtgggaggaaacatggaggtgaatgtttacggcgcgatcatgcatgaagtcaggttcaaccatctcggacatatcttcaccttcaccccccagaacaatgaatttcagcttcagcttagccctaagacttttgcaagcaagacttacggactgtgtggtatatgtgatgaaaacggagctaacgactttatgcttcgcgatggcaccgtgaccacggattggaaaacgctggtgcaagaatggaccgtgcagcgcccaggtcaaacctgccaacccatacttgaagaacaatgtctcgtccctgatagcagccattgtcaagtgctccttcttcctctttttgcagaatgccataaagtgctggccccagccaccttctacgcaatttgccagcaagattcgtgtcatcaggaacaagtgtgtgaggtgattgcatcctacgcgcatctttgtagaaccaatggtgtgtgcgtagattggcggactcccgatttctgtgcaatgtcatgtccgccatcgctcgtgtacaatcattgtgaacatggttgtcctcggcattgcgatggtaacgtcagctcatgtggtgatcacccgtcagaaggctgtttctgtcctccggataaagtcatgcttgaaggatcctgtgtgcccgaagaagcgtgcacccaatgcatcggagaggacggagtacagcaccaatttctggaggcatgggtgccagaccaccagccatgtcagatctgtacctgcttgtctggtcgtaaagtcaattgtactacccaaccgtgtccaactgcgaaggcgcctacgtgtggcctgtgcgaagtggctaggcttaggcaaaatgccgaccaatgttgtcctgagtatgagtgtgtgtgcgatccagtgtcctgtgatctgcctccagttccgcactgtgagagagggcttcagcccacgttgaccaaccctggagaatgccggccgaactttacctgcgcttgccggaaggaagaatgcaagcgagtgtcacccccaagctgccccccgcacaggctgcccactttgcgcaagacccaatgctgtgatgagtacgaatgtgcatgtaattgcgtgaactccactgtcagctgtcctctgggttacctcgccagcaccgcaacgaacgactgtggctgcaccactaccacttgtttgccagacaaagtgtgcgtccaccgatccacgatttacccagtgggccaattctgggaggagggttgtgatgtatgtacttgtactgatatggaggacgcagtcatgggtctgcgtgtggcacaatgtagccaaaaaccatgtgaggattcgtgccgctcaggtttcacttacgtgctgcatgaaggcgaatgttgcggtcgctgccttccttcagcgtgtgaagtggtcacgggatccccaaggggagactcacagtcctcctggaagagcgtgggctcccaatgggcatcacccgagaacccatgtctgattaacgaatgtgtgagagtgaaggaagaagtctttatacagcaacggaatgtgtcgtgcccgcagctggaggtgcctgtgtgccctagtggtttccagctctcctgtaaaactagtgcctgttgtccgtcctgcaggtgcgaacgcatggaagcctgtatgctcaatgggactgttattggaccaggcaagaccgtcatgattgatgtgtgcactacttgtaggtgcatggttcaggtaggagtgatcagcgggtttaaacttgaatgtcgaaaaactacctgtaatccctgcccccttggctacaaggaggaaaacaataccggggaatgttgtggccgttgtctgccaactgcctgtactattcagctgcggggcggtcagattatgactctgaaaagagacgaaactctgcaagatggatgcgacacccacttttgtaaagtgaacgagcggggggagtacttctgggagaagagagtgacgggttgtcctccttttgatgaacacaagtgtcttgcggaaggaggcaagattatgaagattcccgggacttgttgtgatacttgtgaggaaccagaatgcaatgacatcacggcacgactgcaatacgtgaaggtggggtcctgtaaatccgaagttgaggtggacatccactactgtcagggaaagtgtgcttccaaagcgatgtacagcatcgatatcaatgatgtgcaagatcagtgttcgtgttgttcgcctacccgtaccgaacctatgcaggtggccctgcactgcacgaacggttctgtcgtctaccatgaagtcctcaacgcaatggaatgcaagtgtagcccccggaagtgctccaag

SEQ ID NO: 21342 - DNA, 8439 bp, Artificial Sequence
  Description of Artificial Sequence: Synthetic coding sequence
atgatcccggcacggttcgcaggagtcctccttgcactggcccttatccttccgggtacgctgtgcgccgaaggtactcgggggagatcctccactgcacgctgttcgttgtttggaagcgatttcgtgaataccttcgatggatcgatgtacagcttcgcaggttactgttcctacctgcttgcaggaggatgccagaagcgttcattttcaatcattggcgactttcaaaacggtaagcgcgtgtcactgtcagtgtacctgggcgagttttttgacattcatctctttgtgaacggaaccgtgacccaaggagatcaaagagtctcgatgccttacgcatccaagggactctacctggaaactgaagcagggtactacaaactttcgggagaagcctatggctttgtggcaagaatcgatggatctgggaactttcaagtgttgctgtcagataggtatttcaacaagacgtgtggtctttgcggaaatttcaacatttttgcagaggatgactttatgacccaggagggtactctgacttccgatccttatgactttgcaaactcgtgggcactgtccagcggagaacaatggtgtgaaagagcgtccccaccctcgtcgtcctgcaacattagctccggcgaaatgcaaaaaggactttgggagcagtgccagctcctgaagtcgaccagcgtctttgcgcgatgtcaccctcttgtggatcccgagccattcgtggcgctttgtgaaaaaactctttgtgagtgcgcaggtggccttgaatgtgcatgtccagctcttctggaatatgcaagaacgtgtgcccaggaaggtatggtcctctacggatggaccgaccattcagcatgttcgcctgtttgcccagcaggcatggagtaccgtcagtgcgtcagcccctgtgcacgaacttgtcagtcgctgcacattaacgaaatgtgtcaggagcggtgtgtggatgggtgttcgtgtcctgaaggtcagctccttgacgaaggactgtgtgtggaaagcaccgagtgtccctgcgtccattcgggtaagcggtatccaccaggtacttccctctcccgggactgcaacacttgcatctgtcgtaactcccagtggatctgtagcaatgaagaatgcccgggggagtgcttggtgaccggacagagccatttcaaatcatttgataatcggtactttacttttagcgggatttgtcaatacctccttgccagggactgccaagaccattccttttcaatcgtgatcgaaactgtccaatgcgcggatgaccgagacgccgtgtgcaccaggagcgtaactgtgaggctgcccggtttgcacaactcgttggtcaaacttaaacatggcgcaggcgtggcgatggacggacaagatgtgcaactccctctgttgaaaggagacttgagaattcaacatactgtgacggcaagcgtgagactttcctacggagaagatctgcagatggactgggatggacgtggccgactgttggtaaaactgtctcctgtgtacgcaggaaagacttgtggtctttgtggtaactacaatgggaaccagggagatgattttcttacccctagcggtcttgcagaaccacgcgttgaggactttggaaatgcctggaaactccatggcgattgtcaggatctgcaaaagcagcactcggatccttgtgcactgaacccccggatgactaggttttcagaagaggcctgtgcagtcctgaccagcccaacttttgaagcatgccatagagcagtgtcgcctcttccataccttcggaactgccggtacgacgtgtgcagctgctcagacggtagagaatgtctctgtggggccctcgcatcatatgcagcagcgtgtgcaggacgcggggtgagggtggcatggcgtgaaccaggacggtgtgaattgaactgcccaaagggtcaggtgtacctgcaatgtggaaccccatgcaatcttacctgtcggtcgctttcataccctgatgaggagtgtaacgaagcatgcctcgagggttgtttttgtccaccaggcctttacatggatgaaagaggagactgtgtgcccaaggcacaatgtccttgttactacgacggcgagatttttcagccggaggatatcttcagcgatcaccataccatgtgttactgcgaagatggatttatgcattgcactatgtcaggcgtgcccggttccttgttgcccgatgcagtgctttcttcacctctttcgcatcgttcaaagcgatccctcagctgtaggccacccatggtgaagttggtgtgcccggcagataaccttcgcgcagaaggactcgaatgtaccaaaacctgtcagaactacgatcttgaatgtatgtcgatgggatgtgtgtcgggctgcctctgcccacctggaatggtgcgacatgaaaatagatgtgtcgcactggagagatgcccgtgtttccaccaaggcaaggagtacgcgcctggtgagacggtgaaaataggctgtaacacctgcgtgtgtcaagatcgcaaatggaactgtaccgatcatgtgtgtgacgctacttgctccaccatcgggatggcgcattacctcactttcgatggtctgaagtacctgttccctggagagtgccaatacgtactggtgcaagattactgcggttcgaatcccggtacgttcaggatccttgtgggcaacaagggatgctcacaccctagcgtgaagtgtaaaaagcgggtgactatactcgtggaaggcggagagattgagctctttgacggtgaggtgaacgtgaaaagacctatgaaggatgaaacccactttgaggtggtggaatcgggacgctacatcattctgctcctcgggaaagcactgtccgtggtgtgggatagacatctgagcatctcggtcgttctcaaacagacttaccaagagaaggtgtgtggcctctgtggcaattttgatgggattcaaaacaatgatcttacttcgtccaacctgcaggtggaagaggatccagtggattttgggaattcctggaaggtgtcgtcacagtgcgcggacacccgtaaggtgccactggactcgtcgcctgccacctgtcataacaacattatgaaacagaccatggtggactcgtcctgcagaattctgactagcgacgtgttccaagattgcaataagctggtggacccagaaccatacttggatgtgtgtatctacgatacctgctcctgcgaatccattggagattgtgcatgtttctgtgataccattgcagcgtatgcacatgtctgtgcacaacatgggaaggtggtgacttggcggactgcaaccctttgtcctcagtcgtgcgaagaacgcaacctgagagaaaacggatacgaatgcgagtggaggtacaacagctgcgcacccgcatgtcaagtgacttgtcaacaccctgaacctttggcatgtcctgttcagtgcgtcgaaggttgtcatgcacactgtcctcctggaaagattcttgatgaacttctccaaacctgtgtcgatcctgaagattgtcctgtgtgtgaagtcgcaggcagacggtttgccagcggtaagaaggtgaccctgaacccatccgatcctgaacactgtcagatatgtcattgtgatgtggttaacctgacctgcgaggcatgtcaagagccaggtggacttgtcgtccctcccaccgatgcacctgtctcaccgaccactctgtacgtcgaggatatcagcgaacctcctcttcacgacttttactgttcgcgtctgctggatctcgtgttcctgttggatggatccagccgcctttccgaggctgaatttgaagtgcttaaagcgtttgtcgtcgatatgatggaacgattgcgtatttcacaaaagtgggttagagtggccgtggttgaataccacgatggatcacatgcctacatcggcttgaaagaccggaaaagaccctccgaactccgccggattgcgtcacaagtgaagtatgccgggtcccaagtggcctccacttcagaagtcctcaagtacactctgttccagattttctccaagattgatcgtcccgaagcaagcagaataaccctcttgctgatggcgtcacaagagccacaaaggatgagccgaaatttcgtgcgttacgtccagggactcaagaagaagaaggtcattgtgatcccagtcggtatcggaccgcacgcaaacctgaagcagatccgccttattgaaaaacaagcgccggaaaacaaagcatttgtgctgagctcggtcgatgaacttgagcagcagagagacgagatcgtgtcctacctttgcgacttggccccagaagcaccacctcctaccctcccacctgacatggcacaggtgaccgtcggacctggtctgctgggtgtctccacgcttggtcctaaaagaaactcaatggtgcttgacgtggcgttcgtgctcgaagggtcggacaagattggggaagcggatttcaatcgctctaaggagttcatggaagaggtgatacagagaatggacgtgggacaagattcaatacatgtcactgtcctgcaatactcttatatggtgacggttgaataccctttttcagaagctcaatcgaaaggagatattctgcagcgagtgcgagagattcgctaccaggggggaaaccgtaccaatactgggttggcacttagatacttgtccgatcactcgttccttgtgtcacaaggagatcgagagcaagcaccgaacctggtctacatggtgacggggaatccagcatcggatgaaatcaagagactccctggagacatccaagtggtgccgatcggagtgggacctaacgcaaacgtgcaggagctggaacgcattggctggcctaacgcgccgatacttattcaagatttcgaaacccttccccgggaagcgcccgatctggtgctccagcgctgttgctcgggtgaaggactccagattcctactctttctcccgcacccgattgctcacagcctttggatgtgattctccttcttgacggatcctcatcgtttccagcgtcgtacttcgatgagatgaagtcatttgctaaggcattcattagtaaggcaaacattgggcccaggcttactcaggtgtctgtgctgcaatacggaagcatcaccaccatagatgtcccctggaatgtggtcccggaaaaggcccatcttctctcacttgtggatgtcatgcaacgagaagggggtccttcgcagattggagatgcactgggtttcgcagtccgataccttacctcggagatgcatggtgcccgccccggagcatcaaaggcagtcgtgatcttggtcaccgacgtgtccgtggattccgtggacgcagcagccgacgcggcgagatcgaacagggtcaccgtgtttccgattggaattggtgatagatacgacgcagctcagcttagaattctggctggtccagccggcgattcaaatgtcgtgaagctgcaaaggatcgaggacctgcccacgatggtgactctgggtaattcctttctccataagctgtgctcgggttttgtcagaatatgcatggacgaggatggaaatgagaagaggccaggcgatgtgtggactctgcccgaccagtgccacaccgtgacctgccagcctgatggccaaactctcctgaagtcccacagagtgaattgcgatcggggactgcgacccagctgtcctaatagccaatcgcctgtcaaggtcgaggaaacctgtggatgtcggtggacctgtccttgcgtctgtaccggaagcagcacgcggcatatcgtgacgtttgacggacaaaacttcaagttgaccggaagctgttcgtacgtgctgtttcagaataaagaacaagacctcgaggtgatccttcacaacggcgcatgttcacctggggctagacagggctgtatgaagtctatcgaggtcaagcatagtgctctgagcgtcgaactgcattcggatatggaggtgaccgtcaacggtcgccttgtgtccgtcccctacgtgggtgggaacatggaagttaacgtgtacggggcgatcatgcacgaagtccggttcaatcatcttgggcacatattcacgttcactccccaaaacaacgagtttcaactccagctttcccctaagacttttgcttcaaagacctacggcctgtgcggaatatgcgatgaaaacggcgcaaatgactttatgctcagggatggaaccgtcaccaccgactggaaaacgctggtgcaggagtggactgtgcaaagaccgggacaaacttgtcaaccaatccttgaagagcagtgcctcgtgcctgattcgtcgcattgtcaggtgctgttgctgccccttttcgcagaatgtcataaggtgctcgcccctgcaactttttacgcaatctgtcaacaggacagttgccatcaggaacaggtgtgtgaagtgattgcatcctacgcacatctgtgtagaaccaacggagtgtgcgtcgattggcggaccccggacttttgtgccatgtcgtgtcctccgagcctcgtttacaaccattgtgagcatggctgtcctcggcactgtgatggaaacgtgtcctcatgcggggaccatccatcagagggatgtttctgtccaccggacaaagtgatgctggagggatcatgcgtcccggaagaagcgtgtactcagtgtattggcgaggatggtgtccagcatcaatttctggaagcatgggtgccagaccatcagccttgtcaaatttgtacttgcttgtcaggacgcaaggtgaattgcacgactcagccttgtcccaccgcaaaggctccaacttgtggactttgcgaagtggcccggcttagacagaacgcagatcaatgttgccccgaatatgagtgtgtgtgtgacccagtgtcctgtgatcttccccccgtcccccattgtgaaagaggccttcagcctacccttaccaatccaggagaatgccgccccaactttacctgcgcatgtcggaaggaagagtgcaagcgcgtctcgcctccgtcgtgtcccccacataggctcccgactctgcgaaagacccagtgttgcgatgagtacgaatgtgcctgtaactgtgtgaactcaaccgtgagctgtccattgggatatttggcctcgaccgccactaatgactgtggttgtaccaccaccacttgccttccagataaggtctgtgtgcacagatcgactatttacccagtcggacagttctgggaggagggatgtgatgtctgcacttgtaccgatatggaggacgcagttatggggcttagagtcgcacagtgttcgcagaaaccctgtgaggatagctgtcggagcgggtttacttacgtgctccacgaaggggagtgttgcggtagatgccttccatcggcttgtgaagtggtgaccgggtcgccacgaggggactctcagtcgagctggaagagcgtcgggtcgcagtgggcctccccagaaaatccatgtctcattaacgaatgcgtgagggtcaaggaagaagtgtttatccaacagcggaacgtgtcctgtccccagcttgaagtgccagtctgcccttctggattccagttgtcctgtaagacttccgcctgttgcccttcgtgccgttgcgaacgcatggaggcctgtatgctgaatggaaccgtgatcgggccagggaaaactgtgatgattgatgtgtgtaccacttgccggtgtatggtccaagtgggggtcattagcggctttaagttggaatgtcgcaagactacctgcaatccttgtcctctgggatacaaggaggagaacaataccggtgagtgctgtggtcggtgcctgcctactgcatgtactatccaacttaggggaggccagataatgactctcaagcgggatgaaacgcttcaggacggatgtgatactcatttctgtaaggtcaacgagcggggagagtacttttgggaaaagcgggttacgggttgtcctcctttcgatgaacataaatgcttggctgagggtggaaagatcatgaagattcctggaacttgctgtgatacctgtgaagaaccagaatgtaatgatatcacggcacgacttcaatacgtcaaggttggttcctgtaagagcgaggtcgaagtcgacatccattactgtcaggggaagtgtgcaagcaaggcaatgtatagcattgatatcaacgatgtgcaagatcaatgtagctgctgttcaccgacccggacggaacctatgcaggtggcattgcattgtactaacggatccgtggtgtaccatgaggtgctgaacgcaatggagtgtaaatgttcgcctcggaagtgctcgaaa

SEQ ID NO: 21343 - DNA, 8439 bp, Artificial Sequence
  Description of Artificial Sequence: Synthetic coding sequence
atgatcccagcccggtttgcgggtgttctgctcgcattggccttgattctacctggcaccctctgtgctgaaggaaccaggggcaggagttctaccgcacgctgtagtctgttcgggtccgattttgtgaacacttttgatggttcaatgtattcctttgcgggttattgctcttatttactggctggggggtgtcagaaacggtcgttttcaatcatcggcgactttcaaaacgggaagagggtgtctctgtcagtctatcttggggagttttttgatatacatctcttcgtgaacggcaccgtgacccagggagaccagagagtgagcatgccatacgcctccaaggggctttaccttgagacagaggctggatattacaaactatctggcgaagcgtacgggtttgtggcaagaatcgatgggtctggaaattttcaagttctgttgtctgatcgctacttcaacaagacctgtggtttgtgtggcaacttcaatatattcgcagaagacgacttcatgactcaggaaggcaccctcaccagcgatccttacgacttcgcaaacagctgggcgttatcgagcggcgaacagtggtgtgagagggcctcaccacctagttcgtcgtgtaacatcagcagtggtgaaatgcaaaaggggctgtgggagcaatgccagctcctgaagtcaacctcagttttcgccaggtgccaccccctagtggacccagagccgttcgtggcactgtgtgagaaaactctgtgtgagtgcgcggggggattggaatgcgcttgcccagcactgttggaatacgcccgaacgtgcgctcaggaggggatggtcctttacgggtggactgatcacagtgcctgctcccccgtgtgtcccgccggaatggagtatcgtcagtgcgtgagtccttgtgcccgaacctgtcagtccctccacatcaacgagatgtgccaggagagatgtgttgatggctgttcatgcccagaaggccaactgctggatgaaggcctttgtgtggaaagcaccgaatgtccttgtgtgcactctggtaaaagataccccccaggaacttctctttccagggattgcaacacatgtatctgcaggaattcacagtggatctgttccaatgaggagtgtcctggagaatgcttggtgactggccagagtcattttaagagctttgacaaccgatacttcacatttagcggaatatgccagtacctattagcgcgggattgtcaggaccactcatttagcatcgtcattgagacagtccagtgcgcagacgaccgggacgcagtttgtaccaggtccgtaaccgtgcgccttcctggattgcataactccctggttaagctaaagcacggggctggggtggcgatggacggacaggatgtgcagctgcctcttctgaagggcgatctgaggattcagcatacagttactgcctctgtccggctatcttatggtgaggaccttcagatggactgggatggccgtgggcgcctgctggtcaaactctctcctgtctacgctggtaagacctgcggcttgtgtgggaactataatggcaatcagggggatgactttctcacgcccagcgggttggctgaaccccgtgtggaagactttgggaacgcgtggaagctgcacggcgactgccaggatttgcagaaacagcactctgacccctgtgctctgaatcccaggatgacccggttttccgaggaagcctgtgccgttctcacttctcccacgttcgaagcttgccatcgggcagtgtcaccactcccatacctgcgcaattgccgctatgatgtgtgttcctgtagcgatggacgagaatgtttgtgcggtgctttagcctcatacgctgccgcatgcgccggcaggggggtgcgggtagcctggcgcgagccgggaaggtgtgagctgaattgtcccaaaggacaggtgtatctacagtgtggaactccgtgcaatctcacttgccgaagtttatcttacccggacgaagaatgtaacgaggcttgcctcgagggatgcttttgccccccaggactgtacatggatgagcgtggagactgcgtgcctaaagctcagtgcccctgttattacgacggagaaatttttcagccagaggatattttcagcgaccatcatacaatgtgctattgtgaagatggctttatgcattgtactatgagcggcgtgcccggctcattattaccggatgctgtgttgagctcacctttgagccacaggagtaaaagaagtctatcctgtcggccccccatggtgaaactggtgtgtccagccgataatctgagggctgagggattggaatgcaccaaaacttgccagaattacgatctggaatgtatgagcatgggatgtgtgagtggttgcctgtgcccccctgggatggtccggcatgaaaatcgctgtgttgccctggaacgttgcccctgtttccaccagggcaaggaatacgccccgggggagacagtgaagataggatgtaatacttgcgtttgccaggacagaaagtggaattgtaccgatcacgtgtgtgacgccacctgctcaacgatcgggatggctcattatttgacatttgacgggcttaagtatcttttcccaggcgaatgtcagtatgttttagttcaggactactgcggttcaaatccgggtacctttcgaatcctcgtgggaaataagggttgtagtcacccctctgtgaaatgcaaaaaacgcgtgaccattctggtagaaggaggggaaatagaattatttgatggagaagtgaacgtcaagagacccatgaaagacgagactcactttgaggtggtcgagtctggccgctacattattctgctgctagggaaggctctctctgtggtgtgggaccggcatctcagcattagtgtcgttctgaagcagacgtatcaagaaaaagtttgtgggctctgcggcaactttgacggcattcagaataacgacctgacctcttctaatctacaggtggaggaggatcccgtagattttggcaattcctggaaagtttcatcacagtgcgccgatacccgcaaggtaccactggactcgagccccgccacatgccacaataatatcatgaagcagacaatggtagactcttcatgccggatccttacctccgatgtgtttcaggattgcaataagttggtggatccggaaccttacctggatgtctgtatttatgatacatgctcgtgcgagagcatcggggattgtgcctgtttttgcgacactatcgcagcatacgcgcatgtttgcgctcagcacggaaaagtggtaacctggaggaccgcgactctgtgcccacagtcttgtgaagagaggaatctaagggagaacggatatgagtgtgagtggcgatataacagctgcgcccccgcctgccaagtgacttgccagcatccggagcccctggcttgtcctgtccagtgtgtggaaggttgccacgcccactgcccaccaggaaaaatcctggatgagctgctacagacctgcgtggacccagaagactgtccagtgtgcgaggtcgctggacggcggtttgcgtccggaaagaaggtgacattgaaccctagcgatcctgagcactgtcagatctgccactgtgatgtggttaacctgacatgcgaagcttgccaggaaccagggggactggtcgtgccccctaccgacgctcccgtgtctcccactaccctctatgtggaggacatatcggagccacctctacacgatttttattgctctcgcctcctggatttggtcttcttgttggatggatcgtcccgacttagcgaggccgaatttgaggtgctaaaggccttcgttgtagatatgatggagaggctgagaatctctcaaaaatgggtgcgggtcgcagtggttgagtaccatgatggctcacacgcttacattggattgaaggacaggaagagaccttccgagctgaggcggattgcatcgcaagtgaaatatgctggttcgcaggtggcttcaacctccgaggtgctgaagtatactctcttccagattttctcaaaaattgatcgaccagaagcttctcggattaccttgctgcttatggctagccaagagcctcaacgaatgtcacgtaacttcgtgaggtatgtccagggactgaagaagaagaaagtaatcgtaattcccgtggggattggtcctcacgcaaatctaaagcagattcggcttatagaaaaacaggctcccgagaataaagcatttgtgctttctagtgtggatgaacttgagcagcaaagggatgaaattgtcagctatctttgtgacctcgccccagaagctcctccaccgaccctgccaccggacatggctcaggtgactgtggggccaggcctgttgggggtttctactctcggccccaagcgtaactctatggttctcgacgtggctttcgtgctagaaggcagcgacaaaatcggtgaggccgacttcaaccgcagcaaggaattcatggaggaagttatccagaggatggacgtgggccaggacagtatccatgtgactgttctccaatacagctacatggtgactgtggagtaccccttctctgaggctcagagcaaaggagatattcttcaacgcgtgagggaaatcagatatcaggggggcaatagaaccaatacaggacttgcgctgagatatctctctgatcacagctttctggtgagccagggcgacagggaacaggccccaaacctagtgtatatggtgactggcaatccagcgtccgacgagattaaacgcctacctggggacatccaggtggtcccaattggtgtgggtcctaatgccaatgtacaagagttggagcgtattggatggcctaatgccccgatcctgattcaagacttcgagactctccctcgcgaagctcccgacctggttttgcagcgctgctgcagtggggaagggttacagattccaactctgtcacctgccccagactgctctcaacctttggacgttattttgttgttggatgggagttctagttttccagctagctattttgacgaaatgaaaagcttcgccaaggcttttatttccaaggcaaatatcgggcctagactgacacaagttagcgttttgcagtatgggagtattaccactatcgacgttccttggaatgttgtccctgaaaaagcccatctgctgagtctagtcgacgtcatgcagagggagggcgggccttcccagattggcgatgcgctgggctttgccgttaggtatctcactagtgaaatgcacggggctagaccaggagcgtccaaggctgtagtgattctcgttacagacgtgagcgttgattcagtggatgcagccgcagacgcagcacgaagtaatcgggttactgtttttccaatcgggataggcgataggtacgatgccgcccagctgcgaatcctcgctgggccagccggagacagcaatgttgtgaaactgcagagaatcgaagacttgcctacaatggtgacgcttggcaactctttccttcacaagctgtgcagcgggtttgtccgaatttgtatggatgaggatgggaacgagaagcgaccgggcgacgtgtggacgttaccagatcagtgtcatacagtgacatgtcagcccgatgggcagacacttctgaagtctcacagagtcaactgcgaccgtggactgcgtccctcgtgtcctaattcccagtctccagttaaagttgaggaaacatgcggatgcaggtggacttgcccatgtgtctgcacagggtcttccacaaggcatattgtcacgttcgatggtcagaatttcaagctgacaggatcttgttcgtacgtgctcttccagaataaggaacaggacctggaggttattctgcacaacggagcttgctcaccaggcgcaaggcagggttgtatgaagtctatcgaggtcaagcactctgcgctaagcgtggaacttcactccgatatggaggttacagtgaatggcagactcgtttccgttccatacgttggaggaaacatggaagtgaacgtgtacggggcgatcatgcatgaggttcggtttaatcacctcgggcatatttttacgtttaccccacagaacaacgagtttcagcttcagttgtctcctaagaccttcgcctctaagacatacggtctgtgtggcatatgcgacgagaacggcgccaatgacttcatgctgagggatgggactgtcacaactgactggaagactctggttcaagagtggaccgtacagcggcctgggcagacgtgccagcccatcctggaggaacaatgcctcgtgccagacagcagccactgtcaggtgcttctgctcccacttttcgctgaatgtcacaaagtgctcgccccggctaccttttacgccatttgtcagcaggatagctgccaccaggagcaagtttgcgaggtcatcgcctcttatgcacatctgtgtagaacaaacggggtgtgcgtggactggcggactcccgacttctgcgccatgtcatgccctccaagcctcgtgtacaaccactgcgagcatggctgtccgcggcactgcgatgggaacgtgtcctcctgtggagatcacccctcagaaggatgtttttgcccaccagataaagtgatgctggaaggatcttgtgtgcctgaagaggcttgcacacagtgcattggagaggacggggtgcagcaccagttcctggaagcttgggtgccagaccaccagccctgccagatatgcacctgcctttcaggccgcaaagtgaattgcaccacccagccctgccccaccgccaaggcgcctacatgtgggctttgcgaggtggccagactgaggcagaacgcggatcagtgttgcccagagtacgagtgcgtatgcgacccggtgtcgtgcgatctgccaccggtcccgcactgtgagaggggcttgcagcccacgttaacgaaccccggagagtgtcgccccaactttacctgtgcctgccggaaggaggagtgcaaaagggtgagcccaccgtcctgtccccctcaccgattacctactcttcgaaagacacagtgttgtgatgagtacgagtgcgcctgcaattgtgttaactcaactgttagctgcccccttggctacctggccagcaccgcaacgaatgactgcgggtgtacgaccacaacctgtctgcccgataaggtgtgtgtacaccggtccacaatttatccagtaggacagttttgggaggaggggtgcgatgtttgcacatgtactgacatggaagatgccgtaatggggctcagggttgcccaatgctcacagaagccttgcgaggattcttgtagaagtggtttcacatatgtcttacacgagggcgaatgttgcggccggtgcttaccgagcgcatgtgaggtcgtcaccggatctccgcgaggggattctcagagtagctggaagagtgtcggctcgcagtgggcctcacccgagaacccttgcctcatcaacgagtgcgtgagagtgaaggaggaggtgtttatacagcagagaaatgtcagctgtcctcaactggaggttccagtttgcccgtcgggctttcagcttagctgtaagacgtccgcctgttgcccgtcctgcaggtgcgagagaatggaggcttgcatgctgaacggtaccgtaatcggccccggcaagaccgttatgatagatgtgtgcacaacctgtcgctgtatggttcaagtgggcgtgatcagcggtttcaaattggagtgccggaaaaccacttgcaacccctgcccactggggtacaaggaggagaacaacaccggagaatgttgtggcaggtgtctccctactgcatgcaccatacagcttcggggggggcaaattatgaccctgaagcgcgacgagacgctgcaagacgggtgtgacacccatttttgcaaagtgaatgagcggggagaatatttctgggagaaaagagttaccgggtgccctccatttgatgaacacaagtgtctggctgaaggaggcaagatcatgaagatccctggcacctgctgcgacacatgcgaagagccggagtgcaacgatataacggcacgcctgcagtatgtgaaagttggcagttgtaaatccgaggtcgaagtggatatacattactgtcaggggaagtgtgcctctaaggccatgtactccatcgacatcaacgatgtccaggatcagtgttcctgttgcagtcctaccagaaccgaaccaatgcaagtagctctacattgcacaaacggctctgtggtctaccatgaggtgttgaatgctatggaatgtaaatgctcaccacgcaagtgctccaaa

SEQ ID NO: 21344 - DNA, 8439 bp, Artificial Sequence
  Description of Artificial Sequence: Synthetic coding sequence
atgataccagctaggttcgcaggcgttctgctcgctctggcgcttattcttcccgggactctgtgcgcagaaggaaccaggggtcggagtagcactgcgcgttgctcactctttgggtcagatttcgtcaataccttcgatgggtctatgtactcctttgccggatactgcagctatctcttagccggcggctgtcaaaagcgaagcttttccataattggggactttcagaatggtaaaagggtttcactgagtgtatacctaggcgagttctttgacatacatttgtttgtcaatggcaccgtgacacagggggatcagcgtgtgagtatgccatacgcttctaagggcctctatctggagaccgaggccggctactacaagctgtctggggaagcctatgggtttgtggcccgcatagatgggtccggaaattttcaggttctcctctccgacaggtattttaataagacctgtggactgtgcggaaactttaacatttttgccgaagacgactttatgacccaggaaggaaccctgaccagtgacccttatgacttcgctaattcatgggcactgtcatctggggaacaatggtgcgaaagggcctccccaccttcctcctcgtgtaatatcagctccggcgaaatgcagaaaggcctgtgggagcagtgtcaactactcaagtcgacatctgtatttgctaggtgtcacccgctggtggaccctgaacctttcgtggccttgtgtgaaaaaaccctgtgtgaatgtgcgggtggcttagagtgcgcctgccccgcattgttggagtacgctcggacttgcgcacaggagggcatggtgctgtacgggtggacggatcactctgcatgctccccggtctgccctgcagggatggaatacaggcagtgcgtctccccttgtgcccgcacatgccagagcctgcacattaatgaaatgtgtcaggagaggtgtgtagatggttgtagttgcccagaagggcaactgctggacgaggggctatgtgtggaatccactgaatgtccctgcgtccatagcggaaagagatatcccccgggcactagtctctctagggattgcaacacttgtatttgccggaattcccagtggatatgctccaatgaggaatgtcccggagagtgtctggttaccgggcagagtcacttcaagtccttcgataatcggtattttacgttctcaggcatttgtcaatatctgctggcccgggactgtcaagatcacagtttttcgatcgtgattgagacagtacagtgcgccgatgaccgtgacgcggtttgtacccgctctgtgacggtgcgtctgcctggactgcataactctctggtaaagcttaaacacggagcgggcgtcgccatggacggccaagatgtccaactgcctcttctgaaaggtgatctgaggatacagcacactgtgaccgcctctgtgcgactgtcctacggagaagacctgcaaatggactgggatggacgtggccgactgctggtgaaattatcccccgtgtacgccggcaagacctgcgggctgtgcgggaattacaacggtaaccagggggacgactttctgacgcccagtggactcgccgaaccacgtgtggaagacttcggaaatgcctggaagctgcatggtgactgccaggacctgcagaagcagcattctgacccttgtgcattgaacccacgcatgactcggttttccgaggaagcgtgtgccgtcctgaccagtccaacctttgaggcatgccatcgggcagtctcccccctgccttacctgcgcaattgtcgctacgatgtctgttcatgttctgatggtagggaatgcctgtgtggagccctcgcaagttacgctgctgcctgcgctgggcggggcgtccgcgttgcctggagggaacccggacggtgcgagcttaattgccctaaaggccaggtctatctccagtgcggaacaccttgtaatctgacgtgccgcagcctatcctatccagacgaagagtgcaacgaagcttgcctggagggctgcttctgtccgccaggcctgtatatggatgagaggggggattgcgtgcctaaagcgcagtgcccatgctactatgatggtgagatcttccagcccgaggatattttttcagaccaccatacaatgtgttattgcgaggatggcttcatgcattgtactatgtccggcgtgccaggatcattactgcccgacgccgtgctgtcctccccattgtcccaccgctctaagcgatcacttagctgccgccccccaatggtcaaactggtctgcccagccgacaatctgcgggctgaggggctggaatgtacaaagacgtgtcagaactacgacctggagtgcatgagtatggggtgtgtgagtggctgtttgtgccctcctggcatggtgcggcatgagaaccgctgtgttgccctggaaagatgcccgtgctttcaccaaggtaaagaatacgctccaggggaaaccgtgaaaattggctgcaacacttgcgtctgccaagaccggaagtggaactgtactgatcacgtctgtgatgcaacctgcagcactataggtatggcacattatttgactttcgatggcttgaagtacctattcccaggtgaatgccagtacgtgctcgtgcaggactattgtggctccaaccctgggaccttcagaatccttgtaggtaataaaggctgctctcacccctccgttaaatgtaagaagagggtaaccatcttggttgaggggggggaaatcgaactttttgatggcgaggtgaacgttaagagacctatgaaagatgaaacccacttcgaagtcgttgagagtggacgctacattattttgcttctgggaaaagccctttctgtggtgtgggatcggcacctatccatttctgtggtgctgaagcaaacgtatcaggaaaaagtttgtgggctgtgtggtaacttcgacggaatacagaacaatgatctgactagtagtaatctgcaagtcgaggaagatccggtggacttcggcaacagttggaaggtctcttctcagtgcgcagatacccgcaaagtgccacttgactctagcccggcgacatgccataacaacattatgaagcagacgatggtggatagctcctgtaggatattgacctccgatgtcttccaggattgtaacaagctagttgacccagagccctacctggacgtctgcatctatgacacttgttcttgtgaaagcatcggcgattgcgcatgtttctgcgatactatcgccgcatatgcccacgtttgcgcccaacacggcaaggtcgtgacctggagaacagctacactttgtccccagagctgtgaagagaggaatctccgagaaaatggttatgaatgcgagtggaggtataactcatgtgctcctgcttgccaggtcacctgtcagcacccagaacccctggcctgccctgtgcaatgcgtcgaaggctgtcatgctcactgccccccaggcaaaatcttggatgagctactccaaacttgcgtggatccggaggactgtcccgtgtgcgaagtggccggaaggagattcgcctccgggaagaaagttaccctcaatcccagcgaccccgagcactgtcagatctgtcactgtgatgtggtaaacctgacatgcgaggcatgtcaggaacctggaggattggtggtaccgccaaccgacgctcctgtaagcccaaccaccctatacgtggaggatatctctgaaccgcctctccacgacttctattgctcgcgcctgctggacctcgtgttccttttagacggctcatctagactgtccgaggccgagtttgaggtcctgaaagcatttgtagtggacatgatggagcggctgagaatcagccagaaatgggtgagggtggctgttgtggagtatcatgatgggagtcacgcctatatcggtctgaaggatcggaaacgcccaagtgaactgcgtaggatcgcctcgcaggtcaagtatgctggatcccaggtggcttctacctccgaggtgctgaagtatactctttttcaaatctttagcaagatagaccggcccgaggcgtcacggattacgcttctgcttatggcatcccaggaacctcagagaatgtccaggaactttgtgaggtacgtgcagggcctgaagaaaaaaaaggtgatagtgatacctgttggcatcggcccccatgcgaacctgaagcagatccggttaatcgagaaacaggcaccagagaataaggcttttgtactatcttctgtcgacgagctggagcagcagagagacgagattgttagttacctgtgtgacctagccccagaagcccccccccctacgctgcccccagatatggctcaagtcactgtggggccaggcttgctcggcgtctcaaccctgggacctaagcggaacagcatggtgctcgacgtggcgtttgtgctggagggatccgacaaaatcggggaggcagactttaatagatccaaagagtttatggaagaagtgattcaaaggatggacgttgggcaggattcaatccacgtgaccgtgctgcaatacagctacatggttaccgttgagtaccccttcagcgaggctcagtctaaaggggacattttgcagcgcgtgcgagagattaggtaccaaggtggtaacagaaccaacacaggtttggccctccggtacctctctgaccactcgttcctagttagtcaaggcgatagggagcaggctcctaacctcgtgtacatggtgaccggcaaccctgcgtccgatgaaataaagcggcttcccggcgatatacaggtagtgcccataggggtcggcccaaacgctaacgttcaggagttagagcgcatcggctggccaaacgcacccatcctgatccaggacttcgaaacactgccacgggaggctcccgacctggtattgcaacggtgttgtagcggggaagggctgcagataccaaccctatctcccgcgcccgattgcagtcagcccttggatgtgattctcctgttagacgggagctcgtcttttccggcttcatatttcgatgaaatgaagagcttcgctaaggcattcatctccaaggctaacattggaccaaggttgacccaggtctctgtcctgcaatatggatccatcaccactatagacgtgccgtggaacgtggttccggagaaagcccacctgctgagtctggtggatgtgatgcagcgggagggcggcccatcccagattggagatgccctgggatttgcagttagatacctgaccagcgaaatgcacggagcccggcccggcgcatctaaggccgtggtgatcctagtgacggatgttagtgtggactcagtggacgccgcagcggacgcagcgcgcagtaatcgcgtgaccgtcttccctatcggtattggggaccgctacgacgcggcccagctccgcattctcgctggccccgccggcgactccaacgtggtgaaactgcagaggatcgaagatctaccgacgatggtaacactgggtaactcctttctacacaaattatgttcaggcttcgtgcgtatatgcatggacgaagacggaaatgagaaacggcctggcgacgtgtggactcttcctgatcagtgtcacaccgtgacctgccagccagacggccaaacgctgctgaagtctcatagagtgaattgcgacaggggattgaggccaagttgtcctaactctcagtctcccgtcaaggttgaagagacctgtggctgtaggtggacctgcccttgcgtgtgcacgggttcttctacaaggcacattgtcacatttgacgggcaaaacttcaaactgacaggtagttgtagctacgtgctgttccagaataaagaacaggatttggaagtaatcctgcacaatggggcgtgcagtccaggagcccgccagggatgtatgaaatcaatcgaggtcaaacatagcgccttgtccgtagaactccattccgacatggaagtcaccgttaacgggaggctggtgagcgtcccatacgtcggaggcaatatggaggttaacgtctatggagctattatgcacgaggttaggtttaaccacctggggcatatattcacattcactcctcaaaacaacgagttccagttgcaactctcacctaaaacattcgcctctaaaacctatggcctctgcggcatctgcgatgagaacggcgcgaatgatttcatgctgcgggacggaactgtcacgaccgattggaaaactctcgtccaagaatggaccgtacagcgacctgggcagacttgtcaaccaattctggaagagcagtgcttggttcccgattctagccactgccaagtcctcctcttaccactgttcgcagaatgccacaaggtgctggctccagccactttttatgccatttgccagcaggactcttgccatcaggaacaggtctgtgaggtcattgcgtcctacgctcacctgtgccgaaccaatggagtttgtgttgattggcgaacacctgatttttgcgccatgagctgccccccttcgctggtgtacaatcactgcgagcacgggtgcccgagacattgtgacggcaacgtgagcagctgcggggaccacccttccgagggatgtttctgtccccctgataaggtaatgctggagggttcatgcgtccccgaggaagcttgcacacaatgtataggggaggatggggtgcagcaccagttcctggaggcctgggtacctgatcatcagccatgccagatttgtacttgcctttcaggccgtaaggtgaactgcactactcaaccatgtcctacggctaaggcccccacttgcgggttgtgtgaagtggccagactgcgacagaatgcagatcagtgctgtcccgagtatgagtgcgtgtgcgaccccgtaagttgtgacctgcctccagtgccacactgtgaaagaggacttcagcccaccttgacaaatccaggcgagtgccggcccaacttcacatgcgcatgccgcaaggaggagtgcaagcgggtgagtccgccctcctgcccccctcacaggctgccaaccctcaggaaaacacagtgctgtgatgagtacgagtgcgcctgtaattgcgtgaactccaccgttagctgtcccctcggctacctagccagtacagccaccaacgattgcgggtgtacaaccaccacctgtctgcccgacaaagtatgtgtgcacagatccactatctatccggtcgggcaattttgggaggaaggatgcgatgtctgcacatgcacagatatggaggacgccgtcatgggtctgagagtggcacagtgctctcagaagccgtgcgaagatagctgccgcagcgggtttacttacgtgctccacgaaggcgaatgttgtgggcggtgcctccccagtgcctgcgaagtcgttactggaagcccccgtggcgactctcaatcatcttggaaatccgtggggtcacagtgggcctcccccgagaatccctgcctgatcaatgaatgcgtgagggttaaggaggaggtgttcatacagcaaaggaacgtatcgtgtccccaactcgaagtcccggtctgtccctccggctttcagttatcgtgcaagacaagcgcatgttgcccctcctgccgttgtgagagaatggaggcttgtatgctcaatggaacagtgatcggaccaggaaagacagttatgatcgacgtgtgtaccacatgccgctgcatggtccaggtgggggtgatttcgggtttcaagttggaatgtcgcaaaaccacatgtaatccatgtcctctcggctacaaagaagaaaataatactggtgagtgttgtgggcgatgcttgccaacagcctgtacaatccaactgcgcggagggcaaatcatgaccctgaagcgggatgagacactgcaagatggctgcgacacccatttttgcaaggttaacgagaggggcgagtatttctgggagaaaagggtgacaggctgccctcccttcgatgagcataaatgtttggcggaggggggcaagattatgaagatacctggaacctgctgcgacacttgcgaagaaccagaatgcaatgatataacagctcgtttacaatatgtcaaagtgggtagttgtaagtcagaggttgaggttgacatccactactgtcagggcaagtgcgcatccaaagccatgtattctatagatattaacgatgttcaggaccaatgtagctgctgtagccccactagaacagagcccatgcaggtggccctccactgcacaaacggttccgtggtgtatcacgaggtgctgaacgccatggaatgcaagtgttcaccgaggaaatgctccaaa

SEQ ID NO: 21345 - DNA, 8439 bp, Artificial Sequence
  Description of Artificial Sequence: Synthetic coding sequence
atgatacccgcccgattcgctggtgttcttctggcgctggcactcatcctgccgggaactctctgtgccgagggaactcggggacggagctccacggcccgctgttccctgttcggctccgacttcgttaacaccttcgacggatccatgtactccttcgcaggatactgtagctacctgttggccggaggttgtcaaaaacgctccttctcgatcattggcgatttccaaaacgggaagcgcgtgtccctttccgtgtacctgggagaattcttcgatatccacctgttcgttaacggcactgtgacccaaggtgaccagcgcgtgtcgatgccttacgcgtctaagggcttgtacctggagactgaggctggctactacaaactgtcgggagaggcatacggatttgtcgccaggattgacggctcgggaaactttcaggtactgctgtcggatcgctacttcaataagacttgcggactctgtggtaatttcaatatctttgccgaagatgactttatgactcaggagggcacccttacttccgatccatacgattttgccaactcttgggccctttcgtccggagaacagtggtgcgaacgggccagcccaccgagctcatcatgcaacatcagctcgggcgaaatgcagaagggcctgtgggaacagtgccagctcctcaaatcgacctcggtgttcgcccgctgccacccgcttgtggatccagagccattcgtggctctgtgcgaaaagacgctctgcgaatgcgccggaggactggagtgcgcctgccctgctctcctggagtacgcgagaacttgcgcccaggagggaatggtgctgtatggatggaccgatcactcggcatgcagccccgtctgccctgctggaatggaataccggcagtgtgtgagcccttgtgcaagaacctgccaatcactccacatcaacgagatgtgccaggaacggtgcgtcgacggctgctcctgcccggagggacagctccttgacgaagggctgtgcgtagagagcactgagtgcccttgcgtgcactcgggaaaaaggtacccaccgggtaccagcctctcccgcgactgcaacacctgcatctgtcgcaattcccagtggatctgctcgaacgaggaatgcccaggcgagtgcctcgtcacgggacaaagccacttcaagagttttgacaacagatactttaccttctcaggaatctgccagtacctccttgcaagagactgtcaggatcactccttttccatcgtcattgaaaccgttcagtgtgcggacgaccgggatgctgtctgcactaggtccgtaacggtgcggcttccaggcttgcataactccctggtcaaactgaagcatggggctggggtggctatggacggacaggacgtgcaactgcccctgctcaaaggagatcttcggatccagcacaccgtaacggcgtcggtgcggctgagctacggggaagatctccaaatggattgggatgggcgggggagattgctcgtgaagctgtcgccagtatacgcaggcaagacttgtggactctgcggcaattacaatggtaatcagggcgatgattttctgactccatcgggactggctgaaccgcgggtcgaagattttggaaacgcatggaaactgcacggagactgccaggacctgcaaaaacaacacagcgacccgtgtgctctcaatccgcggatgacccgcttttcagaagaagcctgcgccgttctgacttccccaaccttcgaggcttgccatcgcgctgtgtcgccactgccttaccttcggaactgccgctacgacgtctgctcgtgttccgatggaagggaatgtctttgtggagcactggcctcgtacgcggcggcgtgcgcaggtcgcggggtgcgcgtcgcctggagggaaccaggccggtgcgagctcaattgtcctaagggacaagtttaccttcagtgcgggactccgtgcaatcttacttgccggtcgctctcgtacccggacgaagaatgcaatgaagcctgcctggaaggctgcttctgcccccctgggttgtatatggacgagcggggtgactgcgttcccaaagcgcaatgcccgtgctactacgatggggagatcttccaaccggaggacatcttctcggatcaccatacgatgtgttactgcgaggacggctttatgcattgtactatgtccggtgtgccgggatcgctcctgccggacgcggtgctcagcagcccactcagccatcggtcaaagcggtccttgtcctgtcggccgccaatggtcaagctggtgtgcccggccgacaacctgcgggccgaaggtctggagtgcaccaagacttgtcaaaactacgacctcgagtgtatgtccatgggctgcgtctctggctgcctttgtccgccgggtatggtccgccacgagaaccgatgtgtggcccttgagcggtgtccatgttttcatcagggaaaggagtacgcacctggagagactgtcaagatcgggtgcaacacctgtgtctgccaggacagaaagtggaattgcactgaccacgtgtgtgacgccacctgctcaaccatcggaatggcacactacctgaccttcgatggactgaagtatttgttcccgggtgagtgccagtacgtcctggttcaggactactgcggctccaatccgggcacctttcggattctcgtcggcaacaagggatgctcacacccgagcgtgaagtgcaaaaaacgcgttaccatcctggtggaaggaggggaaatcgagctttttgacggcgaagtcaacgttaaaagaccgatgaaggacgagactcactttgaagtggtcgagtctggccgatacatcatcctgctgctgggtaaggccctcagcgtcgtctgggatcgccacctgagcatttcagttgtgctcaagcagacgtaccaagaaaaagtgtgtggactctgtgggaatttcgatggaatccaaaacaacgatctgacctcctccaatctgcaagtggaggaggacccagtggatttcggaaactcgtggaaggtgtcatcacagtgcgcggatacgcggaaggtgccactggattcgtccccggccacgtgtcataacaacatcatgaaacagaccatggttgactcgagctgtcgcatcctgaccagcgacgtgttccaggactgcaataaactcgtcgatccggaaccttacctggacgtgtgcatctacgacacgtgctcctgtgaatcgatcggagattgtgcatgcttctgcgatactattgctgcatacgctcacgtttgcgctcagcacggtaaggtcgtgacttggcggactgccactttgtgcccccagtcatgcgaggaacggaatcttcgtgaaaacggatacgagtgcgaatggcgctacaacagctgcgcgccggcatgccaggtgacctgccagcaccccgaacccctggcatgcccggtgcagtgcgtggaaggatgccacgcgcattgcccaccgggcaaaatcctcgacgagctgcttcaaacgtgcgtggacccagaggattgcccggtctgtgaagtggccggaagaaggttcgctagcggaaaaaaggtcactctgaatccgagcgacccagagcattgccaaatctgtcattgcgacgtggtgaacctcacctgcgaagcatgccaggaacctggcgggttggtcgtgcctccgactgacgcccccgtgtctccgaccactctctacgtggaagatatctcagagccgccgctgcatgacttttactgcagcaggctgttggatctggtattcctcctcgatggttcttcccggctctctgaagcggagttcgaggtcctgaaggcattcgtcgtggatatgatggaacgcctccgaatctcgcaaaaatgggtgcgtgtggcggtcgtggagtaccatgatggctcccatgcctatatcggactgaaggaccggaaaagaccatccgagctgcgcagaatcgcgagccaagtcaagtatgccggttcccaggtggccagcacttcagaagtgctcaagtacactctgttccaaatcttttccaagatcgatagaccagaagcgtcccgcattaccctcctgctcatggctagccaagaaccgcaaaggatgtcgagaaacttcgtgcgttacgtgcaaggacttaagaagaaaaaagtgatagtgatccccgtgggaatcggaccgcatgctaacctcaaacaaattcggttgattgaaaagcaggcccctgagaataaggcgttcgtgctttcttctgttgacgagctcgagcaacagcgggacgaaatcgtgtcatacctgtgtgacctggcccctgaagcgcccccgcctactttgccaccagacatggcccaggtcacggtcgggccaggtctgctgggggtgtcgaccctgggcccaaagcggaattccatggtgctggatgtcgcattcgtcctggaagggtccgataagattggagaggccgacttcaatcggagcaaggaattcatggaagaagtgatccagagaatggacgttggacaggattcgatccacgtgaccgtgctgcagtactcctacatggtgactgtggagtaccccttctcagaagcacagtccaagggagacatcttgcagagagtgcgcgaaattagataccagggcggaaaccgcaccaatactggactggctctgcgctatttgagcgaccattcattcctggtgagccagggagatcgtgaacaggctccgaacctggtatacatggtgaccggtaacccggcctcggacgaaatcaagcgcctgccgggagacatccaagtcgtgccgatcggcgtggggccgaacgcgaatgttcaggagctggagcgcattggatggccgaacgccccgattctcatccaagatttcgaaaccctgcctcgagaagccccagatttggtcctgcaaaggtgctgcagcggagagggcctccagattcctactctctcgccggccccggactgctctcagccgctcgacgtgatcttgctcctcgacggatcgtcatccttccccgcctcctacttcgacgagatgaagtcattcgcgaaggcattcatctcaaaggccaatatcggcccacggctcactcaggtgtccgtcctgcagtatggctctataactactattgacgtcccctggaacgtggtgccggaaaaggcacacctgctgtcgctggtcgacgtcatgcagagagaaggaggacctagccagatcggcgacgccctgggattcgcagtgagatacctgacctctgagatgcacggtgcccgcccgggggcgtccaaggccgtcgtgatcctggtgactgacgtctccgtggactccgtcgacgcggctgcggatgcggccagatcaaacagagtgaccgtgtttcccatcggaatcggcgatcggtacgacgcggcacagctcagaatcctcgccggccctgccggagattcgaacgtggtgaagctgcagaggatcgaggacctgccgaccatggtgacccttggaaattcgttcctgcataagctctgtagcggtttcgtgcgcatctgtatggacgaggatgggaacgaaaaacgcccaggggacgtgtggaccctgccggatcaatgccacaccgtcacctgtcaaccggacggacaaactctccttaagtcacatcgcgtcaattgcgatagaggtttgcgcccatcctgtccgaattcccagtcaccagtgaaagtcgaagaaacctgcggatgccgctggacttgcccttgtgtgtgtaccggatcgtcgacccgacacatcgtgacctttgacggacagaatttcaagctcaccggatcctgttcatatgtgctgttccagaacaaagaacaagacctggaggtgatcctgcacaatggtgcctgcagcccaggggcgcgccagggatgtatgaagtccattgaggtcaaacactcagccctctcggtggaactgcacagcgatatggaagtaaccgtcaacggaaggctggtgagcgtgccctacgtgggtggaaacatggaagtgaatgtgtacggagcaatcatgcacgaggtgcgcttcaaccacctgggtcacatattcactttcacccctcagaacaatgaattccagcttcaacttagccctaagacgtttgcctccaagacttacggactgtgcggtatctgtgacgaaaacggcgccaacgatttcatgctgcgtgacggaactgtgactacggactggaaaaccctggtccaagaatggactgtgcagcgaccaggacaaacctgccaaccgatcctggaggaacaatgtttggtgcctgacagtagccactgccaggtgttgctcctgcctctctttgcagagtgccataaggttctggctcctgcaaccttctacgcgatctgtcagcaagattcgtgccatcaggaacaagtctgcgaagtgatcgcctcatacgctcacctgtgcagaactaatggggtctgtgtggattggcgtacccccgacttctgtgcgatgagctgcccaccgtcgctggtgtacaaccactgtgagcacggatgccctcgtcactgcgacggaaacgtgtcctcgtgcggcgaccacccctccgaaggatgcttctgcccgccggacaaggtgatgctggaaggatcctgcgtgccagaggaggcttgtacgcagtgtatcggcgaagatggagtccagcaccaattcctggaagcatgggtccctgatcaccaaccgtgtcagatttgtacgtgtttgtccgggcgcaaggtgaactgcaccacgcagccgtgcccgactgctaaggcccccacctgcggattgtgcgaggtcgcgcgcctcaggcaaaacgccgatcaatgctgcccagaatacgaatgtgtgtgcgaccctgtgtcgtgtgacttgccaccggtgccccattgcgaaaggggattgcagccaaccctgaccaacccgggggagtgcagaccgaacttcacttgcgcgtgccggaaggaggagtgtaagagagtgtccccaccatcgtgcccaccgcatcggttgcctacccttaggaaaacgcagtgctgcgacgaatacgaatgcgcctgcaactgtgtgaactcgaccgtgtcgtgcccgctgggctacctcgcctcgacggcgaccaacgactgcgggtgtaccaccaccacttgcctccctgacaaggtctgcgtccacaggtcaactatctacccagtgggacagttctgggaagagggatgcgatgtgtgcacttgcaccgatatggaggatgccgtcatgggacttagagttgcgcagtgctcacaaaaaccgtgcgaggactcatgtcgatctggctttacctacgtgctgcacgagggagaatgctgcgggcgctgcctgcccagcgcgtgcgaggtggtgaccggatcaccgagaggcgactctcagagctcgtggaagtccgtggggtcgcaatgggcctcgccagaaaatccctgtctcatcaacgagtgcgtgcgcgtgaaggaagaggtgtttatccagcagcggaatgtgtcgtgcccccaactggaagtgccggtctgtccaagcggcttccagttgtcgtgcaagacctccgcctgttgcccttcttgccgctgcgagcggatggaggcatgtatgctcaacggcaccgtcatcggcccgggtaaaactgtgatgatcgacgtctgtacgacctgtcgctgcatggtccaggttggagtcatctccggctttaagttggaatgccgcaagacgacctgtaacccatgccctctcggatataaggaggagaacaacaccggcgagtgctgcggacgctgcctcccgaccgcgtgcactattcaactgcgcgggggacagatcatgactctgaaacgggatgaaaccctgcaagacggatgcgacactcatttctgtaaggtgaatgaacgaggagaatacttctgggaaaagagagtaactggctgccccccgtttgatgagcataagtgccttgcggaaggtggtaaaatcatgaagatcccgggcacttgctgcgatacttgcgaagagcccgaatgcaacgatatcaccgcacgcctgcagtacgtgaaggtgggttcatgcaagagtgaagtggaagtcgacatccattactgccaggggaagtgcgcctcaaaagctatgtactcgatcgacatcaacgacgtgcaggaccaatgctcatgctgctcgccgactcgcactgagccaatgcaggtggcactgcattgcaccaatggtagtgtggtgtaccatgaagtgctgaatgctatggaatgcaagtgctcgccccggaagtgcagcaaa

SEQ ID NO: 21346 - DNA, 8439 bp, Artificial Sequence
  Description of Artificial Sequence: Synthetic coding sequence
atgattccagccagatttgcaggagtacttctcgcccttgccctgattctgcccggtactctgtgtgctgaaggcacacggggacggagcagtactgctagatgctctctctttggatccgattttgttaacactttcgatggttccatgtactctttcgcaggctactgctcttacctcttggccggaggctgccagaagagatcattctccattataggcgatttccagaatggaaaacgcgtttccctctccgtttacctgggagagttctttgatatccatctgtttgtcaacggaacagtaacgcagggcgaccaaagagtttccatgccttacgcctctaaaggcctctaccttgagaccgaagccggctattacaaacttagtggggaggcctatggcttcgtggcccgcatagacgggtccgggaacttccaagttttgctgagtgatcggtattttaacaagacttgcgggctttgtggaaacttcaatatttttgcagaggacgatttcatgacccaggaagggacgctgacctcagacccctacgactttgcaaacagttgggccctgtcctccggtgaacagtggtgcgaacgagcaagcccgcccagttccagttgtaacatcagttcaggggagatgcagaagggcctgtgggagcagtgtcaactgctcaagtccacgagtgtgtttgccaggtgccatcctcttgtggacccagagcccttcgttgctctgtgcgagaaaactctttgtgagtgcgctggcggccttgagtgtgcatgccctgcgcttctggaatacgcacgcacctgtgcgcaggagggcatggtgctgtacggatggaccgaccacagcgcctgctcacctgtgtgcccagctggcatggaatatcgacaatgtgttagtccctgtgccagaacttgccaatcactgcatatcaacgagatgtgccaggaaaggtgcgtggatggatgtagttgccctgaagggcagctgctggacgaaggcttgtgcgttgagtctacagagtgtccctgtgtgcacagtgggaaacgctatccacctggtacatcactttcaagggattgtaacacttgcatttgtcgcaatagtcaatggatttgttctaatgaagaatgcccaggggaatgccttgtgacaggccagtctcacttcaagtcttttgacaacagatacttcacttttagcgggatttgccagtacctgctggctcgggactgtcaagatcactcattctcaatagtcatcgagactgtgcagtgcgctgatgaccgggatgcggtctgcacccgcagcgtgactgtgcgcctccccggactgcacaactcccttgtcaagcttaaacacggagcgggcgtggccatggatggccaggatgtacagcttccactgctgaagggggaccttaggatccaacacaccgtgaccgcaagcgtgcggctctcatatggggaagacctgcagatggactgggatggccgaggtaggcttctcgtcaagctttcaccagtgtacgcaggtaaaacgtgtggactgtgcggaaattacaacgggaatcagggagatgattttctgacccctagcggcttggcagagcccagggttgaggactttggcaacgcctggaagctgcacggtgattgtcaggaccttcagaagcaacacagtgatccttgcgcactgaacccacggatgacccggtttagcgaagaggcctgcgccgtccttacttcccccacattcgaggcgtgccatagagcagtctcaccactgccttacctcagaaattgtaggtatgacgtgtgctcatgcagcgatgggagagaatgtctttgcggcgcacttgcctcttatgccgctgcatgcgcaggtcgcggggtcagagtggcgtggcgggagcctgggcggtgtgaacttaattgtcccaaaggccaagtttatctgcagtgtggaacaccttgtaacctgacttgtagaagtctcagctaccccgatgaggagtgtaatgaagcatgtttggagggatgcttctgtcctcctggactgtacatggacgagcggggtgactgtgtgcctaaggcccagtgcccctgctattacgatggcgaaattttccaacctgaagacatcttcagtgaccaccacacaatgtgctattgcgaggatggcttcatgcactgtacaatgtcaggtgttcccggcagtctgcttccagatgccgtcctgtcttctcccctcagtcatagatctaaacggtctctgtcctgtcgaccgccaatggtaaaactggtgtgccctgccgacaatctgagggcggagggcctcgaatgtaccaaaacatgtcagaactacgatctggagtgcatgtctatgggttgtgtgagtggctgcctgtgccccccaggcatggtgcgacacgaaaaccggtgtgtggcgctggagcgatgcccatgtttccatcaaggcaaagagtatgcgcccggcgagactgtaaagatcggctgcaatacatgcgtttgccaggaccggaagtggaactgcactgatcacgtctgcgacgcaacatgtagcacaataggaatggcccattatctgacatttgatggtttgaagtacctcttccccggagaatgccaatatgttctggtgcaggattattgcggcagcaatccaggtacctttcgcatactggtcggaaataagggttgtagccatccatcagtcaaatgcaagaagagagtcactatcctcgttgagggcggcgagatagaactgttcgatggcgaagtgaacgtcaaaaggcctatgaaggatgagacccattttgaggtggtggaatctgggagatatatcattctgttgttgggcaaggcgctcagcgtggtgtgggaccggcatttgtctatcagtgtggtattgaagcagacttaccaggaaaaggtctgtggcctgtgtggaaacttcgacggcatccagaataatgacctcacttcaagcaatctgcaagtggaggaagaccccgttgactttggaaatagctggaaggtgtcctcacaatgtgccgatactcgcaaggttcccctggatagctctccagcgacatgccataataatatcatgaagcagacaatggttgatagttcctgccgaatcctgacttccgatgtgtttcaggactgcaacaaattggtggatccagaaccctacctggacgtctgtatctacgacacatgttcttgcgaatctatcggggactgtgcctgtttctgcgatacaatagctgcgtatgcgcacgtctgtgcccaacacgggaaagtcgtcacatggcgaaccgctactctctgtccccagagctgcgaagaaagaaacctgcgagagaacggctatgagtgcgaatggaggtataattcttgtgctccagcctgtcaggtgacttgtcaacatccagagccactcgcatgtcccgtgcagtgcgtagaagggtgtcatgcccactgtcccccagggaagatcttggatgagctgctccagacatgcgtggacccagaggattgtccagtatgtgaggtggcaggccgccgatttgcttccgggaaaaaggttaccttgaatccctcagatcctgagcactgtcagatctgccactgcgacgtcgtgaatttgacgtgcgaagcttgtcaggagcctggtggcctcgtcgtaccgccgacggacgcccccgtctcccccactaccctttatgttgaggacatctccgaacccccactgcacgatttttactgctctcggctcctggatctcgtgtttctgctggacggatcatctcggctcagcgaggctgaattcgaagtgctcaaggctttcgtggtggatatgatggaacgccttcggatcagccagaagtgggtgcgcgttgcggtagtggaatatcacgatggatctcatgcttacattggcctcaaggatagaaaacgcccatccgagctgcgcagaatcgccagtcaggtaaaatatgccggctcccaggtagcctctaccagtgaggtcttgaagtacaccctgttccagatcttctctaaaattgaccggccggaagcttctcgaatcaccctgctgctgatggctagccaagaaccgcagcgcatgtcccggaattttgttaggtacgtgcaggggttgaagaagaagaaggtgatagtgatacccgtgggaatcgggcctcacgctaaccttaaacagatccggcttatcgaaaaacaggccccggaaaataaggccttcgtcctgagctctgtcgatgaactggaacagcagcgggacgagatcgtgtcttacttgtgtgatctcgcgccagaggcacctccgcctacactccctcccgacatggctcaagttacagttggccccgggttgctgggggtcagcacactggggccaaaacggaacagtatggtgctcgacgttgcatttgtactcgaggggtccgacaagatcggtgaggcggattttaataggagcaaagaattcatggaagaagtcattcagcggatggatgtaggacaggactccattcatgtgaccgtgttgcagtactcatatatggttaccgttgaatatcccttcagtgaagcccaatccaagggcgacatcctgcagagagtgcgggagattcgctaccagggggggaacagaacaaataccggacttgccctgcgatacctttccgaccactcttttctcgtctcacagggggacagggagcaggcaccaaacctggtgtacatggttaccggcaatccagcaagcgacgagatcaaaagactcccaggggacatacaggttgtaccaatcggcgtggggcccaacgctaacgtgcaggagctggagcgaatcggctggccaaacgctcccattctgattcaggacttcgagacacttcccagggaggcccctgacctggtgctgcagagatgctgttctggggagggtctgcagattcctaccttgagtcccgccccagattgtagccaaccactcgacgtgattctgctcctggatggcagctcatctttcccagcttcatatttcgatgagatgaagtcttttgcgaaggcattcatctcaaaggcgaatatcggtccaaggttgacgcaggtgagtgtcctgcagtacgggtctattacaaccattgacgtgccttggaatgtggtgccggagaaggcacatctgctctcattggtggatgtgatgcagcgcgagggtggacctagccagattggcgatgcactgggatttgccgtacgctatctgacctccgaaatgcatggcgctaggccaggggcgtccaaagccgtggtgattctcgtcactgatgtgtctgtggattctgttgacgccgctgccgatgctgcaagatccaaccgggtcacagtgtttcccatcggaatcggagataggtatgacgccgctcaactcaggattcttgccggaccagccggcgactctaacgtggtgaagctccagcggatcgaggaccttcccactatggtgaccctgggcaattctttcctgcataaattgtgttctggttttgtacgcatttgcatggacgaggacggcaacgagaaaaggccaggggacgtgtggactttgcctgaccaatgccacaccgtcacctgtcagccagacggtcagacactgttgaagagccaccgagtgaattgcgatcgaggcctgaggccctcctgccctaacagccagagccctgtgaaggtggaagagacatgtggctgtagatggacttgtccatgtgtttgcaccggctctagtaccagacatatcgtaacatttgacggacaaaactttaagctgactgggagttgctcctacgtgctgtttcaaaacaaagaacaggacttggaagtcatactgcacaacggagcttgtagcccaggtgccaggcagggctgcatgaagtccattgaggtcaagcacagcgccctctccgtggagctgcactccgatatggaagtcactgtgaacggacggctggtcagtgttccctacgtgggcggtaacatggaggtgaacgtgtatggtgcaatcatgcatgaagtgaggttcaaccatcttggacacattttcacatttacccctcagaataatgagtttcagctgcaactgtcacccaagacattcgccagcaagacctatggcttgtgcggcatctgcgatgaaaacggggccaacgacttcatgttgcgggatggcaccgtaaccaccgactggaagaccttggtgcaggagtggaccgtgcagaggccagggcaaacatgccagccgatactggaggagcagtgtttggtgcctgacagcagccattgtcaagtcctgctgctgccactcttcgccgagtgtcataaggtcctggcacccgccaccttttatgcaatttgccaacaagatagctgccatcaggagcaggtctgtgaggtcatcgcctcctacgcacacctgtgcaggacaaatggagtgtgtgtagactggaggacccccgatttttgtgccatgagctgccctccttcactggtctacaatcactgcgaacacggatgtccccgccactgtgacggaaacgtaagctcatgtggagaccacccttctgaaggctgtttctgcccgcctgataaggtgatgctggaggggtcctgcgtgcccgaggaggcctgtacacagtgcattggcgaagacggggtgcagcatcagtttcttgaagcttgggttccggaccaccaaccctgtcagatttgcacgtgtctctctgggagaaaagttaattgtaccacccagccatgccctaccgcaaaggcccccacctgtgggttgtgcgaggtggccagactgcggcagaatgcagaccagtgttgtcccgagtacgaatgcgtgtgtgatcctgtttcttgcgacctgcctccggtcccacattgtgagagaggattgcaacccacgctgactaatccaggtgaatgccggccgaacttcacctgcgcgtgccgaaaagaagagtgcaaacgggtgagtccacctagctgccccccccacaggttgcctaccctgagaaagacacagtgctgtgatgagtatgaatgtgcttgcaactgtgtaaattccaccgtgtcctgcccgctcggttacctggcaagcactgccacgaacgattgtggatgtacaaccaccacttgcctccctgataaggtatgtgtgcatcggagcaccatctaccctgtaggccagttctgggaagagggttgtgatgtgtgcacatgtactgacatggaggatgccgtgatggggctcagagttgcacaatgttcccagaaaccctgtgaagactcatgtagatccggttttacttacgtgttgcatgagggagagtgctgtggcaggtgtttgccatcagcctgcgaggtggttacaggcagtccccggggggattcacagagtagttggaagtccgtcggatctcagtgggcctccccagagaacccttgccttattaacgagtgcgtcagagtcaaagaggaggtcttcatccagcagcgaaatgtgtcatgcccgcaactcgaggtacccgtgtgtccatccggctttcagcttagctgcaaaactagcgcttgctgcccgagttgtcgctgtgagaggatggaagcttgtatgctgaacggtaccgtgatcgggcctggtaaaactgtaatgatcgatgtgtgcactacgtgccgctgcatggtccaagttggcgtgattagcggttttaagctggaatgtcgaaaaacaacctgtaatccatgtcccctcgggtacaaggaagaaaataacacgggcgagtgttgcggtaggtgtttgcctacggcttgcaccattcagctcagaggtgggcagatcatgaccttgaagagagacgaaaccttgcaggatggatgtgacacccacttctgcaaggttaatgagcggggcgaatacttctgggagaagcgggtcactgggtgtcccccgtttgacgagcacaagtgtttggcggagggtggtaaaattatgaagattcctggaacatgttgcgacacctgcgaggagcctgagtgtaacgatattaccgctcggctccaatacgtgaaagtcggcagctgcaaatcagaggtcgaagttgatattcactattgtcaaggaaaatgcgccagtaaagccatgtactcaattgacatcaacgacgttcaggaccagtgctcatgctgttctccaacacgaaccgagccaatgcaggtagctctccattgcacaaacggttccgtcgtgtaccatgaagtgctgaacgcaatggaatgtaagtgcagccccaggaagtgctccaag

SEQ ID NO: 21347 - DNA, 8439 bp, Artificial Sequence
  Description of Artificial Sequence: Synthetic coding sequence
atgattccggcccggttcgctggggtcctgttggctctggccctgatcctcccgggtactctgtgcgcggaagggaccagaggaaggtcctcaacggcccgctgctcgctcttcggctcggacttcgtcaacaccttcgacggctcgatgtacagcttcgcgggctactgttcatatttgctggcaggaggatgccagaaacggtcgttttcgatcatcggtgatttccaaaatggaaagcgcgtctcgctctcagtgtacctgggcgaattcttcgatatccacctgtttgtgaacggtaccgtgacccagggagatcaacgcgtgtccatgccgtatgcctcaaagggactgtacctcgaaaccgaagcgggatactacaagctcagcggggaggcatacggatttgtcgctagaatcgatggctccggaaatttccaagtgctgctctccgatagatactttaacaagacgtgtggtttgtgtggcaatttcaatatcttcgcagaagatgatttcatgacccaagagggaactctgacctccgacccctacgacttcgctaactcctgggccttgtcctcgggtgagcaatggtgcgaaagggcatccccgccgtcaagctcctgtaatatctcgtccggtgaaatgcagaagggactctgggaacagtgtcagctgttgaagagcacttccgtctttgccaggtgccacccgctggtcgacccggagccgtttgttgcgctgtgtgaaaagacgctctgcgaatgcgccggaggactcgaatgtgcatgccctgctctgctggaatacgcccggacctgcgcccaggagggaatggtgctgtacggctggaccgaccactcagcatgctccccggtgtgcccagccgggatggaatatcgccagtgcgtttccccgtgtgccagaacttgtcaaagcctccacatcaacgaaatgtgccaggaacgatgcgttgacgggtgcagctgccccgagggacagcttctggacgaaggcctgtgcgtggagtcgactgagtgtccttgtgtgcactccggcaagcgctacccacctgggacttcactgtcccgcgattgcaatacctgcatctgcagaaattcacagtggatttgcagcaatgaggagtgtccgggggaatgcttggtcaccgggcaaagccacttcaagtccttcgataaccggtatttcaccttttctggtatctgtcagtaccttctggccagggactgccaagatcactccttcagcattgtcatcgaaaccgtccaatgcgcagacgatcgcgacgccgtctgcactcggtcggtgactgtgagactgccaggactccataattctttggtgaagctcaaacacggagcaggagtcgcgatggacgggcaggatgtgcagttgccgcttctgaagggagacttgagaatccagcataccgtgactgcgtcagtccggctcagctacggagaagatctgcagatggactgggacgggcgggggagactccttgttaagctctcgccggtctatgccggtaaaacgtgcggactctgcggtaactacaacggtaatcagggagatgacttccttaccccaagcggcctggcggagccgcgggtggaagattttggaaacgcgtggaagttgcacggagactgtcaggaccttcaaaaacagcattcagatccgtgcgcattgaacccccgcatgacgcgcttctcagaagaagcctgcgcagtgcttacgtctccgaccttcgaagcatgccacagagccgtgtccccgctcccatatctccgcaattgtcggtatgacgtgtgctcgtgctccgacggacgggagtgcctgtgcggcgcactggcgtcctatgccgcagcctgtgctggcaggggcgtgcgcgtggcatggagggagccaggacggtgcgaactgaactgcccaaagggtcaagtttacctgcagtgtggaactccgtgcaatcttacttgtagaagcctgtcgtaccctgatgaggaatgcaatgaggcctgccttgagggatgcttctgcccgccaggtttgtacatggatgaacggggggactgcgtccctaaagcccaatgcccatgctactacgacggagagattttccagccagaggatatcttctcagatcaccataccatgtgctactgtgaggatggctttatgcactgcacgatgtccggcgtcccgggctccctgctgccggacgcagtgctctcgtcaccgctgagccaccgctccaagcggtccctctcctgccggcctccaatggtcaagctcgtttgcccggcggacaacctgcgcgcagagggcctcgaatgcaccaaaacgtgccaaaactacgatctggagtgcatgtctatgggctgcgtcagcggatgcctgtgcccgcccggaatggtccggcacgaaaaccggtgtgtcgccctggaacgttgcccttgctttcaccaaggaaaggaatacgccccaggcgagactgtcaagatcggctgcaatacttgcgtgtgtcaggacagaaagtggaactgtaccgatcacgtgtgtgatgcaacctgctcgaccatcggtatggcgcactacctcactttcgacggactgaagtaccttttccctggtgaatgccagtacgtgctggtgcaggactactgcggatcgaatcccgggacgttccgcatcctcgtggggaacaaaggatgctcacatccgtcagtgaagtgtaagaagagagtgaccattctggtggaaggtggcgaaattgaactgttcgatggcgaggtgaacgtgaaaaggccgatgaaggacgagactcacttcgaggtggtggagtcggggcgctacatcatcctgctcctcgggaaagcactgtcggtggtgtgggaccgccatctgtctatctcggtggtgctcaaacaaacctaccaagagaaggtttgtggcctttgcggcaattttgacgggatccagaataacgacctgacctcctcgaaccttcaagtggaggaagatccagtggatttcggaaatagctggaaggtgagctcccagtgcgcggatacgagaaaggtgccactcgactcgtcaccagcaacttgccataacaacattatgaagcaaactatggttgatagcagctgcaggatcctgaccagcgacgtgttccaagactgtaacaaacttgtcgaccctgagccgtacctggacgtgtgtatttacgacacttgtagctgtgagtcgatcggagactgcgcctgtttctgcgatactatcgcggcctacgcccatgtgtgcgcccagcacggtaaggtggtcacttggcgcaccgcgaccctttgcccccaaagctgcgaagaacgcaatctccgggaaaacgggtacgaatgcgagtggcgctacaattcatgcgccccagcatgccaggtgacttgccagcaccctgaaccgcttgcctgccctgtgcaatgcgtggaaggatgccatgcccactgtcctccgggaaagatcctggatgagctgcttcagacctgcgtggatccggaagattgtcccgtctgcgaagtggccgggaggcggttcgcttcgggaaagaaggtgaccctgaacccttcggatccggaacattgtcaaatctgtcactgcgacgtggtgaacctgacgtgtgaagcgtgccaggaacccggggggctggtcgtccctccaaccgatgcacctgtgtcacccaccactttgtacgtcgaagatatctccgagcctcccctccatgacttctactgcagcagactcttggacctcgtgttcctgctggatggatcctccagactctcagaggcggagttcgaagtgctgaaggcgtttgtcgtggacatgatggagcgcttgcggatctcccagaaatgggtgcgcgtcgccgtggtggaataccatgacggatcccatgcctacatcggtctgaaggaccggaagcgcccttccgagcttcggcggatcgcttcgcaagtcaaatacgcaggttcgcaagttgcctccactagcgaggtgctgaagtacaccctgttccagattttctcaaagattgatcgcccggaggcttcgcgcattactctcctgctcatggcatcccaggaacctcagagaatgtcgcggaacttcgtccgctacgtgcaggggctcaagaagaaaaaggtgatcgtgatccctgtcggaatcggtcctcacgccaatctgaagcagattagactgatcgagaaacaggctccggagaataaggcgttcgtgttgtcgtcagtggacgagctcgaacagcagagggacgagatcgtcagctatctgtgcgatcttgcacctgaggcccctccaccaaccctgcctccagatatggcgcaggtgactgtgggtcccggactgttgggagtctcgactttgggaccgaaaagaaattctatggtcctggacgtggcctttgttctggaagggtccgataagatcggagaggccgatttcaaccgcagcaaggagtttatggaggaagtcatccaaagaatggatgtgggtcaggactccatccatgtgaccgtgttgcagtactcgtacatggtgaccgtggagtacccattttccgaggcgcagtccaaaggcgacatccttcagagagtgcgggagattagataccaaggaggaaatagaacgaacaccgggctcgcccttaggtacctgtctgatcatagcttcctcgtgagccaaggcgacagggagcaggcccctaacctggtctacatggtcaccggaaatccggcgtcggatgagattaagcggctgcctggcgacatccaagtggtccccatcggcgtgggacccaacgctaacgtccaggagctggaaagaattggttggccaaacgctccgatcctgatccaggacttcgaaaccctcccaagagaggctccggatctggtgctgcagcgctgttgttcaggagaaggactccagatccccactctgtcccccgctccagactgctcgcaaccactggacgtgatcctgctcctggacggttcatcctcattcccggcatcgtacttcgatgagatgaagtcattcgcgaaggccttcatctcgaaggccaacatcgggccaagactgacccaagtctctgtgcttcaatacgggtcgatcactaccatcgatgtgccgtggaatgtggtgccggagaaggcccacctgttgtcactcgtcgacgtgatgcaacgcgagggcgggcctagccagattggagacgcccttggatttgcagtccgctacctcacttcggaaatgcatggagctagaccgggagcctccaaagctgtggtcatcttggtgactgacgtgtcagtcgacagcgtggacgctgcggccgacgccgctcggtccaaccgcgtgaccgtctttccgattggcatcggcgacagatacgacgcggcacagctccgcattctggcagggcccgctggggactccaacgtggtgaagctccagcgaatcgaggacctcccgactatggtgactcttggaaatagcttcctgcacaaactctgcagcggcttcgtgagaatctgcatggatgaagatggcaacgagaagcgcccaggtgacgtgtggactcttccggatcagtgccatactgtgacctgtcagccagatggccagacccttctgaagtcccaccgcgtcaactgtgacaggggactgcgaccctcttgcccgaacagccagtcgcctgtcaaagttgaggaaacttgcggatgccggtggacctgcccatgcgtctgcactggatcctccacccggcatatcgtcacgtttgacggccagaacttcaagctcactggatcgtgcagctacgtgctgttccaaaacaaagaacaggatttggaagtgatcctccataacggagcgtgctcacctggcgctcggcaaggatgcatgaagtcgatagaagtgaagcattccgccctgtccgttgaactgcacagcgacatggaggtcaccgtgaacgggcgcctggtgagcgtgccgtatgtgggcggaaacatggaagtgaacgtctacggcgcaatcatgcatgaagtgcggttcaatcacctgggacacatctttacttttaccccgcagaataacgaatttcagcttcaactgtcgcctaagactttcgcctccaagacctacggtttgtgcggcatatgcgacgagaacggggcgaatgatttcatgctgagggacggaaccgtgacgactgattggaaaaccctggtccaggagtggactgtgcagcgcccgggacaaacttgtcagccaatcctcgaagagcagtgcctggtcccagactcttcacattgccaggttctgctgcttcctctcttcgctgaatgccacaaggttctggcgccagcaaccttctacgctatctgccagcaagattcctgccaccaggaacaagtttgtgaagtgatcgcatcgtacgctcatctctgcagaactaacggcgtgtgcgttgattggaggaccccggatttctgcgcaatgtcatgcccgccatccctggtctacaaccattgtgaacacggatgccctcgccactgcgacggaaacgtgtcgtcgtgcggggaccacccgtcggaaggctgcttctgccctccggacaaagtgatgctcgagggatcctgcgttcccgaggaggcctgcactcagtgcattggagaggacggcgtccagcatcagttccttgaggcttgggtcccagatcaccaaccgtgccaaatctgtacctgtctgtccggccgcaaagtcaattgtactacgcagccttgtccaaccgcgaaagcgccgacctgcggcctgtgtgaggtggctcggcttagacagaacgctgatcagtgctgtccggagtatgagtgcgtttgcgacccggtgtcgtgcgatctcccgcctgtgccgcactgtgaacgcggactgcaaccgactttgaccaacccgggagaatgccgccccaacttcacttgcgcttgcagaaaggaggagtgtaagcgggtgtcgccgccgagctgtccaccacaccgcctgccgaccctgcgcaagactcagtgttgcgacgagtatgagtgtgcgtgtaactgcgtcaattccacggtttcgtgcccactcggctacctggcctcaacggctactaacgattgtggctgtactaccaccacttgcctgcccgacaaggtgtgtgtccatcgctccaccatttacccagtcgggcaattctgggaggagggatgtgacgtttgcacgtgcaccgatatggaagatgccgtcatgggactgagggtcgctcagtgttcgcagaaaccatgtgaggactcctgccgctcaggattcacttatgtgctgcacgagggagaatgctgcggtagatgccttccttcggcgtgcgaagtggtgaccggaagcccgagaggcgatagccaaagctcgtggaaatccgtcggctctcaatgggcctccccggaaaatccgtgccttatcaacgaatgtgtgcgggtcaaagaagaagtgttcatccaacagcggaacgtgtcatgtccgcagctggaagtgcccgtgtgcccatcgggttttcagctgtcatgcaagacctccgcatgttgccctagctgccggtgcgaacgcatggaggcatgcatgctgaacggcaccgtcattggaccgggcaagactgtgatgattgacgtgtgtaccacctgtcggtgcatggtgcaagtcggcgtgatctctggtttcaagctggagtgccgcaagaccacgtgcaatccatgtccgcttgggtacaaagaagaaaacaacaccggagaatgttgcggtcgctgcctgccaactgcctgtaccatacagttgcgagggggacagatcatgactctcaagagagatgaaacgctgcaagatggctgcgacactcacttctgtaaagtgaacgaacgcggcgagtacttttgggagaaacgcgtgactggctgtccacctttcgacgagcataaatgcttggcagaaggaggcaaaatcatgaagatcccgggaacctgctgcgacacttgcgaagagccggagtgcaacgacattacggcccgtctgcaatacgtgaaggtgggttcgtgcaagtcagaagtcgaagtcgacatccattactgccagggaaaatgtgcgtcgaaggccatgtacagcatcgacatcaacgacgtccaggatcaatgctcgtgctgcagcccgaccaggacggaacctatgcaagtcgccctgcactgcaccaacgggagcgtggtctatcacgaggtcctgaacgcgatggaatgcaaatgttcgccacggaaatgcagcaag

SEQ ID NO: 21348 - DNA, 8439 bp, Artificial Sequence
  Description of Artificial Sequence: Synthetic coding sequence
atgattccagctcggtttgccggcgtgctgcttgcgctggcattgattctgccggggactctctgcgcagaaggcacccgaggtcgtagctcaaccgctaggtgcagtttgttcggttccgactttgtgaacaccttcgacgggtcgatgtattctttcgccggatattgctcctacctattggctggtggctgccagaaaaggtcctttagcataataggtgacttccaaaacgggaagagggtgagcctgtccgtgtatcttggtgagtttttcgatatacatctattcgtaaacggcactgtgacacaaggggaccagagggttagcatgccctatgcgtcaaaagggctgtatctggagaccgaagcaggttactacaaactgtctggcgaagcctatgggtttgtagctcgaatagacggatccggaaattttcaggttttactaagtgaccggtacttcaacaaaacctgcggattgtgtgggaactttaatatctttgcagaggacgacttcatgacccaggaggggaccttgaccagcgatccatacgatttcgctaactcttgggcactcagctccggggagcagtggtgtgagcgggcaagccccccgtcttccagctgtaatatttcgtcgggggaaatgcagaaaggtttatgggagcagtgccagttgctgaaatcgaccagtgtgttcgcacgatgtcaccccttggtggacccagaacctttcgtcgccctgtgtgagaaaaccctatgcgagtgtgccggtggtctcgaatgtgcctgtcctgcgttgctggagtacgcaagaacatgcgctcaggagggaatggtgctatacggctggactgatcattcagcgtgctcacccgtgtgtcccgcagggatggagtaccgccagtgtgtgtccccatgcgcgagaacctgccaatctctgcatattaacgagatgtgtcaggagcgttgcgtggacggctgtagttgtcctgaaggtcaactgcttgatgaaggtctgtgcgtggagtccacagagtgtccctgtgtccatagtggaaaaaggtatcctcctggcacctccctttccagagattgcaacacctgcatctgccggaactcccaatggatctgttccaatgaggagtgtccaggcgagtgccttgtcaccggccagtcgcactttaagtctttcgataatcgttattttaccttttccggaatctgccagtacctcctggcaagggattgtcaagatcacagcttcagtatagtgatagagacggtccagtgcgcagatgacagggacgctgtgtgtacaaggagcgtgacagtcaggctcccaggactgcacaattcactggtcaaactgaaacatggggcaggagtggcaatggacggacaagacgtgcaattacccctattaaagggggacctaagaatccagcataccgttacagcttccgtccgcctatcctacggggaagacctgcagatggattgggatgggagaggtcgactcttggttaaactgtccccagtgtatgccgggaagacctgcgggctgtgcgggaactataatggcaaccagggggacgatttcctgactcccagcgggttggccgaacctcgtgtggaggatttcgggaacgcatggaaactgcatggagactgccaagatttgcagaaacaacactcagatccctgtgcactgaatcccagaatgacacggttttcagaggaggcttgcgcagtgctgacgtcaccaacttttgaagcgtgccatcgcgccgtgagcccactgccttatcttaggaactgtcgctacgacgtgtgttcatgctcggacggacgcgagtgtttgtgtggagcactggcatcctatgctgcggcctgtgctggccgaggcgtgcgggtggcttggcgagagccaggcaggtgcgagctcaactgtcccaaagggcaggtgtacttgcagtgcgggacaccctgcaatctcacctgcagatctctgtcttaccctgacgaggaatgcaacgaggcttgtctggagggatgtttctgcccacccggcctgtatatggacgagcgaggcgactgtgtcccaaaggcacagtgtccctgctattacgatggcgagatctttcagccagaggacatatttagcgaccatcataccatgtgttactgtgaggatgggtttatgcattgcaccatgtctggtgtccctggatctctcctccccgatgccgtcctgagtagcccactaagccaccgatcaaagcgcagtctgagctgtaggccacccatggtgaagctggtgtgtcccgctgataatcttcgggctgagggtcttgagtgcaccaagacatgccagaattacgacctggagtgcatgtccatgggatgcgtgagcggctgcctctgtccccccggaatggtccgacatgagaacaggtgtgtggcattggagagatgcccctgcttccatcaggggaaagagtatgccccgggagaaacagtgaaaattgggtgtaacacctgtgtatgtcaggaccgcaagtggaactgcacagaccacgtgtgtgacgctacatgttccacaattggaatggcccattatctgacctttgacggcctcaagtatttattccccggcgaatgccaatatgtactggttcaggactattgtggaagcaatcctggaacgtttagaatcctcgtagggaacaaaggttgtagccatcccagcgtcaagtgcaagaaaagagtgactattctcgtagagggaggcgagatcgagctgtttgatggagaggtcaatgtcaagcggccgatgaaggatgaaacccacttcgaggtggttgaatctggacgttatattattctgctcctgggcaaagcactttcagtggtgtgggataggcatctctcgatcagcgtcgtgttgaagcagacctaccaagaaaaagtgtgcggattgtgtggaaactttgatggaattcagaataacgatctaacctccagcaacctacaggtagaggaagaccccgtcgacttcgggaatagctggaaagtgagctcacagtgcgccgacactaggaaagtacctctggacagttcacccgctacctgtcataacaatatcatgaagcagaccatggtggactccagttgccgcatcctaaccagtgatgttttccaggactgcaacaagctggttgaccctgagccgtacctggatgtgtgcatatacgacacttgctcttgcgagtcgattggggactgcgcatgcttctgtgatactatagccgcttatgctcacgtttgtgctcagcacgggaaggtcgtgacatggcggactgccacactgtgcccccagtcttgcgaggagcggaacttaagagaaaacgggtatgagtgcgagtggagatataactcttgtgcacccgcctgccaggtcacctgccagcatccagaacctctggcgtgccctgttcagtgtgtggagggatgccacgcgcattgtccaccaggcaaaatacttgatgagctgttgcagacttgcgtggatcccgaggactgtcccgtatgcgaggttgctggaagacgattcgcatctggcaaaaaggtaactctgaatccttctgaccctgagcactgccagatttgccactgtgatgtcgtgaaccttacctgtgaagcttgccaggaacctggagggcttgttgttccacccacagacgccccagtgtcccctaccacactgtacgtggaggatatatccgaacctccgctccacgatttctattgtagtagacttctggatttggttttcctcctcgatggtagcagtcgattaagtgaagccgagttcgaggtcctgaaagcctttgtagtggatatgatggagagactgcgtatttcacagaagtgggtaagggtcgctgtagtagaataccatgatgggtcacatgcttacatcggactgaaggatcgtaagagaccctctgagctcagaaggatagcctcacaggtgaagtacgccggcagtcaagttgcaagcacctcagaagtgctgaaatacacactcttccaaatcttcagtaagatcgatagacccgaggctagcagaatcacattacttttgatggcgtcccaagagccacagaggatgtcccgcaatttcgtgaggtatgtccagggtctcaaaaaaaaaaaagtcatcgtcattcctgttggcataggcccccatgcgaatcttaagcagatcagacttattgaaaagcaggccccagaaaataaagcgttcgtgttatcatccgttgacgagctcgagcagcagcgggatgaaattgtatcctacttgtgcgatcttgccccagaggctcctcctccgaccctgccgccagacatggcacaagtcacagtgggccccgggcttctgggtgtgtccaccctgggaccaaaacgaaactctatggtgcttgacgtagctttcgtgctagaaggcagtgataaaatcggggaggcggacttcaatagatccaaggaatttatggaagaggtgatccaacggatggacgtgggtcaagactccatccatgtaaccgtcctccaatactcttatatggtcactgttgaatacccattcagtgaagcacagtcaaaaggggatatacttcagcgcgtgcgggaaattcgttaccaaggaggcaatcgcacaaataccggacttgcgctgcggtacctaagcgaccacagcttcctggtttcacagggagatagggagcaggcaccaaatctggtttatatggtcaccggcaaccctgcttccgacgagattaagaggcttcccggcgatatccaagtggtgcctatcggtgtaggccctaatgcaaacgtgcaggagctggagaggattggctggcccaacgcccccatcttaattcaggatttcgagacactgccccgcgaggcaccagatctcgttcttcaacgatgctgctcaggcgaaggcctccagatcccaacgctgtcaccagcgcccgactgctcccagcctctcgatgtcattctcctgctagatggaagctcaagttttcccgcatcatattttgacgagatgaagtcgttcgctaaggcctttatctccaaggcaaacatcggaccacgcttaacccaggtgtccgtgctgcagtacggttccatcacgacaatcgatgtcccatggaacgtcgttcccgagaaagcacatttgcttagcttagttgacgtgatgcaacgggagggcggtccctcccagattggagatgcactgggattcgccgtgcggtacctaaccagtgagatgcacggcgcaaggccaggcgcctccaaagccgtggtcatcctcgtgaccgacgtgtccgtggactccgtcgatgcagccgccgacgcagccagaagtaaccgggtgaccgtgtttccgatcgggataggtgatcggtacgatgcggcgcagcttaggattctcgcgggcccagctggtgattctaacgtcgtgaagctacagcgtatcgaggaccttccaacgatggtgactctgggcaatagtttcctgcataagctgtgcagcggcttcgtcaggatttgtatggacgaggacggaaacgagaagcggcccggcgacgtctggacattgcccgatcagtgccatacagtgacatgccagcccgatggccaaacactgcttaaatctcatagggtgaactgcgaccggggcctgcgacccagctgtcctaatagccagagccctgttaaagttgaagagacctgtgggtgccggtggacatgcccctgcgtgtgcacgggttcctccactagacacatcgtgacatttgacgggcagaacttcaagctgaccggaagctgcagttacgtgttattccaaaataaagaacaggatctcgaagttatacttcataatggagcctgcagcccgggagcccgccaggggtgtatgaaaagcattgaagttaaacatagtgcactgtctgtcgagttgcacagcgacatggaagtgaccgttaacgggcgcctcgtgtccgtgccatacgtgggagggaacatggaggttaatgtttatggggcaatcatgcatgaggtccggttcaatcacttagggcacatttttacctttacccctcagaataacgaatttcagttacagctcagccccaaaacttttgcgagtaaaacgtatggactgtgcggaatttgtgacgagaatggggcaaacgactttatgctgagggacgggacggtgactacagattggaagaccctggtccaagagtggacggtccagcgaccagggcagacatgtcagcccatcttggaggaacaatgtctggtgccagattcctcacactgccaagtgctgctgctcccccttttcgccgagtgccacaaggtccttgcacccgcaacgttttatgccatttgccagcaggacagctgccaccaggagcaggtgtgtgaagtgatcgcctcctacgcccatctgtgcagaacaaacggagtgtgcgtagattggaggactcctgatttttgcgctatgtcttgtcccccaagtttggtgtataatcactgcgaacacggttgcccgagacactgcgatggaaatgtctcctcctgtggggaccatccatccgagggttgcttctgtcctccagacaaagtaatgttagagggatcctgtgtgcctgaagaggcatgcacccaatgcattggagaagacggggtccagcaccagtttctggaggcttgggtgccggaccaccagccttgccagatctgcacatgtctgtcggggcggaaagtcaattgtactacacagccttgtcccacagcaaaggccccaacttgtggcctgtgtgaagtagcgcgtcttagacagaatgccgaccagtgttgcccggagtacgagtgcgtatgcgatccggtttcatgcgatctgccaccagttccgcactgtgagcggggcctccaacccaccctgaccaatccaggcgagtgccgtcccaatttcacctgcgcttgccggaaggaggaatgcaagcgagttagccctccgagctgcccaccacatcgcttgccaaccctacgcaaaacccagtgctgcgatgagtacgaatgcgcctgcaactgcgttaatagtacggtctcatgccccctggggtacctcgctagcacggcaactaatgattgcggctgtactacgacgacttgcctcccagataaggtttgcgtacaccgctccaccatctaccctgtaggccagttctgggaagaaggctgtgacgtgtgtacatgcactgacatggaggatgccgtgatggggttaagggtagcgcaatgctcccagaaaccttgtgaagactcctgcagaagtggatttacttacgtactccacgagggcgaatgttgcgggcgttgtctgccctccgcctgtgaggtggtaacaggctccccgcgcggggatagtcagagctcttggaagagcgttggaagccaatgggccagcccagagaatccctgtctcattaatgaatgtgtcagggtgaaagaggaagtattcattcagcagcgcaatgtctcgtgtcctcagctggaggtgccggtgtgcccctccggctttcagctgtcttgtaaaacctcggcttgctgtccatcctgccggtgcgagagaatggaggcatgcatgctgaatggcaccgtgattggtcctgggaagacagtgatgatcgacgtctgcactacatgcagatgtatggttcaagtgggcgtgatatctgggttcaaactggagtgccgcaaaacaacatgcaatccctgtccgctgggctataaggaagagaacaacactggagaatgctgtggcaggtgcctcccgacagcgtgtacaatacagctcaggggcgggcaaataatgaccctcaagcgagacgagaccctccaggacggctgcgacacccatttttgcaaggtcaatgaaagaggagagtacttctgggagaagcgtgtgacagggtgccctccgttcgatgagcataaatgcctcgctgaaggggggaaaattatgaagataccagggacgtgttgtgatacatgtgaggaaccagagtgtaatgacatcacagctcgtttacaatacgtgaaagtgggttcatgcaagtcggaggtagaggtggatatccattactgtcaaggtaagtgcgcaagcaaggcaatgtactccattgacatcaacgatgtgcaggatcagtgtagttgctgttctcccaccagaaccgagcctatgcaggtggccctccactgtacaaacggctctgtggtgtaccacgaagtcctcaatgcaatggaatgcaaatgctctccccggaagtgctcaaag

SEQ ID NO: 21349 - DNA, 8439 bp, Artificial Sequence
  Description of Artificial Sequence: Synthetic coding sequence
atgatcccagcccggtttgccggagtcctgttggcgctggccctgattctgcctggcactctttgcgccgaaggaacccggggaagatcctcgactgcacgatgttcactgtttggttcagacttcgttaacaccttcgatggctcgatgtactcatttgcaggctactgttcctacttgcttgcaggaggctgccagaagagatcgttttcgattattggtgacttccaaaatggcaagcgtgttagcttgtccgtatacctcggagagtttttcgatattcatctttttgtcaacggtaccgtgacgcagggggatcaacgtgtttccatgccatacgcatccaagggcctgtacctcgagactgaagcaggatactacaaactttcgggagaagcatacgggtttgttgctcgaattgatggctcgggcaattttcaggtgcttctgtcagatcgctacttcaacaaaacctgcgggctgtgtggtaatttcaacatctttgctgaggacgacttcatgactcaggaaggtactcttactagcgatccatacgatttcgcaaactcgtgggcactttcatcgggcgaacaatggtgcgagagggcatcacctccatcgtcctcgtgtaacatatcttccggcgaaatgcagaaaggtctttgggaacaatgtcaactgcttaagtccacttcagtgttcgcgcgctgccatcctttggtggatccagagccttttgtggcactttgtgaaaagaccttgtgtgaatgtgcaggagggctcgagtgtgcgtgcccagcccttttggagtacgctcgcacttgtgctcaggagggaatggtgctctacggatggaccgatcattcggcctgttcgcctgtgtgtccagcaggtatggaataccggcaatgcgtgtcaccatgtgcaaggacctgtcaaagcctccatatcaacgaaatgtgtcaagaaagatgcgtcgatggctgctcgtgcccggaaggccaactgcttgatgaaggactgtgtgtggaatccactgagtgcccatgtgtacactcgggtaagcggtacccgccaggtacttcacttagccgcgattgtaatacctgtatctgccgcaactcacagtggatctgcagcaacgaagaatgccccggagagtgtctcgtcactgggcaaagccacttcaagtcatttgacaaccgttacttcaccttctcaggcatttgtcaatacttgcttgcgcgtgattgtcaagatcactcgtttagcattgtcatagaaactgttcagtgtgccgacgatcgagatgccgtgtgtactaggtcggttaccgtgagactcccgggactgcataatagccttgtgaaactgaagcatggcgcgggagtcgctatggacggacaggatgtccaactgcctctgcttaagggggatcttagaattcagcacactgtgaccgcctcggtgcgcctgtcgtacggggaggacctgcagatggactgggatggacgtggacgcctgctcgttaagctctcccccgtgtacgcggggaaaacttgtggcctttgcggcaactataatggtaaccaaggggacgattttcttactccctcaggtcttgcagaaccaagagtggaggactttggtaatgcgtggaaacttcacggcgactgccaggatctgcaaaaacaacattccgatccttgtgcactgaaccccagaatgacgagattctcagaggaggcatgtgccgtccttacctctccaacctttgaagcatgccatagagcagtcagcccgctcccctacctgcggaattgcaggtacgatgtctgtagctgttccgatggaagagaatgcctttgcggagccctggcatcgtacgctgcagcatgcgcgggtcgcggagtccgggtggcgtggcgcgaacctggacggtgtgaactgaattgtccaaagggccaggtgtacctgcaatgtggaacgccttgcaatctcacttgcaggagcctttcttaccctgatgaagaatgtaacgaggcatgtctcgagggatgtttctgtcctcccgggctgtacatggatgaacgcggagattgcgtgccgaaagcacagtgtccatgttactacgatggtgagatttttcaacctgaggacatcttttcagatcaccataccatgtgttactgtgaggatggtttcatgcattgtactatgtctggtgtccctggatcgcttctgcctgacgcagtgctgagttcgccactgagccatagatccaagagatcgctgtcatgtcgccccccgatggtgaaacttgtgtgtcctgctgataaccttagagcagagggcctcgaatgcaccaagacctgccaaaactacgatctggagtgcatgtccatgggatgtgtgtcagggtgtctctgtccccccggtatggtccggcacgagaatagatgtgtcgccctggagaggtgtccttgtttccatcagggaaaggaatacgccccaggagaaactgtgaaaattggatgtaacacttgtgtgtgtcaagatagaaagtggaactgtaccgatcacgtgtgtgacgcaacgtgtagcactattggtatggcccattacctgacttttgacggtctgaagtacctgtttcccggggaatgtcagtacgttctggtgcaggattactgtggtagcaacccaggtacctttagaatactggtgggaaataaggggtgttcccatccctccgttaagtgtaagaagcgggtcactatccttgtggaaggaggggagatcgaactgtttgatggggaggtgaacgtcaaaagaccaatgaaggacgagactcattttgaagtggtggaatccggacgatacattattctgctcctggggaaagcactgtccgtggtctgggatagacatctgtccatctcggtggtgctgaagcaaacgtaccaggaaaaagtctgcggtctgtgcggaaactttgatggcattcagaacaacgacctcacttccagcaatcttcaagttgaagaggacccagtggatttcggaaattcctggaaggtgtccagtcaatgcgcagatacccgtaaggtgccattggatagcagccccgccacctgccataacaacattatgaaacaaactatggtggactcttcctgtcggatcctgacctccgacgtatttcaggactgcaataaacttgtcgatcccgagccctaccttgacgtgtgcatttatgacacctgttcttgtgaatccatcggggactgtgcatgcttttgcgataccattgcagcatacgcacatgtgtgtgcacaacatggtaaggtagttacgtggcgtacggcaaccctttgtccccaatcgtgtgaggagaggaaccttcgagaaaacggttacgaatgcgaatggcgctacaattcatgtgctcctgcatgccaggtcacctgtcagcatcctgagcctctggcatgccctgtccaatgcgtggaagggtgccacgcccactgtccacctggaaaaatcttggatgagcttctccagacctgcgtcgatccagaggattgtccagtctgtgaagtggccggtcgaagatttgcctccgggaagaaggtgactctgaatccatctgatccggaacattgtcaaatatgtcactgtgatgtggtcaatcttacttgcgaagcatgccaagaacccggcggattggttgtccccccaaccgatgctccggtatccccaactactttgtacgtggaggatatcagcgagccccctctccatgatttctattgtagccggctgttggatctcgtttttctgcttgacggatcttcgcggctcagcgaagcagaattcgaggtgcttaaggcatttgtggttgacatgatggaaagacttcgcatttcacagaagtgggtcagagtcgcagtggtggaatatcacgacggatcccacgcatacatcggcctgaaggatagaaagcggccctcggaactgcggcgcattgcctcccaggtgaagtacgcaggttcccaggtggcatccacctctgaagtgcttaagtacacccttttccaaatcttttcaaagattgatagacctgaggcgtcacgaataactcttctgctgatggcatcccaggaaccacaacggatgagccggaactttgtgcgctatgtgcagggtcttaagaagaaaaaagtgatagtgattcctgtcgggatcggaccacatgccaaccttaaacaaattcggctgattgaaaagcaggcacccgaaaacaaggccttcgtcctgagctccgtcgatgagcttgagcagcaacgggatgaaattgtgtcttacctctgtgatctggctcccgaagcaccaccacctacgctgccccctgatatggcacaagtgaccgtcggacccgggctgctgggggtttcaaccttgggtccaaagcgcaactccatggtgctcgatgtggcatttgtgctcgaaggatccgataagattggtgaagccgactttaatcggagcaaggaattcatggaagaagtgatccaaagaatggacgtgggccaagactcaatccatgtcactgtgctgcaatattcgtacatggtgactgtcgaatacccattctcggaggctcagagcaagggggatatactccagagagtgagggaaattcgctaccagggaggtaacaggacgaacactggacttgcattgaggtacctttcagatcattcgtttctggtgagccaaggtgatagagaacaagctccaaacctcgtgtacatggtcactggaaatcccgcatcggacgagattaagagacttcctggagacatacaagtggtcccaatcggcgtaggcccaaatgcaaacgtccaagagctcgaacggattggttggcctaatgcacctattctcatacaagacttcgaaactctgccgcgggaagcgccagacctcgtgttgcaacgttgctgcagcggtgaaggcctccagatcccgactctttcaccagctccagattgtagccaacctctggacgtgatcctgctcctggacggatcgtcctcctttcctgcatcatactttgatgaaatgaagagctttgcaaaagcatttatcagcaaggccaacatcggcccgcgcctgacccaagtgtcagtgctgcaatacggatcgattactactatcgatgtgccgtggaacgtggtccctgagaaggcacatcttctctcgcttgtggacgttatgcagagagagggaggaccatcgcaaattggagatgcactgggtttcgccgtgcggtacctcacttcagaaatgcatggcgccagacccggagcgtcaaaggcggtggtcattctggtcaccgacgtgtccgttgactccgtcgacgcagcagctgacgccgcaagatccaatcgagtgacggtgtttcccatcggtatcggggatcgctacgacgcagcccaacttcgcattctcgcaggccctgccggtgattccaacgtggttaagctccaacgaatagaagatctgcctactatggtgacgcttggtaattccttcctgcacaagctctgtagcggcttcgtgcgaatctgtatggatgaagatggtaatgaaaaaagacctggggacgtgtggacgcttcctgaccagtgccatacggtgacttgccagccagatggtcagactttgctgaagagccacagggtcaactgcgaccggggacttagacccagctgtcctaactcccaatcacctgtgaaggtcgaggaaacttgcggatgtcgctggacgtgtccttgcgtgtgtacgggatcctctacccgccacattgtgactttcgacggccagaactttaaactgaccggatcctgttcttatgtgctctttcagaacaaggaacaggatctggaagtgattctgcataacggagcatgttcacctggtgctagacagggatgcatgaaaagcattgaagtcaagcattcggcacttagcgtggagcttcattccgatatggaagtgaccgtgaacgggagactggtgtccgtcccttacgtgggaggaaatatggaagttaatgtatacggagcgattatgcatgaagtgcggtttaaccacctgggtcacattttcaccttcacccctcaaaacaacgaatttcagcttcaattgagccctaaaaccttcgcttcgaaaacctacgggctttgcggtatctgcgatgaaaacggagcgaatgactttatgctgcgcgatgggacggtgaccacggattggaaaaccctcgtgcaagaatggactgttcagcgaccaggacagacttgtcagcccatccttgaggaacagtgtctggtgccagatagctcccactgccaagtgctcctgctccctctctttgcagagtgtcataaagtgcttgccccggcaactttctatgcgatctgtcagcaggactcgtgccaccaagagcaggtgtgtgaagtgatagccagctacgcacatctgtgccgaacgaatggagtctgcgtggactggagaacccctgatttttgtgcaatgtcctgcccaccgagccttgtctataaccattgcgagcacggatgtccccgccattgtgatggcaacgtgtcgtcgtgcggggaccacccgtctgaaggttgtttctgtccccctgataaagtgatgcttgaagggtcgtgtgtgcctgaagaggcctgcacccaatgtattggtgaggatggggtccagcaccagtttcttgaggcatgggtcccggaccaccaaccttgtcagatctgtacctgtctctcgggaagaaaggtcaattgcactacccagccctgcccaaccgcgaaggcccccacttgtggtttgtgcgaagtggcaaggcttcgtcagaacgcggaccaatgttgccctgagtacgagtgcgtgtgtgatccagtgtcgtgtgatttgccccctgtaccacactgtgagagaggcctgcaacctactttgactaaccctggtgaatgccgaccgaactttacctgtgcctgccggaaggaagagtgtaaaagagtgagcccaccttcatgcccacctcaccgcctccccactctgcgcaagacccaatgttgcgatgagtacgaatgtgcgtgtaactgcgtgaattcaactgtcagctgtcctcttggatacctcgcctcgaccgccacgaacgattgtggttgtactaccaccacctgtctgccagataaggtctgtgtgcatcggtcgaccatatacccagtgggacaattttgggaggaaggttgcgatgtgtgtacttgtactgatatggaggatgcagtgatgggtcttagagtggcacaatgctcgcagaagccatgcgaagatagctgtagatccggctttacctacgttctgcatgaaggagaatgctgcggaaggtgcctgccttcggcatgtgaggtggtgaccgggtcgccgcggggagattcccaatcgagctggaagtcagttggatctcaatgggcctcgccagaaaacccatgcctgattaatgaatgtgtccgcgttaaggaagaggtgttcatccagcagaggaatgtgtcttgtcctcaactcgaagtccccgtgtgcccttctggttttcagctgtcgtgtaagacctccgcatgttgtccgtcctgccgatgtgaaaggatggaggcgtgtatgcttaacggaaccgtgatcggtcctggtaagactgtcatgattgacgtttgtaccacttgtcggtgcatggtccaagtcggagtgatttcgggattcaaacttgagtgcagaaagaccacctgcaacccttgcccactcggatacaaagaagaaaacaacaccggtgaatgttgtggcagatgtctgccgactgcatgtactatacagctccggggagggcaaatcatgactcttaaacgtgacgaaactcttcaagatggatgcgatacccatttttgcaaggtcaacgagcgaggcgagtacttttgggaaaaacgtgtgaccggttgtcctccctttgacgaacataagtgtctcgcagaaggtggcaagattatgaagatccctggcacctgttgcgacacctgtgaagaaccagaatgtaatgacataaccgcacgattgcagtacgtcaaagtgggtagctgtaagtcagaagtcgaagtggacattcattactgtcagggaaagtgtgcctccaaggcgatgtactccattgacattaatgatgttcaagaccaatgtagctgttgtagccctacccgcaccgagcctatgcaagtcgcgctccattgtactaacggatcggtagtgtaccacgaagtgctcaacgctatggaatgtaagtgtagtcctcgcaagtgttcaaag

SEQ ID NO: 21350 - DNA, 8439 bp, Artificial Sequence
  Description of Artificial Sequence: Synthetic coding sequence
atgatcccggctaggttcgcaggtgtgctgctcgccctggcactcatactccccggtacgctctgcgcagaaggtacgagaggtagatcctcaaccgcaagatgcagcctttttgggtcggattttgtgaatacttttgatggatcgatgtacagttttgcaggatactgtagttacctgcttgctggtggttgtcagaaacgttcgttctccatcatcggagatttccagaacggaaagcgtgtgtccctttcggtgtaccttggagagtttttcgatatccatctctttgtcaacggaactgtcactcagggggatcagcgtgtgtcgatgccctatgcgtcgaaaggactttaccttgaaactgaggcgggttactacaaactgtccggggaagcatatgggtttgtggcccgcattgatggttccggtaactttcaagttcttttgtccgaccgctatttcaacaagacttgcggcctttgtggcaatttcaacattttcgcagaagatgacttcatgacccaagaaggcactctgaccagcgatccatacgatttcgcaaactcatgggcccttagctctggagagcagtggtgcgagagggcgtcacctccaagcagctcatgtaatatctccagcggcgaaatgcagaaggggctttgggagcagtgccaacttctcaagtcgacctcggtgtttgctagatgccatcctcttgtcgacccggagccctttgtggccctttgcgaaaaaactttgtgcgaatgcgccggtggcctggaatgtgcctgcccagctcttcttgagtacgcccgaacctgtgcgcaggaagggatggtgctgtacggctggacggatcatagcgcctgctcgccggtatgcccggccggaatggagtaccgacaatgtgtgagcccttgtgcccgtacctgtcagtcgctccacatcaacgaaatgtgtcaggagcgatgtgtcgatggatgttcttgtccagagggacagcttcttgacgaaggattgtgcgtcgaaagcaccgagtgcccttgcgttcactcgggcaagagataccctcctggtaccagcctttcacgggattgcaatacctgtatctgtcgtaactctcaatggatttgttccaatgaggagtgtccaggagagtgcttggtgactggacagagccactttaagtcctttgataatcgttactttaccttctccggaatctgtcaatacttgctcgcaagggactgccaagatcattccttttcgattgtcatcgaaaccgtgcaatgcgcagatgaccgagatgcagtgtgtacccggtcggtcactgtgagactccctggcctgcataactcattggtgaagctgaagcatggagcaggagtggcgatggacggacaggatgttcaattgcctctgcttaaaggggatctgcgcatccaacacactgtcacggcaagcgtgcggctctcgtacggcgaagatttgcagatggattgggacgggcgcggaaggctgctcgtgaagctgagccccgtgtatgcaggaaagacgtgcggactttgtggtaattacaacggcaatcaaggcgatgattttctcactccttccggactggcagaacctagggtcgaagatttcggaaacgcatggaagttgcacggagattgccaagatcttcaaaagcaacattcagatccatgtgcattgaaccctcgcatgacccgattcagcgaagaagcatgtgccgtcctgacttctcccaccttcgaggcgtgccatagggccgttagcccacttccttacctgcgcaattgccgttacgacgtgtgtagttgctcggatggaagggagtgcttgtgtggtgcactggcatcatacgcagcagcctgtgcaggaagaggtgtccgcgtggcatggcgagagccgggacggtgtgagttgaactgtcctaagggtcaggtctacctccaatgtggaaccccatgcaatctcacttgtcgatcgctctcatacccagatgaagaatgtaatgaggcgtgtcttgaagggtgcttttgtccaccaggtctgtacatggatgaaagaggcgactgtgtccctaaagctcagtgcccttgttactacgatggagagattttccagccggaggatatctttagcgatcatcacactatgtgttactgtgaggacggctttatgcattgtaccatgtccggagtcccaggttcgctgctccccgatgcagtcctctcctcccctctgtcacaccgcagcaaacggtccctttcgtgtcgaccgcccatggtgaaactcgtgtgtcctgcagataatctgagagcagaaggtcttgaatgtactaagacctgtcaaaactacgatctcgagtgcatgtcaatgggatgtgtgtccggatgcctctgccctccaggaatggtgcgccatgagaacaggtgcgtggctctggaacggtgtccttgctttcaccaaggaaaagaatacgcaccaggcgagacggtgaagatcggttgtaacacctgcgtgtgtcaagaccgtaaatggaactgtactgatcatgtgtgtgacgcaacctgttccaccattggtatggcgcattacctgaccttcgacggactcaaatacttgtttcctggcgagtgccagtacgtgctggtgcaggactactgcggaagcaatccaggcacctttagaatcctggtgggtaacaaaggatgttcgcacccctcggtgaagtgtaagaaaagggtgacgattcttgtggagggaggtgaaatagagcttttcgatggagaagtcaacgtcaagcggccaatgaaggatgaaacccatttcgaagtggttgagtcgggccggtacattattctgctgcttggaaaggcactttccgtggtgtgggatcgccacttgtccatctccgtcgtgctgaagcagacctaccaagagaaggtttgtggtctgtgcggtaactttgacggtatccaaaacaatgatttgacttcgtccaatctgcaagtggaagaagatcccgtcgattttggaaactcgtggaaggtttccagccaatgtgccgacaccaggaaggtgccccttgattcgagccctgctacctgccataacaacattatgaaacagaccatggttgactcgtcgtgtagaatactgacctccgatgtgttccaagactgtaacaaacttgtggaccctgaaccatacctggatgtctgtatctacgatacctgttcttgtgaaagcattggagattgtgcatgcttttgcgataccatcgccgcttacgcacacgtgtgtgctcagcatggcaaagtggtcacttggagaaccgccaccctttgcccacaatcgtgtgaagaacggaacctccgtgaaaacggctacgaatgtgagtggcgatacaatagctgcgcacctgcctgtcaagtcacgtgtcaacacccagaaccactcgcatgtccagtgcagtgcgtcgaaggatgtcatgcacattgtcctcctggcaagatacttgacgaacttctccagacctgtgtcgaccctgaagattgccctgtttgtgaggtggctggtaggagatttgcttcgggtaagaaggtcacccttaacccttcagatcctgaacactgtcagatttgtcactgtgatgtagtaaatctcacgtgtgaagcatgtcaggagccggggggactggtggtgcctccaaccgacgcacccgtgtccccaaccaccctctacgtcgaggacatttcggaaccacctcttcatgacttctattgttcccgtctgctggatttggtattcctgctggatggatcgagcagattgtcggaagcggaatttgaagtccttaaagccttcgtggtggacatgatggagaggctgagaatctcccaaaagtgggtcagagtggcggtcgtggaatatcatgacggtagtcatgcgtacattggcctgaaggatcgcaagaggccctcagagcttcgaagaattgcctcgcaagtgaaatacgcaggctcacaagtggctagcacttccgaagtccttaagtacactctctttcagattttcagcaagattgacagaccggaggccagccggattactctgcttcttatggcaagccaggagcctcagcggatgtccagaaatttcgtgagatatgtgcagggacttaagaagaaaaaagtcatcgtgatccctgtgggaattggacctcacgcaaatcttaagcaaatacgcctcattgaaaaacaggcccctgagaataaggcattcgtcctgtcatcagtggatgaactcgagcaacaaagggatgagatagtctcctacttgtgtgacctggcacccgaagcgcctccccctacccttcctcctgatatggctcaagtgacggtcggccccggactcctgggcgtttcgaccctgggcccgaagcgcaattcgatggtcctggatgtcgcctttgtgcttgaaggatcggataagatcggtgaggcagactttaacagaagcaaggagtttatggaagaggtcattcagcgcatggacgtcggacaagactcaatacatgtgactgtgctccagtactcttacatggtgactgtggagtacccgttctcggaagcacaatcgaagggagatattctccagcgcgtgcgagaaatccggtaccaaggagggaatcgcaccaacactggtctggctttgcgttacctgtcagatcactcgttcctcgtctcacaaggggatagggaacaggcacccaacctggtgtacatggtgaccggtaaccccgcttcggacgaaatcaagagattgcccggggatattcaagttgtgcccattggggtcggacctaacgctaatgtgcaggaactcgaacgaataggttggcctaacgcacctatcctgatccaagactttgaaaccctcccaagagaagcgcccgacctggtcctgcagcgttgctgtagcggagaggggttgcagattccaactctgtcgccagcaccagactgttcacagcctcttgacgtgattctgcttttggatggctcatcatcctttccagcgtcgtactttgatgaaatgaagtcatttgccaaggccttcatatccaaagcgaacattggtccacgcttgacccaagtcagcgtcctgcagtacggtagcattaccacgattgacgtgccttggaatgtggtgccagagaaggcacatctgctgtcactggtggacgtgatgcagcgggaaggaggtccatcccaaatcggcgacgcactgggatttgccgtgcggtacctgacctccgagatgcacggcgcacggcccggagcatccaaagcagttgtgattcttgtgactgacgtgtcggtggatagcgtcgatgctgcagcggacgcagcacgctcaaatcgggtgactgtctttcctatcggtattggtgatagatacgatgcagcgcaactgaggatacttgcaggaccagcgggagattccaacgttgtgaaactgcagcgcatcgaggatctgcccaccatggtgacccttgggaactcatttctgcataagctctgttcagggtttgtgcgcatttgtatggacgaggacgggaacgaaaaaaggcctggtgacgtgtggactctgcctgaccaatgtcataccgtgacgtgccaacccgatggtcaaactttgctcaaatcccatagagtaaattgcgatcggggacttcgaccatcgtgtccgaactcccaatcccctgtgaaggtcgaagaaacgtgtggctgtagatggacctgtccctgtgtctgtactgggtcatcgacccgacatattgtgacgtttgacggacaaaacttcaagttgaccggatcatgctcgtatgtgctgtttcaaaacaaagaacaggaccttgaggtcattctgcataacggcgcttgtagccctggtgcgcgccagggatgcatgaagtcaattgaagtcaagcactctgccctttccgtcgaactgcatagcgatatggaggtcactgttaacggaaggttggtatctgtgccatacgtgggaggaaacatggaggtgaacgtgtacggagcaatcatgcacgaagtgcgctttaatcatcttggacacattttcacctttacccctcagaacaacgaatttcaactgcaactgtcgcctaagacttttgcgagcaagacctatggactttgcggaatatgtgacgagaatggagcgaacgactttatgcttagagatggcacggtgaccaccgattggaaaacccttgtgcaggaatggaccgtgcaaagaccagggcaaacctgccagcctatccttgaagaacaatgtctggtcccagactcctcccactgccaagtgctccttctgcctcttttcgcagagtgccacaaagtgcttgcacctgccacgttttacgcaatctgtcagcaagattcgtgtcatcaggaacaagtgtgcgaagtgattgcatcctacgcgcacctgtgtcggactaatggtgtctgtgtggattggagaactcctgatttttgtgcgatgtcgtgccctccttctctcgtgtacaatcattgcgagcatggttgcccgcgtcactgcgacggcaacgtgagctcatgtggagatcatccaagcgaggggtgcttctgcccacccgataaggttatgcttgaagggtcctgcgtgcccgaagaggcctgtacccaatgtatcggcgaggacggtgtccagcatcagtttctcgaagcctgggtgccagaccatcaaccatgccagatctgtacctgcctgtcgggtagaaaggtgaattgtaccactcaaccatgcccgactgccaaagcccctacctgtggactgtgcgaagtcgcgcgcttgcgacaaaacgccgatcagtgctgtcccgaatacgaatgtgtctgcgatccagtgagctgtgacctccctcccgtgccacattgcgaacgcggcctccagcctactctgactaaccctggggaatgccgacctaactttacttgtgcctgtagaaaggaagaatgcaagagagtgtcaccacctagctgccctccacaccgcctgcccaccctccgaaagacccaatgctgtgatgagtacgaatgtgcatgtaactgtgtgaacagcactgtcagttgtcctctcggttacttggcaagtacggcaacgaatgactgtggttgtaccaccactacttgccttccagataaggtctgtgtgcaccggtccaccatttaccccgtgggtcaattctgggaagagggatgtgatgtttgtacctgtactgacatggaggacgccgtgatgggacttcgggtggcacagtgctcacaaaagccctgtgaggatagctgtcgttcaggctttacctacgtgcttcatgaaggtgaatgctgcggtcggtgccttccttctgcatgtgaggtggtcacggggagcccccgcggtgattcacagtcgtcctggaaatcggtgggttcacagtgggcatcaccagaaaacccctgtctgattaacgaatgcgttcgtgtgaaggaagaagttttcattcagcagcgcaacgtgtcatgtccccagctggaagttcccgtgtgccctagcggatttcagctgtcatgtaaaacgagcgcatgttgtcctagctgtagatgtgaaaggatggaggcctgtatgctgaatggaacggtgattggccctggaaagactgtgatgattgatgtctgcaccacctgtagatgtatggtccaagtgggtgtgatctcgggatttaagttggaatgtagaaaaactacgtgtaacccatgtccgctcggatacaaggaagagaacaataccggagagtgttgcggtaggtgtttgcctacggcctgtaccattcaactgagaggaggacaaatcatgactctgaagagggatgagactttgcaagatggctgcgacacgcatttctgcaaggtgaatgaaaggggtgagtacttctgggaaaagcgagtgacggggtgtccacctttcgacgagcacaagtgtctggcggagggaggcaagataatgaagataccaggtacttgctgtgatacttgtgaggagccagaatgtaacgatattactgcccgcctgcaatacgtgaaggttgggtcgtgcaaatccgaagttgaagtcgatattcattactgtcaaggcaagtgtgcttcgaaggccatgtactccattgacatcaacgatgtgcaagaccagtgtagctgctgttcgcctactagaaccgagccaatgcaagtggcactgcattgcactaacggttcggtcgtctatcatgaagtgcttaacgcaatggagtgtaaatgtagccccagaaagtgttcgaaa

SEQ ID NO: 21351 - DNA, 8439 bp, Artificial Sequence
  Description of Artificial Sequence: Synthetic coding sequence
atgatcccagcccggtttgcaggtgtcctgttggctctggcactgatcctcccaggaacgctgtgcgcagaaggtacaagaggtaggagttctacagcccggtgctccctgtttgggtctgacttcgtgaacaccttcgacggctccatgtactctttcgcaggctactgctcctacctgctggcaggcgggtgccaaaagcgctcatttagtatcataggagatttccaaaacgggaaaagggtgtctctgagcgtctacttaggggaattctttgacattcatttgttcgtcaatggcactgtgacccagggcgatcagagagtctcaatgccctatgccagcaagggtctttacctcgaaacggaggccggctactacaagttgtccggtgaggcctacgggttcgtcgcgcgaattgacggatccggtaattttcaggtactgctgtctgaccgatatttcaataagacatgtgggctgtgtggaaactttaatatttttgcagaggatgattttatgacacaggagggaaccctgacaagcgatccttatgacttcgctaatagctgggcactgagttcaggagaacagtggtgtgagagggcctctcctccatcttcttcctgtaacatctctagtggtgagatgcaaaagggtttgtgggagcagtgtcaactgcttaagtctacatccgtgttcgcacgatgccaccccctggttgatcccgagccatttgttgctttgtgtgagaagactctgtgcgagtgtgcaggtggattagaatgtgcctgtccagccctcttagagtatgctcgtacgtgcgcgcaggaggggatggtcttgtatggctggacggaccactcagcatgctctcccgtctgtccagccgggatggaatatcgtcagtgcgtcagcccctgcgcccgaacatgtcagtccctgcacatcaatgagatgtgtcaagagcgttgcgtagatggatgtagctgtccagaaggacagttactggatgaaggcctgtgcgtcgaatccaccgaatgtccatgtgtgcatagtggaaagaggtatcctccgggaacttccctgtcccgagactgtaatacatgcatatgtaggaattcacagtggatctgcagcaacgaggagtgtcccggtgaatgcctcgtgaccggccagtcccatttcaagtcctttgacaatcgctacttcacgttttccgggatctgccagtacctgctcgcccgcgactgtcaggaccatagttttagcatcgtgatagagaccgtccagtgcgctgacgaccgggacgctgtgtgcacccgatctgtcactgtgaggctgccaggcctgcacaatagcttagtgaagttgaagcatggcgctggcgtggctatggacgggcaggatgtgcagctgccgcttttgaaaggggacctgcgcatccagcacaccgtgacagcctcagtacggctttcgtatggagaagacttacagatggactgggatgggcgagggcgcctacttgtgaagctcagtcccgtgtatgcaggaaaaacatgcgggctgtgtggcaactacaatggaaatcaaggcgacgatttcctaactcccagcgggctggccgaacctagagtggaggatttcggaaacgcgtggaagctgcacggagattgccaagatctgcagaagcagcatagtgacccttgtgccctgaatcctcggatgacacggttttctgaagaggcatgcgccgtactgacctctccaaccttcgaggcatgccatcgagctgtatcacccctgccctacctcaggaactgccggtacgacgtgtgttcttgcagcgacgggcgcgagtgtctctgtggagcgctagccagctatgcagcagcctgtgctggcagaggtgtgcgagtggcgtggcgggaacctggcaggtgtgagctgaattgccctaaagggcaagtataccttcagtgtggtacgccttgcaacctgacttgcaggtccctgagttacccagacgaggagtgcaacgaggcctgcttggagggatgcttctgcccacccggattgtacatggatgagagaggcgattgtgtgcccaaggctcagtgcccatgctattatgatggggagatttttcagccagaggatatattctctgatcatcacaccatgtgctattgtgaagacggattcatgcattgtacaatgagtggggtgccagggtccctactgcccgatgccgtgctgagcagcccactttctcatcggtctaagcggtcactgagctgtcggcctcctatggttaagctggtgtgccccgccgacaatctgagggcagaagggctggaatgtaccaaaacctgccagaactatgacctcgagtgcatgagcatgggctgtgtgtctgggtgtctctgcccaccggggatggtgcgccacgagaatagatgtgtcgccttggagcgctgtccttgcttccatcagggtaaagagtacgccccaggtgagaccgtgaagatcggatgtaatacatgcgtgtgccaggacaggaagtggaactgtaccgaccacgtctgcgacgccacttgctctactataggtatggcccactacctgacgttcgacgggcttaaatacctgttccccggagaatgtcaatacgttctggtgcaagactactgtggatctaatcccgggacgttccggattctggtgggaaataagggttgtagtcaccctagcgtgaagtgcaaaaaacgcgtgaccatacttgtggaggggggcgagatcgaactctttgacggcgaggtgaacgtcaaaaggcctatgaaagatgagactcactttgaggtggttgagagtggccggtacattatcctccttctgggcaaggccttgtccgttgtgtgggatcgacatttgtctatttctgttgtcctgaagcagacctaccaggagaaagtctgcggattgtgcgggaatttcgacgggattcagaataacgacctgacatctagcaatctgcaggtggaggaagacccggtcgacttcggtaattcttggaaagtgagttcccagtgtgctgacaccagaaaagtacccctcgattcatcccctgccacctgccacaacaacatcatgaaacagacgatggtagattcaagctgcaggattctcacgtccgatgttttccaggattgcaacaagctggtggacccagaaccatacctggatgtgtgcatatacgatacttgtagctgcgaatcaattggagattgcgcttgcttctgtgataccatcgccgcgtacgctcatgtgtgtgctcagcacggcaaggtggtcacatggagaacagccacgctttgcccccagtcttgcgaggagaggaacctgcgcgagaatggctacgagtgtgagtggagatataactcgtgtgctccagcttgccaggtgacgtgccagcatccagagccactggcatgtcccgtgcagtgcgtggaaggatgccacgcacattgtcctcccgggaaaattttggatgagctcctgcagacttgcgttgaccccgaagactgcccggtgtgtgaggttgctggccgcagattcgcgagtgggaaaaaggtgactttgaacccctccgacccggagcactgccagatctgtcactgcgacgttgtgaaccttacctgcgaggcgtgccaggaaccaggcgggctggtcgtcccccctaccgatgccccagtgtcacctaccactctctacgtggaagacatctccgagccccctctgcatgacttttactgtagccgactcctcgacctcgtctttctgctcgatggctcctcgcgactgagtgaggccgagtttgaggtgctgaaagctttcgtggtggacatgatggagcgactacgaatctctcagaagtgggttagggtggccgtcgtggagtatcacgatggctcgcacgcgtacataggcctgaaggacagaaaacgaccatctgaactgcgcaggatcgcctctcaggtcaaatatgctgggtcccaggtcgcctctacaagcgaggtccttaaatacacactttttcaaatattttccaagatagatcgtccagaagcctccaggatcaccctgctgctgatggctagtcaagaaccccagcgaatgtcaaggaacttcgtgaggtacgtgcagggattgaagaaaaagaaggtgatcgtgattccggtcgggatcggccctcatgctaatctgaagcagattcgcttgatcgaaaagcaagcgccagagaacaaggcttttgtgctgagtagcgtggacgagctagagcagcagagggatgagattgtgagctatttgtgcgatctggccccagaagcccctccacctactctgccccctgacatggcacaggtcacagtgggaccggggttgctcggagtgagcaccctgggccccaaaaggaacagcatggtgctcgacgtcgcctttgtgctggaagggtccgataagatcggagaagccgattttaacagatccaaggaatttatggaggaggtgatccagcgcatggatgtgggccaggacagcattcatgtgactgtgctgcaatacagctacatggtgacagtggagtatccttttagcgaggctcagtctaagggcgacatcttgcagcgcgtcagggaaatccggtaccaagggggaaaccgcaccaacacagggctggccctgcgctacctgtcggatcactcatttttggtgagccagggtgaccgggagcaagccccgaacctcgtatacatggtcactggcaacccggccagtgacgaaattaaacggcttcctggagatatccaggtggtgccaattggcgtcgggccaaacgcgaatgtgcaggagcttgagcggatcggatggccgaacgcccctattctgattcaggatttcgagacactgccccgtgaagcacctgatttagtgctgcaacggtgttgctctggagaaggtctccagattcctacattgtcacccgctcctgattgctcgcaacccctcgatgttatccttctcctcgatggcagcagttctttccccgccagctattttgacgagatgaagagttttgccaaggctttcatctccaaggcaaacattgggccaagattgactcaggtttccgtattgcaatatggctcgatcacaacgatcgacgtgccctggaacgtggtccctgagaaagcgcatctcctgagcctcgtagatgtcatgcagcgtgaaggagggccatcccaaattggggatgccctgggattcgccgtccgctacttgaccagcgagatgcacggagcccgccctggtgcaagcaaggctgtggtgatcctggtgaccgacgttagtgttgattccgttgatgcagccgccgacgcggcaagaagcaatagggtgaccgtgtttcccattggaattggggacaggtatgacgccgcccagctgcgcattttagccgggcctgcaggagactcaaatgtggtgaaactgcaaaggatcgaagacttgcccacaatggtgaccttgggaaattctttcctccataagctgtgctcgggcttcgtaaggatctgtatggatgaagacgggaacgaaaaacgccctggagatgtctggacccttccagaccagtgccataccgtaacatgtcaacctgacgggcagaccctgctgaaatcacatcgagtaaactgtgacagaggcctgagaccctcgtgccctaacagccagtctcccgttaaagtggaggagacctgtggatgtaggtggacctgtccctgcgtctgtacaggaagcagcaccaggcatatagttacatttgacgggcaaaactttaagttgactggatcgtgttcctacgtcctgttccaaaacaaagaacaggacctcgaagtgatactccacaatggagcttgttctcccggggctagacaaggctgcatgaaatcaatcgaagtaaagcatagcgctctgagcgtggagctgcatagcgatatggaagtcaccgtgaatggccgcttggttagcgttccctacgtaggtgggaacatggaggtgaacgtgtacggggccataatgcacgaagtccgctttaatcatttgggccacatctttactttcactccccaaaacaatgagttccagctccaactgtctcctaagacctttgcatccaagacttatggcctttgcggtatctgtgacgagaatggcgcgaacgatttcatgcttcgcgacgggacagtcaccacagactggaagaccttggttcaagagtggactgtgcagagacccggtcagacatgccagccaatcctagaagaacagtgcctggtgcccgattctagtcattgccaggttctgcttctgcctttgttcgccgaatgtcacaaggtgttagctccggcaactttttacgctatctgtcagcaggattcgtgccaccaagagcaggtgtgcgaggttatcgcctcctacgcccatttatgtcgtaccaacggcgtctgtgtggattggcgcacacccgacttctgcgcaatgagctgccccccaagtctggtgtataaccattgcgaacatgggtgtcccaggcactgtgatgggaacgtgtccagctgtggcgatcacccctccgaggggtgtttctgccctcccgacaaggtcatgctggagggatcttgtgtcccggaggaggcttgcacccaatgcatcggcgaggatggggtacaacaccagttcctcgaagcatgggtgccggaccaccaaccctgtcagatctgtacttgcctatctgggcgaaaggtaaattgtactacccagccctgccctacggcgaaggcgcccacttgtggcctgtgtgaagttgccaggctacgacagaacgctgatcagtgctgccccgagtatgagtgcgtgtgtgaccctgtttcctgcgacctcccccctgtgccccactgtgagaggggcctccagccaacgttgacaaatcctggcgaatgtcgccctaatttcacgtgcgcctgcagaaaggaagagtgcaaacgagtgagccctccctcctgccctcctcaccgattgcctacactaaggaaaactcaatgctgtgatgaatacgagtgcgcctgcaactgcgtgaatagtaccgtgtcctgccccctgggctaccttgcgtctaccgctacaaacgactgcggctgtacgacaactacctgcctgcccgacaaggtgtgtgtgcaccggtctactatctatccagtaggtcagttttgggaagaaggatgtgatgtttgcacctgtactgacatggaggacgccgtgatggggcttagggttgcccagtgctcccaaaaaccttgtgaggattcatgtcgcagcgggttcacctatgtgctgcacgagggggagtgttgcgggcggtgtctcccgtccgcatgtgaagtggtaaccggttcgcccagaggcgactcgcagtcatcatggaagtcagtcgggagccaatgggcaagtcctgagaacccgtgccttatcaacgaatgcgtgagggtgaaagaggaggtatttattcaacagagaaacgtgagctgcccacagcttgaggtgccggtttgcccctccggctttcagctgagctgcaaaaccagcgcctgctgtccttcatgccggtgcgagagaatggaagcctgcatgctcaatggcaccgtgatcggtcctgggaagaccgtgatgatcgacgtttgcacgacttgccgctgcatggtgcaggtcggcgttatttcgggctttaagctggagtgccgtaaaacaacatgcaatccctgcccccttggatataaagaagagaataacactggcgagtgctgcggtcggtgcctgccgacagcctgtactattcagcttagaggcggccaaataatgaccctgaaaagagacgaaacacttcaagatggttgcgacacccacttttgtaaagtgaacgagagaggggaatatttttgggaaaaacgagtgaccggttgtcccccgtttgatgagcacaagtgcctggctgagggcggcaagatcatgaagattccaggaacatgttgcgacacttgtgaggaaccggagtgcaacgacatcaccgcccgtctccagtatgtcaaagtgggctcgtgtaagtcagaggtcgaggtcgacattcactactgccaggggaaatgtgccagtaaagccatgtattctatcgatatcaacgacgtgcaggatcagtgctcatgttgttctcccactaggaccgagcccatgcaggtggctcttcactgcacgaacggtagcgtcgtttatcatgaggtactcaatgcaatggaatgcaagtgtagtccacggaaatgctcgaaa

SEQ ID NO: 21352 - DNA, 8439 bp, Artificial Sequence
  Description of Artificial Sequence: Synthetic coding sequence
atgattccagccaggttcgctggcgttctcctggctctcgctctgattcttccaggtactctgtgtgccgagggtaccagaggtaggagcagcacagcacgctgttcactcttcggtagcgacttcgttaacacattcgatggctcaatgtattcctttgctggatactgctcctatctgctggccggtggttgtcagaagagaagcttttccatcatcggcgatttccagaacggcaagagagtgtccttgtctgtctacttgggtgagtttttcgatatccacctgtttgtgaacggtacagtcacccaaggagatcagagagtatccatgccttacgccagcaagggcttgtatttggagactgaagctggatattacaagctgtctggcgaggcctacggttttgtagcacgcatcgatggctcaggtaacttccaagtgctgctgagcgatagatatttcaacaaaacatgcggcctctgcggaaacttcaatattttcgccgaagacgacttcatgactcaggagggcaccctgaccagcgatccctacgacttcgctaacagttgggccctgtccagtggcgagcaatggtgcgagagagctagcccacccagtagttcctgtaatataagcagcggagagatgcagaagggcctctgggaacaatgccagctgttgaagagcacttctgtcttcgccagatgtcatcctctggttgacccagaaccatttgtcgccctctgcgagaaaacactttgcgaatgcgccggcggcctcgagtgcgcttgccctgccctcctcgagtacgcaaggacctgtgcacaagagggtatggtgctgtatggctggaccgatcatagcgcttgttcccccgtgtgccccgcaggtatggagtaccgccaatgcgtcagtccatgcgcaagaacatgtcaatccctgcacattaacgagatgtgccaggaaagatgtgtggacggatgttcatgcccagaaggtcagctcctggacgaaggtctctgtgtcgaatccactgaatgtccttgcgtgcattctggcaaaaggtatccccccggtaccagcctgtctagagactgtaacacttgtatatgtcgtaactcacaatggatttgctccaacgaagagtgccccggcgagtgccttgtaacaggtcagtctcacttcaagtccttcgataacaggtacttcacattttctggcatttgtcaatacctccttgccagggattgccaggatcactctttttcaatcgtgatcgagactgtacagtgtgctgacgacagagacgcagtctgtactaggtcagttactgttcgtctccccggccttcataacagcttggttaagctcaagcatggagcaggtgtggccatggacggtcaagacgttcagcttcccttgctgaagggagacttgagaatccagcataccgttaccgcaagcgtaaggctgtcttacggcgaggaccttcagatggattgggacggaagaggccgtctgctcgtgaagctctctcccgtctatgctggaaagacatgcggactctgcggaaactataacggaaatcaaggcgacgattttctgacaccaagtggattggccgagccccgtgtcgaggactttggcaacgcctggaagctgcacggtgactgccaggatctgcaaaagcaacatagcgacccctgtgctctcaatcccaggatgacccgttttagcgaggaagcctgtgctgtcctcacaagcccaaccttcgaagcctgccaccgcgctgtgtccccccttccctatctcaggaattgtagatacgatgtttgtagttgttccgacggtcgtgagtgcctctgcggcgccctcgcttcttacgccgccgcatgcgccggtaggggcgtgcgcgtggcctggagagagcccggcagatgtgagttgaactgccccaaaggacaggtctaccttcaatgcggcaccccatgcaacttgacatgccgtagtctttcataccctgatgaagaatgtaacgaggcatgtcttgagggatgcttttgccctcccggactgtacatggacgagcgtggcgactgcgttcccaaggcccagtgcccatgctattatgatggagagatcttccaacctgaagacattttcagtgaccaccataccatgtgctactgtgaagacggtttcatgcactgcaccatgagcggtgtgccaggatcccttctccccgacgccgtgcttagcagcccattgtcccacagatctaagagatcactgagttgtaggccaccaatggtgaaactggtttgccccgctgacaacctgcgtgctgaaggcctggagtgcactaaaacttgccagaattacgacctggagtgtatgagtatgggctgtgtatccggatgcctctgtcctccaggcatggttaggcacgagaaccgctgcgtcgccctggaacgttgcccctgtttccatcagggcaaggagtacgcacctggagaaaccgttaagatcggatgcaatacttgcgtatgccaagaccgtaaatggaattgtactgatcacgtatgtgatgcaacatgctccacaatcggaatggcccactaccttaccttcgatggactgaagtacctgtttcccggcgagtgtcaatatgtactggtacaggattactgtggatctaaccctggaacattcagaatcttggtgggtaacaagggctgcagtcaccctagcgtcaagtgtaagaagcgcgtcactatcctggtggagggaggcgagatcgaactgtttgacggtgaggtcaatgtgaaaaggcctatgaaggacgagacccatttcgaggtcgtggagtccggaaggtacatcatcctgttgctcggtaaggctttgtccgtcgtatgggacaggcatttgagtatctcagttgtcctgaaacaaacttatcaggagaaggtctgtggcttgtgcggaaattttgatggcatccaaaacaatgaccttacttcttcaaaccttcaagtggaagaggacccagtggatttcggcaactcctggaaagtgagcagccaatgtgctgatacccgcaaggtcccattggacagctctcccgctacatgccataacaacatcatgaagcagactatggtcgactcatcttgccgcatcctgacatccgacgtgtttcaggattgcaataagctggttgatcctgaaccttacctggatgtatgcatttatgatacatgctcttgcgaatccatcggagattgcgcctgcttctgcgacaccatcgctgcctacgctcacgtgtgtgcacaacacggtaaggtggtgacctggaggacagccacactttgtccacaaagctgtgaagagcgcaaccttcgcgaaaatggctacgaatgcgagtggcgttacaactcctgcgctcccgcttgtcaggtgacttgccagcatccagaacctcttgcctgtcctgtgcagtgtgtcgagggttgccacgcacattgtccaccaggtaagatcctggatgagctgctccagacttgtgtggaccctgaggactgtcctgtgtgtgaggtggcaggtaggagattcgcaagtggcaagaaggtgaccttgaaccccagcgatcccgagcactgtcagatatgtcattgcgatgtggtcaacttgacatgcgaagcctgtcaggaacccggcggccttgtcgttccacccaccgacgctcctgtttcccctacaactttgtatgtggaagatatttcagagccacccttgcacgacttttattgctcacgtctccttgacctcgtgttcctccttgatggctcttccagactgtctgaggctgagttcgaggtgctgaaagccttcgtggtggacatgatggagaggctcaggatttctcagaagtgggtgcgtgtggctgtggtggaataccatgatggctcacacgcctacatcggactgaaagacaggaaacgcccatctgagctgcgcaggatagcttcccaggtgaagtacgctggatcccaggttgcaagcacctctgaggtgttgaagtataccctgtttcagatctttagtaaaatcgatcgtccagaggctagtcgtatcaccctgctcctgatggcatctcaggaacctcaaagaatgagccgcaacttcgttcgctacgtacagggcctgaagaagaagaaggttattgtgatcccagttggcatcggcccacacgccaacttgaaacagatacgtctgatcgagaagcaagctccagagaacaaggcattcgtcctgtctagcgttgatgaactggagcagcagcgtgatgaaattgtatcttacctttgcgacttggccccagaagcacctccccctaccctgcctcctgacatggctcaagtgacagtgggaccaggactgctgggtgtttcaaccttgggtcccaagagaaattctatggtgctcgacgtagccttcgtgctcgagggctcagacaagatcggcgaagctgacttcaatagaagtaaggagttcatggaggaggttatccagcgcatggatgttggccaagatagcatccacgtgaccgtgctgcagtattcctacatggtcacagtggagtacccattctccgaggcccaatccaagggcgacattctgcagcgcgtccgtgagatcagataccagggaggcaatagaacaaacaccggcctcgctctgcgctacctgtctgaccacagcttcctggtgagccagggagacagggaacaggcccctaacctcgtttacatggtaactggcaacccagcctccgatgaaatcaagcgtctccctggtgacatacaagtcgttccaattggagtgggacccaacgctaacgtgcaagagctggagaggatcggttggcccaacgcccctattctgatccaggattttgagacattgcctagagaggccccagatttggtcctccagcgttgctgttctggagaaggtctgcagatacccactttgtcacctgctcctgactgttctcaaccattggatgtgatcttgctgttggacggatccagctccttcccagcatcatactttgacgaaatgaagagtttcgcaaaagccttcatttccaaggccaatatcggcccccgtctcacacaggtctcagtgctgcagtacggcagcattaccacaatcgacgtgccatggaatgttgtgccagaaaaggcccatttgctttccctcgtcgatgtaatgcaaagggagggaggaccctcccagatcggcgatgccctcggcttcgccgtgaggtacctgacttcagaaatgcatggagctagacctggtgcatctaaggctgtcgttatccttgtcaccgacgtttctgttgattcagttgacgctgccgccgacgccgcacgtagcaacagagttactgtgttcccaatcggcattggcgatcgttatgacgccgcacagctgcgcatcctggctggtcctgctggcgattctaacgtcgtgaagttgcaacgtattgaggatctgccaactatggtcacactgggtaacagttttctgcataagctttgtagcggatttgtccgtatatgtatggatgaggatggtaacgaaaagagaccaggagatgtgtggactctgcccgaccagtgtcataccgttacttgtcagcccgatggccagactctgttgaagtcacaccgtgtgaactgcgacagaggtttgagaccatcctgccccaactctcagtctcctgtgaaggttgaggagacatgcggatgcaggtggacctgcccctgcgtctgcacaggttcaagtacacgtcacatcgtgacttttgacggtcagaatttcaaactcaccggcagctgcagttatgtcctctttcagaacaaggaacaagatcttgaagtaatcctgcataacggcgcctgctctcccggtgctcgtcagggttgcatgaagtccattgaggtcaaacatagcgccttgtctgtggagttgcactccgatatggaagtaacagtgaacggccgcctcgtctccgtgccctacgtaggcggtaatatggaggtgaacgtctatggtgctatcatgcatgaggttagatttaaccacctgggccacattttcaccttcacaccccaaaacaacgaatttcaactccagctgtcccccaagactttcgctagcaagacctacggattgtgcggaatatgcgatgagaatggtgctaatgacttcatgttgcgcgacggcactgtcacaactgactggaagacactggtgcaagagtggaccgtgcagcgcccaggtcaaacctgtcagcctattcttgaagagcagtgcctggttcccgattccagtcactgccaggtgttgctgttgcctctcttcgctgaatgccacaaggtgttggccccagccactttctacgccatctgtcaacaggacagctgtcatcaggagcaggtgtgcgaagtaattgcttcatacgctcatctctgcaggacaaacggtgtctgtgtggattggaggactcccgacttctgcgctatgtcctgccctcccagtctggtttataaccattgcgagcacggatgcccccgccactgtgatggtaacgtaagtagttgcggcgaccacccaagtgaaggttgcttctgcccacccgacaaggtgatgcttgaaggatcctgtgtccctgaagaagcctgcacacagtgtattggtgaagatggagtgcagcaccagttccttgaggcttgggtgcctgatcaccagccatgccagatctgtacctgcctctccggccgcaaggttaactgtacaactcaaccttgtcctactgcaaaagctcccacatgcggcctgtgcgaagttgctaggctgaggcagaacgccgaccagtgctgccctgaatacgagtgcgtgtgcgaccctgtctcctgcgatctgccacctgtgccccattgcgagcgcggcttgcagcctacactcaccaatccaggtgagtgcagaccaaacttcacttgcgcctgtcgtaaggaggagtgcaagagagtgtcacctcccagctgcccacctcaccgtttgcctaccttgagaaaaactcagtgttgtgacgagtatgaatgtgcctgcaactgcgtgaacagcaccgtttcctgccctctgggttacctcgcatccaccgctaccaacgattgtggctgtaccaccaccacctgtctccccgataaggtgtgcgttcataggagtactatctaccctgtgggacaattctgggaggagggctgtgatgtgtgcacatgcacagatatggaggatgcagtgatgggactgcgcgtggcacaatgttcccaaaagccttgtgaggactcttgcaggtccggtttcacctacgttctgcacgagggcgagtgttgtggacgctgccttcccagcgcatgcgaggtcgtgaccggcagtcccagaggagactctcagtcatcatggaagtcagtgggcagccagtgggctagtcctgaaaacccttgcttgattaacgagtgcgtgcgcgtcaaggaggaggttttcattcagcaacgtaatgttagttgtcctcaacttgaggtacctgtttgtccaagtggtttccagttgagttgcaagaccagcgcctgctgcccttcttgcagatgcgaaaggatggaggcatgtatgctcaatggaaccgtaatcggaccaggtaagactgtgatgatcgacgtgtgcactacttgtaggtgcatggtacaagtgggagtcatcagcggtttcaagctggaatgcaggaagacaacctgcaatccatgtccattgggttacaaggaggagaacaacaccggtgagtgctgtggaagatgtttgcccaccgcctgcactatacagctgcgtggaggtcaaattatgacactgaagagggatgaaactttgcaagatggctgtgacacacacttctgcaaggtgaacgagcgcggagaatatttctgggaaaaacgtgtgaccggatgccctcctttcgacgagcacaaatgccttgctgagggcggtaagatcatgaagattcctggaacctgttgtgacacctgcgaggaaccagaatgcaatgacattacagcacgcctccagtatgtcaaagtcggcagctgcaagtctgaagtggaagtggatattcactactgccagggcaagtgtgcttctaaggcaatgtactctatcgatatcaatgacgtccaggatcagtgttcatgttgcagccctacaaggacagagccaatgcaggtcgcactgcactgcactaacggcagcgtagtataccatgaagtactcaatgctatggagtgcaaatgttcccctcgtaaatgttccaag

SEQ ID NO: 21353 - DNA, 8439 bp, Artificial Sequence
  Description of Artificial Sequence: Synthetic coding sequence
atgatccctgccagatttgccggcgtcttactggccctggctttgattctccctggaactctgtgcgcagagggcacccgggggaggtcttcaacagcaaggtgttctttgtttggctctgacttcgtgaataccttcgacgggtccatgtatagcttcgctggctattgctcctacctcttagccggtggttgccagaagaggagtttcagtattatcggggacttccagaacggcaaacgcgtgtcactaagtgtgtatctaggcgagtttttcgacatccatctgttcgtgaatgggactgttacacagggtgatcagcgtgtctctatgccatacgcatctaaggggctgtacttagagacagaggccggttactataaactgtctggtgaggcatatggcttcgttgcccggatcgatggctcaggtaattttcaagtccttttgagcgatcggtacttcaataagacatgcggactatgcggaaacttcaatatatttgcagaggacgactttatgactcaagagggtactctgacttctgatccctacgacttcgcaaactcatgggccctatcctctggggaacaatggtgcgagcgagccagtccacccagttctagctgtaacatctcaagtggcgagatgcagaaggggctgtgggagcagtgtcaactgctgaagagtacaagtgtctttgcccgctgtcatcccctagtggacccagagccatttgtggccctgtgtgagaaaaccttgtgcgaatgcgctggcggtctggaatgcgcctgtcccgccctgctcgaatatgctaggacctgcgcccaggagggaatggtgctgtacgggtggaccgatcacagtgcctgctctcccgtctgcccagccgggatggaataccgccaatgcgtgtccccctgtgctagaacatgccagtctctgcacatcaatgaaatgtgtcaggagcggtgcgtcgatggctgcagttgtcccgagggacaactcctggacgagggactatgtgtcgagagtaccgaatgcccatgtgtccactctggcaaaaggtacccacctggcactagtctgagccgcgactgtaatacctgcatttgcaggaactcccagtggatatgtagtaacgaggaatgtcctggcgaatgtcttgtgacaggacagagtcacttcaaatcttttgacaataggtacttcaccttttccggtatttgtcaataccttcttgcaagggattgccaggatcactctttttctatagtcatagagactgttcagtgcgcagacgacagagacgccgtctgcacaagatccgtaaccgtgagactacctggtctgcacaacagtctggtgaagctcaaacacggggcaggcgtggctatggacggacaggacgtccagctccctctcctgaagggtgacctgcgaatccagcacaccgtgactgcatcagtcaggctcagctacggtgaggatttgcagatggactgggatgggcggggccgacttctggttaaactttccccagtctatgctgggaagacatgtggactgtgcgggaactacaacggaaatcaaggcgatgacttcctgactccgtcaggccttgccgaacccagggtagaagattttggcaatgcatggaaacttcacggcgattgtcaggacctccagaagcagcacagtgatccctgcgccttaaacccaaggatgactcggttcagcgaagaagcatgcgccgttctgaccagtcccaccttcgaagcctgccatagagctgtttctccactaccctacctccgcaattgccgttatgatgtgtgtagttgtagtgacggccgggagtgcctttgtggcgccttagcctcttacgcagccgcctgtgccggccgaggcgtgagagtggcatggagagagccaggtagatgtgagcttaactgccccaaaggccaggtttacctgcagtgtgggactccatgtaatctaacctgtcggagcctgtcttatccagacgaagagtgtaatgaggcctgccttgaagggtgcttctgtcccccaggcctgtatatggatgaaagaggcgactgcgtcccaaaggcccaatgcccgtgttattatgatggggaaatcttccagccagaagacatatttagtgatcaccataccatgtgctattgcgaggacggcttcatgcactgcaccatgtcaggcgtccccggtagtctgctgccagatgccgtgctgagttccccactatctcaccgaagcaagcggtccctgtcttgtcggcctcccatggtgaagctggtatgtcccgctgataacctgcgagctgagggcctggagtgcaccaaaacatgtcagaattatgatctggagtgcatgtccatgggctgcgtgagtggctgtctgtgtccacccggcatggttcgacatgagaatcgctgcgtagctctggagcggtgcccgtgcttccaccaaggcaaggaatacgctccaggcgaaaccgtgaagattggatgcaacacatgcgtgtgtcaggatagaaaatggaattgtaccgatcacgtatgcgacgctacatgttctaccattgggatggcacattacctgacttttgatgggttgaaatacctgtttcccggggagtgccagtacgtcctcgtccaagactactgtggctctaatccaggtacctttcggatcctcgtggggaataaaggttgcagtcacccaagcgtcaagtgcaagaaacgcgtcacaattctggtagaaggcggagagatcgaactgttcgacggtgaggttaatgtgaaaaggccaatgaaagatgagacccacttcgaggttgtcgagagcggccgctacattatcctgctgctgggcaaggcactgagtgtggtctgggatcgacacctgagtatttccgttgtgctgaagcaaacatatcaagagaaagtgtgtgggctgtgtggtaattttgatgggatacagaataatgatttaacctccagtaatctacaggttgaagaagatccagtggacttcggcaatagttggaaagttagcagccaatgcgcagacaccaggaaagtcccactcgactcaagtcctgctacttgtcataataacatcatgaagcagacaatggttgattcttcttgccggatcctgacctctgacgttttccaggattgtaataaactcgtggacccagaaccctatctagatgtgtgcatttacgacacctgttcttgtgagtctattggcgattgcgcttgtttttgcgatactatagccgcttacgcccacgtgtgcgcacagcacggaaaggtggtgacttggcggactgctacactgtgtcctcagtcatgtgaggagcggaatttaagggaaaacggttatgaatgtgagtggcggtacaacagctgcgccccagcctgtcaagttacttgccagcacccagaacctctggcctgtccagttcaatgtgtggagggttgtcatgcacactgccctcccggcaagatcttggatgagctgctgcagacatgtgtcgaccctgaagattgtcccgtgtgcgaggtcgccggaaggcgttttgccagcggcaaaaaggtgaccttaaatccatccgacccagagcattgtcagatttgccactgtgatgttgttaacctgacttgtgaggcatgccaggagcccggcggcctggtcgtgccacctaccgacgctcctgttagtccaactacactgtacgtggaagacattagcgaaccacccctgcacgacttctactgcagccgtctgctggatctggttttcctgctggatggctccagcagactcagcgaggccgaatttgaggtcttgaaggcttttgtagttgatatgatggagaggctgcgtatttcacaaaagtgggtgcgcgtggcagtcgtcgagtaccacgatggcagccacgcatacatcggcctgaaggatagaaaacggccttctgagctgcgccggattgctagtcaagtgaagtacgctggctctcaggtggcttcaacctccgaggtgctgaagtacactctgtttcagatcttttccaagatcgatagaccagaggctagtagaataacactgttactaatggcctctcaggagccccaacgaatgagtcggaactttgtgcgatacgtccagggcctgaagaagaagaaagttattgtgatacccgttggaatcggcccacacgctaacctaaagcaaataagactgattgaaaagcaggctccagagaataaagcctttgttctctcaagtgtggacgagctggaacaacagcgcgacgagatagtgtcttacctgtgcgacctggccccagaagctccccccccaaccctccctcctgatatggctcaggttacagtggggcctggcctgctaggcgtcagcacactaggtcctaagcggaattcaatggttctggacgttgcctttgtcctggagggctccgacaaaattggagaagcagattttaacaggtctaaggagtttatggaggaggttatccagagaatggacgtggggcaggactctattcatgttaccgttctacaatattcttatatggttactgtggagtatccatttagcgaggctcagtccaagggggatatactgcagcgggtcagagagattaggtaccaggggggtaacagaactaacaccggcctggcactccgatacctgagtgaccactccttcttggtgagtcaaggtgaccgcgagcaggccccgaatctagtgtacatggtgacaggaaatccagctagcgacgaaattaaacggctacccggcgatatccaggtcgttccaatcggggtgggtcccaacgctaacgtccaggagttagaacggattgggtggcctaacgctcccattctaatccaggacttcgagactctgcctcgggaggccccggatctagtgttacagcgctgctgctctggagagggcctgcagatccccacactgtcaccagccccagactgctctcagcccctggatgtgatcctgctgctggatggcagttcctcctttccagccagctattttgacgagatgaaatccttcgctaaagcttttattagcaaggctaacatcggaccccgtctaacccaagtgtctgtcctgcaatacggaagcataaccactatagacgtgccttggaacgtcgttccagagaaggcccatctgctgagcctagtcgatgttatgcagcgcgagggaggcccaagccagataggagacgccttgggtttcgccgtcagatacctgaccagcgaaatgcacggggcccgtcccggagcctccaaagctgttgtgatccttgtaacagatgtctctgttgactcagtggacgccgccgccgacgccgctaggagcaatcgcgtcaccgtgtttccaatcggcataggcgatcgctacgatgccgcccagctgcgcattctggccgggcctgccggcgattccaacgtggttaagctgcaacggattgaggacctgcccaccatggtgaccctggggaattcattcctgcacaagctgtgcagtggttttgttaggatttgcatggacgaggacggcaacgagaaacggcccggggacgtctggaccctgcctgaccagtgccataccgttacctgccagcctgatggacagaccctgttgaagagtcatcgcgttaattgcgatagaggactgcgacctagctgccctaattcacagagccctgttaaggtggaagagacttgcgggtgcaggtggacttgcccctgtgtttgcacaggctccagcacacgccacattgtaactttcgatggtcagaattttaaactaaccggaagctgtagctacgtactgtttcagaataaggagcaggatctggaggtgatactgcataacggggcttgctcccctggagcacgccaaggatgtatgaaaagcattgaggtgaaacatagcgctctgagcgtggagttacattctgacatggaggtgaccgtcaacggaaggttggttagcgtgccctatgtgggcggcaatatggaagttaatgtttacggcgccattatgcacgaggtcagattcaatcacctggggcacatatttactttcactcctcagaacaacgaattccagctccagctatcccctaagaccttcgcctccaagacctacggcctgtgtgggatatgcgatgagaatggagccaatgacttcatgctgcgggatgggacagtgactaccgactggaaaacactcgtccaagagtggaccgtgcagcgacctggacagacctgccagcctatactagaggaacagtgcctagtccccgattcatctcactgtcaggtcctactcctccctctgttcgccgaatgccataaagttctcgcacccgcaacattttatgccatttgtcagcaagacagctgtcaccaggagcaggtctgcgaagtcatcgcctcttatgctcacctgtgtagaactaatggtgtttgtgtcgactggaggacacccgatttttgtgccatgagttgccccccaagcctggtttacaaccactgcgagcacggttgtccccgtcactgtgacggcaatgtatcttcctgcggcgaccatccatctgaaggatgcttttgccccccagacaaagtcatgctagaaggtagttgcgtacctgaggaggcttgcactcagtgtataggcgaggacggcgtccagcaccagttcctggaggcatgggtgcccgaccaccagccatgtcagatctgtacctgcctctccggaaggaaggtgaactgcactacccagccatgtccaactgcaaaagcccccacttgtgggctttgcgaggtcgctcgactgaggcaaaacgccgaccaatgctgccccgagtatgagtgtgtgtgcgacccagtctcctgtgatcttcctcccgtaccacactgcgagcgaggtctacaaccaacactcaccaatcctggggagtgccgccccaacttcacctgtgcttgcagaaaggaggaatgtaagagggtgagtccaccttcctgtccaccacacaggctgccaaccctgcggaagacacagtgttgcgacgagtacgagtgcgcctgcaactgtgttaattctaccgttagctgtccactagggtacctcgcttccaccgccactaacgattgcggctgcactactaccacatgcctccccgataaagtgtgcgtgcacaggagcactatctacccagtcggccaattctgggaggagggctgtgacgtgtgcacatgtaccgacatggaggatgccgtgatgggtctccgtgtcgcacaatgttcccagaagccttgtgaagactcttgccgcagcggcttcacctatgtgctacacgagggcgagtgttgtggccgttgtttgcccagcgcctgcgaggttgtgaccggcagtccacggggggattcacagagcagctggaaatcagttggctctcagtgggctagtcccgaaaacccctgtctgatcaacgagtgtgttcgggtgaaagaggaagtgtttattcagcagcggaacgtgtcctgcccacagctggaagttccagtgtgcccctcagggtttcaactgtcctgtaaaacctccgcatgctgtccatcctgccgctgcgagcgtatggaggcttgcatgctgaacggtactgtcattggccccgggaaaacagtgatgatcgacgtgtgcaccacctgcaggtgtatggttcaggtgggagtcatatccggattcaagctagagtgccggaaaactacctgtaacccttgtcctctcggttataaggaggagaacaatactggcgaatgttgtggccgttgtctccctacagcctgcacaatacagttaaggggcggccagataatgacactcaagcgcgacgaaacactgcaagatggctgcgatacccacttctgcaaagtgaatgagagaggggagtatttttgggaaaaaagagttactgggtgcccacctttcgacgaacataagtgcttagctgagggcggcaagatcatgaaaatccccggcacctgctgtgatacatgcgaggagcctgagtgcaatgatatcacagcacgactgcaatacgtgaaggtggggagttgtaagagcgaggtggaagtggacattcattattgccaggggaagtgcgctagtaaggccatgtactccatcgatatcaacgatgtgcaggaccagtgcagctgctgttcccctacacgtaccgaacctatgcaggtcgctctgcactgcaccaacggctcagtcgtttaccatgaagtcctgaacgccatggaatgcaagtgctctccccgaaagtgcagtaag

SEQ ID NO: 21354 - DNA, 8439 bp, Artificial Sequence
  Description of Artificial Sequence: Synthetic coding sequence
atgataccagccaggtttgctggcgttttattggcactggccctgatactccctggaaccctctgtgcagaaggaacgcgcgggaggagctcgaccgcgaggtgttccctattcggatccgatttcgtcaatacctttgacggcagtatgtactccttcgccgggtactgctcttacctcctcgctgggggttgtcagaaaagaagtttcagcatcattggcgactttcaaaatggcaaacgagtcagtctcagcgtctatctgggagagttcttcgacatacacctctttgtcaatggtacagttacacagggtgaccaacgagtgagcatgccatatgctagtaaaggtctatacctggaaaccgaggccggttactacaaactgagcggcgaagcttacgggttcgtggcccgtattgatgggagtggaaattttcaggtactgctgagtgaccgctatttcaataaaacttgtgggctctgtggcaactttaatatttttgccgaagacgacttcatgactcaggaaggcactctgacctcagacccatatgactttgccaattcttgggcccttagttctggcgaacagtggtgcgaacgggcaagccccccgagcagcagttgtaacatatcttcaggagagatgcagaaaggtctctgggagcagtgtcaattgttaaagtccacaagcgtgtttgccaggtgccatccactggtagatccagagcctttcgttgccctttgcgagaaaacgctgtgtgagtgcgccgggggcttggagtgtgcttgcccggcccttctcgaatacgctcgaacctgtgcacaggagggcatggtgctctacggctggaccgaccatagtgcctgtagccctgtgtgtcctgccggcatggagtacaggcagtgtgtgagtccatgcgcaaggacttgtcaatccctgcacataaatgagatgtgtcaggagaggtgcgtggacgggtgctcatgcccggaaggccagttactcgatgagggactgtgtgtggagtccactgaatgcccttgtgtgcattcaggcaagcgctatcctccaggcacatcgctttcgcgggattgtaatacttgcatctgtcgaaactctcagtggatttgctctaacgaggaatgtcctggggaatgccttgtgacaggccagagccattttaaaagttttgacaacaggtacttcaccttctctggcatttgccagtacctgctggctagggattgccaagaccattccttctcaatcgtgatcgagactgttcagtgcgcagatgatcgggatgctgtgtgcacgcgatctgtcacagtcagactacccgggctccataatagtctggtgaaactgaagcatggtgccggcgtcgccatggatggtcaagatgttcagttgccactccttaagggggaccttcgtatacagcacacagtgactgcctcagttcggttaagttatggcgaagacctgcagatggattgggatgggaggggtcggcttcttgttaagttgtctcccgtgtatgcaggcaaaacctgtggcctatgtggcaattataacggaaaccagggcgatgatttcctcactccctccggtctcgcagagccccgcgtcgaggactttggaaacgcttggaagctccatggcgattgccaggaccttcagaaacaacactctgatccctgtgctctgaaccccaggatgacacggttttccgaagaggcatgtgccgtcttgacatctcccacattcgaggcttgccacagggcggtatcacccctgccctacttgcggaactgccgatatgacgtttgttcttgctctgacggaagagaatgtctgtgcggcgctctggcaagttatgccgccgcttgtgcgggtaggggcgtgcgcgtagcttggagggagccaggtaggtgtgagctgaattgtccaaaaggtcaagtctatctccaatgcggcacgccctgcaatctgacgtgtaggtcactgtcgtatcccgacgaagaatgcaatgaggcttgtcttgaaggttgtttttgcccaccgggactgtacatggacgagcggggagattgcgtgcccaaagcccagtgcccatgctattatgacggggagatctttcagccagaggacatattctccgaccatcacaccatgtgttattgtgaagatggatttatgcactgtaccatgtccggagtgcccggatcattgctgcctgacgcagtgttatctagccctctcagtcaccgatccaagcgctcactttcatgtcggcccccaatggtgaaattggtttgcccggctgataacttgcgcgccgagggtctggaatgcactaaaacttgtcagaactacgaccttgaatgcatgagcatgggatgcgtgtcagggtgtctatgccccccgggcatggtcaggcacgaaaaccgttgtgtcgccctggaaaggtgcccttgcttccaccagggaaaggagtacgcaccaggggaaacagttaaaatcggctgcaatacatgcgtgtgccaggacagaaagtggaattgtacagatcacgtgtgcgatgcgacctgctccactatcggaatggctcattatctgactttcgatgggctcaagtatctgttccccggagaatgtcagtatgtgttggtacaggattactgcgggtctaatcctggtacatttcgcatactcgtgggcaacaagggatgctcgcacccttctgtcaagtgcaagaagcgcgtgacaattcttgtggagggcggagaaattgaactcttcgacggcgaagtcaatgtcaaacgcccaatgaaggatgagactcattttgaggtggtggaatcaggaagatatatcattctgctgctaggtaaggcgctgagcgtggtgtgggataggcacctcagcatcagcgtggtactcaaacagacatatcaggagaaggtctgcgggctctgtggaaattttgatgggattcagaataatgacttgacgagtagtaatctacaggtcgaagaagatcccgtcgatttcggcaattcctggaaggtctcgagccagtgcgccgacacccgcaaagtacccctggattcatctccagctacctgtcacaacaatattatgaagcagacaatggttgactcttcttgtaggattctgacatccgatgtcttccaggattgcaataagctggtggatcccgagccttacctcgacgtgtgcatttacgacacatgttcatgtgagtctataggggactgcgcttgtttctgtgataccattgcagcatacgcccacgtatgcgctcagcatggcaaagttgtaacatggaggactgcaaccctgtgtccccagtcatgtgaggagcgaaatctcagagagaatggctatgagtgtgagtggagatacaacagttgtgctccagcctgccaggtcacctgtcagcatccagaacccctggcttgccctgtacaatgcgttgaggggtgccatgcccactgtccgccaggtaaaatcctcgacgagctattacagacatgcgtagaccccgaggattgtcccgtttgcgaggtcgccggaaggaggttcgcctcagggaaaaaagtcaccttgaacccctccgatcccgaacactgtcaaatctgccactgtgatgtggtcaacctgacatgcgaagcttgtcaggagcctgggggactggtggtgccccctacagatgccccagtctctccaacaacactttacgtggaagacatatccgaaccccccctgcatgacttttactgttctcggctcctggacttggtgttcctcctggatggctcatccaggttgtccgaagctgaattcgaagtcctgaaggcatttgtggtggatatgatggagcggctgcgaatttcgcagaagtgggtcagggtggcggtggtggaatatcacgacggcagtcacgcgtatataggcctcaaagaccgcaagcgacctagcgaattgagacgaatagcctcgcaagtgaaatatgccgggtctcaagtggctagcactagcgaggttctgaaatataccttgttccaaatcttcagtaagattgatcgacctgaggctagccgtattacgctgctgctgatggcctctcaggaacctcagcggatgtctaggaatttcgtcaggtatgtgcagggcctaaagaaaaagaaagtgatcgttatccctgtaggtattgggccacacgccaacctgaagcagattcggttgatagaaaagcaggcgccagaaaacaaggccttcgtgctgtcctccgtcgacgagttggagcaacagcgagacgagatcgtctcctatctatgcgacttggcacccgaagctccacctcccactctgccgccagatatggcccaggttaccgtcggacctgggctcctaggggtgtctacactggggcccaagcgaaacagtatggtgctagatgtggcattcgtgctggaaggctctgataagatcggagaagctgatttcaataggtctaaagagttcatggaggaggtgatccaaagaatggatgtgggacaggactccatccacgttactgtgcttcagtactcatacatggtcactgtggagtacccatttagtgaggcgcagtcaaagggtgatatactgcagcgggtgcgagaaatcagataccagggaggaaaccgcaccaacactgggctggccctgagatacttgtccgaccactcatttctcgtgagtcagggggaccgcgaacaagcaccaaacctggtttatatggtgaccgggaatcctgcttccgacgaaataaagagattgcctggagatatccaagtggtcccgattggcgtaggccccaatgccaacgtgcaggaattggagcgtattggctggccaaatgcccccattctaattcaggactttgagacactgccccgtgaagcccccgatctggtactgcagaggtgttgctccggtgagggtctgcagatacccacacttagcccagcaccggactgctctcaacctctcgacgtgatacttctgctagacggatcctcctcatttcccgcctcctatttcgatgagatgaaaagttttgctaaggcattcatttctaaggccaacatcggtcccagactaacccaggtgtccgttctgcaatacgggtccattacaacaatcgatgtaccgtggaatgtagtgcccgaaaaagcccaccttctctcgctggtcgatgtcatgcagagggagggagggcctagtcagatcggcgacgctctcggatttgcagtccggtatttgacttcagagatgcatggagctaggcccggcgcttcaaaggccgttgtgatactggtgacagacgtgtcagtggattccgtggacgctgcagctgatgctgccagaagtaatcgagtaacagtgtttcctatagggatcggagatcgatatgatgccgcccagctgcgcatcctggcaggtccagccggggactcaaatgtcgtcaagcttcaacggattgaagacctacccacgatggtaaccttggggaattcatttctccacaaactctgcagtggtttcgtgcgcatctgtatggacgaagatggcaacgaaaagagacccggcgatgtgtggacgttgcctgatcagtgccatactgtaacatgtcagcctgacggccagacactcctaaaaagtcaccgtgtaaattgtgaccggggccttcggccttcctgtcctaacagccaatctcccgtgaaggtggaggagacttgtgggtgcaggtggacttgtccctgcgtgtgcactggatctagcaccagacacatcgtgaccttcgatgggcaaaatttcaagcttaccggcagctgtagctacgtcctgtttcagaataaggagcaggatctggaggtgatactccataacggcgcctgcagcccaggtgcaaggcagggttgcatgaagtcgatcgaggtgaagcacagcgcacttagcgtcgaattacacagcgatatggaagtgaccgttaacgggaggctggtgagcgtgccctatgtcggagggaatatggaggtgaatgtgtatggcgcaattatgcatgaggtacgttttaaccacctgggccacattttcaccttcactccgcagaacaatgaattccagttgcaactttcccctaaaacttttgcctctaagacttatggactgtgtgggatttgtgacgagaacggggcgaatgatttcatgttgcgcgacggcacagtgaccactgactggaagacactcgtgcaggagtggacagtccaacggccgggtcagacttgtcagcctatcctcgaggaacaatgtttggtccccgattcgtcccactgccaagtgctgctactgcccttgttcgctgagtgtcataaagtcctggctccagctaccttctatgccatctgtcagcaggacagttgccaccaagaacaggtgtgcgaggtcatcgcctcctacgcccatctctgccgtaccaatggggtatgtgtggattggcgaactccagacttctgcgctatgagttgcccgccaagtcttgtctataatcactgcgagcatggttgcccacggcactgtgatgggaacgtttcctcatgcggcgatcacccaagtgagggttgtttctgtccccctgataaggtaatgctggagggctcttgcgttccggaggaggcctgcacacagtgcatcggggaagacggagtgcagcaccagttcttggaggcctgggtgccagatcaccagccatgtcaaatctgcacttgtctgtccggtaggaaggtgaactgcacgacgcagccttgtcccactgccaaggctcctacttgcggcttgtgtgaggtggcacggctacgtcagaacgccgatcagtgttgccccgagtatgagtgtgtgtgtgatcctgtgtcatgcgatcttcctcctgttcctcactgcgagcgcggtctgcagcctactctcacgaaccccggcgaatgccgtccaaattttacctgcgcgtgtcggaaggaggaatgcaagcgagtctccccaccaagctgtccgcctcatagattgcccactctgaggaagacccaatgctgtgatgagtacgagtgcgcttgtaactgcgttaacagtaccgtgtcctgtcccctggggtatttggcctcaaccgctacaaacgactgtggctgcaccaccacaacctgcctacctgacaaggtgtgcgtgcatcggtctacaatctaccctgtcggtcagttctgggaagagggatgcgatgtttgcacttgcacagacatggaagatgcagtgatgggcctcagagtggcccagtgctcacagaaaccatgtgaagacagctgccgcagcggcttcacgtacgtgctgcacgagggagaatgttgcggacgttgcctgccatccgcctgtgaagtggtgaccgggtctcctcgcggtgactcacagagttcatggaagagtgtcgggtctcaatgggcctctcccgagaatccttgtctgattaatgagtgtgtcagagtaaaagaggaggtgtttatacaacagaggaacgtgagctgcccgcagctggaggtgccagtctgtccctctggatttcagctgtcatgtaaaacgtccgcctgttgcccatcttgccggtgtgagcgcatggaagcttgtatgcttaatggaacagtcatcggcccggggaaaactgtgatgatcgatgtctgtacgacctgcaggtgtatggtccaagtgggagtcatttccggattcaagctcgaatgccggaaaaccacctgcaatccatgtccactgggctacaaggaagaaaataacaccggtgagtgctgcggacgttgcctgcctacggcatgtacgatccaactgaggggaggtcagatcatgacgttgaagagggatgagaccctgcaggacggttgcgatacgcatttctgcaaggtgaacgagaggggggaatatttctgggagaagcgggttaccggctgcccccccttcgatgagcacaagtgcctggcagagggaggcaagatcatgaaaatccctggcacatgttgtgatacctgtgaagagccagagtgtaacgatatcacagctaggctgcagtacgttaaggtgggctcctgtaagtcggaggtggaagtagatattcattattgtcagggaaagtgcgcaagtaaagctatgtacagcatcgatatcaatgatgtgcaagaccaatgttcatgttgtagtccaaccagaactgaacccatgcaggttgccctgcattgcaccaacggcagtgttgtttaccatgaagtgctcaatgctatggaatgcaaatgttctcccagaaaatgctcaaag

SEQ ID NO: 21355 - DNA, 8439 bp, Artificial Sequence
  Description of Artificial Sequence: Synthetic coding sequence
atgatcccggcgcggtttgctggcgtgctgctggcgcttgctctcatcctgccgggtactctctgcgctgaggggactcggggacgctcgagtaccgcccgctgttccctgttcggatcggacttcgtgaacaccttcgacggatcgatgtactcgttcgccggctactgctcatacctgctcgcaggaggatgccaaaagaggtccttttcgattatcggagacttccaaaacggaaagcgggtgagcctgtcagtctacctcggagaattcttcgacatccacctgttcgtgaatggaactgtcacccaaggcgaccagagagtgtccatgccatatgcctccaaaggactgtatctggaaaccgaagcgggctactacaaattgtccggggaagcgtacgggtttgtcgcccggatcgacggatcagggaatttccaagtgctcctgtcggacagatacttcaacaagacctgcggactgtgcggcaatttcaacatcttcgctgaagatgatttcatgacccaggaaggtacgctgacctcagatccgtacgacttcgctaattcttgggctctctcctcgggggagcagtggtgtgagcgagcgtcgccacctagctccagctgcaacatttcctccggcgagatgcagaagggcctctgggagcagtgtcaattgctgaagagcacgtccgtctttgcccggtgtcacccactggtcgacccagaaccattcgtggctctgtgcgagaaaacgctgtgcgaatgcgcaggcggtctggagtgtgcgtgcccggcgctgctggaatacgcgcgcacctgcgcacaggaaggaatggtgctgtacggctggaccgaccattcggcctgctcgccagtttgtccagccggcatggaatacaggcagtgcgtgtccccttgcgcacggacctgtcaatcgctccacatcaacgaaatgtgccaggaaagatgcgtcgacggctgttcctgcccggaaggacagctgctcgacgaagggctctgcgtcgaatccaccgagtgtccgtgcgtgcactccggtaaacgttaccctccgggcacctcactgtcacgcgactgcaacacttgcatctgcagaaattcccagtggatctgctccaacgaggaatgcccaggagagtgtctggtcactggccagtcacacttcaagtcatttgataatcggtatttcacgttcagcggcatctgtcaataccttctcgcaagggactgccaggaccactccttctcgatcgtgatagagacggtgcagtgcgcggatgatagagatgccgtctgtactcgctcagtgaccgtcaggctgccgggactccacaactcactggtcaagctcaaacatggggcaggcgtggcgatggacggtcaggatgtgcaactgccactgttgaaaggcgatttgcgcatccaacacactgtcactgcatcggtgagattgtcctacggagaggatctgcagatggactgggacgggagaggtagactgctggtgaagctgtcgccggtgtacgcgggcaaaacttgcggcctgtgtggcaactacaacggaaatcagggcgatgatttcctcaccccttcaggactggcggagcctagggtggaggattttgggaatgcctggaagctccatggagattgccaggatttgcagaagcaacattcggacccttgtgccctgaatccacgcatgactcggtttagcgaggaagcctgcgctgtgctcacctcgcctaccttcgaagcctgtcatcgagccgtgtcgcccctgccttacctccgcaattgcaggtacgatgtgtgcagctgtagcgacggacgcgagtgcttgtgcggcgccctggcatcgtacgcggccgcttgcgccggacgaggtgtcagagtcgcctggcgcgaaccagggcgctgcgagctcaactgcccgaaaggccaagtctaccttcaatgtggaaccccctgcaatctgacctgcagatccctgtcctacccggacgaagaatgcaatgaggcctgcctggagggatgcttttgtcctcccggactgtacatggacgaaagaggagactgcgtgccgaaggcccaatgcccctgctactacgatggagaaatcttccagccagaggatatcttttccgaccaccacaccatgtgctattgcgaggatggcttcatgcattgcactatgtccggagtgcctgggtcgttgctgccggatgctgtgctgagctctccactctcccaccgctcgaagagatccctgtcatgccgcccaccgatggtaaagctggtatgcccggcggacaacctgagagcagaaggactggagtgcactaagacgtgtcagaattacgatctggaatgcatgtctatgggttgcgtgtcgggatgcctctgcccgcctggaatggtgaggcatgaaaatagatgcgtcgcattggagcggtgcccgtgcttccatcaaggtaaagagtacgctccaggtgagacggtgaagatcggatgtaacacttgcgtgtgccaggataggaagtggaactgcaccgaccatgtgtgtgacgccacctgctcgactatcggaatggcacactacctgacctttgacggcctgaagtacctcttcccgggtgagtgccaatacgtgcttgtccaagattactgcggttccaatccaggaactttcagaatcctggtggggaataagggatgctcccatccttcggttaaatgtaagaagcgggtcaccatcctggtcgaaggcggagaaatcgaactgtttgacggtgaggtcaatgtgaaaagacctatgaaggacgaaacccactttgaagtggtggagtcgggacggtacatcatcctgctcctgggcaaggcgctcagcgtcgtgtgggaccgacacctgagcatctccgtcgtcctgaagcagacctatcaagaaaaggtgtgcggactgtgtggtaactttgatgggatccaaaacaacgatctgaccagctccaacttgcaggtggaggaggacccggtcgacttcggaaatagctggaaggtgtcctctcaatgcgctgatacccggaaagtcccgcttgactcgtcaccggccacctgccacaacaatatcatgaagcagaccatggtcgactcctcatgccggatcctgacttcggatgtctttcaggactgtaataagttggtggacccggaaccatacctggacgtgtgcatctacgacacttgctcgtgtgaatccatcggagactgcgcctgcttctgtgataccatcgcagcatacgctcatgtgtgtgcccaacatggaaaggtcgtgacctggaggactgccactctgtgccctcagtcctgcgaggagcggaacctccgggagaacggatacgagtgcgagtggcggtacaattcgtgtgcaccggcctgccaggtcacctgtcaacatccggagcctctggcctgccctgtgcagtgcgtggagggttgccatgcccattgcccaccaggaaaaatcctcgacgaactgctgcagacttgtgtggacccggaggattgtccggtctgtgaagtggccggacgccggttcgcgagcggaaaaaaggtcactctgaatccgtccgacccggaacattgccagatctgccactgcgatgtcgtcaatcttacttgcgaagcctgccaagagcccgggggactggtggtgccgccgaccgatgcgccggtgtcgccaacgaccctctacgtggaggacatatcagaaccgccattgcacgatttctattgcagcagactcctcgaccttgtgttcctgctcgacggaagctcgcggctctcagaagcggaattcgaagtgctgaaagccttcgtcgtggacatgatggaacgactgagaattagccaaaagtgggtccgggtggcagtggtggagtaccatgatggctcgcacgcgtacattggactcaaagaccgaaaacggccgtccgaactccggcgcattgcttcacaagtgaagtacgcgggttcacaggtcgctagcaccagcgaggtgctgaaatacactctgttccaaatcttctccaaaatcgatcgccctgaggccagccggatcaccttgcttctcatggcctcgcaggagccccagcggatgtccaggaacttcgtgagatacgtccagggcttgaaaaagaagaaggtgatcgtcatcccagtgggaatcggcccgcacgccaacctcaagcaaatccgccttatagaaaagcaagcaccggaaaacaaggcctttgtgctgtcaagcgtggacgaactggagcagcagcgggatgaaatcgtaagctacctgtgcgacctcgcacctgaagcccctccgccaactcttccgccggacatggcccaagtcaccgtgggaccgggcctcctgggagtgtccaccctgggaccaaagcgcaactccatggtcctggatgtggcgttcgtgcttgaaggatctgacaagatcggcgaggcagactttaacagatccaaggaattcatggaggaggtgatccagcgcatggacgtgggccaggattcaattcacgtcacggtccttcaatattcttacatggtgactgtcgaatatccgttttcggaggcgcaaagcaagggagacatccttcaacgtgtgcgcgagatcagataccaaggtggcaatcggactaacaccgggctggcgttgaggtacctgtcagaccactcgtttctggtgtcgcagggggacagagaacaagctcctaacctggtgtacatggtcactggaaacccagcatccgacgagatcaagcgactgccaggagacatccaggttgtgccaatcggggtcggtccaaacgctaacgtgcaggaactcgaaagaatcgggtggccgaacgcgcccatcctcatccaggactttgagacgctccccagagaagcaccggacctggtgctgcaacgctgctgcagcggggaaggacttcagatccctaccctctcaccggctcctgattgctcacagccactggatgtcatcctgctcttggacggatcgtcatcctttcccgcttcgtattttgatgagatgaagtcattcgccaaagcgttcatctctaaggccaacattgggcccagactcacccaagtctccgtgcttcagtacggatcgatcacgaccatcgatgttccttggaatgtggtgcctgaaaaggctcacctgcttagccttgtggatgttatgcaacgggaaggtggccctagccagatcggagacgctctgggatttgcggtgcggtacctgacctccgagatgcacggagcccggccaggagcttcaaaggctgttgttatcctcgtcactgacgtgagcgtggactccgtggatgccgcggctgacgctgcacgctcaaaccgggtgacggtattcccaatcggcatcggggaccgctacgatgccgcccaactgagaatcttggccggacccgccggcgactccaacgtggtgaagctccagaggattgaggacctgccgaccatggtgaccctcggcaactcgttcctccataagctgtgctccggattcgtgagaatctgcatggacgaggatgggaacgagaaaagacccggcgacgtttggactctcccggaccagtgccataccgtgacctgtcagcctgatgggcagaccctgctgaagtcgcatagagtgaattgcgataggggcctccgaccgtcatgtccaaactcccagtccccggtgaaggtcgaggaaacttgcggatgccgctggacctgcccatgcgtgtgtaccggctcatccacccgccacatcgtcactttcgacggccagaacttcaaattgactggaagctgctcatacgtcttgttccagaacaaggaacaggacctggaggttatcctccataacggggcctgttccccaggagcgcggcagggatgtatgaagtcgatcgaagtcaaacatagcgcactgtccgtggaacttcacagcgacatggaagtgactgtgaatggtcgcctggtgagcgtgccgtacgtcggaggaaatatggaggtgaatgtgtacggagcaattatgcacgaagtccgctttaaccatctcgggcatatcttcaccttcactccgcagaacaatgagttccaactgcagctgtcgccaaagactttcgcgtcgaaaacctatgggttgtgcggaatttgcgacgagaatggggctaacgacttcatgctccgcgatggcactgtgaccactgattggaaaacgctcgtgcaagaatggaccgtgcagaggccgggccagacgtgccagccgatcctcgaagaacaatgccttgtgccggattcgtctcactgccaggtcctgctgcttccactgttcgccgaatgccacaaggtgctcgccccggccactttctatgccatctgtcagcaggactcctgtcatcaggaacaagtatgtgaggtgattgcctcgtacgcccacctctgcagaactaacggagtgtgtgtggactggagaactccggatttttgcgcgatgtcatgtccgccctcactggtgtacaatcattgcgagcacggatgcccgcgccactgcgacggaaatgtgtctagctgcggagatcacccatccgaaggttgcttctgcccgcccgacaaggtgatgctggagggaagctgtgttccggaggaggcttgcacccaatgtattggtgaggacggtgttcagcatcagttcctggaggcatgggttccggaccatcagccatgccagatttgtacctgcctctcaggacgcaaggtcaattgcactactcagccatgcccgaccgcgaaggcgcccacttgtggactctgcgaggtcgctcgcctccgccagaacgcagatcaatgttgcccagaatacgaatgcgtgtgcgacccagtctcgtgcgatctgccgccggtgccacattgcgaacggggacttcagccgaccctcaccaatccaggagagtgcaggccaaatttcacctgcgcttgccggaaggaagagtgtaagagagtgtcacccccgtcctgtccgcctcatcggctgccgacccttcggaaaacccaatgttgcgacgaatacgagtgcgcgtgcaattgcgttaactcgactgtgagctgtcccctggggtacctcgctagcacggccaccaatgactgcgggtgtaccaccaccacttgcctgccagacaaagtgtgcgtgcacaggagcaccatctacccagtcggacaattctgggaagaggggtgtgacgtatgcacctgcactgacatggaggacgccgtcatgggactgcgcgtggctcagtgttcccagaagccgtgcgaagattcctgccggtcggggttcacttatgtcctgcacgagggagagtgttgcggccgctgtctgccttcggcgtgtgaggtggtcactggctcgcctcggggcgattctcagtcatcatggaaatccgtgggatctcaatgggcctcaccagagaacccctgcctgattaacgagtgcgtccgtgtgaaggaagaagtattcatccagcaacgcaatgtttcctgcccacagttggaggttccggtgtgcccatccgggttccaattgagctgcaagacctcagcctgctgccctagctgcagatgcgagcggatggaagcgtgcatgctcaatggcactgtcattggcccaggcaaaaccgtgatgatcgacgtgtgtaccacttgccggtgtatggtgcaggtgggagtgatctcgggcttcaagctcgagtgcaggaaaaccacttgcaacccttgtcccctgggctataaagaggagaacaacaccggagaatgttgcggccggtgcctgcccaccgcttgcactatccaacttcggggaggacagatcatgactctgaaacgcgacgagactctccaggatggctgcgatactcacttctgcaaggtgaacgagcggggtgagtatttctgggaaaaaagagtgactggatgtcccccatttgacgagcataagtgcctggcagagggcggaaagatcatgaaaatcccaggcacctgctgcgatacctgcgaggaaccggaatgcaacgacatcaccgcgcggctgcagtacgttaaggtgggttcgtgcaaatcagaggtggaggtggatatccattactgtcaggggaaatgtgcgtccaaggccatgtactcgattgacattaacgacgtgcaggaccagtgcagctgttgctcacccaccagaactgagcctatgcaggtggccctgcattgcacgaacgggagcgttgtctatcatgaggtgcttaacgcgatggagtgtaaatgctcgccacgaaaatgctctaag

SEQ ID NO: 21356 - DNA, 8439 bp, Artificial Sequence
  Description of Artificial Sequence: Synthetic coding sequence
atgattccagcccggtttgcaggggtcctccttgcgttggccctgatcctgccagggaccttatgtgccgaggggacgcggggccgctcctcaacagcgcggtgcagtctctttgggtctgattttgtcaacacatttgacggctccatgtattcctttgctggatattgtagctatcttctcgcaggaggttgccagaagcgctcattcagcattattggggatttccagaacggtaagcgggtcagtctgtctgtctatttgggagagttcttcgacatacacctgttcgtgaacggaacagtgacccaaggggaccaacgagtgtctatgccttacgcctccaaaggtctttatttggaaaccgaggctggatactataagctgtccggcgaggcgtacgggttcgtggcccgtattgacggctctggcaacttccaggttctgctgtctgataggtacttcaacaagacgtgtggtttgtgcggcaattttaatatttttgccgaagacgatttcatgacacaggagggaaccttgacttccgatccttacgatttcgccaattcctgggcgctgagctctggggagcagtggtgtgagcgtgcttccccaccttcgagctcatgtaacattagctcaggcgaaatgcagaagggtctttgggaacagtgccaacttcttaaatccacaagcgtttttgcgcgttgccaccctctcgttgaccccgagcctttcgtggcgctatgcgaaaaaacactttgcgaatgtgccggggggctggagtgtgcctgccccgccctcttggagtatgcccgcacttgtgcccaagagggcatggtactgtacggatggacagatcacagcgcttgttcaccggtctgccctgcaggcatggaatatcgccaatgcgtgtccccctgcgctcgcacatgtcaaagtttacacatcaatgaaatgtgccaggagcgctgtgtggacggttgttcatgtcctgaggggcagctcttggatgaggggctgtgtgtggagtccacagaatgcccttgtgtgcatagtgggaagaggtatcctcctgggacgtctctgtccagagattgtaacacgtgtatttgcaggaactctcagtggatctgctctaacgaggagtgtcctggcgaatgcttggtgacagggcagtcccactttaaatccttcgacaaccgttacttcaccttctccggtatttgccagtacctgttggcccgcgattgtcaggatcattcttttagtatcgtgatcgagacggtgcagtgcgccgacgatcgcgatgcggtttgtacaaggtcagttacagttcgcctgcctgggctacacaacagtcttgtaaagctcaaacatggcgccggggttgctatggatggacaagacgttcagttgcccttacttaaaggagacctgaggatccaacatacagtcacagcaagtgtgcggctcagctatggtgaggatttgcagatggactgggacgggcgtgggaggctcctggttaagttgtcgcctgtgtatgctggtaagacctgtggtctttgcggcaactacaacggtaaccagggtgatgactttctgacaccaagtggcttggccgagcctcgggtcgaggatttcggaaatgcttggaaactccacggggactgccaggacctgcaaaaacagcattcagatccgtgtgcactcaatcctaggatgacaaggtttagtgaggaggcttgcgccgtgctgacttctcctacatttgaggcatgtcaccgagccgtcagtcccctgccgtatctccgaaattgcagatacgatgtatgctcctgcagcgacggacgcgaatgcctgtgtggagctcttgcatcctacgccgcggcctgtgccggacgaggagtgcgggtagcatggagagagccagggcggtgcgagctgaactgccctaaaggccaggtctacctccagtgtgggaccccatgtaacctcacctgtaggtccttgagctatcccgacgaggaatgtaacgaggcgtgtctcgaggggtgcttctgccctcccggcctatacatggacgaacggggcgattgcgtgcctaaggcgcagtgcccttgctattacgacggtgagatattccagcccgaggacatattcagcgatcaccataccatgtgctattgtgaagacggattcatgcattgcactatgtcgggggtcccgggcagcctcctgccggacgccgtcctaagctctcccctgtcccaccgctctaagcggtccctgtcatgtagacctcctatggtgaagctggtgtgccccgccgataacctcagagccgaagggttagaatgcactaagacatgtcagaactacgatctagaatgtatgagcatgggatgcgtttctggatgtctgtgtccccccggcatggtgcgtcacgaaaaccgatgcgtagctctggagaggtgtccctgcttccatcagggtaaagagtacgccccaggcgagactgtgaagataggttgtaatacctgcgtctgccaagacagaaaatggaactgcactgaccatgtctgtgacgcgacctgctctactatcggaatggctcactacctgacctttgacggccttaaatatctattcccaggagagtgccagtatgtgcttgtacaggattactgtggatctaatcctggcaccttcaggattctcgtgggcaacaaaggttgttcccacccctcagtgaagtgtaaaaagcgcgtgacaattttagtagaaggcggcgagattgaactgtttgacggcgaagtgaacgtgaagcgcccaatgaaggatgagacccacttcgaggtcgttgaatcaggtcggtatattatacttctactgggaaaagccctttcagttgtctgggatcggcacctgagtatcagtgttgtactgaaacagacttatcaagagaaggtgtgcggactgtgcggcaatttcgatggaattcaaaataacgatttgacctcttccaaccttcaggttgaagaggatcctgtggactttgggaattcatggaaggtgtcgtcgcagtgcgctgatactcgcaaggtacctttggactcgtcccctgcgacatgccataacaacattatgaaacagacaatggttgactcatcatgtcgcattcttacgagtgatgttttccaggattgcaataaacttgtggaccccgaaccctacctggatgtatgcatctacgacacctgttcctgcgagtcgattggcgattgcgcctgcttctgcgacaccattgctgcatacgcccacgtgtgcgctcagcatgggaaggtggtgacttggaggacagcaactctgtgcccccaatcttgcgaggaacgcaatctgcgcgagaatgggtacgagtgcgagtggaggtacaacagctgcgcacccgcctgtcaggtcacatgtcagcaccccgagcctctggcgtgccctgtgcagtgtgtggaaggttgtcacgcacactgtcctcccgggaagattctcgacgaactgttacaaacttgcgtggaccccgaagattgtccggtttgtgaagtggccggacgccggttcgcatccggtaaaaaagtgactctcaacccctccgaccctgagcactgccagatatgtcactgcgacgtcgtcaatctcacatgtgaggcctgccaggagcctggaggtctggtggttccaccaacagatgcaccagtgtctccaacaaccttgtacgtagaggacatctcagaaccaccactgcacgacttttattgctcccgactgctagacctggtgttccttcttgatgggtcgtcccgcctaagtgaggccgagtttgaggtgctaaaggcttttgtcgtcgatatgatggagcggctacgcattagtcagaagtgggtgagggtggccgtggtagagtaccacgacggatcccacgcgtatatcggactcaaagaccgcaagagacccagtgaactaagacggatcgcttcacaagttaagtatgccggaagtcaggtggcctctaccagcgaggtcctcaagtataccctgttccagatcttctctaaaatcgatcgcccggaagctagtcgcataaccctgttgctcatggcctcccaggagccacagcggatgtcgcgcaattttgtgaggtacgtgcagggcttgaaaaagaagaaggtaatagtcataccggtgggcatcggcccacatgcaaatctcaaacaaatcaggctcattgagaagcaggctcccgaaaacaaggctttcgttctcagtagtgtggacgagttggaacagcagcgggacgagattgtgtcttacctctgcgatttagcccccgaagcaccgccccctacactgcccccagacatggctcaggtgacggtaggtccaggacttctcggagtgagcaccctcgggccaaagcgcaatagtatggttcttgacgtggcgtttgttcttgaagggagcgacaagatcggagaggctgacttcaatcggagcaaggaattcatggaggaggtgatccagcgcatggacgtggggcaagattctatccacgtgactgtcctccaatactcttacatggtgacggtggagtatcctttctctgaagcacaatctaagggggacattctgcagagggtgagggagattcggtaccagggtgggaaccgcactaatactgggcttgccctcaggtacctgagcgatcactcttttttggtttctcaaggggacagggaacaggcgccgaacctggtctatatggtgacagggaacccagccagcgatgagatcaagcggttacccggcgatatacaggtcgtgcctatcggcgtgggaccgaatgccaacgtccaagagctggaacgtataggttggccaaacgctccgattctgattcaggacttcgagacgctgcctcgagaagcgccggatctggtactgcagcgctgttgctctggcgagggtttgcaaattcctactttaagtccagcgccagactgctctcagcctctggacgtgattcttttactggatggcagctcctcttttcccgcttcttacttcgatgaaatgaagagcttcgccaaggcttttatttcgaaagcaaacatcggcccacggctgacccaggttagtgtgctacagtacggttctatcaccacaatagacgtgccatggaatgtcgtgcccgaaaaagcgcacctgctgagcctcgtcgacgtgatgcaacgcgaaggaggaccaagccagatcggtgacgcactaggcttcgctgtacggtatctcacatcagaaatgcacggcgcaagacctggcgctagtaaggctgtggtcatcctcgtgaccgacgtctcagtggacagcgtggacgcagccgccgacgctgcgcgctctaaccgggtgacagtgttccctatcggaatcggcgacaggtatgacgccgcccaactgcgcattctggcgggacctgcaggcgattccaacgtcgttaaactgcaaaggatcgaagatctgcctaccatggtcactctgggcaattccttcttacacaagctgtgctccggcttcgtgagaatctgtatggacgaggacggaaacgaaaagcgcccaggtgatgtgtggacactccctgaccaatgccacacggtaacatgccagcccgacggacaaaccttgttaaagtcgcacagggtgaactgcgaccggggactgagacctagctgccctaacagccaatcacccgtaaaggtagaagagacctgcggctgccggtggacatgcccctgtgtgtgtactggctcctccacaagacatattgtgacttttgacggtcagaatttcaagcttaccggaagctgcagttatgtgcttttccagaataaggagcaggacctggaagtcatactgcacaacggggcttgtagtcctggagccagacaaggttgtatgaaatctatagaagttaaacactccgccctatccgtggagctgcacagcgacatggaagtgactgtcaacggtagactagtgtcagtgccctatgtgggtggcaatatggaggtgaacgtgtacggggccattatgcatgaagtgcggttcaatcaccttggacacatctttacatttacccctcagaacaacgaatttcagctgcaactctcacctaaaacatttgcaagtaagacttatggcctctgcggcatctgcgatgaaaatggagccaacgattttatgcttagggacgggaccgtgacaaccgactggaagaccctagtgcaagaatggacagtccaacggcctggacagacatgtcagcctattttggaggagcaatgcttggtccccgattcttcacattgtcaggtgctgctccttcctctctttgctgaatgccataaggtcctcgcacccgcaaccttctacgccatttgccagcaggactcctgtcaccaggaacaggtttgcgaggtcattgcttcctacgcacatttgtgtcgcactaacggtgtgtgcgtcgattggagaacgcccgacttctgtgctatgtcttgtcccccatctctggtgtataaccactgcgagcatggctgtcctagacactgtgatggcaatgtgtctagctgcggagaccatccgtccgagggctgtttctgtccacccgataaggttatgctagaaggctcttgcgtgccagaggaggcgtgcacacagtgcatcggggaagacggcgtgcagcaccaatttctcgaggcctgggtgccagaccatcagccatgccagatatgcacttgtttatctggcaggaaagtaaattgcactactcagccatgcccaacggcaaaggctcctacatgcggcctctgtgaagttgcccgactgagacagaatgcggaccaatgctgcccagaatatgaatgcgtctgtgaccctgtgagctgcgatttaccccctgtgcctcattgcgaacggggcctgcagcccacactaaccaacccaggggagtgtcgacccaattttacctgcgcctgcagaaaggaagagtgtaagagggtcagccccccctcatgtccaccccatagactgccaacattgaggaaaacccagtgctgtgatgagtatgaatgtgcctgtaactgcgtgaattcaacggtgtcttgccccctgggatatctggcaagtaccgcgacaaacgactgcggctgtacaaccactacttgtttgcccgataaggtatgtgttcacaggtcaactatatatccggtgggccagttttgggaagaaggatgcgatgtatgtacctgtaccgacatggaggatgcagttatgggacttcgggtcgcccagtgttcgcagaaaccttgcgaagatagctgccggagcggtttcacatatgtcctccatgagggcgagtgctgtggcaggtgcctgccatccgcctgtgaggtcgtcacggggagtccacgaggagatagccagtcctcttggaaaagcgtgggatcgcagtgggcgagccccgaaaacccctgtctgattaacgaatgcgtgcgtgtgaaagaggaggtgtttattcagcaacggaacgtgagttgtccccagttggaggttccagtgtgtcctagtggattccagttaagctgtaagacaagcgcttgttgccctagttgtcgttgtgagcgcatggaggcatgtatgctcaacggcacagtcattgggcccggcaagactgtgatgatcgacgtctgtacaacctgccgttgcatggtgcaggtcggcgtgattagtggcttcaagctggagtgtagaaaaaccacctgtaacccttgccccttaggctacaaggaggagaacaacacgggcgaatgttgcggccgctgtctccctaccgcatgcaccatccaactcagaggaggccagataatgacactgaagagagacgaaacactccaggatggctgtgacacgcacttctgcaaggtgaatgagcgtggggaatacttttgggagaagagggtgaccggctgtccaccctttgacgaacacaagtgtctcgcagagggtggtaaaatcatgaagattcccgggacgtgctgcgacacatgtgaagagcctgagtgtaatgacataaccgctcgcctgcagtatgtgaaagtggggtcctgcaagagtgaggtggaggttgatatacattattgtcaaggcaaatgtgcctcaaaagccatgtacagcattgacatcaatgacgtgcaagaccaatgcagctgttgcagtcctacaagaactgaacccatgcaggtggcccttcactgtacaaatggctctgttgtgtatcacgaagtgctcaatgcgatggaatgtaaatgctctccgcggaagtgtagcaag

SEQ ID NO: 21357 - DNA, 8439 bp, Artificial Sequence
  Description of Artificial Sequence: Synthetic coding sequence
atgattccagcgcgctttgcaggggttcttcttgccctggcactgatcttgccgggaactctgtgtgctgaagggaccagaggacgctcctcaactgcccggtgttccctcttcggatcggactttgtcaatacgttcgatgggtcgatgtactcctttgccggatactgtagctaccttcttgcgggaggttgtcagaaaaggtccttttcgatcattggagactttcaaaatggtaagcgggtgtcactttccgtgtatctgggcgagttttttgatatacatctgttcgtgaacggcaccgtgacgcaaggggatcaaagagtgtcgatgccctacgcatccaaaggactttacctcgaaaccgaagcgggatattacaagctgagcggggaagcatacggctttgtcgcacggatcgacggttcggggaattttcaagtgcttctgtcagaccggtactttaacaagacctgtggactgtgtggcaactttaacatatttgcagaggatgactttatgactcaagaaggcaccctcacttcggatccatacgattttgcaaattcgtgggcactctcgagcggtgagcagtggtgcgagcgggcaagcccaccttcgtcgagctgcaacatttcgagcggagaaatgcagaagggtctttgggagcagtgtcagctgctgaaatcgacctcggtgtttgcaagatgtcatccacttgtggacccagaaccattcgtggcactctgtgaaaagaccctgtgtgagtgtgcgggtggtctggaatgcgcatgtccagcactcctggagtacgcacggacttgtgctcaggaaggtatggtcctgtacggctggactgatcactccgcctgttcgccagtgtgtcctgcgggaatggagtatagacagtgtgtgtcaccatgtgcaaggacgtgtcaaagcctgcacatcaacgaaatgtgtcaagaacgttgcgttgacgggtgtagctgtccagagggccaacttcttgatgaaggactgtgtgtggaatctacggaatgcccatgtgtgcacagcggaaagcgatacccgcctggcacgtccctctcgagagattgcaacacttgcatctgtcgtaactcgcaatggatctgttcgaacgaggaatgtccaggggagtgccttgtgactggacaatctcatttcaaatcattcgacaaccgttactttaccttctccggtatctgtcagtacctcttggcaagggattgtcaggatcacagctttagcatcgtgattgaaaccgttcaatgcgcagacgatcgggatgcagtatgtaccaggtccgttaccgtcagactccctggactgcacaattcgcttgttaagttgaaacatggcgccggcgtcgcaatggatgggcaagatgtgcaactccctctgctgaagggggatctgagaatacaacatactgtcaccgcgtcggtgaggctgtcatacggtgaggatttgcaaatggattgggatggaagaggtaggttgctcgtgaagctgagcccggtctacgcaggaaaaacctgtggcctgtgcggaaactacaatgggaaccagggagatgattttcttaccccttccggactcgccgaaccgcgggtggaagattttgggaacgcttggaaacttcacggagattgccaagaccttcagaagcaacattcagatccatgtgcacttaatccaagaatgacccggttctccgaagaggcgtgtgctgtcctgacctcacctacttttgaagcatgccaccgagcagtcagccctctgccatatttgcggaactgccgatacgacgtgtgttcatgctccgatggtcgggagtgtttgtgcggtgccctcgcctcatacgctgcagcatgtgcaggacggggagtgagagtggcctggcgggaaccaggccggtgtgagctcaattgtccaaagggtcaggtctaccttcagtgcggaaccccatgtaatctcacttgcagaagtctttcctacccagacgaagagtgcaatgaagcatgccttgaaggttgtttctgtcccccaggcctttacatggacgagagaggtgattgcgtcccaaaggcccaatgtccgtgctactacgatggagagatattccaaccagaggatatcttctctgatcaccatacgatgtgctactgtgaggacgggtttatgcattgtaccatgtcaggcgttcctggatcactcctccctgatgcagtgctttcatcgccactttcacacagatccaaacgctcgcttagctgcaggcctcctatggtgaagttggtgtgtcctgccgataacctcagggcagagggtctggaatgtactaagacctgtcagaactacgacctggaatgcatgtcgatgggttgtgtgtcaggttgtttgtgtccgcctggaatggtgagacacgaaaatagatgcgtggccctggaaagatgcccttgcttccatcagggaaaagaatacgcacctggcgaaaccgtcaaaattggatgcaatacctgcgtctgtcaggatagaaagtggaattgtaccgatcatgtgtgtgatgcgacttgtagcactattggaatggcccattatcttacctttgacggacttaagtaccttttcccaggagagtgtcaatacgtgctcgtgcaggattactgcggtagcaatccggggacttttaggatacttgtgggaaataaggggtgttcccacccatctgtcaaatgtaagaaaagagttaccattctcgtcgagggtggcgaaatcgaactcttcgatggagaggtcaacgttaagcgaccaatgaaggatgaaacccatttcgaggtggtcgagagtggacggtacattatcttgttgctcggaaaggccctctccgtggtgtgggatcgccacctgtcgataagcgtggtgctgaagcagacgtaccaagaaaaagtgtgcggactctgtggaaactttgatggaattcagaataatgatctgacctcgtccaaccttcaggttgaggaggatccagtggattttggcaattcctggaaggtgtcctcgcagtgcgcagatactcgcaaggtaccacttgactcgagcccagccacttgccataacaacattatgaagcaaaccatggtggacagttcctgtagaattctgacctccgacgtctttcaagattgcaacaagctggtggaccccgaaccctacttggacgtctgcatctacgacacttgttcatgcgagtccattggcgactgtgcctgtttctgcgatacgattgcagcgtacgcacatgtctgtgcacaacacgggaaggtcgtgacttggcggactgctaccctgtgcccccaatcatgtgaggaacgaaacctgagagaaaatggttacgaatgcgaatggcggtacaattcttgtgccccggcctgtcaagtgacttgccaacatccagaacctctggcgtgtccggtgcagtgtgtggaaggttgtcatgcccattgtcctccgggaaagattttggacgaactccttcaaacttgtgtggaccccgaggattgccctgtgtgcgaggtggcaggacgccgttttgcgagcggtaaaaaggtgactctgaatccgtcggatccagagcattgtcagatctgtcactgtgatgtcgtgaacttgacctgtgaggcctgccaagaacccggcggactcgtggtgccgcctaccgacgcaccagtgtcgcctactaccctctatgtggaagatatttcagaaccaccactgcatgacttctattgctcccgcttgcttgaccttgtttttctgctggacggcagctcccggctgtcagaagccgagtttgaagtgttgaaggcatttgtggtggatatgatggagagactgagaatttcacaaaagtgggtgagagtcgcagtcgtggaataccatgacggatcgcatgcctacatcggccttaaggatagaaaacgaccctcggagcttcgtagaatcgcttcgcaagtgaagtacgcgggaagccaggtcgcctcgacttcggaagtgctcaaatacaccctctttcaaatcttttccaaaatcgaccggccagaagcatcgagaattacgctgcttttgatggccagccaagagccccagcggatgagcagaaatttcgtgagatacgtccaaggcctgaagaaaaagaaggtgattgttatcccagtggggatcggccctcatgctaacctcaagcaaattaggctgattgaaaagcaggcgcccgagaataaagcgtttgtgctttcctccgtggatgaactcgagcagcaaagagatgagatagtctcatacctttgcgatcttgccccagaagcaccaccgccaaccctgcccccagatatggcacaggtgaccgtgggccccggactcctgggtgtatcgactctggggccaaagagaaattcgatggtcctggatgttgcatttgtgcttgaaggtagcgacaagattggtgaagctgatttcaaccgtagcaaggagttcatggaggaagtgattcaacgcatggacgtcgggcaggattcgatacatgtgacggtcctgcaatactcctacatggttaccgtggagtaccctttctcagaagcgcaatcgaagggcgatatcctgcaacgtgtgcgggaaattcgctaccaggggggtaatcggactaacactggcctggcccttagatacctttccgatcattcattccttgtgtcgcagggcgaccgtgagcaggccccaaacctcgtctacatggtcactggtaaccccgctagcgacgagattaagagacttccaggtgatattcaggtcgttcctattggtgtggggcctaacgcaaatgttcaagagcttgagagaattgggtggcctaacgcaccaattctcatccaggattttgaaaccctcccacgagaggcccctgatctcgtgttgcagcgttgctgctcgggagaaggactccaaattccaaccctgtcccctgccccagattgttcccagcctttggatgtgatcttgctcctggacggttcctcatcattcccagcatcctactttgatgaaatgaagtcatttgctaaagccttcatctcaaaagcaaacataggacctcgactgacccaggtgagcgtgcttcaatatggctccattaccactatagacgtcccatggaacgtcgttcctgaaaaagcacatcttctgagcctggtggacgtgatgcaacgggaaggaggaccttcgcagatcggagatgcactgggctttgccgttcgctatctcacttccgagatgcacggggcccggccgggggcttcaaaggcagtggtgatccttgtcactgatgtcagcgtggattcagtcgacgccgcagcagatgcagcaaggtccaaccgcgtgaccgtgtttcctattggtattggagatcgctacgatgcagcacagctgcgcattctcgccggcccagcaggagactctaatgttgtgaagctccagaggattgaagatcttcctactatggtgactctcggtaattcgtttcttcataagctctgctcgggctttgtgcgcatctgcatggatgaagatggcaatgagaagcgccccggagatgtctggactctgcccgatcagtgccataccgtcacttgtcagcctgatggtcaaacccttctgaagagccacagagtcaactgtgatagagggcttaggccgtcctgcccgaactcgcaatcccctgtgaaggttgaggaaacctgtggctgtaggtggacttgcccgtgtgtctgcactgggagctcgaccaggcatatcgtcacttttgacggacagaactttaaactgactgggagctgttcctacgtactctttcagaacaaggaacaggatcttgaagtgatcctccataatggtgcctgttctcctggagcgcgccagggatgtatgaaaagtatcgaggtcaagcattctgccctttcagtggaactccactccgatatggaggtgactgtgaatggtaggcttgtctccgtgccttacgtgggagggaacatggaagtgaacgtgtatggggcgatcatgcatgaagtccgatttaaccatttgggtcacatattcactttcacccctcaaaacaatgaatttcaactccaactgtcccctaagacttttgcgtcaaaaacttacggtctgtgtggaatatgtgacgagaacggcgcaaatgactttatgttgcgtgacgggaccgtcactaccgattggaaaaccctggtgcaagaatggaccgtgcaacgtccgggccaaacttgccagcctatcctggaagagcagtgcctggtgccagatagcagccactgccaggtgttgcttctgcctctttttgcagagtgtcacaaggttcttgcaccggcgaccttctacgctatctgtcagcaggatagctgccatcaagagcaagtgtgtgaagtcattgcatcgtacgcccatttgtgtcggactaatggcgtctgtgtggactggcgaacccccgatttctgtgcaatgagctgccctccatccctggtctacaatcattgcgagcacggatgtcctagacactgcgatggaaacgtctcatcatgcggagatcatccttccgaaggttgtttttgtccccccgataaggtgatgctggaaggctcatgtgtgcccgaagaagcatgtacgcaatgtatcggagaagatggggtgcaacaccaattcttggaggcatgggtcccagatcatcagccttgtcagatatgtacgtgtctgtccggtcgtaaagtgaactgtaccacccagccctgccctactgccaaggctcctacttgcggactctgcgaagtggcaagacttcgacaaaacgcagatcaatgttgccccgaatacgaatgcgtgtgtgatcccgtgagctgcgatttgccacctgtgccacactgcgagcgaggtctgcaacctaccctgactaacccgggggagtgcagacctaactttacctgtgcatgtagaaaggaagaatgtaagagggtgtcccctccttcgtgtccccctcatcgtctgccaactctcagaaagacgcagtgttgcgatgagtacgaatgtgcatgcaactgcgtgaactccaccgtctcatgccctcttggatacctggcatcgactgcaaccaacgactgtgggtgtaccactacgacctgtctgcctgataaagtgtgtgtgcatagatccacgatttaccctgtgggacaattttgggaagagggttgcgacgtctgtacttgtactgacatggaggatgcagtgatggggctccgggtggctcaatgtagccaaaaaccatgtgaggattcgtgcaggtccggtttcacttacgtgctgcacgaaggagaatgttgcggtcggtgtctgccttcggcgtgtgaagtggtgactggttccccaagaggcgactcccagtcgtcgtggaagtcggtgggatcgcagtgggcgtcgcctgagaacccatgcctgattaacgaatgcgttcgggtgaaagaagaggtattcatccagcaacgtaacgtgtcgtgtccacagctcgaagtgccagtctgtccttcggggttccagctgtcctgcaagacgtccgcatgctgcccatcgtgcagatgcgaaaggatggaagcatgtatgcttaacgggactgtgataggacccggcaagactgtgatgattgacgtatgtactacgtgtcgctgtatggtgcaggtgggagtcattagcggatttaagctcgaatgtcggaaaaccacgtgtaacccatgtccccttgggtacaaagaagagaataacactggcgagtgttgtggccgctgcttgccgaccgcatgtacgatccagctgcgtgggggacagatcatgaccctgaagagagatgaaactctgcaagatggttgtgatacccatttttgtaaggtcaatgaaaggggagagtacttttgggaaaaaagggtgaccggctgtcctcctttcgatgaacataagtgcctggccgaggggggaaagataatgaagattcccggaacttgttgcgacacctgcgaagagcccgaatgcaacgacattaccgcccgtctgcaatacgtgaaagtaggtagctgtaagtccgaagtggaagtcgacattcactactgtcaaggaaaatgcgcatcgaaggcaatgtactcgatagatatcaacgacgtccaggaccaatgctcatgttgtagccctactagaactgaacctatgcaagtggcgctgcactgtaccaatggctcagtggtgtaccatgaggtgcttaacgccatggaatgtaaatgttcaccccggaaatgttcgaag

SEQ ID NO: 21358 - DNA, 8439 bp, Artificial Sequence
  Description of Artificial Sequence: Synthetic coding sequence
atgatcccggcccggtttgcgggcgtgctgctggctctggcgctcatcctcccggggactctgtgcgcagaaggaactagaggacgctcgtccaccgcccggtgtagcctgttcggatcagattttgtgaacactttcgatgggtcaatgtactccttcgccggatactgctcgtacctgctcgctggcggatgccaaaagaggtccttttcaatcatcggcgatttccaaaatggcaagagagtgagcctgtcggtgtacctgggcgagttcttcgacatccacctcttcgtgaacggtaccgtcactcagggggatcagcgcgtgtcgatgccctacgcttcaaaaggactctacctcgagacggaggcaggttattacaagctgtcaggagaggcctacgggtttgtggccagaattgacggctccggaaacttccaggtgctcctctctgaccgctacttcaataagacctgcggcctgtgcggaaacttcaacatctttgcagaggacgatttcatgactcaggaaggaacgctgacctcggacccgtacgacttcgcgaactcgtgggcgctgagcagcggtgagcagtggtgcgagcgggccagccctccgtcctcaagctgcaacatttcaagcggagaaatgcaaaaaggcctctgggaacaatgccagctgctgaagagcacctcagtgttcgcacggtgccatccgctcgtggatccggaaccgttcgtggccttgtgcgagaaaaccctctgcgagtgcgccggagggctggaatgcgcatgtcctgcgctgctggaatatgctcgcacctgcgcccaggagggcatggtcctgtacggctggactgaccactcagcatgttcccctgtgtgtcctgcaggtatggaatataggcagtgtgtgtcaccgtgtgctagaacctgccagtcgcttcatatcaatgaaatgtgtcaggaacggtgcgtggacggatgctcgtgcccggagggacaacttctcgatgagggactgtgcgtggaaagcaccgagtgcccttgtgttcactcgggaaaacggtaccccccggggacttcgctgtcacgggattgtaatacgtgtatctgccgcaactcgcagtggatctgtagcaatgaagaatgccctggagaatgtctggtcactggccagtcccactttaagtcatttgataatagatacttcactttctcaggcatctgccaatacctcctcgcccgcgattgtcaagatcattccttttccatcgtgatcgagacggtgcagtgtgcggacgatcgcgatgcggtgtgtactcggtcggtcactgtccgcctgccgggattgcataactcgctggtcaaactcaaacatggagccggggtcgcaatggacgggcaggacgtgcagctgccgctgttgaaaggcgacctgcggatccaacatacggtgaccgcgtcggtcaggctgtcctacggcgaagatctgcagatggactgggacgggagaggacggctgcttgtgaagctgtcccccgtgtacgcgggaaagacttgcggcctctgcggaaattacaatggaaaccagggcgatgattttctcaccccatcaggcttggccgagccacgggtggaagattttggtaatgcttggaagctgcatggagattgccaagaccttcagaagcagcattccgacccgtgcgcccttaacccgagaatgactcggttctctgaagaagcatgcgcggtgctgacctccccgaccttcgaggcttgccaccgggcagtctcaccgctgccataccttagaaactgccgatacgacgtctgttcatgctcggacggtcgtgagtgcctgtgcggcgccttggcgagctacgcggccgcatgcgccggaagaggagtgcgcgtggcctggagagaacctgggagatgcgagttgaattgtccgaaaggccaagtgtaccttcagtgtgggaccccgtgtaacttgacctgccggagcttgtcgtacccagacgaggaatgcaatgaggcctgtctggagggctgcttctgtccaccgggactgtacatggacgaacgcggggactgtgtccccaaagcacaatgcccatgctactacgacggcgagattttccaaccagaggatatcttctccgaccatcacaccatgtgctactgcgaggacgggttcatgcactgtaccatgtcgggagtcccaggctccctcctcccggacgcggtgctgtcatccccgctgtcccacagatccaagcggagcctgtcgtgtcggccaccgatggtgaagctggtatgccctgcagataatctgcgggccgaaggattggagtgcactaagacttgtcaaaactatgatctcgaatgcatgagcatgggatgtgtgtctggctgtctgtgcccaccagggatggtccgccacgagaaccgctgtgtggctctcgaacgctgcccatgctttcaccaaggaaaagaatatgcgccgggtgagactgtgaagatcggatgcaacacttgcgtctgtcaagaccgtaagtggaattgcaccgatcacgtgtgcgacgcgacttgctcaaccatcggcatggcgcactacttgaccttcgacgggctgaagtatctgtttcccggagaatgccagtacgttctggtgcaggactactgcggatcaaatccaggtacgttcagaatcctggtggggaataagggctgctcgcacccatcggtgaagtgcaagaagcgcgtgaccatcctggtggagggaggagagatcgaactgttcgacggcgaagtcaacgtgaaacggccaatgaaggacgaaacgcatttcgaagtggtggagtcgggacgttacatcatcctgctgctcggaaaggcgctgagtgttgtgtgggatagacacctgagcatctccgtcgttttgaaacagacttaccaagaaaaggtctgcggactttgcggaaatttcgatggaatccagaataacgatctgacttcctcaaatcttcaagtggaagaggacccagtcgacttcggaaactcctggaaggtgtcatcccagtgtgccgacactcgcaaggtccccctggacagctcgcccgccacctgccacaacaacatcatgaaacagaccatggtcgactcctcgtgccgcatactcactagcgacgtgtttcaggactgcaacaaactggtggacccagagccctacctggacgtgtgcatctacgatacctgtagctgcgaatcaatcggagactgcgcctgtttctgcgacactatcgctgcctacgcccacgtgtgcgcacagcatggaaaagtggtcacctggagaacggccaccctgtgtccccagtcgtgcgaagaaagaaatttgagagaaaatgggtacgaatgtgaatggagatacaattcgtgtgcaccggcttgtcaagtcacctgccaacatccagagccactggcatgtccagtgcagtgtgtggaaggatgtcatgcccactgtccccctggaaagatcctggacgaactgctgcaaacctgcgtggacccggaggactgcccagtatgtgaagtcgcgggacgcaggttcgcgtcaggaaaaaaggtgaccctcaacccctccgacccagagcactgccagatctgtcattgcgacgtggtgaatctgacctgcgaagcgtgccaggaaccaggcggcctggtggtccctcctactgatgcaccggtgtcccctaccaccctctatgtcgaggacatctccgagccgccgctgcatgatttctactgctcgcgcctgctggacctcgtctttctgctggacggatcaagccggttgagcgaagcagaattcgaggtgctgaaggcgtttgtcgtggacatgatggagcggctgcgcatcagccagaagtgggtgcgggtggccgttgtggaataccatgacggttcacacgcatacatcggactgaaagacagaaagcgcccgtccgaactccgacgcatcgccagccaggtgaaatatgcaggaagccaggtggccagcaccagcgaggtgcttaagtacaccctgttccagatcttttcgaagatcgacagaccggaggcgtctaggatcactttgctcctgatggcttcccaagagcctcaacgcatgtctcggaatttcgtgagatacgtccagggactgaagaagaaaaaagtgatcgtcatcccggtggggatcggaccacacgcgaatctcaagcagatccggctcatcgaaaagcaggctccggaaaacaaggctttcgtgctgtcgtcggtggatgagctggagcaacaacgcgacgaaatcgtgtcgtacctctgcgacctggcgccggaagcgcctccgccgactctgcccccggacatggcacaagtcactgtgggacccggcctgctgggagtgtccaccctgggtccgaagcggaattccatggtgctcgatgttgccttcgtgctggagggttctgacaagattggtgaggcagacttcaatcgctcgaaggaattcatggaggaagttatccagcgaatggatgtgggccaagacagcatccacgtcactgtgttgcagtactcctatatggtgaccgtggaatatccattttcggaagcccagtccaagggtgacatcctgcagcgcgtccgcgaaattcggtaccagggcgggaatcgcacgaataccggactggccctgcgctacctttccgaccactccttcctcgtgtcccaaggggaccgggaacaggctcccaacctggtttacatggtcactgggaatccagcctcagacgagatcaaacggcttccgggagatatccaggtcgtgccgatcggagtggggcctaacgcaaacgtccaagaacttgaacgcatcgggtggcctaacgcgcctatcctgatccaggatttcgaaaccctgccgagagaagccccggatctggtgctccagcgctgttgcagcggggaaggtctgcagatcccgactctgagcccggccccggactgcagtcagccgctggacgtgattttgctgctcgacggttcttcgtcattcccggcttcctacttcgatgagatgaaatcctttgccaaggccttcatttcgaaggcgaatatcgggccccggctcacccaagtgtccgtgctgcaatacggatccatcaccactatcgacgtcccctggaatgtcgtgcctgaaaaggctcacctgctgtcactggtggacgtgatgcagcgcgaggggggaccgtcccagatcggagacgctctgggattcgcagtcagatatttgacttccgagatgcacggggcaagaccgggagcatcaaaggccgtggtgatcctcgtgaccgacgtgagcgtcgactcagtcgatgctgcggccgacgctgctcgatccaatcgcgtgacggtgttcccgattgggatcggtgatcggtacgacgcggcccagctgcgaatcctcgccggaccggccggagactctaacgtggtcaaactgcagcgcatcgaggacctgccgactatggtgactctcggtaattccttcctccacaagctgtgttctggattcgtgcgcatctgcatggatgaggacggaaacgaaaagcgtccgggagacgtgtggactctgcctgaccaatgtcatactgtaacctgtcagccagatggacagactctgttgaaaagccaccgggtgaattgcgatagaggactgcggccatcgtgtccaaattcccagtcgcctgtgaaggtcgaggaaacctgcggatgtcgctggacctgcccgtgtgtgtgcactggatcgagcacccggcacattgtgacctttgatggacaaaactttaagctgactggcagctgctcatacgtgttgttccagaataaggaacaggatctcgaggtgattctgcataacggcgcctgtagccctggcgctcgccagggttgcatgaaatcaattgaagtcaagcactccgcgctctccgtcgagctccactccgacatggaggtcactgtgaatggaaggctcgtgtccgtcccctacgtgggaggaaatatggaggtgaacgtgtacggagcgatcatgcatgaagtgcgcttcaatcacctgggccacatcttcacttttacgccccagaacaacgaatttcagctgcagctcagccctaaaaccttcgcatccaagacttacggtctgtgtggcatctgcgatgagaacggagctaacgacttcatgctgcgcgacggaactgtgaccaccgattggaaaaccttggttcaggaatggaccgtgcagcgcccgggtcaaacttgccaaccaatcctggaagaacagtgtctggttccggacagctcccattgccaggtgctgctgctcccactgttcgctgaatgccataaggtgctggcaccggcaactttctacgccatttgtcagcaagactcgtgccaccaagaacaagtgtgcgaggtgatcgcatcctacgcccatttgtgcagaaccaatggagtgtgcgtggattggcgcaccccggatttctgtgccatgagctgcccaccatcacttgtgtacaaccattgcgaacatggatgcccgcggcactgcgacggcaatgtgtcctcctgcggcgatcatccctcagaaggatgcttctgcccgccggataaagtgatgctggaaggctcctgcgtgccagaagaagcgtgcactcagtgcatcggagaggatggagtgcagcaccagttccttgaggcctgggtgcctgatcatcagccgtgccagatctgcacctgcctgtcgggaagaaaggtgaactgcactacccagccatgtcccacggccaaggctccgacctgtggactgtgcgaagtggcgcgattgcgccaaaacgccgaccagtgctgtccagaatatgagtgcgtctgcgacccggtgtcctgcgatcttcctcctgtcccccactgcgagcgggggctgcagccaactctcaccaacccgggagagtgccgtccgaactttacctgcgcatgcaggaaagaggaatgcaaacgggtgtcgccaccttcctgcccaccacaccgcctgccgacccttcggaaaactcaatgttgtgatgagtatgaatgcgcgtgcaactgcgtgaattcgaccgtgtcatgtccgcttggatatctggcttcgaccgcgaccaatgactgtggctgtactactaccacttgtctgccggacaaggtgtgtgtgcataggtcgactatctacccggtgggacagttttgggaggaggggtgcgacgtgtgtacctgcaccgatatggaagatgccgtcatggggctgcgtgtggcgcagtgttcgcaaaagccgtgtgaagattcgtgtaggtcgggcttcacgtacgtcctccacgaaggagaatgctgcggacgctgcttgccgtcagcgtgcgaggtcgttaccgggagcccacgcggtgattcacaaagctcctggaagtcggtgggttcgcagtgggccagcccggaaaacccgtgcttgatcaacgagtgcgtcagagtcaaggaagaggtattcatccagcagcggaacgtctcctgcccgcagctggaagtccccgtttgcccctcgggattccagctgtcgtgcaagactagcgcttgctgcccttcctgcaggtgcgaacggatggaagcctgcatgctgaatggaactgtgataggaccgggaaaaaccgtgatgatcgacgtctgcactacttgcagatgcatggtccaggtcggggtgatctcagggttcaagctcgaatgcaggaaaaccacgtgcaatccgtgtccgctgggctataaggaagaaaacaacaccggagagtgctgcggaagatgcctgcctactgcttgcaccatccagcttcggggaggacagattatgaccctgaaacgggatgaaaccttgcaggacggatgcgatacccatttctgcaaggtgaacgagagaggggaatacttttgggaaaagcgcgtgactggttgtccaccattcgatgagcacaagtgcctcgcggagggtggaaagatcatgaagatccccggcacgtgttgcgacacttgtgaagagccagaatgcaatgatatcaccgcacgcctccagtacgtcaaggtggggtcttgcaagtccgaggtcgaagtggacatccactactgtcagggaaaatgcgccagcaaggccatgtactcgatcgacatcaacgacgtgcaagaccaatgctcctgctgttcccctacccgcactgagccgatgcaggtggcactccattgcaccaacggcagcgtcgtgtaccacgaagtgctgaatgcgatggagtgcaaatgcagcccaagaaagtgcagcaaa

SEQ ID NO: 21359 - DNA, 8439 bp, Artificial Sequence
  Description of Artificial Sequence: Synthetic coding sequence
atgattcctgcacgcttcgctggcgttctactagctttggcgctgattctgccaggcaccctctgcgccgagggcacccgtggcaggtcctccacagcccggtgctcattatttggctccgacttcgttaacacgtttgacggtagtatgtattccttcgctgggtattgctcatatctactagcaggaggctgccagaaaaggagcttcagcattattggagattttcagaatggcaaacgggtgagcctgtctgtctatctgggagagttcttcgatattcacctgttcgtgaatgggacggtaactcagggggaccagcgtgtctccatgccctatgcctccaaagggttgtacctggagaccgaggccggctactacaagctaagcggcgaggcctatgggttcgttgcaaggattgacggcagcgggaatttccaggtgctcttgtctgacagatatttcaacaagacctgcggcctctgcggaaatttcaacatttttgcggaagacgactttatgactcaagaaggaactctcacttcagatccatatgatttcgcgaattcttgggcactctcttctggagaacagtggtgcgagcgcgctagtcccccctcctctagttgcaacatctcttccggcgagatgcagaaaggcctttgggagcagtgtcagctgttgaaatctacttcagtgtttgcccggtgccacccacttgttgaccctgagcctttcgttgctttgtgcgagaaaacgttatgtgagtgtgcaggaggactggagtgtgcttgccctgccttgctggagtatgctcggacttgcgcccaggagggtatggtgttgtatggatggacagaccattcagcttgttctcccgtgtgtccggcggggatggagtatcgacagtgcgtgagtccgtgcgccagaacttgtcaatcactccatatcaacgagatgtgtcaggaaagatgcgttgacggatgtagctgtcctgaagggcagcttctggatgaaggcctgtgcgtggagagcacagagtgtccttgcgtccacagtgggaagagatatcctcccgggacctcattatcacgggattgcaacacctgtatttgccgcaattcccagtggatctgcagtaatgaggaatgcccaggcgaatgcttggttactggccagtcacacttcaagagcttcgacaatagatattttactttctcaggtatttgtcagtacctgttagctagggattgtcaagatcactccttttcaatcgtcatcgaaacggttcagtgcgcggatgaccgcgacgccgtatgtacgcgttccgtgactgttagactacccggtcttcacaactctctagtgaagctgaagcacggggccggcgtggctatggacggacaggatgttcaactccccctactgaaaggtgatcttagaatacagcacactgtcacagcgagcgtcaggttatcgtacggagaggatctccagatggactgggacggccggggtcgtctccttgttaagctgagccccgtgtatgccgggaaaacatgtggactgtgcggcaactacaatggaaaccaaggtgatgattttttgacgcctagcggccttgccgagcctagagtggaggatttcggcaacgcttggaaactgcacggcgattgtcaggacttgcagaagcaacacagtgatccttgcgcactgaacccacggatgacaagattttctgaagaggcttgtgctgtcctaaccagtcctacatttgaagcttgccatagagccgtatccccgttaccatatctgcggaactgccgatacgatgtttgttcctgttcggacggccgcgaatgtctgtgcggggcactggcctcttacgccgccgcatgcgcaggccgaggtgtacgtgtcgcgtggcgcgaaccgggacgctgtgagcttaattgtccaaaaggccaggtctatttgcaatgcggcactccctgtaacctaacttgccgcagcctctcataccccgacgaggagtgcaatgaagcttgtctcgaggggtgtttctgtccccccgggttatacatggacgaacgcggtgattgtgtgcccaaagctcagtgcccatgttactacgacggggagatcttccagcccgaggatatctttagtgaccaccatactatgtgctactgcgaggacggttttatgcattgcaccatgtccggggtgcctggcagcctgctgcccgacgctgtcctgtcgagtccgctgtcacaccgcagtaaacggtcactgtcctgtcggccaccaatggtaaagctagtatgtcccgccgacaacctccgcgccgagggtttagagtgcacaaagacttgtcagaactacgacctggaatgtatgagtatggggtgtgtatcagggtgtctgtgcccccctggaatggtgaggcacgagaataggtgtgttgcacttgagaggtgtccttgctttcatcaaggcaaggaatatgcgccaggagagaccgtgaagattggctgtaatacatgtgtgtgccaggaccgaaaatggaattgtacagaccatgtctgcgacgccacgtgcagcacaattggcatggcccactatctgacctttgacggcctgaagtatctgtttcccggcgagtgccagtacgtgctggttcaagactactgcggaagcaatccggggacctttcgcatactggtggggaataaaggttgcagtcatccttctgtgaagtgcaaaaaacgggttaccatactggtagagggcggggaaatcgagcttttcgatggagaagtgaacgtgaaacgccctatgaaggacgaaacacacttcgaggtcgtcgagtcgggacgatacattattctgctgttgggaaaggctctttcagtagtgtgggatagacatctttccatttcggtcgttctgaaacagacttatcaagaaaaggtttgtggattgtgcggtaacttcgacggcattcagaataatgatctgacctcctcaaacctgcaggttgaagaggatcctgtggattttggcaattcttggaaggtgagctcccagtgtgcggacacccgcaaagtccctctggatagcagccccgccacgtgtcacaacaatattatgaaacaaaccatggtagatagcagttgtaggattttaacaagtgacgtgttccaagattgcaataaactcgtcgatccagagccctacctagatgtgtgtatctatgatacttgtagctgcgaaagtatcggagactgtgcctgcttttgcgataccatcgcagcctacgctcatgtgtgcgctcagcatggcaaggtggtcacttggcggacagccaccctctgccctcaaagttgtgaagagagaaacctgagagagaacgggtacgaatgcgagtggcggtacaacagttgtgccccggcatgtcaggtcacgtgccagcaccccgaacccctagcgtgccctgtacagtgtgtagaaggttgccatgcccactgcccgcctgggaagattctcgacgagttgctccagacgtgtgtagacccagaggattgcccagtgtgcgaagtggccgggcgcaggttcgcctcggggaaaaaggtgacactgaacccgtctgaccctgaacactgccagatctgccattgcgacgttgtgaacctgacctgtgaggcctgccaggaaccaggagggctggtggtcccacctaccgatgcccctgtttctcctacgactctgtatgtggaggacattagcgaaccacccttacacgacttttactgttcacgcctcctggatttggtgttcctgttggatgggagttctaggctgtcagaggcggagttcgaagtcttaaaagccttcgtagtggacatgatggagcggttgcggattagccagaaatgggtgcgggtcgccgtggtagagtatcatgacggatcacacgcttatatcggcctgaaagatcggaaacgcccgtccgaattgcgtagaatcgcttcacaggtcaaatatgccggatctcaggttgcgagtacaagcgaagtactcaaatataccttgtttcagatcttttccaagatcgacaggcctgaggccagccgcattaccttgcttttgatggctagccaggagcctcagcggatgagccggaactttgtccgctatgtacaaggactgaaaaaaaagaaggtgatcgtaattcctgttggaataggccctcatgccaaccttaaacagattcgcctaatagaaaagcaggcgcccgaaaacaaggccttcgtattgtcctcggtggatgaactggaacagcaacgtgacgagatcgtatcctacctgtgtgaccttgctccagaagcccccccccctactcttccaccggacatggcacaggtcactgttggacccggtctgttgggcgtgtctaccctagggcccaagcgtaactcgatggtcctcgatgtggccttcgtgttagaagggagcgacaagattggagaggccgacttcaacaggtcaaaagaattcatggaggaggtgatccagcggatggatgtgggtcaagactccattcacgttacagttttgcagtactcgtacatggtcaccgtagagtaccccttctccgaagctcagagcaaaggagacattctgcagcgtgttcgcgagatccgttatcagggcggcaaccggacaaacacgggtctggccttaagatatctcagcgatcactctttcctcgtgtcacaaggagaccgggaacaggcccctaacctggtctacatggtgaccggaaatcccgctagcgacgagataaagaggctcccaggagacatccaggtcgtgcctattggcgtcgggcccaacgcaaacgtgcaagaactggagaggatcggatggcccaatgcccccatcctgattcaggactttgagacattgcctcgagaagcgcctgatttagtgctccagcgttgctgttccggcgaaggcctccagatcccaacactcagccctgctcccgactgtagtcagcctctcgacgttatcctcctgctggacggttcttccagtttccctgccagttatttcgatgaaatgaagtcattcgctaaggcatttatttccaaggctaatattgggcctcggctgactcaggtcagcgtcttgcagtatgggagcattacaacgattgacgtgccttggaatgtggttcccgaaaaggcccatttactcagtctggtggacgtcatgcagcgcgagggtggcccgtctcagataggggacgccctcggattcgccgtgcgctacctcacgagcgagatgcacggagcccgcccgggcgcgtcgaaagctgtcgttatactcgtgaccgacgtatcagtcgattccgtggacgcagctgctgatgcagctagaagtaatcgagtcacagtgttcccaattggcatcggtgaccggtacgacgccgctcagttgcgaatcctagctgggccggccggcgattctaatgtggtgaaacttcagcgcatcgaagacctgcccaccatggtcaccctgggaaactcatttttgcacaaactctgcagcggcttcgtgcgcatatgcatggacgaggacggcaatgagaagagaccaggagacgtgtggaccctgcccgatcagtgccacactgtgacctgtcagcctgacggacagacacttcttaagagccatagggttaattgcgatagggggctgagacccagctgccctaactcgcagagtccagtgaaggtcgaagagacatgtgggtgcagatggacttgcccctgtgtttgcaccggttcatcgactcggcatatagtgacgttcgatgggcaaaacttcaagctaaccgggtcatgttcatacgtgctcttccagaacaaggagcaggacctcgaggtgattcttcataatggtgcatgttcaccaggcgccaggcagggttgtatgaagtccatagaggtcaagcattctgcattgtccgtggagctgcactccgacatggaagtgaccgtgaatgggcgcctggtgtctgtgccttatgtcggcggcaatatggaagtgaacgtgtatggcgccataatgcatgaggtacggtttaatcacttggggcacatttttacatttacaccgcagaataatgaattccaactgcaactgtcacctaagacatttgcctccaagacttatggtttgtgtggtatttgtgacgagaacggcgccaacgatttcatgcttcgggacggcacagtgactactgattggaagacactggtgcaagaatggaccgtccagaggccaggccagacgtgccaacccatcctggaggaacagtgcctggtaccggatagctcccattgtcaggtgttgcttctgcccctatttgcggagtgtcacaaggtgctggctcccgcaactttttatgccatatgccaacaggacagctgccaccaggagcaggtgtgcgaggtgatcgcttcctatgcccatctgtgtcgcaccaatggagtttgcgtggattggcggaccccagatttttgcgccatgtcctgccctcccagccttgtctataatcattgtgagcatggatgccccaggcattgcgatggcaatgtgtcatcctgcggcgatcacccatccgagggctgcttctgccccccggataaggttatgctggagggttcatgcgtccctgaagaagcttgcacccagtgcatcggcgaggacggagtccagcaccagtttctggaggcatgggtgccagaccaccagccctgtcagatctgtacatgcctgagtggtagaaaggtcaattgtaccacgcaaccctgtcctacagcaaaagcccctacgtgcgggctatgtgaagtggcccggttacggcaaaacgcagaccaatgttgtccagagtacgaatgcgtgtgtgatcctgtgtcctgtgatcttcctcctgttccccactgcgaacgaggactccagccaaccttgactaacccaggtgagtgccgaccaaactttacttgcgcttgtaggaaggaggagtgtaagcgggtgtctccccccagctgtccaccccatagacttcccaccttgaggaaaacccagtgctgcgatgagtacgagtgtgcctgtaattgtgtgaactctacagtcagttgtcctctggggtatctggctagtaccgcaaccaatgactgtgggtgcacaactaccacgtgcctcccagataaggtgtgcgtgcaccgcagcaccatctaccccgtgggccagttctgggaggaaggttgcgatgtctgtacatgtactgacatggaggatgccgtcatgggactcagagttgcacaatgcagtcagaaaccctgtgaagattcttgtcgatccggttttacatacgttctgcatgaaggcgagtgctgcggccggtgtttgccttcagcctgcgaagtggttacagggagccccagaggagactcccaatcaagctggaagagcgtggggtcccagtgggcctcccctgagaacccctgcctgattaatgaatgtgttcgagtgaaagaggaagtttttatccaacagcgtaatgtctcttgcccccagttggaagtacccgtatgcccaagtgggttccagcttagctgcaagacctcagcttgttgtccgagctgtaggtgtgaacgtatggaagcgtgtatgcttaacgggacggtgatcggccctggcaaaaccgtcatgatagacgtctgtaccacatgtcgctgtatggtgcaggtaggggtgatatctggctttaagcttgaatgtcgcaagaccacttgcaatccatgcccgctggggtataaggaggagaataacaccggcgagtgctgtggtcggtgcctcccgacagcgtgtactattcagctgcgcggcggtcaaattatgacattgaaaagagacgagacactccaggacgggtgcgacacacacttctgcaaggtcaacgagcggggggagtatttctgggaaaagcgggtgacaggctgccccccattcgatgaacacaaatgcttggccgaaggtggaaagatcatgaaaataccagggacatgttgtgatacttgtgaagaacccgaatgcaatgatatcactgcaaggctgcagtacgtgaaggtggggtcttgtaagagcgaggtggaagtggatatccactactgccaggggaagtgtgccagcaaagccatgtactccattgatattaacgacgtgcaggaccagtgtagttgttgctcacccaccagaactgaacccatgcaagtggctctccactgcactaatggcagcgtggtttaccacgaggtgctgaacgccatggagtgcaaatgtagtccaagaaagtgctccaaa

SEQ ID NO: 21360 - DNA, 8439 bp, Artificial Sequence
  Description of Artificial Sequence: Synthetic coding sequence
atgattcctgcacgcttcgcaggtgtcctccttgcgctggccctgattctgcccggaaccctctgtgcagaaggtactcgcggacgctcctcgactgctagatgttccctgtttggtagcgacttcgtgaacacgttcgatggctctatgtactcgtttgcaggatactgttcctacctgctcgcagggggatgtcagaagcggtccttttccatcattggagattttcagaatggtaagcgagtgtcactttccgtgtaccttggagaattcttcgacattcatctcttcgtgaatggcaccgtgacccaaggggatcagagagtatcaatgccttacgccagcaagggactctaccttgaaactgaggcgggatactacaaacttagcggcgaggcctacggttttgtggcgaggatagatggatcgggaaatttccaagtgctgctttccgatcggtacttcaataagacctgtggactgtgtggtaactttaacattttcgcagaggatgactttatgactcaggaagggaccttgacctccgacccatacgattttgcaaactcgtgggcactttcgtccggtgagcagtggtgtgagcgggcttcacctccttccagctcgtgcaacatatcatcaggagagatgcaaaaaggcctgtgggaacaatgtcaactgctcaagtcgacttctgtgttcgcaagatgccacccactcgtcgatccagaaccttttgtggcgctttgtgaaaaaacgttgtgtgaatgcgcaggcggacttgaatgcgcctgtcctgccctgttggaatacgctagaacttgcgcacaagaaggaatggtgctctatggatggaccgaccattcggcttgttcgccggtctgtccagcaggtatggaatacagacaatgtgtgtcaccgtgtgcccggacttgtcaatctcttcacattaacgaaatgtgtcaagagagatgtgtcgatggatgttcatgcccagaaggtcagctgcttgatgaaggcctgtgtgtggaaagcactgaatgtccttgtgtccattcgggaaagagataccctcctggcacgagtctctcccgcgattgtaacacctgtatctgtcgcaactcccagtggatctgttcaaatgaagaatgcccaggagaatgcctggtgaccgggcagtcgcacttcaagtcctttgataacaggtactttaccttttcgggaatttgtcaataccttttggcccgcgactgtcaagatcattcattctccattgtcattgaaacggtccaatgtgcagatgatagagacgctgtgtgcactcgcagcgtgactgtgcggctgcctggtctgcataacagtctggttaagctgaaacatggagcaggagtcgcaatggacggacaagacgtgcaactccctctcctcaagggtgacctccggattcagcatactgtgaccgcatcggtgcgcctgtcgtacggcgaagatcttcagatggattgggacggcaggggacgacttcttgtcaagctgtcacctgtgtacgcaggtaagacctgcgggctgtgtggcaattacaacggaaatcaaggagacgatttcctgaccccctcaggtcttgcagagcctcgcgtggaagattttggcaatgcctggaagctgcatggtgattgtcaagatctgcaaaagcagcatagcgacccatgcgccctgaacccaaggatgacccgattttccgaagaagcctgcgcagtgctcacctcacctaccttcgaagcgtgtcatagggcagtgtctcctctcccttaccttcggaactgcagatacgatgtctgctcttgctcggatggacgcgaatgcctttgtggggcgttggcaagctacgcagccgcatgtgctggtcgcggtgtgcgggtcgcatggagggagcccggtaggtgcgaactgaactgtccaaaggggcaggtgtatcttcagtgtgggacgccttgcaacctcacgtgtcgcagcctctcgtaccctgacgaagagtgtaatgaagcctgtcttgagggctgcttctgtcccccaggactgtacatggatgaacggggagactgtgtgcctaaggcacaatgtccttgctactacgatggagagatttttcaacctgaggacattttctcggaccatcatacgatgtgttactgtgaggatgggtttatgcattgtaccatgtcgggagtgcctggctccctgctgccagacgccgtcctgtcctcgcctctgtcacacagatcaaaacggagcctttcgtgtagaccccccatggtgaaacttgtgtgtcccgcagacaatttgcgggcagagggtctggagtgcaccaagacctgccaaaactacgatctggagtgtatgtcaatgggttgtgtctccggctgcctgtgtcctccgggtatggtccgacatgaaaataggtgcgtggcacttgaacgctgcccgtgttttcatcaaggtaaggaatacgcacctggcgaaactgtgaaaattggatgcaacacctgtgtgtgccaggacagaaagtggaactgtactgatcacgtgtgtgacgctacgtgttcgaccatcggaatggcacattacctgacctttgacggactcaagtacctgtttccgggagaatgtcaatacgtcctggtgcaggactactgcggatccaatcccggaacttttcggattctcgtcggcaacaagggttgttcacatccttcggtaaaatgtaagaagcgggtcactatcttggttgaagggggagaaatcgaactttttgatggagaggtgaatgtaaagaggccaatgaaggatgaaacccactttgaggtggtggaatcaggtcgttatatcatcctcctgctcggcaaagcgctttcagtcgtgtgggatagacacctctccatttcagtggtcctgaaacaaacctaccaggagaaggtgtgcggactgtgcggaaatttcgacggaatccagaataatgatctcacttcctcaaatcttcaggtggaggaggaccctgtcgatttcgggaactcctggaaagtgtcctcacaatgcgcagatactaggaaagtgcccctggactcctcgcctgcaacctgccacaacaacatcatgaagcagaccatggtggatagtagctgtaggatcctgacctccgatgtctttcaagattgcaataaacttgtggatcctgaaccataccttgatgtgtgtatttacgacacctgctcgtgtgaaagcataggtgattgtgcatgtttttgcgataccattgcggcatacgcacatgtatgcgctcaacacggtaaagtggtgacctggcgaactgcgaccctgtgcccgcaatcctgcgaagagaggaatctgcgagaaaatgggtacgaatgtgaatggcggtataactcctgtgcccctgcatgccaagtcacttgtcagcatccagaaccactggcctgtccagtgcagtgtgtcgaaggatgccacgcacattgtcccccaggcaagatactggacgagctgcttcaaacttgcgtcgaccctgaagattgtccggtctgtgaggtcgcaggccggcggtttgcatctgggaagaaagtgaccctgaacccctccgatccagagcattgtcaaatttgtcattgtgatgttgtgaatctgacttgtgaagcgtgtcaggaacccggtggtcttgtggtgcctccgactgacgcacccgtctccccgactaccctgtacgtggaggacatttcagaaccgcctctgcacgacttttactgctcgcgactcctcgacctcgtctttctccttgatggaagcagcagactctcagaagcagaatttgaagtgctgaaagcatttgtggtcgatatgatggagagacttcgcatctcgcagaaatgggtgagagtagcagtggtggaataccacgatggatcacacgcttacattgggcttaaggatcggaagcgccctagcgagctgcgccgtatagcctcgcaggtgaagtacgcaggatcgcaggtcgcgtcgacctcggaagtccttaagtacacgttgtttcagatattctccaagatagatagaccagaagcctcccggataacccttcttcttatggcatcccaggaaccacagcgtatgtcccggaacttcgtcaggtacgtgcaaggccttaagaagaagaaggttatcgtgattccagtgggcattgggcctcatgcaaacctcaagcagattagactgattgagaagcaggctcccgaaaacaaggccttcgtgctgagctccgtggacgaacttgaacaacaacgcgacgaaattgtctcatacctttgcgatctcgcgcctgaggccccacctcccaccctcccgccagacatggctcaagttaccgtgggaccaggactgcttggagtgtcgactcttgggccaaagcggaactcgatggtgcttgatgtggcgttcgtgctcgagggatccgacaagatcggagaagcagactttaatcgcagcaaagaattcatggaagaggtgattcagcgcatggatgttgggcaggactcgatacacgtgaccgtccttcagtactcgtacatggttaccgtggagtacccttttagcgaggcacagtcgaaaggcgatattctgcaaagagtgcgggagatccgttaccaaggggggaaccgaactaacactggactcgcactgaggtacctttctgaccatagctttcttgtgtctcagggtgatcgtgaacaagcgccaaacttggtctacatggtcactggtaaccctgcatccgacgagattaagcgcctccctggtgacattcaggtggttcctattggcgtcggtcccaacgccaacgtccaggaacttgaacgcattggatggcctaacgcgccgattctgatacaagattttgaaacccttcctagagaggctccggatcttgtgcttcaaagatgctgttcaggggagggactgcagatccctactctgtccccagctcctgattgctcgcagccactggatgtgattctgcttcttgatggatcttcgagtttccctgccagctatttcgatgaaatgaaatcgtttgcgaaggcatttatcagcaaagcaaacattggtcctcgtctcacgcaagtctcggttctgcagtacggttccataactacgatcgatgttccgtggaacgtggtccctgagaaggcccatttgctgtcgcttgtcgacgtcatgcaacgcgaagggggaccgtcacagattggagatgcactgggatttgcggtgagatacctcacttcagaaatgcatggagccagacctggtgcaagcaaggcagtcgtgattcttgtcaccgacgtgtcggtggacagcgtcgatgcggcggctgacgcagcacggtctaaccgcgtgaccgtgtttcctattggcatcggtgatcggtatgatgcagcccaacttcgcattcttgcgggtcctgcaggagatagcaatgtcgtcaaacttcagagaattgaagatctccctaccatggtgaccctgggcaactcatttctgcataaactttgtagcggattcgtgcgtatctgcatggatgaggatggcaacgaaaaaagacctggagatgtgtggactcttcctgatcagtgccataccgtgacttgccagcctgacggtcagacgctgctcaagtcccaccgcgtcaactgcgacaggggactgcgcccctcgtgtcctaactcacaaagcccggtcaaggtggaggaaacttgcggttgccgatggacgtgcccttgtgtgtgcacgggatcgagcactcggcacatagtgacttttgatggtcaaaactttaagttgactgggtcctgttcatatgtgctgtttcagaacaaagagcaagacctcgaggtgatccttcataacggcgcgtgcagccctggggcaagacaaggatgtatgaagtccatcgaagtgaagcattccgctctgagcgtcgaacttcacagcgatatggaagtgaccgtgaatggcagacttgtctccgtgccatacgtgggtggtaacatggaggttaacgtgtacggagcaattatgcacgaggtgcgtttcaaccatctgggacacatctttacctttactcctcaaaacaatgaatttcagctccaactttcgcctaagactttcgccagcaagacctatggactttgtggcatctgcgacgaaaatggagccaacgatttcatgctgcgcgatggtaccgtgactactgactggaaaactctggtgcaagaatggactgtgcaacgccccggtcagacgtgtcagccaatactcgaagagcagtgtctggtgcccgatagctcgcactgccaggtcctgcttctcccgctttttgcagaatgccataaagtcctggcgcctgcgaccttttacgccatatgtcaacaggactcatgccatcaagaacaagtgtgcgaggtgatcgcatcctacgcacacctgtgtaggaccaacggtgtctgtgtcgactggagaacccccgatttttgcgcaatgtcgtgcccaccatcgctggtgtacaaccattgtgagcatggttgccctcggcattgtgatgggaacgtgagctcatgcggcgaccaccctagcgaaggatgtttctgtccacctgataaggtcatgcttgaaggaagctgtgttcccgaggaagcgtgtactcagtgtatcggtgaggacggtgtccaacatcaatttctcgaagcctgggtccctgatcaccaaccttgtcagatatgtacttgtctctcaggacgtaaagtgaattgcaccacgcaaccgtgtccaaccgccaaggcaccaacctgcggattgtgtgaagtggcgcggcttcgacagaacgcggatcagtgctgcccagaatacgaatgtgtgtgtgatcctgtcagctgcgatctcccccctgtccctcactgcgagaggggactccaaccaactcttaccaatccgggtgagtgtagacctaactttacctgcgcatgtcgcaaggaagaatgtaagcgcgtcagccctccatcatgtcctccacacagactgccgactctcagaaagacgcagtgttgtgacgagtacgaatgtgcatgtaattgtgtgaacagcactgtgtcttgtccactgggttacctggcctccactgcgaccaacgattgcggttgcacgactaccacctgtttgccagataaggtgtgtgtacatagatcgactatctaccctgtgggacaattctgggaggagggatgtgatgtgtgcacctgcaccgatatggaagatgcagtgatgggattgcgcgtcgcccaatgttcgcaaaagccttgcgaagattcgtgccggtcagggtttacctacgtgcttcacgagggcgaatgttgcggtcggtgccttccgtccgcttgtgaggtggtgactggatcgcccagaggcgattcccaatcttcttggaagagcgtgggctcgcaatgggcaagcccagaaaatccatgcctcattaatgaatgtgtgcgagtgaaggaggaagtattcatccaacagagaaacgtctcgtgtccacaactcgaagtgcccgtgtgtccatcaggatttcaactctcgtgtaagactagcgcatgctgcccgtcatgtcgctgcgagcgcatggaagcctgtatgttgaatggaactgtcattggcccaggaaagactgtgatgatcgatgtatgtaccacttgcagatgtatggtgcaggtgggcgtcatttccgggtttaaactcgagtgtcgaaaaaccacttgcaatccctgtcctctggggtacaaggaggaaaacaatactggagaatgttgtgggcgctgccttcctacggcctgtacgatccagcttcgcggaggtcaaatcatgactcttaagcgcgatgaaactcttcaagatggatgtgatactcacttctgtaaggtgaacgagagaggtgaatacttttgggaaaagagggtcactggatgtccaccattcgacgagcataagtgtcttgctgaaggagggaagattatgaaaatccctgggacctgttgcgatacctgtgaagaacctgaatgcaatgacattaccgctcgacttcagtatgtgaaggtggggtcatgtaaatcggaggttgaggtggatattcattactgtcaagggaagtgtgctagcaaagcgatgtactcgattgacattaatgatgtccaagaccaatgttcctgttgttctccaacccgtactgaacctatgcaagtggcactccattgcaccaatggttcggtcgtttaccatgaggtgttgaatgcaatggaatgtaagtgttcaccaagaaagtgtagcaag

SEQ ID NO: 21361 - DNA, 8439 bp, Artificial Sequence
  Description of Artificial Sequence: Synthetic coding sequence
atgatcccagctagatttgcaggcgttctgctcgccttagccctcattcttcctggcacattatgtgccgaggggacgcgcggaaggtcttctacagcaagatgttctctgtttgggagcgactttgtgaacacctttgatggctccatgtattcttttgcaggctactgcagctatctgcttgcagggggatgccagaaacgttcatttagcattattggcgatttccaaaatggcaagcgggtttctctgtccgtctacctgggagagttttttgacatccaccttttcgtgaacggaacagttactcagggggaccagagggtctctatgccttacgcaagtaagggactgtacctggaaacagaagctgggtattacaagctcagcggcgaagcatatggcttcgtggcacgcatcgacggaagtggcaacttccaggtactgctttcagaccggtattttaacaagacctgcggcctttgcgggaatttcaacatctttgccgaggatgatttcatgacccaggaaggaaccctcacttctgacccatacgactttgctaactcatgggcactttcgtctggagaacagtggtgtgaaagagcctcaccgcccagcagtagctgcaacataagctccggagagatgcagaaaggcttgtgggaacaatgtcagttgctgaagagcaccagcgtgttcgcacgatgtcatcccctcgtggacccggagccttttgttgctctttgtgagaagaccctgtgcgagtgcgcaggcgggttagaatgtgcctgccctgctctgttagaatacgccaggacctgcgctcaggagggaatggtgttgtacggctggaccgatcactccgcttgcagccctgtctgcccagctggcatggaatacagacagtgtgtaagcccctgtgcccgcacctgccaatcacttcacatcaatgaaatgtgccaggaaaggtgcgtggatggatgcagttgtcccgaaggacaactcctagatgaaggtctatgcgtcgagagtaccgagtgtccatgcgtgcactctggcaagcgctatccccctggcacatccctcagtcgtgactgcaacacatgcatttgtagaaactcacagtggatttgtagcaacgaggaatgccctggagagtgcttggtcacaggtcaatctcatttcaagagtttcgacaacagatactttactttcagcgggatatgtcaatacctgttggcccgtgattgccaggaccattcatttagcatcgtgatcgaaaccgtccagtgcgccgacgatagggacgcggtgtgcacgaggtctgttaccgttaggctcccaggactgcacaacagcctcgtaaagctgaagcacggagctggagttgccatggatggtcaggatgtgcaactgccactgcttaagggcgacctgagaattcaacacacagtgaccgctagcgttagacttagctacggcgaggatctgcaaatggactgggatggacgaggaaggctgctggttaagctgagtcccgtttacgcgggaaaaacgtgcggattatgtgggaattacaacggtaaccagggagacgatttcctgacccctagcggcctggctgagccgagggtcgaggactttggcaacgcttggaaactccacggcgactgccaagacctccagaaacaacatagtgacccttgtgcgctcaatccaagaatgacccgcttctcagaagaggcgtgcgcagtgttgaccagcccgacttttgaggcttgtcatcgggctgtaagtcctcttccttatttgcggaactgccgctatgatgtttgcagctgtagcgatggccgcgagtgtctctgcggggctttggcaagctacgccgcagcatgtgcgggaaggggtgtaagagttgcctggcgcgagcctggaagatgtgaacttaactgccctaaaggacaagtttacctgcagtgcggtacaccttgtaacctgacatgccgtagcctgtcttacccggacgaagaatgcaatgaggcttgcttggagggctgtttctgcccccccgggctttacatggatgagaggggcgactgtgtgccaaaagcccagtgcccttgctactatgatggcgagatcttccagccagaggatatcttttccgatcaccacacaatgtgctattgcgaggacggctttatgcactgcaccatgtcaggagtgcccgggtccctgctgcccgatgcagtcctttctagccctcttagccaccgcagtaagcgctccctgagctgcaggcctcccatggtcaaactggtctgccccgcagataatttaagagcagagggactcgaatgtacaaagacatgccaaaactatgaccttgagtgcatgagcatgggctgcgtctcaggctgcctgtgcccccctggaatggttcgacatgaaaaccggtgcgtagcactggaaagatgcccttgctttcaccagggaaaagaatacgcacctggcgagaccgtgaaaattggatgcaacacctgtgtgtgtcaagatagaaagtggaactgcaccgatcacgtctgcgatgccacatgctctaccatcggaatggcacattacctgacttttgatggattgaaatacctgttcccaggagagtgtcaatacgtactggtgcaagactattgcggaagcaatcccggcacctttcgtatcctcgtgggcaataaaggttgcagtcatccatccgtgaagtgtaaaaagcgcgtcactattctggttgagggaggggaaatcgagctttttgatggagaggtgaacgtgaaaaggccaatgaaggatgagacacattttgaggtggtggagagcggacggtatattatcctccttctgggcaaggctttgagcgtggtttgggatcggcacttgtcaatcagtgtcgtgctgaaacagacttatcaggagaaagtttgcggcctttgcggcaattttgatggcatacaaaacaatgacctcacatcttccaacttgcaagttgaggaagaccctgtggatttcggcaattcctggaaagtctcatcccagtgtgctgatacacggaaagtgccactggatagtagcccagctacctgtcacaacaacataatgaagcagacaatggtggattcctcgtgtcgcattctcaccagcgatgtctttcaggattgcaataaattggtagaccccgaaccctatcttgacgtctgtatctatgatacctgcagctgcgaaagcatcggagattgtgcttgtttttgcgataccatcgctgcttatgcacacgtatgcgcccagcatgggaaggtggtgacatggaggactgcgacactgtgtccccagtcttgtgaggaaaggaatctcagagaaaacggttatgaatgtgagtggcgctacaattcatgcgccccggcctgccaggtgacctgccaacacccagagccgctggcatgcccggttcagtgtgttgaaggatgccatgcacattgccctcctggcaagattctcgacgagctgctccagacatgcgtagatccagaggattgcccagtctgcgaggtggctggcagaaggtttgcctcagggaagaaggttacactcaatccaagcgaccctgaacattgccagatttgccactgtgatgtggtgaatctgacatgcgaggcttgtcaggaaccgggcggactggtcgttccgccaacagatgccccagtctcccctaccaccctgtacgtggaagacatcagcgagccacctctccatgacttctactgtagtaggctgctggatctggtcttccttctggacgggagtagccgcctcagcgaagcggaattcgaggtccttaaggccttcgtggtggatatgatggagagactcagaatcagccagaagtgggtcagggtagccgtcgttgagtatcacgacggatcacatgcgtacatcggcctaaaggacagaaaacgacccagtgagctgcgaagaatcgcgagccaagtcaagtacgctggctcgcaagttgcttctacgtccgaggtcctcaaatatacactctttcagattttttcaaaaattgacaggccagaggcttctaggatcacactactgctcatggctagccaagagcctcaaagaatgagcaggaatttcgtgcgctatgttcagggtcttaagaaaaagaaggtcatcgttattcccgttgggatcggcccacatgctaacctcaagcagatacggctgattgagaagcaggcgccggaaaacaaagccttcgttcttagctccgtcgacgaactggaacaacagagggatgagatcgtgagctatctttgtgatcttgccccagaggctccccctccaacacttccgcccgatatggcacaggtgactgttggcccaggactcctgggtgtctccaccctcggccctaagcgaaactcaatggtcctggatgtagccttcgttctggaaggctctgataaaatcggtgaggctgacttcaaccgctccaaagagttcatggaagaggtcattcaaaggatggatgtgggccaggattctattcatgtgacggttttacaatacagctatatggtcaccgtcgagtatcctttctcggaagcacaaagcaaaggggacatcctacagcgggtaagggaaattcgctatcaagggggaaatcgcacgaacaccggattagccctacggtatttaagcgaccactcgttcttagttagccagggtgaccgcgagcaggctcctaatcttgtatacatggtgaccggaaatccagccagcgatgagatcaaaagactgcccggggatattcaagtggtgccaattggcgtaggacccaatgctaatgtgcaggaactggaaaggatcggatggcctaatgctcccatcctgatccaagatttcgaaacacttcccagggaggcgcccgacttagtcctgcaacgctgctgcagtggggaaggcctgcagatccccaccctttcccctgcacctgactgttctcagcctttggatgtgatcctgttgttggatggttcaagcagttttcctgccagctactttgacgagatgaaatcgttcgctaaggcatttatctctaaggcgaacatcggtccaaggctgactcaggtatccgttctccaatatgggtcaattacgacaatcgacgtgccctggaatgtcgtccctgaaaaagctcaccttttgagtttggtcgatgtgatgcaacgagaggggggcccttcccagatcggggacgctttaggattcgctgtaaggtacttgacaagcgaaatgcacggggcgagaccaggagcgtccaaggccgtggttatactggtgaccgatgtctccgttgattctgttgacgccgccgctgatgccgcgcggtccaacagggtcacagtattcccaatcggcatcggagatagatatgacgcagcacaactcaggatccttgccggaccagccggagactctaatgtcgtgaagctacaacgcattgaggatctccccaccatggtcacactagggaactctttcctccacaaactgtgttctggcttcgtcaggatttgtatggatgaagatggtaatgagaagaggcccggcgacgtctggacactgcctgaccagtgtcacacggtcacctgtcagcctgacggtcaaaccctcctgaaatcacatcgggtgaactgcgatagaggattgagaccctcctgccctaactctcaaagcccggtgaaggtggaagaaacttgcggttgtagatggacttgcccttgtgtgtgtacaggctccagtactagacacatcgtgactttcgacggtcagaattttaagctgacaggaagctgttcttacgtcctgttccaaaacaaggaacaggacctggaagtgatcttgcataatggggcatgttctccaggcgccagacagggctgcatgaaatccatcgaagtaaaacactcagccctgagcgttgagctgcatagcgatatggaggttaccgtcaacggcagactcgtcagcgtcccttacgtcggaggcaacatggaagtgaacgtgtatggggctatcatgcacgaggtgcggttcaaccatcttggccatattttcacgtttaccccacagaacaatgagtttcagttgcagctgagtcctaaaacctttgccagcaagacctacggtttgtgcgggatctgcgatgagaatggcgcaaacgattttatgctcagggacggcactgttaccacggattggaaaacattggtgcaagagtggaccgtgcagaggcctggccagacatgccagcccatcctggaggaacagtgccttgtgcctgacagcagccactgccaggttttgctgctgccgctgtttgcagaatgccacaaagttctcgctccagcaacattttatgctatctgtcagcaggatagctgccatcaggagcaagtctgtgaggtcatagcttcttatgcacatctgtgcagaactaatggcgtctgtgtggactggaggactccagacttctgcgctatgagttgcccccccagcctcgtatataatcattgtgagcatgggtgtcccaggcattgtgatggcaacgtgtcttcgtgcggggaccacccctcagagggctgcttttgtcctcctgataaggtaatgctggaaggatcctgcgttcctgaggaggcatgtacccaatgcatcggcgaggacggggttcaacatcagtttctggaagcgtgggtaccggaccaccagccctgccagatttgtacatgcctgagcgggaggaaagtgaactgtaccacacagccatgtcccacagctaaagcacctacctgcggcctctgcgaagtagcaagactgaggcaaaacgccgatcagtgctgtcctgagtacgagtgcgtctgcgacccggtgtcttgtgatctcccacccgtgcctcattgcgaacgcggactccagccaaccctgactaatcctggggaatgtcgccccaactttacatgcgcatgccgcaaagaagaatgcaagagggtgtcaccaccaagctgccctccccatcggttgccaacactgcgcaaaacacagtgttgcgatgaatacgagtgtgcatgcaactgcgtgaactctaccgtctcttgcccccttgggtatttggcaagcacggcaactaatgactgcgggtgcactaccacgacttgtctgcctgataaggtctgcgtgcataggtctactatctaccctgtggggcaattctgggaggaaggctgcgatgtttgcacatgtactgacatggaagacgccgtgatgggacttagagtcgctcaatgtagtcaaaagccctgcgaagattcatgccgcagcggcttcacctacgttcttcacgagggtgagtgttgcggaaggtgcctgcccagtgcatgcgaagtggtgacaggtagtccccgcggagattcacaaagctcctggaagagcgtgggctcccaatgggcctctccagaaaacccctgcctcatcaatgagtgtgtcagagtgaaggaggaagtattcatacagcagcgcaatgtgtcatgtccccaactggaagtccctgtttgccccagcgggttccaactcagttgtaaaacttctgcctgctgcccaagctgtaggtgcgaaaggatggaagcgtgtatgcttaacggcacggtgatcgggccaggtaaaactgtcatgatcgacgtgtgcacgacctgcaggtgcatggtacaggtgggagtgatatcaggattcaagctggaatgcaggaagactacatgcaatccttgtcctctcgggtataaggaagaaaacaatacaggagagtgctgcggacggtgtctccctacagcttgcactatccagttaaggggaggtcaaattatgacactgaagcgtgacgagacattgcaggacggctgtgacacacatttctgcaaggtcaatgaaaggggtgagtacttctgggaaaagagggtcacaggctgccctccatttgatgaacataagtgtctggccgaaggcggaaaaattatgaagatccctggtacctgttgcgacacttgcgaagaacctgagtgtaacgatatcaccgcccggctccaatacgtcaaagtgggcagctgcaagagcgaagtggaagttgacatccattactgccaagggaagtgcgcttccaaagcaatgtactcaatcgacatcaatgacgtgcaagaccaatgctcctgctgttcgccgacacgaaccgagccgatgcaggtggctttgcactgcaccaacggcagtgttgtctaccacgaagtgctgaacgcaatggagtgcaaatgcagtcctagaaagtgtagcaaa

SEQ ID NO: 21362 - DNA, 8439 bp, Artificial Sequence; identical to SEQ ID NO: 21303
  Description of Artificial Sequence: Synthetic coding sequence

SEQ ID NO: 21363 - DNA, 8439 bp, Artificial Sequence
  Description of Artificial Sequence: Synthetic coding sequence
atgatccctgcgcggtttgccggagtgctgctcgcccttgctctgatactgcccggaacgctgtgcgctgagggaaccagaggtcggtcgagcaccgcccggtgttcgctttttggatcggactttgtgaacaccttcgacggctccatgtactcctttgcgggctactgttcgtacctcctggcgggcggatgccagaaacggagcttctccattattggtgattttcagaacggaaagcgcgtctctctgtcggtctaccttggagaattctttgatattcatcttttcgttaacggaactgtaactcagggagatcaaagggtgtcgatgccgtacgcatccaaaggactttacttggaaactgaggcaggctactacaagttgagcggagaagcgtacggattcgtcgctagaatcgacggctcgggaaacttccaagtgctgctgtcagatagatactttaacaagacctgtggcctgtgtggcaactttaacatatttgccgaagatgactttatgactcaagagggaaccctgacctcagatccttacgacttcgcaaacagctgggcactttcctccggggaacagtggtgcgaaagggcgtcgcccccatctagtagctgtaacatcagctccggtgaaatgcaaaaaggactgtgggagcagtgtcagctgctgaagtcgacgtcagtgtttgcacggtgtcatcctctcgtcgatcccgaaccgtttgtcgcgctgtgcgaaaagactctttgtgagtgcgccggaggactggaatgtgcttgtcctgcgctgcttgagtacgcacgcacttgtgcccaagagggaatggtgctttacggctggactgaccattccgcatgttcgcctgtgtgtccagctggaatggaataccggcaatgtgtcagcccatgcgcgaggacgtgtcagtcccttcacatcaatgagatgtgtcaagaacgctgtgtcgatggatgcagctgtcctgaaggacaactccttgacgaaggcctttgcgtggagagcacggagtgtccatgtgtgcactcagggaaacgctaccctcccggtacctcgctcagccgcgattgtaacacgtgcatttgcagaaattcccagtggatctgttcgaatgaagaatgccccggtgaatgcctggtgactggacaatcgcactttaagtcctttgataaccgctactttactttctccggtatatgccagtaccttctggcgagggattgccaagatcactcatttagcattgtgatcgaaaccgtacaatgtgcagatgatcgggacgccgtgtgcacccgttcggtgaccgtacgactccccggactccataactcgctggtcaagttgaagcatggagcaggggtggcaatggacggacaggacgtccaactcccacttcttaagggggatctgagaattcagcataccgtgaccgcatctgtcagactttcatacggagaagatctgcagatggattgggatgggagagggcggctccttgttaaactttcgcctgtgtacgcaggtaagacctgtggactttgtggcaattacaatggcaatcaaggtgacgattttctgactccttcgggtctggccgagccaagagtggaagatttcggcaatgcctggaaacttcatggagactgtcaggatcttcaaaagcaacattccgacccatgtgcactcaaccccagaatgacccgctttagcgaagaagcctgtgctgtcctgactagcccaacctttgaggcatgtcatcgggcggtgagcccactgccctacctgagaaactgtcgctacgatgtctgttcatgttcggatggccgtgaatgcctgtgtggcgcactcgcatcgtacgcagcagcatgcgccggaaggggagtgagagtggcatggcgtgagccagggcgatgcgaactcaactgtccgaaaggacaggtgtaccttcaatgtggaaccccttgtaatcttacttgtcggtcgcttagctatcctgatgaagagtgcaacgaagcctgtcttgagggatgtttctgtccacctggactttacatggacgaacgcggtgactgcgtgcctaaagcacagtgcccatgttactacgacggtgaaatcttccaacctgaagatatctttagcgatcatcatactatgtgttactgtgaagatggctttatgcattgcaccatgtcgggtgtcccaggatcgctcctgccggatgcggtcctgtcatcgcctctgtcccataggtccaagagatccctgagttgcaggccaccgatggtcaagttggtgtgtccagccgataacctgagggcagaaggacttgaatgcaccaagacgtgtcagaattacgatctggagtgcatgtcgatgggatgcgtgagcggatgcctgtgcccgcctggtatggttcgtcatgagaacaggtgtgtcgctctggaaagatgcccttgttttcaccaaggaaaggaatacgctccaggagagactgtgaagatcggctgcaatacttgtgtctgtcaagatcggaagtggaactgcaccgatcacgtgtgtgatgcaacttgttcgaccattggcatggcccattacctgacttttgatggcctgaagtacttgtttccgggtgagtgccagtatgtgcttgttcaggactactgtggatctaaccccggaacgtttcgaatcctggttggtaacaagggttgctcgcaccctagcgtgaaatgtaagaaaagagtgactatcctggtcgaaggaggagagattgaactttttgatggcgaagtaaacgtgaagcggccaatgaaggatgaaacccatttcgaagtggtggaatccgggcgttacataattctgttgcttgggaaggcactttcggtcgtctgggatcggcacctttccatttcagtggtccttaaacagacctaccaagaaaaggtgtgcgggctttgtggtaactttgatggcattcagaataacgatctgactagctcaaacctccaggtggaggaggaccctgtcgatttcggaaactcgtggaaagtgtcctcgcagtgtgcagatactcgcaaggtgccccttgactcatcccctgccacctgtcataacaacattatgaaacagaccatggtggattcgtcatgcagaatccttacttccgatgtgttccaagattgtaacaagctcgttgatcccgaaccctacttggacgtgtgtatttacgacacttgttcctgtgaatcaattggagattgtgcatgtttctgcgataccattgccgcctacgcacatgtgtgtgcacaacatgggaaagtggtaacttggcgcactgcaaccctttgtccacaatcctgtgaggaacgcaacctgagagaaaatggatacgaatgtgaatggagatacaattcgtgcgcacctgcctgtcaagtcacctgccagcaccccgagcccctggcttgcccagtccaatgtgtcgaggggtgtcatgctcattgtccccctggaaagattcttgacgaacttctccaaacctgcgtcgatcctgaggattgtcctgtgtgtgaggtggccgggagaaggtttgccagcggaaagaaagtcaccctcaacccaagcgacccggaacattgtcaaatttgccactgtgacgtggtgaatttgacgtgcgaagcatgccaagaaccaggaggacttgtggtgccacccactgacgcacctgtttctcccactaccctgtacgtggaagatatttccgaacctcccctgcatgatttctactgctcccggctcctggatcttgtgtttctgctggacggttcgtcgcgcctttcagaagcagaatttgaggtgctgaaggcctttgttgtggacatgatggaaagactgcgtatctcccaaaagtgggtgagggtggcagtggtggaataccacgacggtagccacgcctacattgggcttaaagatcgtaagcggccttcggagctgcgtcgaatcgcatcgcaggtcaaatacgcagggagccaagtggcatcgacctccgaagtcctgaaatacaccctgtttcagatattcagtaagattgaccggcccgaggcatccagaattactctgctcctcatggcatcccaagaaccgcagagaatgtcgagaaacttcgttagatacgtccagggattgaaaaagaagaaggtcattgtgatccccgtgggcattggaccacatgcaaacctgaagcaaattcgactgatcgaaaagcaagcaccagagaataaggcattcgtgctcagctcagtggacgaacttgagcagcaacgggacgagatcgtgtcctatttgtgcgacctcgcaccagaggcccctcctcctacccttcctcccgacatggcacaggtcactgtgggtccaggccttcttggtgtctccacccttggaccaaagagaaattcgatggtgctggatgtcgcatttgttctggaagggagcgacaaaatcggcgaagcggatttcaatcggagcaaggagttcatggaagaagtcattcaacgcatggatgtgggccaagattctattcatgtgacggttctgcaatactcgtacatggtgacggtggaataccccttttcagaggcacaaagcaagggtgacatactccaaagggtgcgcgagattcgctatcaaggtggaaaccgcaccaataccggtctggcactccggtacttgagcgatcactcctttctggtcagccagggagatcgggaacaggccccaaacctcgtgtatatggtgactggaaacccagcatccgatgagattaagcgcttgcctggcgatatacaagtggtgccaatcggagtcggtccaaatgcaaacgtgcaggagctggaacgcattggatggccaaacgctcctatattgatccaagatttcgaaactctgcccagagaagcacctgatctcgtgcttcagcgatgttgtagcggtgaaggcctgcagattccgactctgtcacctgcacctgattgttcacaaccactcgacgtcatactgctcctggacggcagctcgtcgtttcctgcgagctactttgacgaaatgaagagttttgcaaaggcatttatctccaaagccaatataggaccacgactcactcaggtgtcggtcctccagtacggatcaatcaccacgatcgatgtcccatggaacgtggtccctgaaaaggcgcatctgttgtccctcgtggatgtgatgcagagagagggaggtccttcgcagattggagacgcacttggattcgcggtgcggtacctgacgagcgaaatgcacggagcccgtcctggtgcgtcgaaggccgtcgtgattttggtgactgacgtgtccgtggactctgtcgatgcagccgcggatgcagcccgctctaaccgtgtcacggtgttcccaattggaattggggacaggtacgatgcggcgcaattgagaatcctggcaggaccagcaggtgatagcaacgtcgtgaaactgcaaaggatcgaggaccttccaacgatggtgaccctcggaaactcatttttgcacaaattgtgttcgggattcgtgcgcatctgtatggacgaagatggcaatgaaaagcgccccggcgatgtttggactctgcccgaccaatgtcataccgttacctgtcaacctgatggtcagaccctgctgaaaagccaccgcgtgaactgtgatcgagggttgcgcccgtcctgtcccaactcgcaatctcctgtgaaggttgaggaaacctgcggttgtaggtggacctgcccatgtgtgtgtaccggctcgtccacgaggcatattgtcacttttgacgggcagaatttcaaacttacgggatcatgttcgtacgtgctttttcagaataaagaacaagatctggaagtgatcctgcacaacggcgcatgtagcccaggtgcacgccagggttgcatgaagtcgatcgaagtgaagcactcggcactgtccgtcgaactccattcggatatggaagttaccgtgaacggaaggttggtttccgtgccttacgtgggtgggaacatggaggtcaacgtctatggagccattatgcacgaagtgagattcaatcatctgggccatatcttcacctttacgccccaaaacaatgaatttcaactgcagctgagcccaaagacttttgcctcaaagacgtacgggctttgcggtatttgcgacgagaatggagccaacgactttatgcttagggatggaactgtgacgactgattggaaaacccttgtgcaggagtggactgtccaaagaccgggtcagacttgtcaacccattctggaggagcaatgtctggtgcctgatagctcgcattgtcaggtccttctgctgccactctttgcagagtgccacaaggtcctggccccagccactttctacgccatctgccagcaagattcctgccatcaggagcaggtgtgcgaggtgatcgcgtcctacgcgcacctgtgcagaactaacggtgtgtgtgtcgattggcgcaccccagatttttgtgcgatgtcgtgtcctcctagccttgtgtacaatcattgcgaacatggttgtccccgccactgcgacgggaacgtgagctcctgcggcgaccacccgagcgaaggatgtttttgccctcccgacaaggtgatgctcgaaggatcgtgcgtgcccgaagaagcatgcactcagtgcataggcgaggacggcgtccaacaccaattcctggaggcatgggtccctgatcatcaaccctgccagatttgtacttgtctgagcggtcgaaaggtgaactgtactacccaaccttgtccaactgctaaagcccctacttgtggcttgtgtgaagtggcgagattgcggcaaaatgcagatcaatgctgtccggagtacgaatgtgtgtgtgatccagtgtcctgcgatttgcctcctgttcctcattgcgagcgaggccttcaacctactctgaccaatcctggggaatgccgtccaaatttcacctgtgcatgtaggaaagaagaatgtaagagagtgtcgcctccatcctgtcctcctcaccgccttcctacccttagaaagacgcagtgctgtgatgaatacgaatgtgcgtgcaactgtgtgaactcgaccgtgtcctgtcccctgggttacctcgcgtctacggccaccaatgattgtggctgcaccactactacttgtctgcccgataaggtctgtgtccacagaagcactatctacccagtgggtcaattttgggaagaggggtgtgatgtgtgtacctgtaccgacatggaagatgcggttatgggactccgggtggcacagtgctcgcaaaagccatgtgaagattcatgccggagcggatttacctacgtgctccatgagggagaatgctgtgggcggtgtctcccctcggcatgtgaagttgtgaccggcagccctagaggcgattcccaaagctcctggaagtctgtgggaagccaatgggcatccccagagaacccttgcctgataaacgaatgtgtgcgtgtcaaagaggaagtgtttatccagcagcgcaatgtctcgtgtccgcagctggaggtgccagtgtgcccgtcaggatttcaactttcttgcaagacctcggcatgttgtccttcctgtcgatgcgagcgaatggaagcctgtatgctgaacggaactgtgattggacccggcaaaaccgtaatgatcgatgtctgtaccacctgtcgttgtatggtgcaggtgggagtgatttccggtttcaagttggagtgtagaaagactacctgtaacccttgcccactcggatataaggaagagaacaacactggtgagtgttgcggccgttgtctccccaccgcctgtaccattcaacttcgcggaggtcaaatcatgactctgaagcgcgacgaaactcttcaggatggttgtgatacgcacttttgcaaggttaatgaacgtggagaatacttctgggaaaagagggttaccgggtgtccgccctttgatgaacacaaatgtctggccgaaggaggtaagatcatgaaaatccccggaacttgctgtgatacctgcgaagaaccagaatgtaatgacatcaccgcccggctccaatacgttaaggtgggctcgtgcaagtccgaagtggaagtggacattcattattgtcaaggcaagtgtgcctctaaagcaatgtactcgatcgacattaacgatgtgcaggaccaatgctcgtgctgttccccaacccggactgagcccatgcaggtcgccctgcattgtaccaatggttcggtcgtctaccacgaggtcctcaatgccatggagtgtaaatgttcgcctcgcaagtgttcgaag

SEQ ID NO: 21364 - DNA, 8439 bp, Artificial Sequence
  Description of Artificial Sequence: Synthetic coding sequence
atgatcccagcccgattcgctggggtgctgctggccctggctttgatccttcccggtaccttgtgcgccgaggggacccgcggtcggagttccaccgcccggtgcagcttgttcgggtctgacttcgtgaataccttcgatggttcgatgtattccttcgctggctactgctcatatctgctcgctggtgggtgtcagaaacgcagcttttccatcataggtgactttcagaatgggaagcgggtgtccctgtctgtgtatctcggagagttctttgatatacatctttttgtgaacggaacggtgacacagggcgatcagcgggtatctatgccttacgcctccaaggggctgtaccttgagaccgaggccggttattacaagttatccggggaggcatacggctttgtggcgaggatcgacgggtcgggaaacttccaagtactgctgagcgatcgctacttcaataagacctgcggcctgtgcgggaacttcaatatctttgcagaggatgactttatgacacaagaagggacactgacatctgacccatacgattttgctaacagctgggcgctcagctccggcgaacagtggtgtgagagggcctcccctccttcttcctcttgtaacatttcgtctggagagatgcaaaagggactgtgggaacagtgccagctactgaagtctacttcggtgttcgcccggtgtcatcccttagttgaccccgaaccttttgtggctttgtgcgagaagaccctttgcgagtgtgctggggggctggaatgcgcctgtcccgcgttactagagtacgcccgaacctgcgcacaggaggggatggtcctctacggctggaccgaccacagtgcctgctctcctgtctgtcccgcgggcatggaatataggcagtgcgtctctccctgtgctcgtacctgtcagtccctgcacattaatgaaatgtgccaggagcggtgtgtagatggctgttcatgcccggaagggcagcttcttgatgaggggttgtgtgtggaaagcaccgagtgcccttgtgtgcattccggtaaacggtatccgccgggaacttctctatcccgggattgcaacacctgcatttgccgtaatagtcaatggatttgttccaatgaagaatgccctggcgaatgcctggttactggacagagtcacttcaagtcatttgataatcgatacttcacatttagcggcatttgccagtatctgctggctcgcgattgtcaggaccacagtttctcaatagtgatcgagacagtgcaatgcgccgatgacagagatgccgtatgcactaggtctgttaccgtgcggcttcctggactccacaactccctggtgaagttgaaacacggcgctggagttgccatggacggtcaggacgtacagctgccactgctcaaaggcgatctgagaattcaacatacagtgactgcctcagtccggttgagttacggagaagacttgcagatggattgggacggacgcggaaggctgttggtaaaattgtcgccagtgtatgccgggaagacgtgtggcctgtgcgggaattacaatggaaatcagggcgatgacttcctgacacctagcggattggcagaaccgagggtggaggatttcggaaacgcttggaaactgcatggcgattgtcaggatctgcagaagcagcacagtgacccctgcgccttaaatccccgcatgaccaggtttagtgaagaagcatgcgccgttctcactagccctacattcgaagcgtgtcaccgtgccgttagtcccctgccttatctgcggaactgtagatatgacgtctgtagctgcagtgatgggcgtgaatgcttgtgtggcgctctcgcctcgtatgccgctgcttgtgccggccggggggtcagggtagcatggagggagcctgggcgctgcgagcttaactgtcctaaaggccaagtgtacctccagtgcggcactccgtgcaatctgacttgccgaagcctatcttatccagacgaggagtgtaatgaagcgtgcctggagggatgtttttgtcctcccggactatacatggatgagagaggagattgtgtgcctaaagcgcaatgcccctgctactatgacggtgaaatttttcagccagaggatatttttagcgaccaccataccatgtgttattgtgaggacggtttcatgcactgcaccatgtcaggcgtacccggcagtctcttgcccgacgctgtgctgtcctcccccctgtcccatagatctaagagatccctgtcctgtcgtccacccatggtgaagctggtatgtccggccgacaatttgagggccgaaggtctggaatgcactaaaacctgccagaactacgacctggaatgcatgtcaatgggttgcgtgtctgggtgtttatgtccccccggcatggtaagacacgagaacagatgtgtggctctcgaacgttgtccttgtttccaccagggcaaggaatacgcccccggcgaaaccgttaagattgggtgcaacacctgcgtgtgccaggatcgcaaatggaactgtacagaccatgtttgcgacgctacttgctctaccatcggaatggcacattacctgacgtttgatggactaaaatacctgtttcctggagagtgccaatatgtgttggtccaggattattgcggcagcaacccagggactttccgaatcctcgtggggaataagggttgctcccacccttcagtgaagtgcaagaaaagagtgacgatcctggttgaaggaggagagattgagttgtttgatggggaggttaacgtgaaaaggcctatgaaagatgaaacacatttcgaggtggtagagtccggcaggtacattatcttgctgttgggaaaggcgctgtccgttgtatgggaccggcatctgtctatcagtgtggtgctgaagcagacttaccaggaaaaggtctgtgggctatgcgggaacttcgacggtatccagaataacgacctgacatcaagcaacttacaggtggaggaggaccccgtggacttcgggaattcctggaaggtctcatcgcaatgtgccgatactcggaaggtgcctctggattcctctccagccacctgccacaacaacatcatgaaacagacaatggttgacagctcgtgtcggattttaaccagcgacgtgttccaggactgtaataagctggtggaccccgagccatatctggacgtatgcatctacgacacctgcagctgtgaatcaattggcgattgcgcatgtttttgcgatactatcgccgcatatgcccatgtatgtgcacagcacggcaaggtggtaacttggcgaacggctacactgtgtccccagtcgtgcgaggagagaaacctgcgcgaaaacggatacgagtgtgaatggcgctataactcttgtgcccccgcctgccaagtgacctgccagcatcccgagcccttggcctgcccagttcaatgtgtggagggctgccatgctcattgccctcctgggaagatcctagatgagctgctgcagacatgcgtagacccagaagactgcccagtctgtgaagtagctggcaggaggttcgcctccggtaaaaaggttactcttaatccctcagatcctgaacattgccaaatctgtcactgtgacgtggtgaatctcacatgcgaggcttgccaagagccaggaggcttggtggtgccgcctaccgatgctccagtctcccctaccaccctgtatgtggaagacatcagcgagcctccactccacgacttctattgcagtcgtttgctggatcttgtcttcttgctagatgggtcctctaggttgtccgaagctgaattcgaggtactcaaggccttcgttgtcgatatgatggaacgcctcagaatatcccagaagtgggtgagagttgccgtagtcgaatatcacgacggatcccatgcctacattggcctgaaggaccggaagaggccttccgaactgcgtagaattgccagccaggtaaagtatgctggcagccaagtggcgagcacatccgaggtcctaaagtacacactgtttcaaatcttttccaagattgatcggcctgaggcctccaggataacgctcctgctcatggcatcgcaggaaccacagaggatgtctcggaacttcgtgcgctatgtgcaagggcttaagaagaagaaagtgattgtcatcccagtcggcattggcccccatgccaacctgaaacagatccgcctcattgaaaaacaggcccccgagaacaaggcttttgtgctgtcctcagtcgacgagttggagcagcaacgggatgagatcgtcagctatctctgcgacctggcacccgaagcaccacctcctacccttccccctgatatggcccaagtgacagtgggtccaggcctgctgggagtgtctacactcggacctaaacgtaattccatggtcttggacgtcgcgtttgtcttggaggggtctgacaagatcggtgaggcagatttcaatcggagtaaggagttcatggaagaagtcatccagcggatggatgtcgggcaggacagtatccatgttacggtgttgcagtacagttatatggtaacagtggaatatcctttttctgaagcccagtccaagggggacatcctgcagagggtgcgagagatcagataccagggcggtaaccgcacaaacaccgggctggccctgcggtatctgtcagatcacagttttttggtatctcaaggagacagagaacaggcccccaatctggtgtatatggtgacaggaaaccccgcctccgacgaaatcaagcgcctccctggggacattcaagtcgtgccgatcggggtgggacccaatgccaatgtgcaagaactcgagagaattggctggcccaatgccccaatcctaatccaagattttgagacattgccccgtgaggcaccggacctggtattgcaacggtgttgcagtggtgaggggctgcagatccctactctgtctcctgcgccagattgtagccagccgcttgatgtgatactgctattggacggcagcagttcctttccagccagctactttgacgagatgaaatccttcgcgaaggccttcatcagcaaggccaacatcggtccccgcctgacacaggtgtccgtcctgcagtacgggagtattactaccatcgatgtaccctggaatgtggtgcctgagaaggctcatctcttgagcctggtggatgtcatgcaaagggaggggggacctagtcagatcggggatgcgctcggattcgcggtacgttatttgacatccgaaatgcatggcgctcgccccggcgccagcaaagccgtggtgattctggtcaccgatgtcagcgtcgactccgtggacgccgctgctgatgcggctcgatcgaatcgggttaccgtgtttccgatcggcatcggagaccgctacgatgctgctcagttgaggatcctcgccgggccagcgggagacagcaatgtagtgaagctgcagcgcatcgaggatttgccgaccatggtgaccttaggcaactccttcctacacaagctgtgctccggtttcgtgcgaatttgtatggatgaagacggcaatgagaagcgcccgggcgacgtgtggaccctcccggatcagtgtcatacagtgacctgtcagcccgacggtcagacattgctgaagtcgcacagggtcaactgcgacaggggcctgagaccatcctgccccaacagccagagccctgtaaaagtcgaggagacttgtgggtgtcgatggacgtgcccctgcgtctgcactggtagtagtaccagacatatcgtcacttttgacggacagaactttaagttgacaggctcttgctcgtacgtgctgtttcaaaacaaagagcaggatctggaagttattctccacaacggagcttgcagccccggagccaggcaagggtgcatgaaatcaatcgaagtgaagcacagtgccctgtcagtggaactgcactccgatatggaagtgaccgtgaacggacggctggtatctgtgccctacgtgggcgggaatatggaggtgaatgtctatggggccatcatgcatgaggtccggttcaatcacttaggccatatctttacctttactcctcaaaataatgagtttcagctccagttgtcccctaaaacctttgccagcaagacctacgggctgtgcgggatctgcgatgaaaatggagccaatgacttcatgctgcgggatggcactgttaccaccgattggaagaccctcgtgcaggaatggacagtgcagcgcccaggccagacttgccaaccaatccttgaagaacaatgtctggtacccgactccagtcactgccaagtgctcttactgccactgttcgcagagtgtcacaaggttttggcacctgcgacattctatgctatatgccaacaggacagctgtcaccaggaacaggtttgtgaggtgattgcaagctacgcgcatttgtgcaggaccaatggagtgtgtgtcgattggcgtactccagacttttgtgcgatgagctgccccccttccctcgtgtacaaccactgcgagcacgggtgcccccgccactgtgacgggaatgtaagtagctgcggcgatcatccatctgagggttgtttttgccctcccgataaggtaatgctcgaagggagctgtgtccctgaggaggcgtgcactcagtgcataggagaagatggagtgcagcatcagttcttggaggcatgggtgccagatcaccagccatgtcagatttgcacatgtctctccggtagaaaggtgaattgcaccactcagccatgtcccaccgccaaagcgcctacttgtggtctctgtgaggtggcccgcctcaggcaaaatgccgaccagtgctgtcctgagtatgagtgtgtgtgtgatcctgtttcgtgtgacctgccgcccgtccctcattgcgaaagagggctgcaacctacactgacaaacccaggggagtgcagacctaattttacctgcgcgtgccgcaaagaagaatgtaagcgtgtatctcctccctcttgccccccgcaccggttacctacactaaggaaaacacaatgctgcgacgagtatgagtgtgcatgtaattgcgttaattcaaccgtgtcctgcccgctggggtatcttgccagcactgcgacaaacgactgcggatgcacgactactacatgcctgcccgacaaggtctgtgtgcaccgctctaccatctaccctgtcgggcaattctgggaggagggctgcgacgtctgcacatgtacggacatggaagacgccgttatgggcctgcgggtcgctcagtgctcccaaaagccctgtgaggattcctgcaggtcaggatttacttacgtcctccacgaaggggagtgttgtggacggtgtctgcctagtgcttgcgaggtggtgacaggtagtccgcgcggcgatagccagagctcttggaagagtgttggaagccagtgggcgtcacctgagaatccatgcctgataaacgaatgtgtgcgcgtgaaggaggaggtgttcatccaacaaaggaatgtcagctgcccccaactggaggtgccagtctgtccctctggttttcagctcagctgcaagacatctgcttgttgtccttcctgccggtgtgagcgcatggaggcatgcatgctgaatggcaccgtgatcggacccggcaagactgtgatgatagacgtgtgcactacttgtcggtgcatggtgcaggttggagtgatcagtgggttcaagctggaatgtaggaagacaacatgtaatccttgccctctgggatacaaggaggagaacaatacaggcgaatgttgtgggaggtgccttcccactgcttgcacgatccagcttaggggtggacagataatgacccttaaacgggacgagacgttacaggacggttgcgatacccacttttgtaaggtaaacgaaaggggcgaatacttctgggaaaagagggtgaccggatgcccacctttcgatgagcataagtgcctcgccgaggggggcaaaattatgaagattccggggacttgctgcgacacatgtgaggaaccggagtgcaacgacataactgctcgacttcagtacgtgaaggtgggatcttgtaaaagcgaagttgaagtcgacatccattattgtcagggaaagtgcgctagtaaggccatgtactccattgacatcaacgacgttcaggaccaatgctcatgctgctcacctacacgtactgagccaatgcaggtcgcactacactgtactaacggatcagtggtctaccatgaggtgctcaacgctatggagtgcaagtgtagcccccgcaagtgcagtaag

SEQ ID NO: 21365 - DNA, 8439 bp, Artificial Sequence
  Description of Artificial Sequence: Synthetic coding sequence
atgattcccgcgcggtttgccggagtattgctggccctggcactgatccttcccggaacactgtgtgctgaaggcaccagggggcggagctccacggcccggtgcagcctgttcggcagcgatttcgtaaataccttcgatggaagtatgtatagctttgcgggttactgttcatacctgctggctgggggctgtcagaagagaagctttagcatcatcggagatttccagaacggaaaacgagtgagtctttccgtgtacctgggcgagttcttcgacatccatctctttgtgaacgggacagtgactcagggcgatcagcgagtttcaatgccttacgcctcaaagggcctctatcttgagacagaagcgggctactataaactcagtggcgaagcatacggctttgtggcccgcatcgatggatcagggaatttccaggtgctgcttagtgaccgctatttcaataaaacctgcggactgtgcggcaatttcaatatcttcgcagaggatgatttcatgacccaggaaggtacgctcacttctgatccctacgactttgctaactcatgggcactgtcctctggcgagcagtggtgtgagagggcatcacccccctcttcctcatgcaacattagtagcggcgagatgcaaaaggggctctgggagcagtgtcaactgctgaaatctacctcagtatttgcaaggtgtcaccccctggtggatccggagccttttgtcgccttgtgtgagaagaccctctgtgagtgcgccggggggctcgaatgtgcctgtcccgccttgctcgagtacgccaggacatgcgcccaggagggtatggttctctacggctggaccgatcactccgcttgttctccggtgtgcccagctgggatggagtaccgacagtgtgtttcaccatgtgctagaacctgccagtccctgcacattaacgagatgtgccaggaaaggtgcgtcgatggatgtagttgccctgaggggcagcttcttgacgagggcctctgtgttgagtctacagagtgcccgtgcgtccattctggcaagagatatccaccaggtacaagcctcagcagagattgtaatacatgtatttgccgcaacagtcagtggatttgctctaatgaggagtgtccgggggagtgccttgtcaccggtcagtctcacttcaaatcatttgacaacagatatttcacatttagtggcatttgccagtaccttctggctagggactgtcaggatcacagcttcagcattgttattgagacagtacagtgcgcagatgacagggatgcagtgtgcacaagatcagtgacggtaagactgcctgggttgcataacagcctggtcaagctgaaacatggtgctggcgtagccatggacggtcaagatgtgcaacttcctctcttgaaaggcgacctccgaatacagcacaccgtgacggcctccgtgaggcttagttacggggaggaccttcagatggattgggacggtagaggcagacttctggtcaagctgtcccccgtgtatgctggcaagacatgtgggctttgtgggaattataacgggaaccagggagacgatttcttgacaccctccgggcttgcagaacctcgagtcgaggacttcggaaatgcttggaaattgcatggtgactgccaggacctgcagaagcaacactcagacccctgtgcactcaatcctcggatgacaagattcagtgaggaagcgtgtgccgtgctgacttcccccacttttgaggcctgtcaccgcgcagtgagccctctgccctacctgaggaattgcaggtacgatgtctgttcctgttcagacggccgggagtgtctttgtggagccctcgccagttacgcggccgcctgtgctggcagaggcgtgagggttgcctggcgcgaacccggtcgctgcgagctcaattgtcctaaaggccaagtgtacctgcagtgcggaacgccctgcaatcttacctgtcgctctctgtcttatccagatgaggaatgcaacgaagcctgcctggaaggttgcttctgtccgcccggtctgtacatggacgaacggggggactgcgtgccaaaggcccagtgtccttgctactatgacggcgagatcttccaaccagaggatatcttcagcgatcatcacaccatgtgctattgcgaagatggtttcatgcactgtaccatgtctggcgttccaggcagcctgctgccagatgccgtgctcagttctcctttgagtcatcgatccaagcgctcactgagctgccggccacctatggtaaaattggtgtgccccgccgataatctgagggctgagggcttggagtgcacaaagacttgccagaattatgatcttgaatgtatgtccatgggttgcgtctcaggatgcttgtgccctcccggcatggtgagacatgagaataggtgcgtggctctcgagcggtgcccttgtttccaccaggggaaagagtacgcccccggcgagactgtgaaaatcggatgtaacacgtgcgtatgccaggatcgcaagtggaactgcactgaccacgtttgtgacgctacttgtagcacgattgggatggcccactacctcacgttcgacggactgaagtatctcttccctggggagtgtcagtatgtgctggtccaggattactgcggctcaaaccccggcactttccgaattcttgtagggaacaaaggctgttcccaccctagcgtgaagtgcaagaagagagtaactattctggtcgaagggggagagatagagctttttgatggcgaggtcaatgtgaaacgacccatgaaggatgagactcacttcgaggtggtagagtccggacgctacatcatccttttgcttggtaaggccttgtctgtggtgtgggacagacacctctccatatctgtggtgctgaagcagacctatcaggagaaggtgtgtgggctgtgcggtaatttcgatggaatccagaacaacgacctcacatcaagcaacctccaggtcgaggaagaccctgtggacttcggcaactcttggaaggttagctcacaatgcgctgatacacgcaaagtcccactggatagcagcccggctacgtgtcacaataatataatgaaacagacaatggtggactctagttgtagaatcctgacatcagatgtattccaagattgtaacaagctcgttgatccggaaccatacttggacgtgtgcatctacgatacatgcagctgcgagtccataggggattgtgcatgtttttgtgatacgatcgccgcttatgcccatgtctgtgcgcagcacgggaaagtcgtcacttggagaaccgccactctgtgcccacaaagctgcgaagaacgcaaccttagggaaaacggatacgaatgcgaatggcgatacaacagttgtgccccagcgtgtcaggtgacttgtcaacatcccgaacctctcgcatgcccagtccagtgcgttgaaggctgccacgctcattgtccgcccggcaagatactcgatgagcttttgcagacgtgcgtggacccagaggattgcccagtatgcgaggtggccggcagacgcttcgcctcaggtaagaaggttaccttgaatcctagtgatcctgagcactgtcagatctgtcactgtgatgtcgtgaatctcacatgcgaggcctgtcaagagcccggcggcttggtggtgcccccgacagatgcccctgtgtcaccaacgaccttgtacgttgaggacatctctgaaccacctcttcacgacttttactgctcccgactgctggatcttgtgtttctgcttgacgggtcctcccgactgtccgaggcagagtttgaggtcctgaaagcattcgtcgtcgacatgatggagagactcaggatctctcagaagtgggtgagagtggctgtggtggaatatcacgacggatcacatgcctacatcgggcttaaggataggaagagaccatccgaacttaggcgaattgctagtcaggtcaaatacgcagggagccaggtcgcgagcactagtgaagtgttgaagtacacattgttccagatattctccaagatcgatcgcccagaagcatccaggataacccttctgcttatggcgagccaggagccccaaaggatgagcagaaattttgtgcggtacgtacagggtcttaagaagaagaaggtaatagtcatccccgtcggtatcggcccacacgcaaaccttaagcaaattcgcctgatcgaaaagcaagcacctgagaacaaggcctttgtgctgagctctgtcgacgaactggagcagcaaagggatgagatagtcagctacctgtgcgacctggctccggaggccccaccacccaccttgcccccagatatggcccaggtgacagtcggccccggactgctgggtgtcagtacactgggcccaaagcgcaattcaatggtcctggatgtagccttcgtcctcgagggaagcgacaagatcggagaagcggactttaaccggtctaaggaatttatggaggaggtaatccagagaatggacgtcgggcaggattcaatccacgtaactgtgctgcagtacagttatatggtaacagtagagtatcccttcagcgaagcgcagtccaaaggggacattttgcaacgggttcgcgagatcaggtaccagggcgggaataggacaaacaccggactggcccttcgctatctgtctgaccactcctttctggtgagccagggagaccgggaacaggcccctaatctggtgtatatggtgacaggaaacccggcctcagatgagattaaaaggctgcctggggatatacaggtggtgccaattggggtggggcccaacgccaatgtgcaggagctcgaacgcatcgggtggccaaacgcccccatactgattcaagactttgaaacactgcctcgagaagcccctgacttggtcctgcagcgctgctgttccggggaaggtttgcagatccccaccctgagccctgcaccggattgcagccagccactggacgttatcctgttgcttgatggtagctcatcatttcccgcctcttacttcgacgaaatgaagtcttttgccaaagcgtttatttcaaaggcaaatattggccccagactcacccaggtgagtgtccttcaatacggcagcattactaccatcgacgtgccttggaatgttgtgccagaaaaagcacatctgcttagtcttgttgacgtgatgcagcgcgaaggtggtccctctcaaattggcgatgccctcgggttcgcggttagatatctgacctccgagatgcacggtgcccggcccggcgcctctaaggcagttgtgatactggtgacggatgtatcagttgacagcgtggacgcggccgcggacgcagccaggagtaatagggtaaccgtttttccaatcgggattggcgacaggtatgatgccgcacagctgaggatactggccgggcccgccggagatagcaacgtcgtcaagctgcaaagaatcgaggaccttccaactatggttacactcggcaacagcttcctgcataagctctgtagtggattcgttcgcatttgcatggacgaggatggaaacgagaagagacccggtgacgtgtggacactccccgatcagtgccacacagtcacctgccagccagacggccagaccctgttgaagtcccaccgagttaactgcgatcgagggctgcggcctagctgtcctaactctcaatcaccggtgaaagtggaggagacttgtggatgtaggtggacttgcccatgcgtgtgcactggctccagcacacgccatatcgtgacattcgacggccagaactttaagctgaccgggagctgttcctacgtgttgttccaaaacaaggaacaggacctggaggtgattctccacaacggcgcttgttccccaggagcccgacagggatgtatgaaatctattgaggtgaagcattctgccctgtctgtggagctgcattctgacatggaggtcacggtgaatgggagactggtgagcgtgccttacgtcggagggaatatggaagtaaacgtgtacggcgccattatgcacgaggtcaggttcaaccacttggggcacattttcaccttcaccccacagaacaatgagttccaactgcagctctctcctaaaaccttcgcctctaaaacgtatggcttgtgtgggatctgtgatgaaaacggcgctaacgatttcatgttgagggatggaacagtcactaccgactggaaaactctggtccaagagtggaccgtgcaaaggcccggccaaacctgccaacctatcctggaggaacagtgtttggtgcccgactcatcacactgccaggtgttgctgctgcctctgttcgctgaatgtcacaaggttctggctccagccactttttacgccatttgccagcaggatagctgccaccaggaacaggtatgtgaggtcattgccagctatgcccacttgtgccgcaccaacggagtgtgtgtggactggcgcacacccgacttttgtgccatgagctgcccaccttctctggtgtataaccactgtgagcacggctgtccaaggcactgcgacgggaacgtgtcaagttgtggtgaccacccttccgaggggtgcttctgccccccagataaggtgatgctcgagggcagttgtgtgccagaggaggcctgcacgcagtgcatcggagaagacggcgttcagcatcagtttcttgaagcatgggtacctgaccatcagccttgtcagatttgcacgtgtctgtccggaaggaaagttaattgcacaactcagccatgtcccacagccaaggcccctacttgtggcctttgtgaagttgcccggctgagacagaacgcagaccagtgctgtccggagtatgagtgtgtttgtgacccagtctcctgtgatctcccaccggttccccattgtgagagagggttgcagccaaccctgactaatccaggagagtgtaggcctaactttacttgcgcatgccgcaaagaggagtgtaaaagagtaagcccgccatcctgtccccctcaccggttgcctacactgcgcaagacgcaatgttgtgacgagtacgaatgtgcttgcaattgcgtaaacagcacagttagctgccctctggggtatctggcttccactgccacaaacgactgcgggtgcacaactacaacctgtttgcctgacaaggtgtgtgtacaccggtctacgatttaccctgttgggcagttctgggaggaaggatgcgatgtctgtacatgtaccgatatggaggacgcagttatggggctgcgggtggcacagtgttctcagaagccatgcgaagattcatgtcggagtggattcacatacgtcctgcacgagggagagtgttgcggccgctgcctccccagtgcttgtgaagtcgtgaccggaagcccccggggcgatagtcaatcttcttggaaaagtgtcggcagccagtgggcctcccctgagaatccttgtctcattaacgagtgcgtgagagtgaaagaggaagtctttattcagcaaagaaacgtgtcctgtccacagctggaagttccagtctgcccttccggcttccagctgagctgcaagacgagtgcctgttgcccttcctgcagatgtgaaagaatggaggcttgtatgctgaatggcacagtcattggacccggaaagacagtgatgatcgacgtgtgtacaacctgcagatgtatggtacaggtcggggtgattagtgggtttaagctcgaatgccgaaagacaacatgtaacccatgtcccctgggatacaaagaggagaataacaccggcgaatgttgcggtcggtgcctcccaacggcctgtaccatccagcttcgcggcggacaaatcatgacgctgaagcgcgacgaaactttgcaggacggctgcgacactcacttctgtaaagtaaacgagcgaggggaatatttctgggaaaagcgggtgactggttgtccccccttcgacgaacataaatgcctggcagagggaggaaagataatgaagattcccggcacatgctgcgacacatgtgaggagccagaatgtaatgacattaccgctcgactgcagtatgttaaggtgggttcttgtaagtcagaggtggaggtcgatatccattactgtcaaggtaaatgtgcgtctaaggctatgtactccatcgacataaacgacgttcaggaccagtgttcctgttgttcaccgacacgaacagagccaatgcaggtggcactccactgcaccaatggatctgtggtctatcatgaggtactgaatgcaatggagtgtaagtgctccccccgcaaatgcagtaaa

SEQ ID NO: 21366 - DNA, 8439 bp, Artificial Sequence
  Description of Artificial Sequence: Synthetic coding sequence
atgataccagctaggtttgccggtgttctcctggctcttgccctgatccttcctggaactctttgtgcggaaggcactcgaggccgttcatcgactgcacgctgttccctctttggctccgactttgtgaacactttcgatgggtcaatgtactcgtttgcgggatactgttcatacctccttgccgggggttgtcaaaagcgttcgttttcgattattggagacttccaaaacggaaaaagagtgtcactctcagtgtacctcggcgagttctttgacatccatctcttcgtgaatggcactgtcacccagggtgaccagcgtgtttcgatgccctatgcgtcgaagggtctttacctggaaaccgaggcaggatactacaagctgtcgggcgaggcgtacgggtttgtggccaggatcgatggatcaggtaatttccaagtgctgctgtcagacagatacttcaataagacttgcgggctttgcggaaactttaacatattcgctgaggatgatttcatgactcaagagggaaccctgacctccgacccctacgactttgccaactcatgggccctgtcctccggtgagcagtggtgcgaaagggccagccccccttcatcctcgtgtaacatttcgtccggggaaatgcagaaaggcctgtgggaacagtgccaactgcttaagagcacctccgttttcgcccgctgccacccactcgtcgatccagaaccgtttgtggcactgtgcgagaaaaccctttgtgagtgcgcgggcggactggagtgtgcctgtccggcgttgctggaatacgcccgcacgtgcgcccaagaaggcatggtgttgtacggatggactgatcactcagcatgctctccggtgtgtcctgcgggcatggaataccgtcagtgcgtgagtccatgtgcccgcacctgtcagtcgttgcacatcaatgaaatgtgtcaggagaggtgcgtcgatggttgctcctgcccagaaggccaactgctggatgaaggactctgcgtggaatcaaccgaatgcccctgcgtgcatagcggtaagcggtatccgcctggcaccagccttagccgcgattgcaacacttgtatctgccgaaactcccagtggatctgttcaaacgaagagtgtccaggtgaatgtcttgtcacgggtcaatcccactttaagagcttcgataaccgctactttacctttagcggtatctgtcagtacctgctcgcacgggattgtcaggatcattcgttttctatcgtgatcgaaactgtgcaatgtgccgacgatagagacgcagtgtgtactaggtcagtcacggtgcgcctgcctggactgcacaatagccttgtgaaacttaaacacggcgcgggagtggcaatggacggacaagatgtgcagctgccacttctgaagggagatctgcggatccaacatactgtcaccgcgtcagtgagactgtcgtacggcgaagatcttcagatggactgggatggtagaggacggcttttggtcaagctctccccagtctacgcaggcaaaacttgtggactttgcggcaactataacggaaaccagggtgacgattttctcaccccctcaggtcttgcagaacctagagtggaggactttgggaacgcatggaagttgcatggtgattgccaggatttgcagaagcagcattcggatccttgtgcactcaaccctcgcatgactagatttagcgaagaagcgtgtgcagtcctgactagcccgaccttcgaggcatgtcacagggcggtgtccccactgccttaccttcgaaattgccgatacgacgtgtgttcctgttccgacggtagagaatgcctgtgtggcgcactggcttcctacgcagccgcctgtgctggacggggcgtgcgggtggcctggcgtgaacctggacggtgtgaacttaattgtcccaaagggcaagtctacctgcaatgcggtactccctgtaacctgacgtgtagatcgttgtcgtaccctgatgaagaatgtaacgaggcctgtcttgaaggttgcttctgccctcctggactgtacatggacgaacggggtgactgtgtcccaaaggcacagtgtccatgttactacgatggagaaatctttcaacccgaggacattttcagtgatcatcacaccatgtgttactgcgaggatggattcatgcactgtaccatgtcgggtgtcccaggatccctcctgcctgatgccgtgctttcaagccctctgtcccatcggagcaagagatccctgagctgtagaccccctatggtgaaactggtgtgtccagcagataatctcagagcggaaggtttggaatgtaccaaaacttgtcaaaactacgatctggagtgcatgtcgatgggctgtgtctcaggatgtctgtgcccgccgggtatggtgcggcacgaaaataggtgcgtggcacttgaacggtgtccatgcttccaccaaggtaaagaatacgcacctggtgaaactgtgaaaattggatgtaacacctgcgtgtgtcaggaccgcaaatggaactgtaccgaccatgtctgtgacgccacctgctccactattggcatggcccactaccttacttttgatggcctcaagtacctgttcccgggtgaatgtcaatacgtcctggtccaagattactgcgggtcgaatcctggaaccttcagaattctcgtgggaaacaaaggttgctcgcatccttccgtgaaatgcaaaaaacgtgtgaccattctcgtggaaggaggggaaatcgaactttttgacggagaagtcaacgtgaagcgcccaatgaaagatgaaacgcatttcgaagtcgtggaaagcggtagatacatcatcctcctgctgggaaaggccctgtccgtcgtgtgggatagacatctgtcgataagcgtcgtcttgaaacagacctatcaagaaaaggtgtgcggcctgtgtggaaactttgacggtattcaaaacaacgacctgacctcgtccaatctccaagtggaggaggaccctgtggacttcgggaacagctggaaagtgagcagccaatgtgcagatactaggaaggtacctcttgactcctcaccggccacttgtcacaacaatatcatgaaacaaaccatggtggattcgtcctgtcgaatccttacgtccgacgtgtttcaagattgtaataagctggttgatccagaaccataccttgacgtgtgtatctacgacacctgttcatgtgaatccattggagactgcgcatgtttttgtgacaccattgcagcttacgcacatgtgtgcgcacagcacggtaaggtcgttacctggcggaccgcgactctttgtccccagtcatgtgaggaacggaatttgagggaaaatgggtacgaatgcgagtggaggtataactcatgtgcccctgcatgccaagtcacgtgtcaacatcctgagcccctcgcgtgtccagtgcaatgtgtcgaaggttgtcatgcacattgtcctccaggcaaaattcttgacgagctccttcagacttgcgtggatccagaggattgcccggtgtgtgaagtggccggtaggagatttgcatccgggaagaaagtgactctgaatccaagcgatcctgagcattgtcaaatttgtcattgtgatgtcgtgaatctgacttgtgaggcttgtcaggaacctggaggtttggtggtgcctcctaccgacgctcctgtctcgccaactactctttacgtggaggacatttccgaacctcccctgcatgatttctattgtagccgtctgcttgaccttgtgtttctccttgatggttcttcgcggctttcggaagctgaatttgaagtgttgaaggcatttgtcgtcgatatgatggaaaggcttcgtatatcgcaaaagtgggtgcgggtagccgtcgtggaataccacgatggatcccatgcttacattggacttaaggaccgaaagcgaccaagcgaactccgacgaattgcatcacaagtgaagtacgcaggttcccaggtggcatctacttctgaagtgctcaaatacactctcttccagattttctcaaagatcgaccgccccgaggcctcgaggattaccttgctcctgatggctagccaggagcctcagcgcatgtccaggaactttgtcagatatgtgcagggactcaagaaaaagaaagtgattgtgattcctgtgggtattggaccccatgcaaacttgaaacagattaggttgatcgagaagcaggccccagaaaacaaggcgtttgtgctgtcgagcgtggatgaactcgagcaacagagggacgaaattgtgtcatacctgtgcgatttggctcccgaggccccaccacctacgctcccacctgatatggcccaagtcaccgtgggccctggtttgctgggagtgtcaaccctgggacccaagagaaatagcatggttcttgatgtcgcatttgttcttgaaggctcggataagattggcgaagcagatttcaacagaagcaaggagtttatggaagaagttatacaacggatggatgtgggacaggattcgatccacgtgactgtgttgcagtactcatacatggtcactgtggaataccctttctcggaggcccaaagcaaaggagacatcttgcaacgcgtgagagaaatccgataccagggaggcaacaggactaatactggactcgctctgcgctatctgtcggatcacagcttcctggtgagccaaggtgatcgggaacaagcaccaaatcttgtgtacatggtgacgggtaaccctgcatctgatgagataaagagactgcctggtgatattcaggtggtgcctattggagtgggtcccaatgcaaacgtgcaagagctggagcgcatcggctggccaaacgccccaatcctgattcaggactttgaaactctcccccgagaggcacctgatctggtgcttcagagatgctgttcgggagagggccttcagattccaactctcagccccgcccccgattgttcacaaccattggatgtgattctgctcctggatggatcatcgtcgtttccagcatcatacttcgacgagatgaaatcatttgccaaagcctttatctccaaggcaaacataggtcctcgccttacccaggtgtcggtgcttcagtatggatcgatcaccaccattgatgtgccatggaacgtcgtgcctgaaaaagctcatcttctgtcgctggtcgatgtgatgcaaagagagggcggaccttcacaaattggagatgcacttggattcgcagtgcggtacctgacgtcggagatgcatggtgcacggccaggggcctccaaggcagtcgtgatcctcgtgaccgatgtctccgtggatagtgtcgacgccgccgcagacgcagctcgctcgaatcgagtgaccgtgttcccaattggaatcggagatcgatacgatgcggcacaactccggatactcgctggacctgcgggagatagcaacgtagtgaagctgcagaggatagaagatcttcctaccatggtgacccttggaaactcctttctgcataagctctgcagcggatttgtgaggatctgtatggatgaagatggcaatgaaaagcgcccaggagatgtttggaccctccccgatcagtgccatactgtcacttgtcaacctgatggacagaccctgctgaaatcccatcgtgtgaactgtgatcggggcctccgacccagctgtcccaattcgcaatcaccggtgaaagtggaggagacttgtggatgtagatggacttgcccgtgcgtgtgcactggctcgtcaacccgtcacatcgtgacttttgacggacaaaactttaagctcactggctcgtgttcctacgtgctctttcagaataaggagcaagacctggaagtgattttgcataacggagcatgttcaccgggcgcgagacaaggttgcatgaagtcgattgaggtgaaacattcagccctgtcggtcgagctccactcagacatggaggtgactgtgaatgggagactggtgtccgtgccgtacgttggaggaaatatggaagtgaacgtgtacggagcaattatgcatgaagtgcggttcaaccacctgggccacattttcacctttaccccccaaaacaacgaatttcagctccagctttcgccaaagacctttgcatcgaaaacttacggactgtgtggtatttgcgatgaaaatggcgcgaacgatttcatgcttcgagatgggactgtcaccaccgattggaaaacgctggtccaagaatggaccgtgcaaaggcccggacagacttgtcagcctattcttgaagagcagtgtcttgtcccagattccagccattgtcaggtgcttcttcttccattgtttgcagaatgccataaggtgcttgcaccagccactttttacgcaatctgccagcaggactcctgtcatcaggaacaagtgtgtgaggtcatcgcttcctatgcacatctttgcagaactaacggagtgtgtgtggattggagaactcctgatttttgtgccatgtcctgcccaccatcacttgtgtacaaccattgtgaacatgggtgtcctcggcactgtgatggcaatgtatcgtcctgtggcgaccacccaagcgaggggtgcttttgccccccagacaaagttatgcttgagggatcttgtgtgccagaggaagcatgtacgcaatgtatcggagaagatggtgtgcagcatcagtttcttgaagcatgggtgccagaccatcaaccctgccaaatttgtacctgcctttcaggtcgaaaggtgaactgtacgactcagccttgtccgaccgcgaaggcccccacttgtggactgtgcgaagtggcccggcttagacagaacgcggaccaatgttgccctgagtacgaatgcgtctgcgaccccgtgtcatgtgacctgccacctgtcccgcattgtgaacgtggtttgcagcctactctgaccaaccctggtgagtgcagacccaatttcacctgtgcatgtcgtaaagaagagtgtaagcgggtgagccctccttcatgtcctccacaccgcctccccaccctcagaaagacccagtgttgcgacgaatacgaatgtgcatgtaattgtgtcaactcgaccgtcagctgcccattggggtacctggcatcgactgcgaccaacgattgcggatgtaccaccaccacttgtctgcctgacaaagtgtgtgttcaccgttcaactatttaccctgtgggacaattttgggaggaagggtgcgatgtctgcacctgtactgacatggaagatgccgtgatgggactccgtgtcgctcagtgtagccaaaaaccatgcgaagattcctgcagatccggattcacttacgtgctgcatgagggggaatgttgtggtcgatgtctcccatccgcatgtgaggtggtgaccggaagcccacgcggagactcacaatcatcgtggaaatcggtcggtagccagtgggcgtcaccagaaaacccttgcctgattaacgaatgcgtccgagtgaaggaggaagtgtttattcaacaaaggaatgtgtcgtgccctcagctcgaagtgccagtctgtcctagcggttttcagctgtcgtgcaaaacttccgcatgctgcccaagctgccggtgtgaacggatggaggcctgcatgctgaatggaaccgtgattggaccaggtaagaccgtcatgattgacgtttgtactacgtgccgctgcatggtgcaagtcggtgtgattagcggtttcaaacttgaatgtcgtaagaccacctgtaacccatgtccgttgggatacaaggaggaaaacaacacgggagagtgctgcggaagatgcttgccaaccgcatgcactatccagctgcgtggcggacaaatcatgaccctcaaaagagacgagactctgcaagacggatgtgacactcacttttgcaaagtgaatgaaagaggagagtatttctgggaaaagcgcgtgactggttgtccgccttttgacgaacacaagtgtttggcagagggcggcaagatcatgaaaatccctgggacttgttgtgacacttgcgaagaacccgaatgtaatgacattactgcacgccttcagtacgtgaaggtcggatcctgtaaatcagaggtcgaggtcgatattcattactgccaaggcaaatgcgcatcaaaggcaatgtactcgattgacattaatgatgtgcaggatcaatgttcgtgttgtagccccaccaggacggaaccaatgcaagtggctcttcactgtaccaatgggagcgtcgtctaccatgaagtccttaacgcaatggagtgtaagtgtagcccaagaaagtgtagcaaa

SEQ ID NO: 21367 - DNA, 8439 bp, Artificial Sequence
  Description of Artificial Sequence: Synthetic coding sequence
atgatcccggccagatttgcaggagtgcttctggccctggccctgattttgcccgggaccctgtgcgctgaggggacccgaggacgctcgtccactgcccggtgctcgctgttcgggtcggacttcgtcaataccttcgatggatccatgtactcgtttgcgggatactgctcctaccttctggcaggcggctgccaaaagcgcagcttctcgatcattggagatttccagaacggcaagcgggtgtcactgagcgtctacctcggggagttctttgatatccacctctttgtcaatggaacggtcacccagggcgaccaacgagtctcgatgccgtacgcttcaaagggcctgtacttggaaaccgaagctggttattacaagttgtcgggggaagcatacggattcgtggcgcgcatcgacggcagcggcaactttcaagtgctcctctcggacagatatttcaacaagacctgcggactgtgtgggaactttaacatctttgcggaggacgactttatgacccaggaaggtaccctgactagcgacccgtatgatttcgcaaatagctgggcgctctcttccggcgaacagtggtgtgaacgcgcctccccaccttcatcgagctgcaatatcagctcgggagagatgcagaagggactgtgggaacagtgccaactgctcaaatctacctcggtgttcgctcgctgccacccactcgtggatccggagccgttcgtcgcactctgtgaaaagaccttgtgcgaatgcgcaggcggactggagtgcgcctgcccagccctgctcgaatacgctcggacctgcgcccaagagggcatggtgctctacggttggactgatcattccgcttgttcaccggtgtgcccggcgggtatggaataccggcaatgcgtttcgccctgcgcgcggacgtgccagagcctgcacataaacgaaatgtgccaggagcgctgcgtcgacggctgttcgtgcccggaaggacagctgctggacgaaggactgtgcgtcgagtccaccgagtgcccgtgtgtacattcaggaaagaggtacccgccgggaacctctctgtccagagattgcaatacctgcatctgtagaaactcccagtggatctgctcaaatgaggagtgccccggtgagtgcctggtgaccggacaaagccactttaagtcgttcgataatagatatttcactttctccggaatctgccagtacctgctggcccgcgactgtcaagaccattccttctcaattgtgatcgaaaccgtgcaatgtgcagacgacagggatgcggtgtgcactcggtcggtcactgtgcggctcccgggcctgcataattcgctggtgaagctgaagcacggcgccggagtggcgatggacggacaggatgtgcagctgccgcttctgaaaggagatctgcggatccaacacaccgtgaccgcaagcgtacgtctctcctacggagaggacttgcagatggattgggacggcagaggaaggctcctggtgaagctctcgccggtctacgccggaaaaacgtgcgggttgtgcggcaactataatgggaaccagggcgacgactttctgaccccatcaggcctggcggagccgcgggtggaggacttcggtaacgcctggaaactgcacggagactgccaggacctccagaagcagcactccgacccgtgcgcgctgaatccacgcatgacgagattctcggaggaggcctgtgcagtccttacctcccctaccttcgaggcttgtcaccgcgctgtttccccgctgccataccttcggaactgccggtacgacgtgtgctcatgttccgatggccgcgaatgcctgtgcggcgctttggcctcctatgctgctgcgtgcgccggccgcggagtgagagttgcgtggcgcgagccaggccgctgcgaacttaattgcccgaaaggacaagtgtacctgcagtgcggaaccccttgtaacctgacctgccgctcattgtcataccccgatgaagaatgcaacgaggcatgcctggaaggttgtttctgccccccggggttgtacatggacgaaagaggagattgcgtccccaaggcccagtgcccatgctactacgacggcgaaatcttccagccagaggacatcttttcagatcatcacactatgtgctactgcgaggacggattcatgcactgtactatgtcgggagtcccgggatcactcctgcccgacgccgtgctgtcgtcaccgctgtcgcataggagcaaacgctccttgtcatgccgcccgccgatggtcaaacttgtgtgtccggcggataacctgagggccgagggccttgaatgcacgaaaacgtgtcagaactacgacttggaatgcatgtccatggggtgtgtgtcaggatgcttgtgcccacctggaatggtccgccatgaaaaccgctgtgtcgctctggagcggtgcccatgcttccaccagggaaaggagtacgcaccgggcgaaaccgtgaagatcggttgcaacacttgtgtctgccaggatagaaagtggaactgtaccgaccacgtgtgcgatgccacctgctcgaccatcgggatggctcattacctgacttttgacgggctgaagtacctgtttccgggggaatgtcagtacgtcctggtgcaggactactgcggatcgaatccaggtacttttagaatcctggtggggaataagggctgctcccatccgagcgtgaagtgcaagaagcgggtcactatcctcgtggaaggcggagagatcgaactcttcgacggtgaagtgaacgtgaaaagaccgatgaaggatgaaacccactttgaggttgtggagtcgggccgctacatcatcctcctgctgggtaaagcactgagcgtggtgtgggaccgacacctgtcgatcagcgtcgtgctcaagcagacttaccaggaaaaggtttgcggattgtgtggaaatttcgacggaattcagaataacgacttgacgagctccaacctccaggtggaggaagatcctgtggacttcgggaattcctggaaagtgtccagccaatgtgccgatacgcgcaaggtgcccctcgactccagtccggcgacctgccataacaacatcatgaagcaaacgatggtggactcgtcgtgcagaatcctgacgtctgacgtgttccaggattgtaacaaactcgttgaccctgagccgtacctggacgtgtgcatctacgacacctgcagctgtgagtcgatcggtgactgcgcgtgcttttgcgacaccatcgcggcctacgcccatgtgtgcgcccagcatggaaaggtggtgacttggcgcaccgcaaccctgtgtccacaatcgtgcgaagagcggaacctgagggagaacggatacgagtgcgagtggaggtacaactcctgcgcaccagcttgtcaggtgacttgccagcaccctgagcccctggcgtgccctgtccaatgcgtcgagggatgccatgcacactgccccccagggaagatcctcgatgaactcctgcagacctgtgtggacccagaggattgccctgtttgtgaagtggctgggcgccggttcgccagtggaaagaaagtgaccctcaacccatccgacccggaacattgtcagatttgccattgtgatgtggtcaacctgacgtgcgaggcgtgccaagagcccggcgggttggtggtcccgccgaccgacgcacccgtgtcgcctaccaccttgtacgtggaagatatctccgaaccgccactccatgacttctactgctcacgcttgctggatcttgtgttcctgctggatgggtccagcaggctttctgaagccgaattcgaagtgctgaaggcattcgtggtggatatgatggaaagactgagaatctcgcagaagtgggtcagggtggcagtggtggagtaccatgatggatcacatgcctacataggactgaaggacaggaaaagaccatcagaactgagaagaatcgcatcacaggtgaaatacgcaggaagccaggtggcttcgacttctgaagtcctgaagtacactctgttccagatcttctcaaagatcgaccggccagaagcgtcgcgaatcactctgctgctgatggcctcgcaggagccacagcgcatgtcgaggaacttcgtccggtacgtgcaaggcctgaaaaagaagaaggtcatcgtcatccctgtgggaatcggaccacacgccaacttgaagcagatccggcttatcgagaagcaggccccagagaataaggcctttgtgctgtcctcggtggatgagttggagcagcagagggacgagatcgtgagctacctgtgcgatctcgcacctgaagcgccaccgcctaccctgccaccagacatggctcaggtgacggttggcccaggactgctgggagtgtcaaccctgggaccgaaacgcaacagcatggtgctggacgtggcattcgtgctcgaggggagcgataagatcggcgaggcagactttaatcgctccaaagaattcatggaagaggtcatccaacggatggatgtcggccaggattcgatccacgtgaccgtgctgcagtactcctacatggtcactgtcgaatacccgttctcagaggctcaatcgaaaggcgacatcctgcagcgggtgcgagagatccgctaccaaggaggaaaccgcactaatactggactcgctctgcgctacctgtcggaccactccttcctcgtttcgcaaggagacagagagcaggcgccgaacctggtgtacatggtgaccggaaaccccgcgagcgacgaaatcaaaagactgcctggggacattcaggttgtgcccatcggggtgggtcccaacgccaacgtgcaggagcttgaacgcatcggatggccgaacgctccaattctcatccaagacttcgagactctgccgcgggaggccccagacctcgtgcttcagaggtgttgctccggtgagggcctccaaataccgaccttgagcccagcccccgactgctcccaacccctcgacgtgatcctgctgcttgatggctcttcgtcctttccggcctcctactttgacgaaatgaaatccttcgcaaaggccttcatctccaaggctaacatcggaccgcgcctcactcaggtgtccgtgctccaatacggatcgatcaccaccatcgacgtcccatggaacgtggtgccagagaaagctcaccttctctcactcgtggacgtgatgcaacgggaggggggaccgtcgcagatcggcgacgctctcggcttcgccgtgcggtacctgacctccgaaatgcatggcgcacgcccgggggcatcaaaggcagtggtcatcctggtgaccgacgtctctgtggattcggtggatgcggcagctgacgcagccagatcaaaccgggttaccgtgttcccgatcggaatcggcgacagatacgatgcggcccagctccgcatcttggccggcccggctggagacagcaacgtggtcaagctccaacggatcgaggatctgccaactatggtgacgctgggaaacagcttccttcacaaactgtgctccggctttgtcagaatctgtatggatgaagatggtaatgaaaagcgcccgggagatgtgtggaccctcccggaccagtgccacacggtcacttgccagccggacggtcaaaccctgctgaaatcacacagggtcaactgcgatcgaggcctgcggccatcctgcccaaactcacagtcaccggtcaaggtcgaagaaacttgtggatgccggtggacgtgtccatgcgtgtgcaccggctcctcaactagacatatcgtgacctttgacggccagaatttcaagctcactggatcctgttcgtacgtcctttttcaaaacaaggagcaagatctggaggtgattttgcacaacggagcctgttcccctggcgcgcggcaagggtgcatgaaaagcatcgaggtcaagcacagcgctctgagcgtcgaactgcacagcgacatggaggtgaccgttaatgggagactcgtgtcagtgccatacgtcgggggaaatatggaggtaaacgtgtatggggcgatcatgcacgaagtgcggtttaatcatctgggacatatcttcactttcactccacagaacaatgagttccagctccaattgtcgcccaagacctttgcctcaaaaacctacggcctctgcggaatctgcgatgaaaacggcgccaacgacttcatgctcagagatggaaccgtaacgaccgattggaaaactcttgtccaggaatggactgtccagcggcctggacagacttgccagcctatcctggaggagcagtgcctggtgccggactcctctcactgccaagtcctcctgctgccgctgtttgcagagtgtcacaaggtcctggcccccgcgaccttttacgccatctgccagcaggattcgtgtcatcaggagcaagtgtgcgaagtcatcgcctcttacgcacatttgtgcagaactaatggagtgtgcgtcgactggcgcactccggacttctgcgctatgtcctgtccgccgtcgctggtctataatcactgcgaacacggctgtcctcgccactgcgacggaaacgtgtcctcatgtggtgaccacccatccgaaggatgtttctgcccgccggataaagtcatgcttgaaggatcctgcgtgccggaggaagcgtgtactcagtgcatcggagaggatggagtgcagcaccagtttcttgaggcgtgggtgcctgatcaccaaccgtgccaaatttgcacctgcctgagcgggaggaaggtgaactgtaccacccaaccgtgcccaacggctaaggccccaacttgtggtctgtgcgaggtggccaggctccgccaaaacgccgaccaatgctgcccggaatatgagtgcgtgtgtgatccagtgtcgtgtgatctcccacctgtgccgcactgcgaacgcggcctccaacccaccctgactaatccgggagagtgcagaccgaactttacctgcgcctgccgaaaagaagaatgtaagcgggtcagcccgccttcgtgccccccgcataggctgccaactttgcgtaagactcaatgctgcgatgaatacgaatgtgcctgcaactgtgtcaacagcaccgtgtcctgtcctctgggatacctggcctccactgcaacgaacgattgcggctgcactactactacctgtctgccagacaaggtttgcgtgcatcggtcaactatctacccggtgggccagttttgggaagaaggatgcgacgtctgcacttgtaccgacatggaggatgcagtcatgggactccgggttgcccagtgttcacagaagccgtgcgaagattcttgcagatcaggattcacgtacgtgctgcatgagggcgaatgctgcggccgctgcctgccatccgcctgcgaggtcgtcactggatccccacggggagattcgcagtccagctggaaaagcgtcggatcccagtgggcgtcccctgagaatccttgcctgattaatgagtgcgtgcgggtgaaagaagaggtgttcattcagcagaggaacgtctcctgcccgcaacttgaagtccctgtctgcccatcaggcttccaactgagctgcaagacttccgcatgctgcccgtcatgccggtgcgagcggatggaagcctgcatgttgaacggaacggtgatcggtcccggcaaaaccgtgatgatcgatgtgtgcaccacttgtagatgcatggtgcaagtgggagtgatctccgggtttaagctcgagtgtagaaagactacttgtaacccatgcccgctgggttacaaggaggagaataacaccggagaatgctgtggacggtgcctgccgaccgcgtgcaccatccagctgcggggtgggcagatcatgacgctgaaacgggatgaaaccctgcaagacggttgcgatactcacttctgtaaggtgaacgagcggggagagtacttctgggagaagagggtaactggttgcccaccattcgatgagcataaatgcctggccgagggagggaagattatgaagattcctggaacctgctgcgacacctgtgaggaacccgagtgcaatgatatcactgcgcgcctccagtacgtcaaagtggggtcctgcaagtccgaagtcgaggtggacatccattattgccaaggaaagtgcgccagcaaagccatgtacagcatcgacatcaatgacgtgcaagatcagtgtagctgttgctcgccgacccggaccgagccgatgcaggtggcattgcattgcaccaacggaagcgtggtgtaccacgaggtcctgaacgccatggaatgcaagtgctcaccgcggaagtgcagcaag

SEQ ID NO: 21368 - DNA, 8439 bp, Artificial Sequence
  Description of Artificial Sequence: Synthetic coding sequence
atgatccctgcccgttttgcaggtgtgctgttagccctggcgttgatcttgcccggaactttgtgtgcggaggggacccgagggagatcctcaacagcgaggtgttcattgtttggttccgactttgtaaataccttcgatgggagcatgtacagctttgcaggatattgcagttacctccttgccgggggatgccagaaacggtccttcagcataattggtgacttccagaacggcaagagagtgagcttaagtgtgtatctgggggagttttttgatattcacctgttcgtcaatgggactgtgacacaaggggatcaacgagttagtatgccttatgcgtcgaagggtctgtatctagagactgaggccggctattacaagctgagcggtgaagcatatggatttgtggctcgtatcgatggctccggcaattttcaggttcttcttagtgaccgatacttcaataagacttgcggcttgtgtggcaactttaacatttttgcagaagacgattttatgacccaggagggcaccctgactagtgatccatacgactttgccaattcttgggcgttgtctagcggcgaacaatggtgcgagcgggcgtcgcccccctccagctcgtgtaacatcagctccggagaaatgcagaagggactgtgggaacagtgccagctgctgaagtccacctccgttttcgcaaggtgtcaccctcttgtggatccagagccgttcgtggccctgtgcgaaaagactctttgtgagtgtgccggtgggctggagtgtgcgtgtcccgctctgctggagtacgcccggacatgcgctcaggagggcatggtgctctacggctggaccgatcatagtgcatgcagcccggtttgccccgccggaatggaataccgccagtgtgtgagtccctgcgctaggacctgccagtctctacatatcaacgaaatgtgtcaggagcgctgcgtggacggttgcagctgcccagagggccagctgctggatgaaggattatgcgtggagtcaaccgaatgcccatgtgtgcatagcggaaagagatacccacccggtaccagcctgtccagggactgtaatacgtgtatatgcaggaattcacaatggatttgctccaacgaagagtgtcccggcgagtgcctcgttaccgggcagagtcactttaagagttttgacaacaggtattttacattctctggcatttgccagtatctgctcgctcgcgactgtcaggaccattctttctctattgtcatcgaaactgtgcagtgtgcagatgaccgagacgcggtctgtaccagatctgtgacagttcgactgcccggcctgcataattctctcgttaagctcaagcacggtgcgggcgtggctatggacggccaggacgtgcaactaccccttttaaaaggcgacctacgcatacaacacacagtgactgcttccgtgaggctctcatatggcgaggacctgcaaatggactgggacggcagggggagactgcttgtaaaactcagtcccgtctatgcggggaaaacatgtggcctgtgcggcaactacaacggaaatcagggcgatgacttcctcacaccctcagggctggcggaacccagagtcgaagatttcgggaatgcatggaaactgcacggcgactgtcaagatctgcaaaagcagcactcagatccatgcgctttgaaccctcgtatgacacgcttttcagaggaggcctgtgcagtgttaacctctcctactttcgaggcatgccatagggcagtgagccccctgccatacttacggaactgcaggtacgacgtgtgttcctgttcggatggaagagagtgtctttgtggcgccctagcctcttatgctgccgcatgtgcaggccggggcgttcgtgttgcctggagggaacctggtcggtgtgagctgaattgccctaaggggcaggtgtatctgcagtgcggcaccccctgtaacttgacttgccgcagcctttcatatccagatgaggaatgcaacgaagcttgtctcgaggggtgtttctgtccccccgggctgtatatggatgaaaggggagattgcgtgccaaaggctcagtgtccttgttactatgacggtgagattttccagcctgaagacatttttagcgaccatcacacgatgtgctattgtgaagacggatttatgcattgtacaatgtcaggggtgcctggcagcctcttgccggacgcagtgctaagcagccccctgtctcatcgtagtaaacgttctcttagctgcaggccacccatggttaaacttgtgtgcccagccgacaatttacgcgcagaaggactggagtgcaccaaaacctgccagaattacgatttggagtgtatgtccatgggctgcgtgtcaggatgcctctgcccacccggcatggtccgtcacgagaacaggtgcgtcgcactcgaaagatgcccctgtttccatcagggcaaagagtacgctccgggggagactgttaagatagggtgtaacacctgtgtgtgtcaggatcgaaaatggaactgcacagatcacgtgtgtgacgccacatgcagcaccataggaatggctcactatctgaccttcgacgggctcaaatacttattcccgggggaatgccagtatgtcctggtccaggactattgtggctctaatccaggaacgttcagaattttggtcgggaacaagggatgttcccatcccagcgtcaaatgcaagaaaagagtgactatacttgtggaggggggcgaaatcgagctgttcgacggagaggtcaatgttaagcggcctatgaaagacgagactcatttcgaagtggtagaaagtggcaggtacattatcctgctacttggcaaggcgctctcagtggtgtgggatcggcatctgagcataagtgtagtgctgaagcaaacttaccaggagaaagtttgtgggctgtgtgggaactttgacggtattcaaaacaatgacctaacgtcttccaacctgcaggtggaagaggatcccgtggattttggcaacagctggaaggttagctcccaatgcgcggacactagaaaagtcccattagattcttcacccgccacctgccataacaatataatgaaacagaccatggtggacagtagctgcagaattctgacgtcggacgtcttccaggactgtaacaaattggtcgatcctgaaccgtatctcgacgtgtgcatttatgatacctgcagttgcgaatccatcggtgattgtgcttgcttctgtgacaccatcgccgcgtacgcccacgtttgtgcgcagcacgggaaggttgttacatggaggactgccactttgtgcccgcagtcgtgcgaggagagaaatttgagggaaaatgggtatgaatgcgagtggcgctacaactcttgcgcccccgcgtgtcaggtgacgtgccagcatcccgagcccctagcctgccctgttcaatgcgtagaaggatgccatgcccattgtccccccgggaagatactggatgagctcctccaaacgtgtgtcgatccggaagactgtccagtttgtgaggtcgctggacggcgctttgcgtcgggcaaaaaagtgacacttaatccgtccgatcccgaacactgccaaatctgtcattgcgatgtcgtcaatttgacatgcgaggcatgccaagaaccaggcggcttagtggtgccccctaccgacgcccccgtaagccctaccacgttgtatgtcgaggacatcagtgagccccctttgcatgatttttactgctcccgtctgctggacctggtctttctgctcgacggttcctctcggctttcggaagctgaattcgaagtacttaaggccttcgtggtggatatgatggaaaggctgagaatatcccaaaagtgggtcagagtggctgtggtggaataccacgacgggtcccacgcatacatcgggcttaaagatcgcaagcggccttccgaattgcgacgcatcgcatcccaggtgaaatacgccgggtcacaggttgcctctactagcgaagtgcttaaatacacactgtttcagatcttttccaaaattgaccggcccgaggcctcacgaatcactcttctcctcatggccagccaggagccacagaggatgtcacggaactttgtacggtatgttcagggcctgaaaaagaaaaaggtaatcgtgataccagtaggaattggcccccacgcaaacctgaagcagattaggctcatcgaaaaacaagcaccggagaacaaggcgtttgtgctttcttcagtggacgagctggagcaacagcgggacgagatcgtttcgtatctctgtgatctggcaccagaagcccccccgcccactctcccccctgacatggcacaggtgaccgtcggtcccggtctgctgggggtttccacgttaggacccaagcgcaactccatggtgctggacgtggcttttgtcctagaaggttccgacaaaatcggagaggcagacttcaatcgcagcaaagaatttatggaggaggtcatacagaggatggacgttgggcaggattccattcatgtgacagtactgcagtatagctatatggtgactgtggaatacccattcagtgaggcccagagtaagggggacattctgcaaagggtgagggaaatccgctaccaaggcgggaatagaacaaataccggcctggctctgaggtacttgtcagaccactcttttctggtaagccagggtgatagagagcaggcacccaatctggtctatatggtgaccggcaatccagccagcgatgaaattaaacgcctgcccggggatatccaggttgtgcccattggggttggaccaaatgccaacgtccaagagttggaaagaatcggctggcctaacgcccccatattgatccaggacttcgagacactgcctagagaagcgcccgatctggtgctccagagatgttgttccggcgagggacttcaaatcccgactctatccccagcgccagactgtagccagcctctggacgtcattctccttctggacgggtcaagctctttcccagcctcctactttgacgaaatgaagagctttgccaaggcctttatatccaaggccaatattggccctcgactgacccaggtgagtgtgctccagtatgggagtataaccacaattgatgtcccatggaatgttgttcctgagaaggcgcacctgctgagtctggtggatgtcatgcagcgcgagggagggccgtctcagataggcgatgcgcttggtttcgccgtgagatatctgacgtcagaaatgcacggtgcccgacccggtgcttccaaagctgtagtgatactggtgacagatgttagcgtggattctgtggatgccgctgcagacgcagctcgatctaatcgggtcactgtgtttccaattggaattggggaccgctatgacgcagcccagcttcgcatcctggctggtccagccggcgattctaacgttgtcaagctgcagaggatcgaagaccttcctactatggtgacccttggcaactcctttctccacaaattgtgcagcggctttgtcagaatttgtatggatgaggacggaaatgagaaaagacccggggatgtgtggactcttcccgaccaatgccacacagtgacttgccaaccagacggacaaactctgctgaagtcccacagagtgaattgtgacaggggactcagaccgagctgtcccaatagtcagtcaccagtcaaagtggaggaaacgtgtggctgtagatggacatgtccctgcgtatgtactggctcttcaaccaggcacattgtgacgttcgacgggcagaacttcaagctcactggctcatgctcctacgtgctgttccagaataaggagcaagatctcgaggttatcctccacaacggcgcctgctcccccggtgctaggcaggggtgcatgaagagtattgaggtcaagcactccgcattgtcagtggagcttcacagcgacatggaggtgactgtgaatgggaggctggtgtcggtgccctatgtcggcgggaatatggaggtgaacgtctatggagccattatgcacgaggtgcggtttaaccaccttggccatatctttacattcactccacagaataacgagtttcagctacagctttcccccaaaaccttcgcatcaaaaacatacggactttgtggcatatgtgatgagaacggcgctaacgactttatgttgagagacggaacagtgactactgattggaaaacactggtacaggagtggaccgtgcaaagacccggtcaaacctgtcagccgatcctagaggaacagtgtcttgtgccagactcctcccattgccaggtgctcctgcttccgctcttcgcagagtgccataaggtgctcgcccctgccacgttctatgccatctgtcagcaggattcgtgccaccaagagcaggtgtgcgaggtaatcgcttcctacgcccacctgtgccgaacaaacggggtgtgtgtagattggcggacccctgacttttgtgctatgtcctgtcctccctctctagtgtataaccattgcgagcacgggtgtccccggcattgtgacggcaacgtgagctcctgcggcgatcatccttccgagggttgtttttgcccgcccgacaaggtgatgctcgaggggagctgtgtccctgaagaagcgtgcacacagtgcataggagaggacggcgttcagcaccagtttcttgaggcttgggtgcctgaccaccagccttgtcaaatatgcacatgccttagcggcagaaaagttaactgcaccacgcagccttgcccaacagctaaggctcccacgtgcgggctgtgcgaggtggcccgtctgcggcagaatgccgaccagtgctgtccggagtacgagtgtgtgtgcgatcccgtgtcttgtgaccttcccccagttccgcactgcgagcggggtctccagccgacactgactaatccgggagagtgcagacctaacttcacatgtgcgtgcagaaaagaggaatgtaaacgcgtcagtccacccagttgcccccctcaccggctgccaaccctcaggaagacccagtgttgcgatgagtacgagtgcgcctgtaactgtgtaaatagcacagtatcctgccctctcgggtacctggcgtccacggccacaaacgattgcgggtgcaccacgactacctgtcttcccgacaaagtatgcgtccatagaagtaccatctaccccgtaggacagttctgggaggaagggtgcgacgtgtgtacttgcactgatatggaagacgccgtcatggggttgagagtggcccagtgcagtcagaagccctgcgaggacagttgtcgaagcgggttcacctatgttttgcacgagggagagtgctgcggcagatgtctgcctagtgcttgcgaagtggtcacggggtccccccgcggcgattctcagtccagttggaaatccgtgggctctcagtgggcatctccagagaatccctgcctgattaacgagtgtgtcagagtcaaagaggaagtcttcattcaacagcgtaacgttagctgcccccagcttgaggtccctgtgtgtccttcaggattccagctctcttgcaaaacctccgcatgctgtccttcttgcagatgcgagcgaatggaggcctgtatgttaaatggcacagtgattggccctgggaagacagtgatgattgacgtatgtacgacatgccgatgtatggtgcaagtcggggtcataagtggattcaaacttgagtgtagaaaaaccacatgtaatccctgtcctctggggtacaaagaagagaacaataccggagagtgctgcggcagatgcctgccaaccgcttgtacaatacagctcaggggaggccagatcatgaccctcaagcgcgacgaaaccttgcaagacgggtgcgatacacatttttgtaaggtgaacgaaagaggcgaatatttttgggagaagcgagtgacagggtgccctccttttgacgaacacaagtgccttgccgaaggtggcaaaattatgaagatacctggtacttgttgcgacacgtgcgaggagcccgaatgcaacgatattacagcgaggctccagtacgtcaaagtcggcagctgtaagtccgaggtcgaggtggatatacactattgtcagggaaagtgcgcttctaaggcaatgtacagcattgatatcaatgacgtgcaggaccagtgtagctgctgctcccccaccagaactgaaccgatgcaggtggccctccactgcactaatggtagcgtggtttaccatgaggttctgaacgcaatggagtgcaaatgcagccctcggaaatgctccaaa

SEQ ID NO: 21369 - DNA, 8439 bp, Artificial Sequence
  Description of Artificial Sequence: Synthetic coding sequence
atgattcctgcaagatttgcaggagtgctgctggccctggccctgattcttcctggtactctgtgtgcggaagggacccgaggacgttcaagcaccgctagatgctcacttttcggttcagattttgtgaacaccttcgatgggtcgatgtacagctttgctggttactgttcttatctgcttgcaggcgggtgtcaaaagcgcagcttttcaattatcggggattttcagaacggcaagagagtgtcactttcggtgtatctgggagaattcttcgatatccacctgttcgtgaatggaactgtcactcagggagatcagcgggtatcgatgccatatgcgtcaaaaggactttaccttgagacggaggccgggtactacaagctgtccggcgaagcgtacgggttcgtggcacgaatcgatgggtcaggaaactttcaagtgcttctttctgacagatactttaacaagacctgcgggttgtgcggaaacttcaatatctttgcagaagatgatttcatgacccaagaggggaccctgactagcgacccatatgatttcgcaaattcgtgggcactctcgtcgggggagcaatggtgtgagcgggctagcccaccatcgtcgtcatgcaacatatcgtcaggcgagatgcagaaaggactgtgggagcaatgtcagctgctcaagtccacctcggtgttcgcacgatgccatcccctcgtcgacccagaaccttttgtggcgctttgcgaaaagaccctctgtgaatgtgcaggaggacttgagtgcgcatgtcctgcacttcttgagtacgcccgcacgtgtgcacaagagggtatggtgctgtacgggtggaccgaccatagcgcatgttcacctgtctgccctgcaggaatggagtaccgacagtgcgtcagcccttgcgccagaacctgccagtcgcttcacattaatgaaatgtgtcaagaaagatgtgtcgacgggtgttcatgtccggaagggcagcttctcgatgaagggctgtgcgtggaatccacggagtgcccgtgtgtccattccgggaagcggtatccacccggaacctctctttcgagagattgtaatacttgtatttgtagaaactcacaatggatctgctcaaatgaagagtgtccaggggaatgtttggtgactggtcaaagccacttcaagagcttcgataatagatactttacgttctcggggatctgccaatatctgctggcacgggattgtcaagatcactccttttcgatagtgattgaaaccgtccaatgtgcagatgatcgagacgctgtgtgtactcggtccgtcaccgtgagactgccaggactgcataatagccttgttaagctgaagcatggagcaggtgtcgcaatggatggtcaagacgttcagctcccactgcttaagggcgatttgagaattcaacataccgtgaccgcctccgtcaggctgtcatacggtgaagatctgcagatggattgggatggacgcggcagactgttggtgaagctctcgcctgtttacgcaggaaagacctgtgggctgtgcggcaattacaacggaaatcaaggagatgattttcttactccttcagggcttgcagaaccacgagtggaggactttggaaatgcctggaaactccatggtgattgccaagaccttcaaaagcagcactcagatccttgtgctcttaatcctaggatgactcggttttcagaggaggcatgtgcagtccttactagcccaactttcgaagcatgccatagagcagtgtcgccccttccttacttgcgaaattgtcgttacgatgtctgttcgtgttccgacggtagagaatgcctttgtggtgcacttgcctcatacgcagcagcctgtgccggtcgcggagtgcgagtggcctggagggagccaggtaggtgtgaacttaattgtccaaaggggcaggtctacctgcagtgtgggaccccatgtaacttgacttgtagatccctttcctatccagatgaggaatgcaacgaagcatgcttggaaggatgtttctgccctcccggactttacatggacgaaaggggagactgcgttccaaaggcccaatgcccttgttactacgacggggaaatctttcaaccagaggatatcttttccgatcatcataccatgtgctactgtgaggatggatttatgcattgtactatgagcggtgtgccgggttctctgctgccagatgccgtgctgtcgtcccctctgtcgcatagatcaaagagatccctgtcgtgccgccctccaatggtgaagctcgtgtgtccagcagataaccttcgtgcagagggccttgaatgtaccaagacctgtcagaattacgatcttgagtgtatgtcgatgggctgtgtgtcaggatgtttgtgtccccctggtatggtgcgccatgaaaatcgatgcgtggcacttgaaagatgcccatgtttccaccaggggaaggaatacgcacctggagagactgtcaaaattggttgcaatacttgtgtctgtcaggatcgtaagtggaactgcaccgaccacgtgtgcgatgcaacctgtagcaccattggaatggcacactacctgacttttgatgggcttaagtacctttttccgggtgagtgtcagtacgtcctggtccaggattactgtggctcgaaccctgggacctttcggatcctggtgggaaataagggttgctcacatcccagcgtgaagtgcaagaagagggtcaccattcttgtggaaggaggtgaaattgaactctttgatggcgaagtgaacgtgaagcgccctatgaaagatgagactcatttcgaggtcgtggaatctggacggtacattattctgttgctgggtaaggcactctcggttgtgtgggatagacacctttcaattagcgtggtgcttaagcaaacttaccaagaaaaggtctgtggactgtgtgggaactttgacggtattcaaaacaacgatttgacttcttccaacctccaggtcgaagaagatccagtcgacttcggtaactcgtggaaagtttcgtcgcaatgtgcggatactaggaaggtgcctttggattcctcaccagcaacctgtcataacaacatcatgaagcaaaccatggtggattcgtcctgtcggattctgacctctgatgtgtttcaagattgcaacaagctcgtggatccagaaccttaccttgacgtctgtatctatgacacttgctcgtgtgagagcataggggattgcgcctgcttctgcgataccattgcagcctacgcccatgtgtgtgcacagcatggcaaggtcgtcacttggaggaccgcaaccctgtgtcctcagtcctgtgaagagcgcaaccttcgggaaaatggctacgagtgtgagtggaggtacaactcctgcgctccagcgtgccaagtcacctgtcaacaccctgaacctcttgcctgtccggtgcagtgtgtggaaggttgccatgcacattgtccacctggaaagattcttgatgaacttctccaaacgtgtgtagaccccgaagattgccctgtctgtgaagtggcgggaagaaggtttgcatccggaaagaaggtgacgctgaatccttccgatccagaacattgtcaaatatgtcactgtgatgtggtgaacctcacttgcgaagcctgtcaagagcccggaggcctggtggtgcctccaaccgacgcgcctgtcagccctacgaccctttacgtggaggatatctcggaacctccactgcatgatttctactgttcccggctcctggaccttgtgttccttcttgacggttcaagcagacttagcgaagcagaattcgaagtgctgaaggcattcgtcgtggatatgatggagcgtctgagaatcagccagaagtgggtcagagtggcagtggtggaataccatgacgggtcccatgcatacatcggcctgaaggaccgcaagcgcccttctgagcttcggagaatagcttcacaggtgaagtacgcaggatcacaggtggcgtcaacctcagaagtgcttaagtacaccctttttcaaatcttcagcaagattgacaggcctgaagcatcaagaatcaccctgctgttgatggcatcgcaagaacctcagagaatgtcacgcaattttgtcaggtacgtgcagggactgaagaagaagaaggtcatcgttatacccgtgggtatcggacctcacgcaaatcttaagcaaataagacttattgagaagcaggcacctgagaacaaggcctttgtgctgtccagcgtggatgagctcgagcagcagcgagacgagattgtgtcctacttgtgtgatctcgcacctgaagcacctcctccgaccctccccccagatatggcgcaagtcactgtggggcctggactgcttggagtctctactctcggtcctaagcgcaattccatggtgcttgacgtggcgtttgtgcttgagggctcagataagatcggggaggcagactttaatcgtagcaaagagtttatggaagaagtgattcagagaatggatgtggggcaggattcgattcatgtgaccgtccttcagtacagctatatggtcaccgtggaataccctttctctgaagcacagagcaaaggcgatatacttcaaagggtccgcgaaattaggtaccaaggtggtaatcggaccaacactgggctcgcactgcgctacctgagcgaccacagctttcttgtctcccaaggagatcgcgaacaggcacctaacttggtctatatggttaccggaaaccctgcttccgacgaaatcaagcgtttgccaggtgacatccaggtggtcccgattggagtgggacctaatgcaaacgtgcaagaattggagcggatcggatggcctaacgcacccatccttatccaagactttgagactcttcctcgcgaagcacctgatctggtgctgcagaggtgttgttccggagaaggcctgcaaattccaaccctctcaccagctcccgactgctcacagccactggacgtcattctgcttctggacggtagctcctcattcccggcgtcctactttgatgaaatgaagtcattcgcaaaagcatttatcagcaaagctaacattggccccagactgactcaagtctcagtgctgcaatacggatccattactactattgatgtgccctggaacgttgtgcccgaaaaggcacatctcctcagcctcgtggatgtgatgcagcgcgaaggaggacccagccagatcggcgatgcacttggatttgcagtcaggtatctgacgtcggaaatgcacggggcacgccccggggcatcgaaagcagtcgtcatccttgtcactgatgtctccgtggacagcgtggatgcagccgcagacgccgcacggtcgaatcgtgtgactgttttcccaattggtatcggagatcgttacgacgccgcgcaactcagaatcttggctggaccagcaggagattccaatgtggtgaaactgcaacgcatcgaagatctgcctactatggtgacccttgggaactccttcctgcacaaactttgttcaggatttgtgagaatatgcatggatgaggacggaaacgagaagcgaccgggcgatgtgtggaccctgcctgatcaatgccatacggtgacttgccagcctgatggtcagactctgctgaagtcgcatcgcgtgaactgcgacagaggtctgaggccaagttgtccgaattcccagtcgccagttaaggtggaggaaacctgtgggtgcagatggacgtgtccatgcgtgtgtaccggttccagcacccgtcatattgtgacctttgacggccaaaacttcaagttgaccggatcttgctcgtacgtgctgtttcagaataaggaacaggacctcgaggtgattctccacaacggtgcttgtagcccaggggccaggcaaggatgcatgaagtcaatcgaagtcaaacattcggcgctgtcagtggagctccattcggatatggaggtgacggtgaacggtcgtcttgtctctgtcccttacgtgggagggaacatggaagtcaacgtctacggagcgatcatgcatgaagtgagattcaaccacctcggtcacattttcaccttcactccacagaataacgagtttcagctgcaactttcccccaaaacgttcgcatcaaaaacctacggcctgtgtggtatctgcgacgaaaacggagcaaacgacttcatgcttagagacggaaccgtgactactgactggaaaaccctggtgcaagagtggactgtgcagcggcccggccaaacctgtcagccaattcttgaagaacaatgcttggttccagattcgtcgcattgtcaagtgctccttctccccctgtttgcagagtgtcacaaggtgctcgcgcctgccactttttacgccatctgtcagcaggattcgtgtcatcaagagcaagtctgcgaggtcattgcttcctacgcccacctgtgccggactaacggcgtgtgcgttgattggcgaaccccagacttctgcgccatgtcgtgtccaccctccctcgtgtacaatcattgtgaacatgggtgtccccgacattgcgatggaaatgtctcctcgtgtggagatcatccgtccgagggatgtttttgtcctcccgataaagtcatgctggaaggaagctgtgttcctgaagaagcatgtacccagtgtataggcgaggatggggtgcaacatcaatttcttgaagcatgggtgccagaccatcagccatgtcaaatttgtacttgtctctccggcaggaaggtgaactgcaccactcaaccttgtccaactgccaaggcaccaacctgtgggctttgcgaggtcgcaagactccgtcagaatgcagatcagtgttgcccggagtacgagtgtgtgtgcgatccagtctcctgcgatctgccacctgtgcctcattgtgagaggggtctgcaacctaccctgaccaaccctggagaatgtcgccctaatttcacctgtgcatgtcggaaggaagaatgtaagagagtctcgcccccttcatgtccccctcacaggcttcctacccttcgaaaaacccaatgttgcgatgaatacgagtgcgcctgcaactgtgttaattcgacggtttcctgtccactgggctacctggcatccaccgctaccaacgactgtgggtgtaccaccactacttgtctgcccgataaggtgtgtgttcatagatcgaccatttaccctgtcggacagttttgggaggagggctgtgatgtctgcacttgcaccgacatggaagatgccgtcatgggccttagagtcgcacaatgttcccagaagccctgtgaagattcatgtcgatcaggatttacctacgtgttgcatgagggtgagtgctgtggacgctgtctgccctcggcctgcgaagtggtcactggaagccctaggggtgattcacagtcctcctggaagagcgtcggttcacaatgggcgagccccgaaaacccgtgtttgattaacgaatgtgtgagagtgaaggaagaggtgtttatccaacagcggaacgtttcatgtccacagcttgaagtgccagtctgtccgagcggatttcaactttcctgtaaaacttcagcatgttgtccgagctgccgttgcgagagaatggaggcgtgtatgctcaacggaactgtcattggccccggaaagactgtgatgatagatgtctgcaccacctgcagatgtatggtgcaagtcggggtgattagcggttttaagctcgagtgtagaaagaccacctgtaatccctgtccgctcggatacaaagaggaaaacaacaccggggagtgttgtggacggtgcctgcctaccgcatgtacgattcaactgcggggtggtcagattatgacgctcaagagggacgaaactctccaagatggttgtgatactcatttttgtaaggtgaacgaaaggggtgagtacttctgggaaaagcgggtgacgggatgtcctccctttgacgaacacaagtgtctcgccgaagggggaaagataatgaagattcccggtacttgctgtgatacttgtgaagaaccggaatgcaatgatattactgcccgcctgcaatacgtgaaggtggggtcctgtaagagcgaggtcgaagtggatatccattactgccaagggaaatgcgcatcaaaggctatgtattcgatcgacattaacgatgtgcaggatcagtgctcctgctgtagccctacccgaactgaaccaatgcaggtggccctgcattgtacgaatggttccgtggtgtaccatgaggtgcttaacgccatggaatgtaaatgttcgcctagaaaatgttccaag

SEQ ID NO: 21370 - DNA, 8439 bp, Artificial Sequence
  Description of Artificial Sequence: Synthetic coding sequence
atgatccccgcccgcttcgcgggcgtcctgctcgcattggctctcattctccccggcacgctgtgcgccgaggggactcgcggtcgttctagcaccgcccgttgctcccttttcggctctgactttgtgaacactttcgacggcagcatgtacagcttcgccggatattgtagttacctcttggccggcggatgccagaaacggtccttctccatcattggggatttccagaacggtaagcgcgtatcgcttagcgtctacctgggcgagtttttcgatatccacttgttcgtgaacggtacagtcacccagggagaccagcgagtctccatgccctacgccagcaagggtctttacctggagaccgaggcgggatactacaagctgtccggagaggcatacggattcgtcgcccggatcgatgggtcgggaaatttccaggtcttgttgagcgatcgttatttcaataagacttgtggcctgtgcggaaatttcaatatctttgctgaggacgacttcatgacacaggaggggaccctgacgagcgacccttacgactttgcaaactcctgggctctctcctctggcgagcagtggtgcgagagggcttctcctcccagctcatcgtgcaatatcagttcgggcgagatgcaaaagggcctgtgggagcagtgccaacttctaaagtcaactagcgttttcgctcgttgccacccgctcgtcgacccggagcccttcgtcgctctgtgtgagaagaccttgtgcgaatgcgccggcggtctggaatgcgcgtgtcctgccctgctcgaatacgcgcggacgtgtgcccaggagggaatggtcctctatggctggacggaccactccgcatgttctcctgtctgccctgcaggtatggagtaccggcaatgtgtgtcgccctgcgcaaggacttgccagagcctgcacattaatgagatgtgtcaggagaggtgtgtggacggttgttcctgcccagagggtcaactacttgacgagggtctgtgcgtcgaaagcacggaatgtccgtgcgtccatagcggcaagagatacccccctgggacgtccctttccagggactgcaacacctgcatctgccgtaactcccagtggatatgttcgaatgaagagtgccccggcgagtgcctggtgaccggtcagtcccattttaagagcttcgataatcgttacttcacattctcggggatctgccagtatttgctcgctcgcgactgtcaggaccactcgttctctatcgtaattgagaccgtccagtgcgctgatgaccgcgatgcagtctgcacacgctccgttaccgtccggctccccggtctgcataacagccttgtcaagctcaagcacggcgcaggtgtcgctatggacggacaagacgttcagctcccgctccttaagggagatctgcgcatccagcacactgtcaccgcctctgtccgcctgtcgtacggtgaggacctgcagatggactgggacggcagaggtagattgctggtgaagctgtctccggtctacgcgggcaagacctgcggtctgtgcggtaactacaatgggaatcagggtgacgacttcctgacccctagcggtttggccgagccgcgtgtggaggatttcggcaacgcttggaagctgcatggcgattgccaggacctccagaagcagcactccgacccctgcgccctgaacccgcgcatgacacgtttctcggaggaggcctgtgcggttctcactagcccgactttcgaggcctgtcaccgtgctgtctcccccttgccttacctccgcaactgccggtatgacgtctgctcttgtagcgatggccgtgaatgcctatgcggcgccctggcctcttacgccgcggcgtgcgccggccgaggcgtccgcgtagcctggagagagcctggacgttgcgagctcaactgtccaaagggtcaggtctacctccagtgcggtaccccctgcaatttgacctgccggagcctgtcttatcctgatgaggagtgcaacgaggcttgcctcgaagggtgcttctgcccgcctggcctctacatggatgagcgtggtgactgcgtcccgaaggcccagtgcccttgctactacgatggcgagattttccagccggaggacatcttctccgatcaccacactatgtgctactgcgaagatggcttcatgcattgcaccatgtccggagttcctggctccctcctccccgacgccgtcctgtcatctcctctgtctcaccggagcaagcggtcgctgagttgtaggccccctatggttaagctcgtgtgcccggccgacaaccttcgggccgagggtctcgagtgcaccaagacctgtcagaactacgacttggagtgcatgtccatggggtgcgtctccggctgcctgtgcccgcctggcatggtccggcatgagaatcggtgtgtagcccttgagcgatgtccgtgcttccaccagggtaaggagtacgccccgggtgaaactgttaagattgggtgtaacacttgcgtatgccaagatcggaagtggaactgtaccgatcacgtatgcgacgccacctgcagcactattggtatggcccactatttgacgtttgatggtcttaaatatttgtttcccggcgaatgccagtacgtgctcgttcaagattactgcggctctaaccctggaacgttccgtattcttgtgggaaacaaaggctgcagtcacccctccgttaagtgcaagaagagggtcaccatcctcgttgagggcggtgaaatcgagcttttcgatggggaggtcaacgttaaaagaccaatgaaagacgaaacgcacttcgaggtcgtcgagtcgggtcgatacatcattcttcttctgggtaaggcgttgtccgtcgtgtgggatcgtcacctgagtattagtgtcgtcctcaagcagacgtaccaggagaaagtctgcggactttgtggaaattttgacggtatccagaacaacgatctaacgtcgtccaacctgcaagttgaggaagaccctgtggacttcggcaactcgtggaaggtgtcgagccagtgcgcagatacccgtaaggtcccgctggattcctctcccgccacctgtcacaacaacatcatgaagcagaccatggtcgattcctcgtgtcgcatcctcacctcagacgtcttccaggactgcaacaagctggtcgatccagagccctacctcgacgtctgcatttacgatacctgttcttgtgagtctatcggtgattgcgcctgcttctgcgacacgattgccgcctacgcccacgtgtgcgcccagcatggtaaggttgttacgtggcgtaccgcaacgctctgtccgcagtcgtgcgaggaaaggaacctgcgagaaaacggctacgagtgtgagtggagatataacagctgcgcccctgcctgccaggtgacttgccagcaccccgagcccctcgcatgtccagtgcagtgcgtcgagggttgccacgcccactgtccgcccggtaagattcttgatgagctgctacagacctgtgtcgacccagaagattgtccggtctgcgaggttgccggacgtcgttttgcttccggcaagaaggtcactctcaacccttccgatcccgagcattgccagatttgccactgcgacgtggtcaatctcacatgtgaggcctgccaggagccgggtggactcgttgtaccgcccacagatgccccggttagccctaccacgctgtacgttgaggatataagcgagccgcccctccatgatttctactgtagccgtctcctggatctggtcttcttgctggatggctcgtcccgcctgagcgaggcggagttcgaggtgctgaaggccttcgttgtagatatgatggagcgtttaaggatctcgcaaaagtgggtccgcgtcgctgtggtcgagtaccacgacggtagccacgcctacattggtctcaaggaccggaagagaccctctgaactgcgccgcattgcgtcccaagtgaagtacgccggttcccaggtggcctcgacgtccgaagtcctgaagtacaccttattccaaatctttagtaagatcgaccgcccagaagcctcgaggattacgcttcttctgatggcttcccaggagcctcagcgtatgtcccgaaacttcgtccggtacgttcagggccttaaaaagaagaaggttattgtgattcccgtaggtattggccctcacgcgaacctgaagcagatccgcttgatcgagaagcaggcgcctgagaataaggcctttgtgctatcttctgtggacgagctagaacagcaaagggacgagatcgtctcgtatctgtgcgacctggcccccgaggctcctcctcccactctgccccccgatatggcccaggtcaccgtgggaccgggtctcctcggcgtctctacgctcggtcctaagcgaaactctatggttctcgatgtggcttttgtcttggaaggtagtgataagataggggaggccgacttcaaccgaagcaaggagttcatggaggaggttatccagcgcatggacgtcggccaggactcaatccatgtcaccgtcctccagtatagctacatggtcacggtggaatatcctttttccgaggcccagtctaagggcgatatcctccagcgtgtgagagaaatccgttaccagggcggtaaccgtaccaacacgggtctggcgctgcgttacctgtctgaccactctttcctggtatcccagggcgaccgggaacaagctcccaacctggtgtatatggtgaccggcaaccccgcctctgatgagatcaagcgtctgcccggcgatattcaagtggttcccatcggggtcggccccaacgcgaacgtccaggagttggagcgcattggttggcctaacgcgcctatcctcatccaggactttgaaaccctaccccgggaggcgcccgacctggtgctccagcggtgctgctccggcgagggtctgcagatccccaccctgagtccagcgcccgactgctcgcagccgctcgatgtcatccttctgctggatggtagcagcagcttccccgcttcctacttcgacgagatgaaaagcttcgccaaggccttcatctctaaggcgaatatcggaccccggttgacacaggtgtccgtgctacagtacggctcgatcactaccattgatgtcccttggaacgtagtgcccgagaaggctcacctgctgagtcttgttgacgtcatgcagcgtgagggaggtccttcccaaatcggcgacgcgctgggcttcgctgtccgctacttgacctcagagatgcacggtgctcgccctggcgccagcaaggccgtcgtcattcttgtaaccgatgtctcggttgactctgtggatgccgctgccgacgcggcccggtccaaccgcgtcactgtgttccccatcggtatcggagatcgttacgatgctgcccagctccgcatcctggccggacccgctggtgactctaacgtcgtgaagctccaacgcatcgaggatctgccgactatggtcacactgggcaacagctttttgcacaagctctgtagcggcttcgtccgcatttgcatggacgaggatggtaacgagaagagaccaggggacgtgtggacgctcccggatcagtgtcataccgtgacgtgtcagcccgacggccagacacttttgaagtcccaccgtgtcaattgtgatcgtggtctgcgcccttcctgtcccaattcgcagtctccagtcaaggtggaagaaacttgcggctgccgatggacctgcccttgcgtctgcactggttcctcgactagacacattgtgaccttcgatggccagaatttcaagctaaccggttcctgttcttatgtcctgttccagaataaagagcaagaccttgaagttatccttcataacggcgcatgcagcccgggcgctcgccagggctgcatgaagagtatcgaagtcaagcacagcgccctcagcgtagagctccactccgacatggaggtgacggtcaatggccggctcgtttctgttccctatgttgggggcaacatggaggtcaatgtttacggcgctatcatgcacgaagtccgtttcaaccatctgggtcatatcttcactttcactccgcagaataacgaattccagctccaactgtcgccaaagacctttgccagcaagacctacggtctctgcggtatctgcgatgagaacggtgccaacgatttcatgttgcgtgatggtactgtcaccacagattggaagacactggtccaggagtggacggtccagcgacctgggcagacctgccagcccatccttgaagaacaatgtttagtacccgactccagtcactgccaggtcctattgctcccattgtttgctgagtgccacaaggtcctggcgcctgccaccttctacgcaatctgtcagcaggatagttgtcaccaggaacaagtctgcgaggtcatcgcttcatacgcccatctctgccgaacaaatggtgtgtgcgtagactggcgcaccccggacttttgcgccatgtcctgcccaccgagcttggtctataaccattgcgagcacggatgcccgagacattgtgacggaaacgtgtcctcttgcggggaccaccccagtgagggttgcttctgcccgcctgacaaggtaatgctcgaggggagctgtgtgcctgaggaagcctgcacccagtgcatcggtgaggacggtgtgcaacaccaatttctcgaggcatgggtccccgaccaccaaccctgtcaaatctgtacttgcctgagcggccgcaaagtcaattgtaccacccagccatgccctaccgcaaaggccccgacttgcggcctttgtgaggtcgcacggcttcgtcagaacgctgatcagtgctgcccggagtatgagtgcgtatgcgatcctgtttcctgtgacctgccccccgtcccacattgcgagcgcgggcttcagcccaccctcaccaaccccggtgagtgccgccccaatttcacttgcgcatgtaggaaagaggaatgcaagcgtgtttcccctccatcctgccccccccacagattacccaccctccggaagactcagtgctgtgacgagtacgagtgtgcctgcaactgcgtcaattccaccgtttcttgcccattgggttacctggctagtaccgctaccaacgactgtggttgtaccaccactacctgcctacccgacaaggtctgcgtgcaccgcagtaccatctaccctgtcggtcaattctgggaagagggttgcgatgtctgcacctgcactgacatggaggacgccgttatgggcctacgcgtcgcacagtgctctcaaaagccttgcgaagacagttgcaggtcgggattcacatacgtgttgcacgagggtgagtgttgcggccgctgcctgccctcggcttgtgaggtcgtcacgggtagccctcgaggtgatagccagtccagttggaaatcggtgggctcccagtgggcctccccagaaaacccctgcctgatcaacgagtgtgtgcgcgtcaaagaggaggtcttcatccaacagcgcaatgtctcctgcccacagctggaggttcccgtctgtccgtccggcttccaattgtcatgcaagacaagcgcttgttgcccttcctgccgttgcgaaaggatggaggcttgcatgctgaacggtactgttatcggtcccggcaagaccgtgatgatcgacgtgtgtactacgtgtaggtgcatggtacaagtgggtgtcatctccgggtttaagttggaatgccgtaagactacctgcaacccctgtcccctggggtacaaggaagaaaataacaccggtgagtgttgcgggcgctgtctgcccaccgcctgcaccatccagctccgaggcggccagatcatgacccttaagcgtgacgagaccctccaggacggctgcgacactcacttctgcaaagtcaacgagcgtggcgagtacttttgggagaagagggtgaccggttgtcccccttttgacgagcacaagtgcctggctgaagggggtaagatcatgaagatccccggcacctgttgcgacacatgtgaagagcccgagtgcaacgacattaccgcccgtctgcagtacgtcaaggtcggatcgtgcaagtcagaagtcgaggtggatattcattactgccagggaaagtgcgccagcaaggccatgtactcgattgacattaacgatgtccaagaccagtgctcgtgctgctcacccactcggacggagccaatgcaggtggcgctccattgcaccaacggctccgttgtctaccacgaggtgcttaacgcaatggagtgcaagtgctcgccccggaagtgcagcaag

SEQ ID NO: 21371 - DNA, 8439 bp, Artificial Sequence
  Description of Artificial Sequence: Synthetic coding sequence
atgattcccgcacgatttgcgggtgtacttcttgccctggcactgattctcccggggacgctttgtgcagaaggaactagaggtcgctcgtcgacggcaagatgtagcctgtttggctcggatttcgtgaacacgtttgatggctcgatgtacagcttcgcaggatactgttcgtaccttctggcaggaggatgtcaaaaaagatcattctcgattattggggatttccaaaatggaaaacgtgtctccctgagtgtgtatcttggagagttttttgacattcaccttttcgtgaacggaaccgtgacgcagggagatcaacgggtgtcaatgccatacgcgtccaagggcctctacttggagactgaagcaggctattacaaactgtcgggggaagcgtacggattcgtcgcacgcatagacggttccgggaattttcaagtgctgctgtcggacagatactttaacaagacttgtggactttgtggtaatttcaacatctttgcggaagatgacttcatgactcaagaaggtactctcaccagcgatccttacgattttgctaactcgtgggcactttcctccggagaacaatggtgtgaacgagcaagccctccatcaagctcatgtaacatatcatcgggagaaatgcaaaagggcctttgggagcagtgtcaacttctgaagagcacttcagtattcgcacgctgtcatcctttggtggacccagagccttttgtcgccctgtgcgaaaagaccctctgtgaatgcgcaggtggtcttgagtgtgcctgtccagcactgcttgaatacgcgagaacgtgtgcacaggaaggaatggtgctgtacggttggaccgaccactccgcctgctccccggtgtgccccgcaggtatggagtacagacaatgcgtctccccatgtgcacgcacctgtcagtctctgcacataaatgaaatgtgtcaagagcgctgtgtcgacggttgttcttgtcctgaaggacagcttctggacgaaggtctttgcgtggaatcgaccgaatgtccttgtgtgcactcaggaaagaggtacccaccgggcacttcgctttccagggactgtaacacctgcatctgtagaaattcccaatggatatgtagtaacgaagaatgtcccggcgagtgccttgtgactgggcaatcgcactttaagagttttgacaaccggtactttacctttagcgggatctgccaataccttctggcccgcgattgccaagaccattcgttttccatcgtgattgaaacggtccagtgtgcagatgatcgcgacgccgtgtgtacgagaagtgtgactgtccgactccccggacttcataattcacttgttaaactgaagcatggggccggagtggccatggatggtcaagatgtccagctccctcttctcaaaggagatctgagaatacagcataccgtcaccgcgtcagtgcggctttcgtacggagaagatcttcagatggattgggacggcagaggtcggcttttggtgaaactttctcccgtgtacgccgggaaaacttgtgggttgtgtggcaactacaacggaaatcagggagatgattttcttacgccttcgggactggcagaaccaagagtggaagattttggtaatgcatggaagctgcatggagattgccaggatctgcaaaagcagcattcagacccgtgtgccctcaacccgcgcatgactagattcagtgaggaagcctgtgcagtccttacctcacctactttcgaggcatgccatagggcagtctccccacttccataccttcgcaattgtaggtacgacgtgtgttcgtgcagcgacggaagggagtgcctttgtggggcacttgcctcgtacgcagccgcctgtgccgggcgaggtgtgcgcgtagcctggagagagccaggcagatgcgagcttaattgtcccaagggacaggtctacctgcaatgcggaacgccttgtaatcttacctgtcgctcgctttcgtacccagacgaggaatgtaacgaagcatgtcttgagggttgtttttgcccacctggactctacatggatgaacgcggcgactgtgtgcccaaggcacagtgtccttgctactacgatggcgaaatctttcagcccgaggacattttcagcgaccatcataccatgtgttactgtgaagatgggtttatgcactgtaccatgtccggagtgccgggtagccttctccctgacgcagtgctgtcatccccgttgtcgcatagaagcaagcgttcgctcagctgtcgtcccccaatggtgaagctggtgtgcccggcggataatcttcgggcagaaggtcttgaatgtaccaaaacctgccaaaactacgacctggaatgtatgagcatggggtgcgtctccggttgcctttgtccccctggcatggtccgtcatgaaaaccgatgtgtggctcttgaacgctgtccatgttttcaccaaggcaaggagtacgcacctggagaaaccgtgaaaattggatgcaatacctgtgtgtgtcaggaccgcaagtggaattgtaccgatcacgtgtgcgacgcgacttgttctactatcggaatggcacattacctcacctttgacgggctcaagtatctgtttccaggtgaatgccagtacgtcctcgtgcaggattactgtggctcgaaccctggaacctttagaattcttgtcggtaacaagggctgttcccatccctcggtcaagtgcaaaaagagagtgaccattctcgtggaaggaggtgaaatcgaactgtttgacggagaagtaaatgtgaagaggcctatgaaggatgaaactcatttcgaggtggtggaatccggacggtacataattctcctcttgggtaaagccctttcagtggtgtgggaccggcacttgtcaatcagcgttgtactcaaacagacctaccaagagaaagtgtgtggtctgtgtggaaactttgatgggatccaaaacaacgacctgacctcaagcaacctgcaagtcgaggaggatcccgtggactttggcaactcgtggaaagtatcgtcccagtgtgccgatactagaaaggtgccacttgatagctcaccagcaacttgccataacaacatcatgaaacaaactatggtggatagcagctgtcgaatcttgacctcagatgtgtttcaagactgtaataagttggtggatcctgagccatatcttgatgtgtgtatctacgatacctgctcttgtgagagcatcggggactgtgcatgcttttgcgataccattgcagcttacgcgcatgtgtgtgcccaacatggcaaagttgtgacgtggaggaccgcaaccctgtgccctcaatcctgtgaggaacgcaaccttagggaaaatggatatgaatgtgaatggagatacaactcgtgtgcacctgcatgtcaagtgacctgtcagcatccagagccactggcctgcccagtccaatgtgtggaaggctgtcacgcacattgtccccccggcaagattctggacgagctgcttcaaacctgcgtggatcctgaagattgccctgtgtgtgaggtcgctggaaggcggtttgcctccggcaagaaggtgaccctcaatccttcagaccctgaacattgtcagatctgtcactgtgatgtggtgaatctgacttgcgaggcttgccaagagcccggcggactcgtcgtcccacctactgatgcaccagtcagcccaacgaccttgtacgttgaggacatttccgagccgcctctgcatgatttctactgctcaagactgctggacctcgtctttctgctcgatgggtcctcgagactgtccgaagcggaatttgaggtgctcaaggcttttgtcgtcgatatgatggagagattgcgtatcagccagaagtgggtccgcgtggccgtggtggaataccacgatggctcccacgcctacattgggctgaaggaccggaagcggccctccgagctccgtcgcatcgcttcgcaggtgaagtacgcgggatcccaagtcgcaagcacttctgaagtgctgaagtacacccttttccagattttcagtaagattgaccgccctgaagcaagccgtattactctgttgctgatggcatcccaagagccacaaaggatgagccgtaatttcgtccgatacgtgcaaggcctgaaaaagaagaaggtgatcgtgattcctgtcggaatagggccgcacgcaaacctgaagcagattcgcctgattgaaaagcaagctcctgaaaacaaggcatttgtgctgtcgtcagtggatgaacttgagcagcagagagatgaaatcgtctcgtatctctgtgatctggcgcctgaggcgcctcctccgacccttccccccgacatggcccaggtcaccgtgggacccggactcctgggggtgtcgactctcggtccgaagagaaactcgatggtcctggatgtggcgtttgtgcttgaaggttccgacaagatcggtgaagcagactttaaccggtcgaaggaattcatggaagaggtgatccagcgaatggacgtcggtcaggattcaattcatgttactgtgctgcagtacagctatatggtgaccgtggaataccccttttcggaagcacagtccaagggcgatattctgcagcgggtgcgcgaaatcagataccaagggggaaatcggaccaatactgggcttgctcttcgctacctttcggatcatagctttcttgtttcccaaggcgatagagagcaagctcccaaccttgtgtatatggttacgggtaaccccgcatcagatgagataaagcgcctgccaggtgatattcaagtcgtgccgattggagtgggacccaacgcaaacgtgcaggaacttgaacgtatcggatggccaaatgcgccgatattgattcaagacttcgaaactcttccaagagaggcaccggacctggtcctgcaacgctgttgtagcggcgaggggctgcaaattcccaccctttctcctgctcccgattgtagccagcctctcgatgtgatcctgctgctcgatggctcatccagctttcccgcaagttactttgatgaaatgaagtccttcgcgaaagcgtttatctctaaagctaacattggtccacggctcactcaggttagtgtcctccaatacggatcgattaccactattgacgtgccttggaacgtggtccctgaaaaggcccacctgctttcgctggtggatgtcatgcaacgggaaggaggtccatcccaaataggtgatgcacttggttttgcagtgcggtacctcacgtcggaaatgcatggtgcgcgaccaggagcctccaaggcagtggtgattctggtcaccgatgtgagcgtggatagcgttgatgccgctgcagatgctgcaagatcgaatagagtcactgtgttcccaataggcattggggataggtacgatgcagcacagctgcggattctggcaggacctgcaggagactccaacgtggtgaaacttcagcgcattgaggatttgcccactatggtgaccctgggaaacagctttctccacaaactgtgcagcgggttcgtgcggatctgtatggatgaggacgggaatgagaaacggcctggtgatgtgtggaccctccctgaccagtgtcatactgtgacctgtcaaccagatggacaaaccctcttgaaatcccaccgtgtcaattgtgatcggggcctcaggccttcctgtcctaactcccaaagccccgtcaaggtcgaagaaacgtgcggatgccgatggacctgtccatgtgtttgtaccggatcatcgactaggcacatcgtgacgttcgacggacaaaacttcaaacttaccggaagctgttcctacgtgctttttcaaaacaaggaacaagatttggaagtgattctgcataatggagcctgctcccccggtgcacggcagggctgcatgaagtccatcgaagtcaaacattcggcacttagcgtggaactccatagcgatatggaggtgaccgtgaatggacgactcgtgtccgtgccttacgttggtggaaatatggaagttaatgtgtacggagcaatcatgcatgaagtgagattcaatcacctgggccatatctttactttcacccctcaaaacaacgaatttcagctgcagctctcacctaagactttcgcaagtaagacctacggactctgtggtatttgtgacgagaatggggcaaatgactttatgctgagagatggaaccgtgactactgactggaaaaccctcgtccaagagtggactgtgcaacgtcccggacagacctgccagcctattctcgaagaacagtgccttgtgccggactcgtcccattgccaggtgctccttctgccattgttcgcagagtgccacaaggtgctcgcccctgccaccttttacgccatttgtcagcaagattcatgtcatcaagaacaagtgtgcgaagtaattgcgtcatacgcgcacctttgtcgtactaacggtgtctgcgtggattggcgaactccagacttctgtgcaatgtcatgtccaccctcactggtctacaaccattgtgagcatgggtgccctagacactgcgatggaaatgtgtcgtcgtgtggtgatcacccttccgaagggtgtttttgtcctccggataaagtgatgctcgaaggttcatgtgtgccagaagaggcatgcactcaatgcattggtgaggatggggtgcagcaccaattcctggaagcctgggtcccagatcaccaaccatgtcaaatttgtacctgcctgtcaggtaggaaggtcaactgcactacgcaaccttgtcctactgcaaaagcacctacctgtggtctttgcgaagtggcaaggctccgacagaacgcagatcaatgttgtcctgaatacgagtgcgtgtgcgaccctgtttcctgtgacctgccaccagtcccacactgtgaaagaggccttcaacctactctgactaacccaggcgagtgcaggcctaacttcacttgcgcctgtcggaaggaagaatgcaaacgtgtctcacctccgtcctgcccacctcatagactgccaaccttgagaaagacccaatgttgtgatgaatatgaatgtgcctgcaactgcgtcaattctactgtctcttgtcccctgggctaccttgccagcaccgctactaacgattgtggttgcactaccactacttgcttgcccgataaggtgtgtgtgcataggtcaactatatacccagtgggacaattttgggaggagggatgtgatgtgtgtacgtgtactgatatggaagatgcagttatgggacttagagtggcgcagtgctcgcaaaagccgtgcgaagattcctgccggtccggtttcacctacgtgctgcatgaaggagagtgttgcgggagatgcctgcctagcgcatgtgaggtggtgaccggttcgcccagaggagattcgcaatcatcctggaaaagtgtgggttcgcaatgggcaagcccggaaaacccatgcctgatcaatgaatgtgtccgtgttaaggaggaagtctttatccagcagaggaacgtgagctgtccacagctggaagttcccgtttgcccgtcgggattccaactgtcctgtaaaacctcggcgtgttgcccttcgtgccgttgtgagcggatggaggcgtgcatgctcaacggaacggtgattggcccaggaaagaccgtcatgattgacgtctgtactacctgcagatgtatggtgcaggtgggtgtgatatcgggatttaagttggaatgtagaaaaaccacttgtaacccatgtcctctggggtacaaggaagagaataacacgggtgaatgttgcggccgctgcctgcctactgcttgtactatccaactgcggggaggccagattatgaccctcaagcgggacgaaaccctgcaggatggttgcgatacccatttttgcaaggtgaacgaaaggggagagtacttctgggagaagagagtgacggggtgtcctccttttgacgagcataagtgccttgccgaaggagggaagatcatgaaaatccctggaacctgctgtgacacttgcgaagaacccgagtgtaacgatattactgcgcgactccaatacgtcaaggtgggctcctgtaagagcgaggtcgaagtagacatccattactgccagggaaagtgcgcttccaaggcaatgtacagcattgatatcaacgacgtgcaggaccagtgctcctgctgtagcccaactcggaccgagcctatgcaggtagcactgcattgtactaacggaagcgttgtctatcacgaagtgctcaacgcaatggagtgtaagtgctcaccaaggaagtgttccaag

SEQ ID NO: 21372 - DNA, 8439 bp, Artificial Sequence
  Description of Artificial Sequence: Synthetic coding sequence
atgatccccgctcgattcgccggggtgctcctggccctggcacttatcttaccagggaccctctgtgccgagggtacgagaggcagaagctcaaccgcacggtgttctctctttggatcggattttgtcaacacttttgatggatccatgtactcgtttgcgggatactgcagctacctgctggccgggggatgccagaaacgctcattttctataataggtgatttccagaatgggaaaagggtatctcttagtgtgtacctgggggagttttttgatattcatctcttcgtcaacgggacagtcactcagggtgatcagcgagtgtcgatgccgtatgcctccaaaggcctctaccttgaaactgaggcgggttactacaagttgtcaggagaggcgtatggcttcgtggccagaatagacgggtccggcaactttcaggtcctcttgagcgaccggtattttaataaaacatgcggactgtgcgggaattttaatattttcgcggaagatgatttcatgacccaggaaggtacactcacctcagacccgtacgatttcgctaacagctgggctctcagcagcggagagcagtggtgtgagagagcatctcccccaagctcaagctgtaatatttccagcggggagatgcagaaaggcctctgggaacagtgtcagctacttaagagtacctcagtgtttgcgaggtgtcatccattagtggacccggaaccattcgttgccctttgtgaaaaaactctttgtgaatgtgcagggggactcgaatgcgcctgcccagccctcctggagtatgcgagaacatgcgcacaggaggggatggtgctgtatggttggactgatcatagtgcttgcagcccagtatgccccgctggaatggaatatcgccagtgcgtttctccctgcgccaggacgtgccagagtctacatatcaacgagatgtgtcaggagagatgtgttgacgggtgctcttgtcccgaagggcagcttcttgatgaggggctgtgcgtagagtccacagagtgtccgtgtgtccactctgggaagaggtacccccccggaactagtctgtctagggactgcaatacctgcatatgtagaaattcacagtggatctgcagtaacgaagagtgcccaggtgaatgccttgtgacaggacagtcccatttcaagagcttcgacaaccgttactttaccttctctggaatttgccaatacctgcttgcccgggattgccaggaccattcattcagtatagtgatcgagactgtgcaatgtgccgatgaccgggatgccgtttgtacacgcagcgtaacagtaaggctcccaggtctgcataactcattggtgaaacttaaacacggcgccggcgtggcaatggacggacaggacgtccaactgccactacttaaaggcgatcttaggatccagcacacagtaactgccagtgtgcgtttgtcttacggcgaggacctccagatggactgggacggcaggggtcggttgttagtgaaacttagcccagtatatgctgggaagacttgtggcctgtgcggaaactataatgggaaccagggcgatgacttcctcacgcctagcggactggccgaaccaagggtcgaagactttggcaacgcttggaagctgcacggagattgccaggatctgcagaagcagcattctgacccttgcgcactgaacccccgcatgacacgtttctccgaggaggcatgtgccgtgctcacctcccccaccttcgaggcctgtcaccgcgccgtgtctccactaccttatctgcgaaactgtcgatatgatgtgtgcagctgcagtgacgggagggaatgtctgtgtggagcgctcgcgagttatgcagcagcttgcgccggcaggggagtccgagtggcctggcgagagcctggacgttgtgagctgaactgtccgaaggggcaggtctacctgcaatgtggaaccccatgcaacttgacatgtcggtcactgtcttaccccgacgaggagtgcaatgaagcctgtctcgagggctgcttctgtccccccggactttacatggatgaacgcggcgactgcgttcctaaggcccaatgtccctgctattacgatggtgagattttccagcctgaagacatattctctgatcaccacacaatgtgttattgcgaggatgggtttatgcactgcaccatgtcgggcgtgcctgggtcactgctccccgacgcggtcctttctagtcccctcagccataggagcaagagaagcctctcatgtaggcctcccatggtcaagcttgtttgtcccgcggacaatctgcgggctgagggactagaatgcacaaagacatgccagaactatgatctcgaatgtatgtctatgggctgcgtttctggatgcctctgtccacccggtatggtgcgacatgagaatcgttgcgtagcattggaacgctgtccctgctttcaccagggcaaggaatacgcccctggtgaaaccgtgaagatcggctgtaacacttgcgtgtgccaagacaggaaatggaattgcacggatcatgtctgcgatgcaacctgttctacgatcggcatggcccactatttgactttcgacgggctgaagtacctttttccaggtgagtgccagtatgtcctcgtccaggattactgtggaagtaaccctggcacgttccgtatcttggtcgggaacaaaggctgctcccacccgtccgtgaaatgcaaaaagagggtgactatcctggtggagggcggcgagatcgagttgttcgacggggaagtcaacgtaaagagacccatgaaggatgagacacattttgaggtggttgagtctggccggtacatcatcttactgttagggaaggcactaagtgtggtgtgggaccgacatctctccatttccgtcgtgctaaagcagacctaccaagagaaagtgtgcgggctttgtggaaactttgacgggatacaaaataatgatcttacaagttctaatctgcaggtggaagaagaccctgtcgactttggcaattcgtggaaggtaagctctcagtgtgccgatacacgcaaggtgccattagactcctcgcctgcaacttgccataataatattatgaagcagaccatggttgattcaagctgtagaatacttacgtccgacgttttccaggattgtaacaagttggtggaccccgagccctaccttgatgtctgtatctacgatacatgttcttgtgaatcaatcggtgactgcgcctgcttctgtgatactatcgcagcatatgcacacgtctgtgcacagcatggtaaggtggtcacgtggagaactgccaccttgtgcccccaatcttgtgaggagcgaaacctgagagagaatgggtatgagtgcgagtggcggtataactcttgcgcacccgcctgccaggtgacatgccagcatccagagcccctcgcatgcccggttcagtgcgtagagggctgtcacgctcattgtccacccgggaagatcctggatgagctgctgcagacctgcgtggacccggaagattgccctgtttgcgaggtggctgggcgtaggtttgcctctggtaagaaggtcacccttaaccccagtgacccagagcactgtcagatctgtcattgcgacgtggtgaatttaacatgcgaagcctgtcaagagcccggcggcctggtggttccgcccactgatgcacctgtatctccaaccaccctatacgtggaggatatcagcgaacctccactgcacgacttctattgctcccggcttttggatctggtgtttctcctggacgggtccagccggttgtccgaggcagagtttgaagttctaaaagccttcgtcgtggatatgatggaacgactgcggataagccaaaagtgggtccgggtggccgttgtggaataccacgatgggagtcacgcttacataggtctcaaagacaggaagagaccatctgagctgaggcgaattgctagccaggtcaagtacgctggctcacaagtggctagcacatccgaggtgctgaagtatacgctcttccagattttttctaaaattgatcgaccggaggcgagccggattacacttctactgatggctagccaagagccccagagaatgtcaagaaactttgtccggtacgttcaggggctgaaaaagaaaaaagttattgtgataccagttgggattggcccccacgcaaatctaaagcaaataaggctcatcgaaaaacaggccccagagaacaaagcgttcgttctgtcatccgtggatgaattggaacagcagcgggatgagatcgttagctacctctgtgatctggccccagaggcaccaccacccacgctcccccctgacatggcccaagtgaccgtgggtcctggcttgctgggggtttcaacactcggacccaagcggaactccatggtcctagacgtggcgttcgtccttgaagggtccgacaaaatcggcgaagccgacttcaacagaagcaaagagtttatggaggaggtaattcagagaatggatgttgggcaggattcaatccacgtgacggtgttacagtattcctacatggtgactgtagaatatccttttagtgaagcccagagtaagggagatattcttcagagggtgcgtgagatccggtaccaaggcgggaacaggacaaatacagggctcgcattaaggtatctgagtgatcattctttcctggtgtcccagggagatagagaacaggcgccaaacttggtgtatatggtcactggtaaccccgctagcgacgaaatcaaacggctcccgggtgatatacaggtggtcccaatcggtgttgggcctaatgctaatgttcaggaattggagagaattggctggccgaacgcccccattctgatacaggatttcgagactttacccagggaggcccccgatttagtccttcagcggtgttgtagcggcgagggactgcagatccctaccctctcgcctgctccagactgctcacagccgttagacgttattctccttttggatggcagtagttcatttcccgctagctattttgatgagatgaaatccttcgctaaagcctttattagcaaggcaaacataggcccccggctgacccaggtaagcgtgttgcagtacggcagcataacaaccatagatgtcccttggaatgtggtccctgaaaaggcgcatctgctatcactggtagacgtgatgcaacgggagggagggccctcacagatcggggacgccctgggatttgcggttcgctacttaaccagcgaaatgcatggagctcggccaggggcgagcaaggctgtagttattcttgtgactgatgtgagcgtggatagcgtggacgccgcggcagacgccgcccgaagcaatcgggtgaccgtgttcccgattggcatcggggaccgctacgacgcagcccagttaaggatcttagcaggcccagcaggtgactcaaacgtcgtaaaattacagcgtatagaagacctgcctacaatggtgacattaggcaattcatttctgcataagctgtgttccggcttcgtgagaatttgcatggatgaagatggcaacgagaaaagacctggagacgtgtggactctgcccgaccagtgccacacagttacttgtcagcctgacggccagactctcctgaagagtcatagagttaattgcgaccgagggctccgccctagttgccccaatagccagagcccagtcaaggtggaggagacttgtggatgcaggtggacctgtccgtgcgtgtgcacaggcagttcaacccgccatatagttaccttcgatggacagaacttcaagctgaccggctcatgctcctacgtactgtttcagaataaagagcaggacctggaggtgattctacataatggggcctgctcgcccggagctaggcaggggtgtatgaagtctatagaagtcaagcactcagcactctccgttgagttacattcggacatggaagttacggtgaatggacggctggtcagtgtgccctatgtgggggggaatatggaggtgaatgtgtacggggccataatgcatgaggtccgtttcaaccacctgggtcatatattcacattcacacctcaaaataatgaatttcagcttcaattatccccaaagaccttcgcctccaagacttacggcctatgcggcatttgtgacgaaaacggtgccaatgactttatgttgagagacggcactgtaacaacggattggaaaacacttgttcaggagtggacggtgcagcgccccggtcagacctgccaaccaatccttgaggagcagtgtttagtgcctgactcatcacactgccaggtgctcctgctccctctgtttgcggagtgtcacaaagtcttggctcccgcaactttctacgctatatgccagcaagattcatgtcaccaggaacaagtgtgcgaggtgatagcatcctatgcccatttgtgcaggacaaacggcgtatgcgtcgactggaggacaccagatttttgtgccatgagttgcccccctagtctcgtttacaaccactgcgagcatggttgcccgagacactgcgatggaaacgtatctagttgcggagaccatccctcagaaggctgtttctgtccgcccgacaaggtaatgctagaggggtcctgcgtgcctgaggaggcctgcacacaatgcattggagaggatggggtgcaacatcagtttctggaggcatgggtccccgatcaccagccctgccaaatctgtacctgtctgagcggtcggaaggtgaactgcacaacacagccttgtcccaccgccaaggcgcctacttgtggtttgtgtgaggtcgctcggctgcgccagaatgcggaccagtgttgtcccgaatacgaatgcgtctgtgatcctgtgtcctgtgatctcccacccgttccacactgcgagcgaggtctgcagccaaccctcaccaaccccggagagtgtcgacccaactttacctgcgcctgtcgtaaagaggaatgtaagagagtgtcccccccatcttgtccccctcacagacttcctactctgcgaaagactcagtgctgcgatgagtatgagtgtgcctgcaattgcgtaaacagcaccgtgagctgcccgctgggatacctggcatcgacagcaaccaatgattgcggctgcacaaccaccacgtgcttacctgacaaagtttgcgttcataggtccactatttaccccgtcggccagttttgggaggaaggatgcgatgtatgcacatgcactgacatggaggacgctgtcatggggctgcgagtggctcagtgctcccagaaaccctgtgaggactcatgccggtctggcttcacttatgtgctccacgaaggcgagtgttgcggtagatgtttgccctctgcttgtgaagtagtgacaggctccccacgaggagatagtcagtcatcatggaagtcggtgggctcccagtgggccagtcccgaaaatccatgcctgatcaatgagtgcgtccgcgtgaaagaggaagttttcatccaacaaagaaatgtatcctgcccccagttagaggtccctgtctgcccatccggatttcagctgagctgcaagacctccgcctgctgcccaagctgccggtgtgagcggatggaggcttgtatgttgaacggtaccgtgatcggacccgggaagactgtcatgattgacgtctgcactacttgccgatgcatggtgcaggtcggagtgatatcaggttttaagcttgaatgccgcaagactacatgcaacccttgtcccctggggtacaaggaggagaacaataccggcgagtgttgtgggcggtgtttgcctaccgcatgtaccattcaactccgtggcgggcaaatcatgaccctgaaaagagacgagaccctgcaagacggatgcgatacccacttttgtaaagtaaacgaacggggggagtacttctgggaaaaaagggttactggctgcccgccctttgatgaacacaaatgcctggcagaagggggaaagatcatgaagatcccaggtacatgctgcgacacctgcgaagagcccgagtgtaacgatattaccgctcgacttcaatatgtgaaggtggggtcctgtaagtctgaggttgaagtggacatccactactgccagggaaagtgtgcatcaaaagctatgtattccattgacattaacgacgtgcaagaccagtgctcttgttgcagtcccacgagaacagaacccatgcaggtggccctccattgtactaacggatccgtcgtctaccacgaggtgctcaacgccatggagtgtaagtgctccccacggaagtgttccaaa

SEQ ID NO: 21373 - DNA, 8439 bp, Artificial Sequence
  Description of Artificial Sequence: Synthetic coding sequence
atgattcctgctcgttttgccggtgttctgctagccctggcactgattttacccggcacactctgtgcagaagggacacgcggcagatcgagcactgcccgatgtagcctgtttggctcagattttgttaacacgtttgacggcagtatgtacagcttcgcaggctattgttcctacctgctggcgggggggtgtcaaaagcgatccttttccatcatcggagactttcagaacggcaaacgcgtcagcctcagcgtttacctgggcgagttcttcgacatccacctattcgttaatggcacggtcacccagggtgatcagcgggtctccatgccatacgcctcgaagggcctgtatcttgagaccgaagccggctattataaactgtccggcgaggcctatgggtttgtcgcacgcattgacggcagtggcaactttcaagtccttctgagcgaccgctatttcaacaaaacctgtggattatgtggtaatttcaacatctttgctgaggatgattttatgacccaggagggtacgctgacctcggatccgtatgatttcgcaaattcctgggctctctcttctggagagcagtggtgcgaaagagccagcccaccatcgagtagttgcaatatttcgtccggagaaatgcagaaaggcctgtgggaacaatgccaactgctgaagagtacatcagtgtttgccagatgtcacccactcgttgacccggaaccttttgtggctctatgtgaaaagacgttatgtgagtgtgccggaggactcgaatgcgcatgccccgctctcctcgaatatgccagaacgtgtgcccaggagggaatggtgttgtatggctggacagaccatagtgcctgctctccggtatgccccgccggcatggaatacaggcagtgcgtgtccccctgcgcacggacatgtcagagcctgcacataaacgaaatgtgtcaggagcgatgcgtggacggctgttcatgtccagaaggacagctcctggacgagggtttgtgtgtcgaatcaaccgaatgcccatgcgtgcattcaggcaagagatatcccccagggacgagtctgtcccgggactgcaacacctgtatttgtagaaactcacagtggatctgcagcaacgaggagtgccctggtgaatgtctggtgaccggtcaaagtcatttcaagtctttcgacaatcggtacttcactttttccggaatttgtcagtatctcctagcccgagactgccaggaccatagcttctctatagtgattgaaacagttcagtgcgcagacgatcgcgatgcggtatgtacgaggagcgtcactgtcagactgcccggcctgcacaactcactagtcaaacttaagcatggggccggcgtcgctatggacggacaggatgtacagctccccctgctgaaaggtgatctgcgcatccagcatacggtgacggcttccgtgaggctctcctatggggaagaccttcagatggactgggacggtcgggggcgactgctcgtgaagctgtcacccgtgtacgcgggaaaaacttgcggactttgtggtaattacaatggcaaccaaggtgacgatttccttaccccctctgggttggctgagcctagggtcgaggatttcgggaatgcctggaaacttcacggcgattgccaggacctgcagaagcagcactctgacccctgtgccctaaatccccgaatgacccgattctcagaagaagcctgtgctgttcttacgagtccaaccttcgaggcgtgccatcgggccgtaagccccctgccatatctgagaaattgccgatatgacgtttgcagctgtagcgacgggagggagtgcctctgcggagccctggcttcctacgctgccgcatgcgctggacgcggggtacgcgttgcttggcgcgagcccggtcggtgtgaattaaactgtcccaaaggtcaggtttacctccagtgtgggacaccgtgtaacctgacgtgtcggagtctcagctatcctgatgaggagtgtaatgaggcctgcctggagggctgcttttgccctccaggcctgtatatggatgagcggggagattgtgtgccaaaagcacaatgcccctgttattacgacggtgagatcttccaaccggaggacatattttccgatcaccacaccatgtgctactgtgaagatggcttcatgcactgcacgatgtcaggcgtgcctgggtccttgttaccagacgccgttctgtcctcccctttgagtcataggtcgaagcggtctctgagttgcaggccaccaatggttaagttagtgtgtcccgcggataacctgagggcagaaggactggagtgcaccaagacgtgtcagaactatgatctagagtgtatgtcaatgggctgtgtgagcggttgtctctgccccccaggcatggtgcggcacgagaataggtgcgtggccctggaacgatgtccctgctttcatcaaggcaaagaatacgctccaggtgaaaccgtaaagataggatgcaatacctgtgtctgtcaagatcgaaagtggaattgcactgatcacgtgtgtgatgcaacatgctccacaatcggcatggctcactatttgaccttcgacggcctgaaatacctgttccctggggagtgtcagtatgtcctggtgcaggactactgcggatccaaccccgggactttccggatcctagtgggtaataagggctgctctcaccccagcgttaagtgcaagaaaagagtcaccattcttgtggaaggcggcgagatcgagctcttcgacggtgaggtcaacgttaaaaggccaatgaaggatgagacccatttcgaagtggtagagagcggccgatatatcatcctcctgctcgggaaggctttgtccgtggtctgggatcgccacttgtctatatccgtggttttaaaacagacttatcaagaaaaagtgtgcggcctatgtggaaatttcgacggtatacagaataacgacctaacatctagtaacctgcaggtcgaagaggatccggtggatttcggcaactcctggaaagtttccagtcagtgtgcagacactcgaaaggtacctctcgatagttctccagcaacatgtcataataatatcatgaaacagaccatggtggatagctcttgcagaattcttacctcagatgtgtttcaggactgtaataagttggtggatccggaaccttacctagatgtgtgtatttacgacacgtgttcctgcgaatctatcggggactgtgcctgcttctgcgacacgatcgccgcatatgcacacgtgtgcgcccagcatgggaaggtcgtgacctggagaacagccacactgtgtcctcagagttgcgaggaaaggaacttacgtgaaaatgggtacgaatgcgaatggcgctacaacagctgcgctccggcatgtcaagtcacctgtcagcaccccgagcccttagcttgccctgtgcagtgcgtcgaagggtgccacgcgcactgccccccaggtaaaatcttggatgagcttctgcagacctgcgtcgaccctgaagactgtccagtctgcgaagtggcggggcgacgcttcgcctccggaaagaaagtcacacttaaccccagcgatccggagcactgccaaatctgccactgcgacgtggtcaacctaacatgcgaagcttgccaagaaccaggcgggttggtggtgcctcccacagatgccccggtatccccaactacgctgtacgtcgaggatatctctgagccaccacttcacgacttttattgcagtaggctgctggatctggtgttcctgctcgatggaagttctcgactctctgaagccgagtttgaggttctgaaagcattcgtggtggacatgatggaaaggctgcggatctcacaaaagtgggtaagggtcgcggtggtcgagtaccatgatggctcccatgcctatatcggcctgaaagacagaaagaggccatcagagctaagacgaatcgccagtcaggtgaagtacgccgggtctcaggtggcttcaacgtccgaggttttaaaatatacactgttccagattttttcaaagatcgatcgaccagaggcttctaggatcacccttctattgatggccagtcaagagccgcaacggatgtccagaaatttcgtccggtatgtgcagggtcttaaaaagaagaaggtgatagtcatcccagtaggcatagggccccacgccaatctcaaacagatcagactaatagagaagcaagccccggagaataaagcctttgtgctgtctagcgtggatgagttggagcaacagcgcgacgaaatagtctcctatctgtgcgaccttgcaccagaagcgccaccccctactctgccgcccgatatggcacaggtaacggtcggtcccggtctgttaggcgtgtccacgcttgggccaaagcgcaatagtatggtgcttgatgtggcgttcgtcctcgagggcagcgataaaattggggaagccgattttaaccggtcaaaggagtttatggaagaagttatacagcgaatggacgtcggccaggactccatacatgtcacagtgctacaatacagttacatggtgaccgtcgagtacccattctccgaggcccaaagcaagggcgacatcctgcagcgggtgagggagatcagatatcagggtggaaatagaacgaatactggactggctctgcggtatctttcagaccattcttttttggtgtcccagggcgatagggaacaagctcccaacctggtttacatggtgacaggcaatcccgcatcggacgaaattaagagattgcctggggatatccaggttgtcccgatcggagtcggaccaaatgctaacgtccaggaactggagaggataggatggccaaacgcccccatcttaattcaggactttgaaactctgccccgggaggctccagaccttgtgctgcagaggtgctgttcgggcgaaggcttgcaaattccaacactctccccagcccccgactgttcccagccattggatgtgatcctgcttctggacgggtcctcttcattccccgcctcctacttcgatgaaatgaagtcatttgcgaaggcctttatctccaaagcaaacataggccctaggttaactcaggtttcagtgctgcaatacggatctatcacaacaatcgacgtgccttggaacgtggtgcccgagaaggctcacttgctaagcctcgtagatgtcatgcagcgggaggggggtccgtctcaaatcggcgatgcccttggcttcgcagtgcgctacctcacctctgaaatgcatggggcccgcccaggagccagcaaagcagtggtgatcctagtcaccgacgtgagcgtcgactccgtagacgcagccgctgatgcggctcgcagcaatcgtgttaccgtgtttcctatcgggatcggagataggtacgacgccgcccagttgagaatcctggccggccccgccggggacagcaatgtggtcaagctgcaacgcatcgaagacctgcccacaatggtaactcttgggaatagctttttgcacaagctatgctccggatttgtgcgtatctgcatggatgaagatgggaacgagaaaaggcctggtgatgtgtggacacttccagaccagtgccatacagtaacctgtcaacctgacggccaaacactgctgaagtcccatcgagtaaactgtgatcggggccttcgaccctcatgtccaaactcacaaagtcctgtgaaagtggaagagacctgcggctgtagatggacatgcccttgtgtgtgcactggcagtagtactcgacacatcgtcacgtttgatgggcagaatttcaagctgactggctcttgcagctacgtgttattccaaaacaaggaacaggacctcgaagtgatactccacaatggagcgtgctcacctggagcccgccaaggctgtatgaagagtatagaggtcaagcacagcgccttgagtgttgagctccattcagatatggaggttacagtgaatggcaggttggtgtcggtcccctacgtggggggcaatatggaggtcaacgtttatggcgccatcatgcatgaggttagatttaaccacctggggcacatcttcacattcaccccgcagaataatgagttccagttgcagctgtctccgaagactttcgccagcaaaacgtatggtctttgtggaatctgcgacgagaacggcgcaaacgacttcatgctgagagacggcacagtgacgaccgattggaaaacgttagtgcaagaatggaccgtccaaaggccgggccagacttgccaacctattctggaggaacagtgtttggttccagattcaagccattgccaggttctccttctcccgcttttcgctgagtgtcacaaggtgttagctccagcgaccttttatgcaatatgtcagcaagactcgtgtcaccaggagcaggtctgtgaagtgattgctagttatgctcacctgtgccgaactaacggagtgtgcgttgattggcggacccctgatttttgtgcaatgtcctgccctccgagcttggtctataaccactgcgagcacggatgcccccggcattgcgacggaaatgtgtcctcgtgcggcgaccacccaagtgaaggatgcttctgcccgcctgataaagtcatgttagaggggtcctgtgtgcctgaagaggcgtgcacccagtgtattggcgaagacggggtgcagcatcagttcttagaggcatgggtgcccgaccaccagccttgtcagatctgtacttgccttagtggaaggaaagtaaattgcacaactcagccgtgcccaacagctaaagcaccgacctgtgggttgtgtgaggtggcccggcttcggcagaacgcagaccagtgctgtcctgagtacgaatgcgtatgtgaccccgtgtcttgcgacctcccccccgttcctcattgtgaaaggggcttgcagccaaccctcactaatccgggcgagtgccggcccaatttcacctgcgcctgtcgcaaagaggaatgtaagagagtttccccgccaagttgcccaccccaccgcttacctacactgaggaaaacccagtgttgcgatgaatacgaatgcgcatgcaactgcgtgaactccaccgttagctgtccgctgggctatctggcatccactgccaccaacgattgcgggtgtacaaccactacgtgcttgcccgacaaagtgtgtgtgcacagatccactatctacccagtgggccagttttgggaggaggggtgcgatgtatgcacctgtacagatatggaagatgctgtgatgggacttagagtcgcccagtgttctcagaagccctgtgaggactcatgtcggagcggatttacctacgtactgcacgagggtgaatgttgtgggagatgtctgcccagcgcttgtgaggtagtcaccggctcacctcggggcgatagccaatccagctggaagtcagttggatcccaatgggcatcacccgagaacccctgcttaattaatgagtgtgtcagggtgaaggaggaggtgtttatccaacaaaggaacgttagctgccctcagctcgaggtcccagtttgccctagtggcttccaactcagctgtaagacgagtgcttgctgtccttcctgtcgttgtgagagaatggaggcatgtatgttgaacggcacagtgatagggccaggcaaaaccgttatgattgacgtctgcacaacatgcaggtgcatggtgcaggtcggggtgataagtggtttcaaattggaatgtcggaagactacctgtaacccttgcccgcttggttataaggaggaaaacaatacaggcgagtgttgtggacggtgtttacctacagcttgcacaatccagctgcgaggtggacaaattatgaccctgaaaagagatgagaccttgcaggatggctgtgacacccacttctgcaaagtcaatgagcgaggggagtatttctgggagaagagggtgactgggtgtccccctttcgacgagcataagtgcctggcagagggcggcaagatcatgaaaatacctgggacctgctgcgacacgtgcgaggaaccagaatgcaacgacataactgcaagactgcagtacgtaaaggtagggtcttgtaagtccgaagtggaggtggatatccattactgtcagggcaagtgtgctagcaaagccatgtattccatagatataaatgatgtacaggaccagtgcagttgctgcagcccaaccaggacagaacctatgcaggttgcactgcactgcacgaacgggtccgtcgtgtaccatgaagtgcttaatgcgatggagtgtaagtgctcaccccgaaaatgttcgaag

SEQ ID NO: 21374 - DNA, 8439 bp, Artificial Sequence
  Description of Artificial Sequence: Synthetic coding sequence
atgatacctgcgcggttcgctggggtgctgcttgcactggcactgatacttccaggcacactttgtgcagaaggaacgcggggtaggtcctctacagctagatgctccctttttggttctgacttcgtaaacacctttgatgggagtatgtactcatttgccgggtactgcagctacctcttggccggtggctgtcagaagcgatcgttctcgatcatcggggatttccaaaacgggaagagggtgtccttgagcgtttatctcggcgagtttttcgatattcacctgtttgtgaatggcactgttacccagggcgaccaacgtgtgtctatgccatacgcatcaaagggtctatatctagagacagaggctggatactataaactgtctggcgaagcctatggattcgtagcccgcattgatgggtctgggaatttccaggtgttgctgtcggatcggtactttaacaagacttgtggcctctgtggtaacttcaatattttcgctgaagacgattttatgacgcaggagggaactcttacatcagacccatacgatttcgccaattcttgggctctttcctcaggcgaacagtggtgcgaaagagcatctcctccctcctccagctgtaatatctccagcggcgagatgcagaagggcttatgggaacagtgccagttactgaagtccaccagcgtctttgccagatgtcatcccttggtggatcccgagcccttcgtagcgctgtgtgagaagacgctttgcgagtgtgccggggggttagagtgcgcttgccccgctctcctggagtatgcacgcacgtgtgctcaggagggcatggtgctgtacgggtggactgatcacagcgcgtgttccccggtgtgccccgctgggatggagtaccgacagtgcgtttcaccgtgtgcaaggacttgtcaatcactccacataaacgaaatgtgtcaggagcgatgcgtcgatggttgttcttgccccgaggggcagctgctcgacgaggggttatgtgtcgaaagcaccgagtgtccttgcgtacacagcggcaaaaggtatccgcccgggacatcactctcacgcgattgtaacacttgcatatgtcggaatagccagtggatctgttctaatgaggagtgtcctggcgaatgtctggttacgggccaatcgcactttaaatctttcgacaacagatatttcactttctccggaatttgccagtatctgctcgccagggactgccaggatcactcattcagcatagtgatcgagactgtgcagtgtgcagatgatagagacgccgtttgtactcggtcggtgaccgtccgccttcccggactacacaactcactcgtcaagctcaagcatggcgcaggggtggccatggacggccaggacgtgcagctccctttgttgaagggagacttaagaatacagcatacagtgactgctagcgtccgactgagttatggtgaagacctgcagatggactgggatgggcgcgggagactcctggttaaactgtctccagtttacgccggaaagacctgcggattatgcggtaattacaatggcaaccaaggggatgactttttgacaccgtcagggctcgccgagccgcgtgtagaggacttcggtaacgcttggaagctccatggcgactgtcaggacttgcagaaacaacactctgatccgtgtgccctaaacccccgtatgaccagatttagcgaagaagcttgcgccgtcctaacatccccaacattcgaagcctgccaccgcgccgtgagccccctcccctacctgagaaactgtcggtacgacgtgtgctcttgtagcgatggccgagagtgcctgtgcggggccctggccagctacgcggctgcttgtgccggaagaggcgttcgtgttgcttggcgcgaacctggacgttgcgagctcaactgccccaagggccaggtgtacctgcaatgcggtacgccgtgtaatctgacctgccgcagcctgtcgtatcctgacgaggagtgtaatgaagcttgcctagagggatgtttctgtcccccgggactttatatggatgaaaggggagactgcgttccgaaggcccaatgtccctgttactacgatggagaaatatttcagcccgaggatatctttagcgatcaccacaccatgtgctactgcgaggatgggtttatgcactgcacaatgtccggcgtacccggaagcctcttacctgatgcagtgttgtcttcgcccctgagccacaggtcaaaaaggagcctctcttgccggccaccaatggtcaagctcgtttgcccagcagacaacttgcgtgctgaaggactagaatgcacaaaaacctgtcaaaactacgatcttgagtgtatgtctatgggctgtgtatctgggtgcctctgtccgcctggcatggttcgtcatgaaaaccgttgcgtggcactggagaggtgtccatgctttcaccagggcaaggagtatgctcctggagagacggtgaagattggatgtaacacctgcgtttgtcaggacaggaagtggaactgtactgatcacgtctgtgacgccacttgttccactatcgggatggcacactacctgacttttgatggactgaagtatctgttcccaggggaatgccaatacgtcctggttcaggattattgtgggtcaaatcctggtacgtttagaatactggttggcaacaaagggtgctcgcacccttccgtgaaatgcaagaaacgcgttaccattttggtcgagggcggggagattgagctctttgacggcgaagtgaatgtaaagcggcctatgaaggatgagactcacttcgaagtggtggaatctgggcgctatataatcctcctgctggggaaggccctgagtgttgtctgggatagacacctgagtatttccgtggtactgaaacagacctaccaggagaaggtgtgcggtctttgcgggaactttgatggaattcagaacaatgatctgaccagctcaaacctccaggtcgaagaagatcccgtggacttcggaaatagctggaaggtctcaagccagtgtgccgacacgaggaaggtgcctctggactcaagtccagctacttgccataataatattatgaagcagaccatggtcgactcctcttgcagaatccttactagtgacgtgttccaggattgtaataagcttgtggatccggagccttatttagacgtctgtatttacgacacctgtagctgtgaatctattggggactgcgcctgtttctgtgacacaattgccgcatacgctcacgtatgcgcccaacatggcaaggtggtgacttggcgaactgcgaccctgtgtccacaatcctgcgaggagcggaatttacgcgaaaacggctacgagtgtgagtggagatataattcttgtgccccagcatgccaagtgacctgccagcatcctgaaccactagcctgccctgtgcagtgcgtcgaaggatgtcacgctcattgtccccccggaaagatcttggacgagctgttgcagacctgcgttgatcccgaggactgtcctgtgtgtgaggtggcagggcgaagattcgcctctggaaagaaagtgaccctaaacccttcagatccagaacattgtcagatctgtcactgcgatgtggtgaatctgacatgcgaggcctgccaggagcccgggggcctcgtagtgccacctacggacgccccagtctcgccaacaaccctgtacgtggaggatatcagtgaacctcctctgcacgatttctattgtagccgtctgttggatctggtctttctcctggatgggtctagcagacttagcgaggctgagtttgaagtgttgaaagctttcgttgtggacatgatggagcggctgcgcatttcgcaaaaatgggttcgggtggccgtagtggaataccatgatggcagtcatgcatatattggccttaaagaccgaaagaggccctcggaactgcggcgtattgcctctcaggttaaatatgctggttctcaggtggcttctacttccgaggtgctgaagtacacccttttccaaatctttagcaagattgacagaccagaggcgtccagaatcacactgctgctgatggctagccaggaacctcagaggatgagcaggaatttcgttcggtacgtccaggggttgaaaaagaaaaaagtgatagtgatcccagtcggaattgggccacatgcgaacttaaagcagattcgtctgatcgaaaagcaggctccagaaaataaagcttttgttctctcatcagtcgacgaactggaacagcaaagggatgagatcgtgtcctacctgtgcgacctggcgcctgaggcacctcccccaacattgcccccggacatggcccaggttactgttggtcctggcctccttggtgtaagtacattaggtcccaagagaaattccatggtgctggatgtggcctttgtgttggaaggcagtgataagatcggcgaggcggactttaaccggtccaaagagttcatggaagaggtgatccaaaggatggacgtcgggcaggactccatccacgtgaccgttttgcagtatagttatatggtgacagtggaatatccatttagtgaggcacagagtaaaggtgatatcttacagcgcgtgcgggagattcgctatcagggaggaaatagaacaaatactggtctggccttaagatacctcagcgatcactcattcttagtgagtcagggcgacagggagcaggcccccaaccttgtatacatggtgaccggtaatccggcttcggatgagataaaacgactccccggtgacatccaagttgtaccgataggcgtgggacccaatgcaaacgttcaggagctggaaagaatcgggtggccaaatgcccccatcctgatccaagattttgaaaccctaccgagagaggctccagatctggtactgcagcggtgctgtagtggagaaggcctccagattcctactctaagtcccgcccccgattgttcacaacctctggatgtcattcttctgctcgatggatcatcctcctttcctgcctcttacttcgatgaaatgaaatccttcgccaaggcatttatttccaaggctaatatcgggcctcgtttgacccaggtgtcagtgttgcagtatgggtcaattacgactattgacgtcccttggaacgtggtgcccgaaaaggcacatttattgtccctggtagatgtgatgcagcgcgagggtggaccatcccagatcggagatgcactcggctttgctgttaggtacctgacaagcgaaatgcatggtgcccggcctggtgcatccaaagcagtagtgatcttggttacggacgtatcagtggactccgtagacgcagccgctgacgctgcgcgttctaacagagtgacggtattccctattggaattggagacaggtacgatgcagcacagctgagaatcctggctggaccggccggcgactccaatgtggttaaactccagcgcatcgaggacttgcccacgatggttacattggggaactcgttcctccacaaactgtgcagcggctttgtgcgcatttgtatggatgaggacggcaatgaaaaacgccccggagacgtgtggaccttgcccgaccaatgccacaccgttacttgtcagccagacggccaaactctgctcaaaagccaccgggtcaattgtgacagaggccttcgtccatcttgtcctaattcacaatcaccagtaaaggtggaggaaacttgcggatgtcgatggacctgtccatgcgtctgcaccggcagctctacgcggcatatcgtgaccttcgatggccagaactttaagctgactggtagctgcagctatgtactcttccaaaacaaggaacaggacctggaggtaatcctccataacggtgcgtgcagcccaggcgcccggcagggatgcatgaaaagcatcgaggttaaacattcagctctgtccgtggaactgcactccgacatggaggttaccgtcaacgggaggctggttagcgtgccatatgttggcggcaatatggaagtgaacgtgtacggggccattatgcatgaagtccgctttaatcacctaggccacatttttacattcaccccgcagaataacgagtttcagctgcaactgtcacctaaaacctttgcgagtaaaacatacggcctttgcggcatctgcgacgaaaatggagctaatgattttatgctcagggacggcacagtaaccacagattggaagacactggtccaggagtggactgtacagcgacctggccagacttgccagcccatcctggaagaacagtgtttagtgccagactccagccactgccaggtactactcctgcctttgttcgcagagtgtcataaggttctagccccggcgactttctacgctatatgtcagcaggacagctgccatcaggaacaggtctgcgaggttattgcctcttacgcgcacctgtgcagaaccaacggcgtgtgcgtggattggaggactccagatttttgcgctatgtcgtgccccccctccctggtatataaccattgcgagcacgggtgcccgcgacactgtgatggcaacgtgagttcctgcggcgaccacccttcggaaggctgcttctgtcccccagacaaagtgatgcttgagggtagctgtgtgcctgaggaggcatgcacacagtgtataggggaagacggggtgcagcaccaatttctggaagcctgggtgcccgaccaccagccctgccaaatttgcacatgcctgagtggccgcaaagtgaactgtaccactcaaccatgcccaactgccaaagcccctacctgcggactctgtgaggtggctcgcctccggcagaatgcggaccaatgttgtcctgaatacgagtgtgtctgcgatcctgtcagttgtgatctacctcccgtacctcactgtgagcgcgggctgcagcctactctgactaacccaggggaatgccggcctaacttcacctgtgcatgcagaaaggaggagtgcaaacgggtatccccccctagctgtccccctcataggctgccaaccctgagaaaaacacagtgttgcgacgaatatgagtgtgcgtgtaactgtgtgaatagtacagtatcctgccccctgggttatctggcctctacggcaactaacgactgcgggtgcaccaccacaacctgcctaccagataaggtgtgcgtccaccgctctacgatctacccagttgggcagttctgggaggaaggatgtgatgtatgcacttgtactgacatggaagatgcggtgatggggctgagagtggcccagtgcagtcagaagccttgtgaagattcctgtcgcagtggcttcacatacgttctgcatgagggagagtgttgcggtcgttgccttccatcagcctgtgaggtcgtcaccggtagcccgagaggggacagtcagtcctcttggaagtcagtggggagccaatgggcctctccggagaacccttgtttgattaacgagtgcgtgcgtgtcaaggaggaagtattcatacaacagcggaatgtgagttgtccccaactcgaagtgcccgtctgccctagcggtttccagttgtcttgcaagacatcggcctgctgtcccagctgtcggtgcgagcggatggaagcctgcatgttgaatggcaccgtaatcggccccggaaagaccgtaatgatcgacgtatgcacgacatgtcgttgcatggtgcaggtcggcgtcatttctggctttaagctggagtgtagaaagacgacatgcaatccctgtcctctcggctataaggaagagaacaacactggtgaatgctgtgggcgctgccttccaacggcgtgtaccattcagttaagaggcggccagatcatgacactgaaacgtgacgagaccctgcaggatggatgcgacactcacttttgcaaagtgaatgaaaggggcgaatacttctgggagaagcgagtgacgggatgccctccgtttgacgagcacaagtgcctagcagagggcgggaagatcatgaaaatccctgggacttgctgtgatacatgcgaagagccagaatgcaatgacattacggcgcggctgcaatatgtcaaggttggaagttgtaaaagcgaggtggaggtggacattcattactgccagggtaagtgtgcatctaaggcaatgtattctatcgacatcaacgacgtgcaggaccagtgctcatgctgttcccctacacggacagagccgatgcaggtcgctctccactgcaccaatggctcggtcgtatatcacgaggtgctcaatgcaatggaatgcaagtgttcaccacgcaagtgttccaag

SEQ ID NO: 21375 - DNA, 8439 bp, Artificial Sequence
  Description of Artificial Sequence: Synthetic coding sequence
atgatccccgccaggttcgccggcgtgctgctggctctggccctgatattgcctggcacgttgtgcgcagaagggacccgtggtagatcctcaacggctaggtgtagcctatttggtagtgatttcgtcaataccttcgacggttctatgtattccttcgctgggtactgttcatatctacttgctggaggatgtcagaagagatccttctccatcatcggcgactttcagaacggcaagagggtttccctgtctgtctatctcggggaattctttgatattcacctgttcgttaatgggactgtcacacagggtgatcagagggtgagcatgccttacgcatccaaaggcctctatctggagactgaggccgggtattataagctgagtggtgaagcctatgggtttgtcgccaggatcgacggatccggcaacttccaggttctgctgagcgataggtacttcaacaagacctgtggcctgtgcggaaatttcaatatttttgcagaagatgatttcatgacacaggaggggactctaacctccgacccctacgattttgccaacagctgggctctgtcttcaggcgaacagtggtgcgagcgtgcctcaccacccagttcctcatgcaatatttcctccggggagatgcaaaagggcctgtgggagcagtgtcagctgctcaagtcaactagtgtttttgctcgttgtcacccattagtcgaccccgagcctttcgtcgccttgtgcgagaagacactttgtgagtgcgccggcggcctggaatgcgcctgcccagctctgctggagtacgccagaacgtgcgctcaggagggtatggtgctctatggctggaccgaccattccgcctgcagccccgtctgcccagccggaatggaatataggcaatgcgtgtccccttgtgctagaacctgccagtccctgcacatcaacgagatgtgccaagagcggtgcgtcgatgggtgcagttgtcctgaagggcagctgctagacgagggactctgcgtggagagcaccgagtgcccttgcgtgcattctggcaagcgttatcccccaggcacaagcttgtcccgcgactgcaatacatgtatctgccgcaactctcagtggatctgtagtaatgaggagtgtcctggggagtgtctcgtgaccggtcagtctcactttaaatcttttgataacaggtattttacctttagcggaatatgtcaatatctcctggcgcgcgattgtcaggaccatagcttttctattgtgatcgagactgtacagtgtgcggacgaccgcgacgccgtttgcacccggagcgtgacagtcaggctgccaggtctccacaattccctcgtgaagctgaaacatggcgctggggtggctatggacggtcaggatgttcagctccccttactcaaaggagatctcagaatccagcacactgtaactgcctcggtcaggttatcctacggtgaggatctccagatggactgggacggtcgaggccggctacttgtgaaactgtcaccagtatacgctggaaaaacctgtgggttgtgcggaaattacaacgggaaccagggtgacgactttctgacaccttctggtttggcagaaccaagagtggaagacttcggaaatgcgtggaagctccacggggattgccaggacctacagaaacagcactctgacccatgcgccctcaaccctagaatgacacgtttctccgaagaagcttgcgctgtcctgaccagcccaacattcgaagcatgccatcgcgctgtgagtcccctcccatacctgcgcaactgccgatacgatgtgtgttcttgcagcgacggacgtgagtgtttatgtggcgctctcgcaagttatgccgctgcgtgcgcgggaaggggtgtccgggtggcttggagggagccagggcggtgcgagctgaattgccctaagggacaggtgtacctgcagtgtggcactccctgtaacctcacatgtaggtcactgagctatcctgatgaagaatgcaacgaggcgtgcctggaggggtgcttctgccctccaggtctttacatggatgagcggggggattgtgtcccaaaggcacaatgtccctgttattacgacggggaaatcttccagcctgaagacattttttcagaccatcatactatgtgctactgtgaggatggattcatgcattgcaccatgtccggcgtccccggctcattactcccagatgcagtgctgagctctcccctgagtcaccggagtaagagatctttgtcctgtcgtccgcctatggtgaagctcgtttgcccggctgacaatctgagggccgaaggactcgaatgcaccaagacatgtcagaattatgacctggaatgtatgtcgatgggctgtgtgagtggatgcctgtgcccccctggcatggtgcgccacgagaacaggtgcgtggcactggagcgctgcccttgcttccatcaaggaaaggagtacgcacctggggagaccgttaagatcgggtgcaacacgtgtgtgtgtcaggatcgaaaatggaattgtaccgatcatgtgtgtgatgccacttgctcaactatcggaatggcgcattaccttactttcgatggcctgaaatatctttttccaggtgaatgccagtatgtgctggtacaagactactgtggtagcaaccccgggacctttcgcattctcgttggaaacaagggctgttctcacccatcagtgaagtgtaagaagagagtgacaatcctggtcgaggggggtgaaatcgaactatttgatggtgaagtaaacgtcaagcggcctatgaaagacgagacacacttcgaggtggtcgaatccggtagatatataattctgctgctgggaaaggcactgagtgtagtctgggacagacacctatcaatctccgtagttcttaaacagacgtaccaggaaaaggtgtgcggcctgtgtggcaatttcgatggaatccagaacaacgatctgacctctagcaacctccaggtggaggaggatcccgtggactttgggaacagctggaaagtgagttcacagtgtgctgatactcgcaaggtccccttggattcatctccagccacatgtcacaataatattatgaagcaaacaatggttgattcctcttgccgaatccttacaagcgatgtttttcaggattgcaataagttggttgacccggaaccttatctggatgtttgcatttacgatacatgtagctgtgaatctattggcgactgcgcctgcttctgcgataccattgctgcgtacgcacacgtctgtgcccagcacgggaaagtggtcacctggcgcaccgcgactctttgcccccagagttgcgaagagaggaacctcagggaaaacggctacgagtgtgaatggcgttacaactcatgtgctccagcgtgtcaggtcacatgccagcaccccgagccactggcctgccctgtacagtgtgtggagggatgtcacgctcactgtcccccaggcaagatactggatgaactgcttcagacttgcgtggacccggaagattgcccagtgtgtgaggtcgccggtcggcgtttcgctagcggaaaaaaggtcacattgaatccatccgacccagagcactgtcagatctgtcactgcgatgttgttaacttgacttgtgaagcttgccaagaacccggaggtttggttgtccctcctaccgatgcaccggtgagccctaccaccctgtatgtggaggatatcagtgagcctccactgcacgacttttattgttcaagattactggaccttgtattcctgctagatggatcttcaaggctgtccgaagcggaatttgaggtgctaaaagcctttgtcgttgatatgatggagcgactccgaatctcccagaagtgggtgcgggttgccgtggtagagtatcatgacggatctcatgcttacataggtcttaaagacagaaagcgaccgtcggagctgcgtcgcatagctagccaggtgaagtacgccgggagtcaagttgctagtaccagtgaagtgttgaagtacacgctgttccagatattctcaaagatcgaccggccagaggcatcaagaattactctcctgctcatggccagccaggagccccaacgcatgagcaggaattttgtcagatacgtgcagggtctgaagaagaaaaaggtcattgtcatccctgttgggatcggacctcatgcaaacctgaagcagattagattgatcgagaaacaagcgccggagaataaggcctttgtgctttcctctgtggatgagttggagcagcagcgtgacgaaattgtcagctacttgtgcgacctcgctcccgaggcaccgccaccaactctaccaccagatatggcccaagtcaccgtggggccgggactcctgggcgtgtcgactctgggccccaagaggaacagcatggtgctggatgtggcttttgtcctggagggttctgataaaattggtgaggctgactttaataggagtaaggagttcatggaagaggtcattcagcggatggatgtggggcaagactccatccatgtgacagtcctgcagtactcatacatggtgacagtcgagtatcctttctcggaggctcagtccaagggcgacattcttcaacgcgtgcgggaaatcaggtaccagggggggaaccggactaatacggggcttgcattgagatacctgtctgaccacagctttcttgtcagtcagggagacagggagcaggcgcctaatctggtttatatggtgaccggtaatcctgccagcgacgaaataaaaaggctccctggggacattcaggtagtgccaattggagtggggcccaatgctaatgtacaggagctggagcgaatcggttggcctaatgcacccatactaatccaggacttcgaaacgctccccagagaagcacccgatctggtgctgcagagatgttgctctggagaaggcctacaaatacctactttatctcctgcccctgactgctcacaacctctcgacgtgattctcctcctagatggcagcagctctttcccagcttcctattttgacgagatgaagtcgttcgctaaggctttcatttctaaggcaaacattggtccccggctgacccaagtcagcgttttgcagtatggctccataactacgatcgatgtgccttggaatgtggttcccgagaaggcccatctcctgagcctggtcgatgtgatgcagcgggagggggggccctcccagatcggcgatgccctgggattcgcagtcagatacttgaccagcgagatgcacggtgctaggccaggcgcatctaaagctgtggttatcctggtgacggacgtttccgtagacagcgtggacgcagcagcagacgccgctaggtctaatcgcgtcacagtttttcccatcggtataggggaccgatatgacgctgcgcagctccgcattcttgccggtcccgccggggacagcaatgtcgtaaagctccagaggattgaggatctgccgacaatggtgactctcggaaatagtttccttcacaagctgtgtagcggattcgtgcgaatttgtatggacgaagatggtaacgagaaacgacccggcgacgtgtggaccctcccggaccagtgtcataccgtcacctgccagcctgatggacagactctgttaaagtctcacagggttaactgtgaccggggccttagaccttcctgtccaaacagtcagagccctgtgaaggtggaggaaacatgtggctgtagatggacctgtccatgcgtttgcaccggctccagtacaagacacattgtgacttttgacggccagaattttaaactgaccggatcttgttcttacgtgctgttccagaataaagagcaagacctcgaagtaatcctgcataatggggcttgttcacctggcgctcgtcaaggatgtatgaagtccattgaggtcaagcactcagccctgagcgttgaactgcacagcgatatggaggtgaccgtgaatggacgtctggtttccgttccatatgttggaggtaacatggaagtaaacgtatatggcgctatcatgcatgaggtgcgttttaaccacctgggccacatttttacctttacaccacagaacaacgagttccagctacagctttccccaaaaactttcgccagcaagacctacggactctgtggcatttgcgatgagaatggagcaaacgatttcatgcttcgcgatggaactgtgactacggactggaagactctcgtgcaggagtggactgtccagcggcccgggcaaacttgtcagcccattttggaagaacagtgtcttgtgccagactcgtcccattgtcaggtgctgctcttgcctttatttgccgagtgccacaaggtgcttgccccagccaccttctacgctatatgccaacaggactcttgtcatcaagaacaagtgtgcgaggttattgcgagctacgcccacttatgtcgcacaaatggggtttgcgtggattggcgcactccagacttctgtgcgatgagttgtcctccttccctggtatacaaccattgcgaacacggatgcccacgccactgcgatggcaatgtctcctcgtgcggagaccatccctctgagggatgcttttgcccacccgacaaagttatgcttgagggatcttgtgtgccagaagaggcttgtactcagtgtattggggaagacggagtgcagcaccagttcttggaagcctgggtgcctgatcatcagccttgtcagatctgcacatgcctatctggcaggaaagtgaactgtaccacccagccttgtccaacggctaaagcccccacctgtggattgtgtgaagttgcgagactcaggcaaaacgcagatcagtgttgtccggagtacgaatgcgtgtgtgatcctgtcagctgtgacctgccgcctgttccccactgtgaaaggggcctgcagcccacgctgaccaaccctggagagtgtcggccaaatttcacatgtgcgtgtaggaaggaggagtgtaagcgtgtcagtccgccctcctgtcccccacacaggcttcctactttgcggaagacacagtgttgtgacgaatatgagtgtgcctgcaattgcgtgaatagcacggtttcttgcccactggggtatcttgcctctactgctaccaacgattgcggatgtaccaccacaacgtgtctgcctgacaaggtgtgcgtacaccggtccactatctaccctgttgggcagttctgggaggagggttgcgatgtgtgcacgtgtaccgatatggaggatgctgtgatgggcctgcgcgttgcacagtgctcccagaaaccctgcgaggattcatgtcggagcggatttacatatgttctgcacgaaggtgaatgttgtggtaggtgcctgccgagcgcctgtgaagtggttactgggtcaccccgtggcgactcacagtccagctggaaatcagtgggatcccagtgggcctcccctgaaaatccctgcctcatcaatgaatgtgtgagagttaaagaggaggtgttcattcagcaacgcaatgtcagctgcccacagctagaagttccagtgtgtcccagtggcttccaactgtcctgcaaaacatcagcttgttgtccaagctgtagatgcgagcgaatggaagcctgtatgcttaatgggaccgtcatcggccctggtaaaactgttatgatcgatgtgtgtacgacttgtcgatgcatggtccaggtgggggttatcagcggttttaagctggagtgcaggaaaactacatgtaatccgtgtcccctaggctataaggaagagaacaacaccggtgagtgttgtgggaggtgtttgcccacggcatgtaccatacagctacgcggcggccaaatcatgactctgaagagggacgagactttgcaggacggctgcgacacccatttctgtaaggtgaacgaacgcggcgagtacttctgggagaagcgcgtgactggatgtccaccctttgatgaacacaaatgtttggctgagggcggaaagatcatgaaaatccccggcacttgttgtgacacctgcgaggagcctgagtgcaacgacatcacggccaggctccagtacgtgaaggtcgggagctgtaagagtgaggtcgaggtggacattcactattgtcagggtaaatgtgcaagcaaggcaatgtattctattgatattaacgacgttcaggaccagtgcagctgttgcagcccaacacgcacggaaccaatgcaggttgctttgcactgtacgaacggctcggtagtgtatcatgaggtgctgaacgctatggagtgtaaatgttccccacgtaagtgcagcaaa

SEQ ID NO: 21376 - DNA, 8439 bp, Artificial Sequence
  Description of Artificial Sequence: Synthetic coding sequence
atgatcccagcaaggtttgctggggtgctacttgcccttgcactcattctgccggggacattgtgcgcggaagggactaggggacgtagctctacggctagatgttctttgtttgggtcggacttcgtgaataccttcgatggatctatgtatagcttcgctggctactgtagctatctccttgcgggtggctgccaaaagcgctctttctctatcattggtgatttccagaacggcaagagagttagcctgtcagtataccttggggagttttttgacattcacctctttgtgaacggcacggtaactcagggtgatcagagggtgtcaatgccgtatgcttctaagggcttgtatttggagacggaggctggttattataaactcagtggtgaggcctacggctttgttgcaagaattgatggaagtggcaacttccaagtgctgctgagtgataggtatttcaataaaacctgcggcttatgtggtaactttaatattttcgctgaggatgattttatgacacaggagggtaccctcacttcagatccatacgatttcgctaattcttgggctctgtcttcgggcgagcaatggtgtgaaagagctagccctccatccagttcctgcaatatcagctccggtgagatgcaaaaagggctctgggagcaatgtcaacttcttaaatccacttccgttttcgccagatgccatccactagtggatcccgaaccgttcgtagcactgtgcgagaaaaccttgtgcgaatgtgcaggggggcttgaatgcgcatgtcccgctttgttggagtatgctagaacctgtgcacaagagggcatggtgctatatggctggaccgatcactcagcttgcagtccagtgtgtccagcaggaatggagtacagacagtgcgtgtccccttgtgctaggacatgccagagcctacatattaacgaaatgtgccaagagcggtgtgtggatggttgctcttgcccggagggacaattgttggatgaaggtctgtgtgttgaatccacagagtgcccttgcgtgcatagcggtaagagatatcctccaggaactagcctcagtcgagattgtaatacgtgtatttgcaggaacagccaatggatatgttctaacgaagaatgccctggagagtgtcttgtcactggtcaaagtcacttcaaaagttttgacaatcgatatttcacattcagtgggatttgtcaatacttgctagctcgtgattgccaggaccatagcttctctattgtgatcgagactgttcaatgtgctgatgatcgcgatgctgtctgcacacgaagcgttaccgtgaggttgcctggattgcacaactctcttgttaaattaaagcatggagcaggcgttgcaatggacggtcaagatgttcagctcccacttctaaaaggggaccttcgtattcagcacactgtgactgccagtgtgaggcttagttatggggaagatctgcaaatggattgggacggtcgtgggcgactccttgttaaactgtcaccagtctacgccggcaaaacgtgtggactttgcggtaattacaacggaaaccagggcgatgatttcttaaccccatctggacttgcggagcccagagtggaggattttggtaatgcgtggaagcttcatggagattgccaggatcttcaaaagcagcattcggatccttgtgcgctaaacccaagaatgactagattcagcgaagaggcgtgtgctgttttgacttctccaacctttgaggcatgccatagggctgtttcacctcttccgtatcttaggaattgtcggtatgacgtgtgttcttgttctgatgggagggagtgtctctgcggggcactggcttcttacgcggctgcctgtgcaggtcgaggcgtgagagttgcatggcgggaaccaggtagatgcgagcttaattgccctaagggtcaagtttaccttcagtgcggtacaccgtgtaaccttacgtgccgttcgctgtcttatccagatgaggaatgcaacgaagcctgcctcgagggctgcttttgcccacctgggttatatatggatgaaagaggcgattgcgtgcccaaagctcagtgtccgtgctactatgacggggagatctttcagccggaggatatcttttctgaccatcacaccatgtgctattgtgaagatggcttcatgcattgcactatgtcaggtgtgccaggatccttactcccagacgcagtgctgtcttccccattatctcataggtctaagagatctttgagctgccggcctcccatggttaaactcgtttgcccagccgataacctcagagcagagggcttggaatgcacaaagacgtgccagaactacgatctggaatgtatgagtatggggtgtgttagtggatgtctttgtccaccaggtatggtcaggcacgagaatagatgcgtggcactcgaacgatgcccttgctttcatcaaggcaaagagtacgccccaggggaaactgttaaaatcgggtgtaatacctgtgtctgtcaagatcgtaagtggaattgtacagatcacgtgtgcgacgccacttgtagcaccatagggatggctcattacctgacttttgacggactgaaatatctttttccgggagaatgtcaatatgtcttagttcaggactattgcggcagcaaccctgggactttcagaattctagttggtaacaaggggtgtagccatccctctgtcaagtgtaagaaaagggtaactattttggttgagggtggagaaattgagttatttgatggagaggttaacgtcaaacgaccaatgaaagatgagactcactttgaagtagttgagagcggtcgatacataatattgctactcggaaaggccttgagcgtcgtttgggaccggcacctctcaattagcgttgttctcaagcagacgtaccaggaaaaggtttgtgggctctgcgggaactttgatggcatccagaacaatgatctcacatcctcgaaccttcaagtggaagaggatccagttgactttggtaactcatggaaggtctcttctcaatgcgccgatacgcgaaaagtcccactagattcatcaccagctacttgccataacaatattatgaaacaaactatggttgattcttcttgccggattctcacctctgatgttttccaagattgtaacaagttggttgatcccgaaccttatctcgatgtttgcatttacgacacatgctcgtgtgagtccattggagactgtgcgtgtttctgcgatacgatcgcagcttacgctcacgtttgtgctcagcatggtaaagttgtaacgtggcgaacagctactttatgtcctcaatcttgcgaggaaaggaacctcagggagaatgggtatgagtgcgaatggcgttacaattcttgcgctcctgcatgtcaggtaacttgccaacatccagaacctttggcctgccctgttcaatgtgttgagggatgtcacgctcattgccccccaggtaagatactggacgagttgttgcaaacttgcgtggatcccgaagattgccctgtgtgcgaggttgcaggtagaaggtttgcatcagggaagaaggttacgctgaatccttccgatcctgaacattgtcaaatctgtcattgtgatgtcgttaatcttacatgcgaagcttgccaagagcctggtggattagttgttcctccaaccgatgcgcctgtaagcccgaccacattgtatgttgaagacatcagtgagcctccacttcatgatttttattgcagccgattactcgatctcgtttttttactcgacggttctagcagactttctgaagctgaattcgaggttcttaaggcattcgtggtagacatgatggagcgacttagaatctcacaaaaatgggtcagagttgctgttgttgaatatcacgacgggtctcatgcgtacattggcttgaaagatcgaaaaaggccgagcgaactgagaagaattgctagtcaagtgaagtacgcaggatcacaagtcgcatccacttctgaagtgctgaagtatactttgtttcaaattttttccaagattgaccgtcctgaggctagtagaatcaccctcctgcttatggcgtcacaggagccacaacgtatgtcaagaaattttgtgagatatgttcaaggccttaaaaagaaaaaagtcatagttatccccgtgggcatcggtcctcatgctaacctaaaacagataaggttaatcgagaagcaggcacccgaaaataaagcttttgtgttgagtagtgtggacgagcttgaacaacaaagagatgagatcgtttcctatctttgcgatctcgctcctgaggctccaccacctacattgccaccagatatggcccaagtcaccgtgggtcctggtttgctgggtgtgtcaactttgggacccaagcgtaatagtatggttttggatgttgcgtttgttttggaagggagtgataaaattggggaagctgattttaatcgcagtaaagagttcatggaggaagtgatacaacgaatggacgttggccaggattctattcatgtaacagtcttgcaatattcatatatggttacagtggagtatccattcagcgaagctcaaagcaagggcgacattctccaacgcgttcgagagatcagataccaaggtggaaacagaacaaacactggacttgccctcagatatttatctgaccattcattccttgtttcccagggagatagggagcaggctccaaatcttgtttatatggtcactggtaatcctgcttcggatgaaattaaaaggcttccgggtgatatacaagtggtacctattggcgtgggtccgaatgcgaatgttcaggaactggagagaattggatggcccaacgctccaatattgatccaggacttcgagacacttccacgggaagcgccagatctggtattacaacgctgctgttctggtgaaggacttcagattcctacattatcacctgctcctgattgttcacagccccttgatgtgatcttgctgttggatgggtctagttcgttccccgcatcgtactttgatgaaatgaaatcatttgctaaagctttcatcagcaaggcaaacattggtccacgtcttacacaagtgtctgtcctccaatatggatcgataaccactatcgatgttccatggaatgttgtccctgaaaaggctcacttgttgagtcttgttgacgttatgcaacgagaaggagggccatcacaaataggtgatgctctgggttttgccgtgcggtatttgacttccgagatgcatggcgcacgccccggggcatctaaagcagttgtcattttggttaccgatgtttccgtggactccgttgatgctgccgccgacgcggcgcgtagcaatcgagttacagtttttcctattggtatcggcgatagatacgacgctgctcaactacgtatactggctggaccagcgggagactcaaacgtggttaagcttcaaaggattgaggacttacctacaatggttactcttggcaactcattcttgcacaaattgtgttcggggtttgttaggatatgtatggatgaggacggcaatgagaaacggcctggtgacgtctggacactacctgatcaatgtcatacggtgacatgtcagccagatggccagactcttttgaaatctcatagagttaattgcgaccgtggtttgcgaccttcttgccctaactcccagtcgccagttaaggttgaggaaacctgcgggtgcagatggacttgcccctgtgtgtgtactggttcttccactaggcatatcgtcacttttgacggacagaatttcaagcttacaggtagttgcagctatgttttgttccaaaataaggaacaagacctagaggtcattttgcacaatggtgcctgcagccccggggctaggcagggttgcatgaaaagcattgaagtgaaacattctgctttgtctgttgaacttcattcagatatggaggttacagttaacgggcggttagtgtcagtcccttatgtcggcgggaatatggaagttaacgtgtacggagcaatcatgcacgaggtgcgttttaatcatctggggcatatttttacctttactccacaaaacaacgaattccagttacagcttagccctaaaacattcgcttcaaaaacctatggcctctgtggcatatgtgacgagaacggcgcaaatgacttcatgttacgtgatggtactgtaactactgattggaagactcttgtgcaggaatggacagtgcagcgccccggccagacttgccagcccatcctcgaggaacagtgcttggttcctgattcctctcattgtcaagttctattattgccactcttcgcagagtgtcataaggtgcttgcgccggctacattttatgcaatctgtcagcaggattcctgtcaccaggagcaagtttgtgaagtaatcgccagctacgcgcacttatgccggacaaatggtgtatgtgtggattggcggacacccgacttttgcgccatgagctgtcctccctcactcgtgtacaaccattgcgaacacggatgtcctcgacattgtgatggaaatgtgtcatcttgcggggatcatccctccgaaggttgcttttgcccacctgataaggtaatgcttgagggaagctgtgttcctgaagaagcttgtactcagtgcattggtgaagatggtgttcaacaccagtttctcgaggcatgggttccggaccatcagccctgtcagatttgcacctgcctctcgggaagaaaggtcaactgcactacacagccttgtccaactgcaaaggcccctacatgtggtctctgcgaggtcgctcggcttaggcaaaatgccgatcagtgctgtccggaatatgagtgcgtttgtgatcctgtttcctgcgatttaccacctgttccacattgcgagcgtgggctacaacccactttgacaaacccaggggaatgccgacccaacttcacttgtgcctgtcggaaagaagaatgcaaaagagtgagccctccatcatgccctcctcaccgtctgccaaccttgagaaaaactcagtgctgcgatgagtacgagtgtgcctgtaactgcgttaattcgaccgtatcctgtccattaggatatttagcttctaccgcaaccaacgattgcggttgtacgactaccacatgccttccagacaaggtttgtgtgcatagaagtactatctatcctgtcggtcagttttgggaagaaggctgtgacgtgtgtacctgcacagacatggaggatgcggttatgggtcttagggtcgcacagtgctcccaaaagccgtgcgaggactcatgccgtagcggattcacctatgtccttcatgagggtgaatgctgtggacgatgcttgccgtctgcctgcgaggttgtgaccggaagtcctagaggagattcccaaagttcgtggaagtctgtgggatcccagtgggcaagccccgagaacccttgtctgataaatgagtgtgttagggttaaagaggaggtctttattcagcaaagaaatgtctcatgcccccaactggaggttcccgtttgtccaagtggatttcagttgtcatgtaagaccagtgcgtgctgccctagttgccggtgtgagcgaatggaggcttgcatgttgaatggtactgtcatcggaccaggcaaaaccgttatgattgatgtatgtactacatgtcgctgcatggtgcaagttggtgttatttccggattcaagttagagtgtagaaaaacaacttgcaatccctgcccactcggttataaagaggagaataacacgggagagtgttgcggacgttgtcttcccacagcttgtaccatccaacttagaggaggtcaaataatgaccttgaaaagagatgaaacactgcaagacggttgtgatactcatttctgcaaggtcaatgaaagaggtgagtatttctgggagaagagagtgaccggttgccctccattcgacgagcacaagtgtttagccgagggtggcaagattatgaaaatccctggaacgtgctgcgatacttgtgaggagccggaatgtaatgacatcacagcacgacttcagtacgtgaaagtgggtagctgcaagtctgaggtcgaagtggatatccattactgtcaggggaaatgcgcttccaaagccatgtattcaatcgatatcaacgatgtacaagatcaatgttcctgctgttcccctacaaggaccgagcctatgcaagtggctcttcattgtacaaatggttcagttgtgtatcatgaggtgcttaatgccatggagtgtaaatgttctcccagaaagtgctcaaaa

SEQ ID NO: 21377 - DNA, 8439 bp, Artificial Sequence
  Description of Artificial Sequence: Synthetic coding sequence
atgattccagcgagattcgctggcgtgctgcttgcgcttgccttaatcctgcccggtactctatgcgccgagggtacccgaggccgcagctcaaccgcccgctgttcattattcggctctgactttgtcaacactttcgacggctctatgtattcttttgccggctactgttcctacctgttggctggaggctgccagaagcgctcattttccatcattggggattttcaaaatgggaagcgggtttcactgtctgtgtacctgggtgaattctttgatatccatctgttcgttaatggcacagtcacccaaggggaccagcgggtgagtatgccttatgcttcaaagggcctttacttggagaccgaggcggggtattacaaactgagcggtgaggcctatggctttgttgctaggatcgacggctctggcaatttccaggtgctgttatctgacagatattttaacaagacctgcggtctgtgtggcaatttcaacattttcgccgaggacgacttcatgactcaggagggaacactcacgtctgatccttacgacttcgccaattcctgggctttatcaagcggagagcagtggtgcgaaagagcttctcccccctccagcagctgcaacatctcatcaggcgaaatgcagaagggcctgtgggagcagtgtcagctgctgaagtcgaccagcgttttcgccaggtgtcatccattagtggaccctgagccatttgtcgcgctgtgcgagaagactctttgcgagtgcgccggcgggttagaatgtgcctgtccagccctgctcgagtacgcaaggacctgtgcccaagaagggatggtcctctatggctggacggaccactccgcatgcagtcccgtctgtccagctggaatggaataccgccagtgcgtgtccccatgtgctcgtacctgccaatccctgcacatcaatgagatgtgccaggagcggtgcgtggacggttgttcttgtcctgaaggccagctcctggatgaagggttgtgcgtggagagcaccgaatgcccttgtgtccatagtggtaagagatatcctcccggaacctctctttccagagattgcaatacttgtatctgtcgaaacagccagtggatttgtagcaacgaggaatgccccggcgagtgcctggtcaccggccagagccacttcaagtcattcgacaaccggtattttaccttttctgggatatgtcagtatctgttggctagggactgccaggatcactcattttccatagtgattgaaacagtgcagtgcgcagacgacagagacgccgtctgtactcgcagcgtgactgtgagactccctggattacacaacagcctggtgaagctcaaacatggagcaggcgtggctatggacgggcaggatgttcagctcccactattaaaaggcgatctcagaatacagcacacagtgaccgccagcgtcagattgagctacggagaggacctgcagatggactgggatggtcggggtcgccttctggtgaaactctccccagtctatgctggcaaaacatgtggcctatgcggcaactacaatggcaatcagggcgatgacttcttgaccccctccggtctcgccgagcctagagtggaggatttcgggaatgcctggaagttgcatggcgactgtcaggacttgcagaagcagcacagcgatccttgcgctttgaacccacgcatgacgcgcttctctgaggaggcctgtgccgtgttaacttctcccacctttgaggcgtgccatagagccgtgtcccctctgccatacttgaggaattgtcgctatgatgtctgctcttgcagcgatgggagggaatgcctatgtggggccctggcctcgtacgctgccgcctgtgcgggaaggggcgtgagagtggcctggagggagcccggccgctgtgaactgaattgtccaaaggggcaggtgtacctgcaatgtggaacgccgtgtaatctgacttgtaggagcctgagctaccccgatgaggagtgtaacgaggcctgtctggaaggatgtttttgtccaccaggtctgtatatggatgagcgcggagactgtgtccccaaagctcagtgcccatgctactacgacggcgaaatcttccagccggaggacatcttctctgaccaccacactatgtgttactgtgaggacggattcatgcattgcactatgtccggggttcctggtagcctccttccagacgccgtcctgagttctccactgagccacaggagcaagagatctctctcttgcaggccccctatggtgaaacttgtgtgcccagcagataacctgagagcagagggactcgaatgcacgaaaacgtgtcaaaattatgatttggagtgcatgtcaatgggctgtgtgagcggatgcctgtgtccccccggtatggtgcggcacgaaaacaggtgcgtggcccttgagcgttgtccctgcttccatcagggaaaggagtacgcgccgggagaaacggtgaagatcgggtgtaatacctgtgtgtgccaagaccggaagtggaactgtacagaccacgtgtgcgatgccacctgtagcacaattggaatggcacactacttgacctttgatggactcaagtatctgttccctggcgagtgccagtacgtgctcgtgcaggactactgtggttccaaccccggtactttcaggatcctggtgggcaacaaagggtgcagccatccatccgtgaagtgcaagaaaagggtcaccattctggtggagggaggggagattgaactgttcgatggtgaggtgaacgttaaacgccctatgaaagacgaaactcactttgaggtcgtcgaatccggcaggtacatcatcctgctcctcggcaaggccctgtcagtcgtgtgggaccgccacctgtccatcagcgtggttctcaagcagacctaccaggaaaaggtgtgtggactttgtggcaactttgacgggatccaaaacaacgatttaacctccagcaatttgcaggtggaggaggatcccgtcgatttcggcaactcatggaaagtcagctctcaatgtgcggatacacgcaaggtgccattggacagttctcccgccacttgtcataacaacatcatgaagcagactatggtagactcctcgtgccgcatcctcacgagcgatgttttccaggattgtaacaagctggtcgatcccgagccttatctcgatgtgtgcatatacgatacctgcagttgtgagtccattggggactgcgcatgcttttgcgatacaatcgctgcgtacgcccacgtttgcgcgcagcacgggaaggtggtcacatggaggaccgcgactctgtgtccccaaagttgcgaagagcggaacctgcgggagaacggctacgagtgtgaatggcggtataatagctgtgcccctgcttgtcaggtaacttgtcagcatcctgaacccctggcttgccccgtgcagtgcgtggaagggtgtcacgcccattgtccaccgggtaagatcctagatgaactgctgcaaacatgcgtggaccctgaagattgccccgtttgtgaagtggctggcagacggttcgcttcagggaagaaggtcacactgaaccctagcgatcctgagcattgtcagatttgtcactgtgatgtggtaaatttgacctgtgaggcttgtcaagagcccggtggactcgttgtcccccctacagacgctccagtgtccccaaccaccttgtacgtggaggatatctccgaaccacctctgcacgacttttactgctctagactactggaccttgtattcctccttgacggctcaagcaggttatctgaggcggagttcgaggtgcttaaggctttcgtcgtggacatgatggagaggcttcgaatttcgcagaagtgggtgcgggttgctgtcgttgaatatcacgacggatcccatgcttacattggcttaaaggaccgtaagcgtcctagtgagctcaggagaatcgcctcacaggtcaaatacgctgggagtcaagtggcttctacctccgaagtgctcaagtataccttgtttcagatcttctccaaaattgaccggcctgaagcaagtcgcattaccctgctgctgatggcttcccaagagccacagcgtatgtcacggaattttgttcggtatgtacagggcttgaaaaagaagaaagtgatagtgattccagtaggcatcggcccacacgccaatcttaaacagatcaggttgattgagaaacaagccccagagaataaggcctttgtcctgtcctccgtcgatgagcttgaacagcagagagatgagatcgtttcttatctctgtgacctggcgccagaggcgcccccacccacactgccccccgacatggcccaagtcacggtcggccccggactattgggggtctccaccctcgggccaaagcggaactcaatggtgctggatgtggcatttgtgctcgagggtagcgacaaaatcggcgaagccgactttaaccgcagcaaggagttcatggaagaggtcatccagcgcatggacgtgggacaggactccatacacgttaccgtcctgcagtattcttacatggtgaccgtcgagtatccattctcagaggctcagtctaaaggagacatcctgcaaagggtgcgcgaaataagataccagggcgggaatcgcaccaacactggattggccttaaggtacctgtcggatcactctttcctggtctcccaaggcgatagggagcaagcaccgaacctggtgtatatggtcacggggaatccagcaagtgacgagatcaagcgcctaccgggagacatccaggtggtgcctattggcgtgggacccaatgccaacgtgcaggagctggagaggatcggctggcccaatgcccccatcctgattcaggacttcgagaccttgccgcgagaagcaccagacctcgtcctgcagcggtgctgttcaggggaggggcttcagatccccacattgtcaccagcgcctgactgctcgcagccactcgatgtgatcctgttactggatgggtctagttctttcccagcgtcctactttgatgagatgaaaagtttcgccaaggcattcatctcgaaagctaacatcggtccaaggcttacccaagtaagcgtcctgcagtacggcagtattacaactattgacgtgccttggaatgtggttcccgagaaggctcacctgctctccttagtggacgtcatgcagcgggaagggggcccttcccagattggtgacgcgcttgggttcgccgtccgctatctcacgagcgaaatgcacggcgctaggccgggggcatctaaggccgtggtgattcttgtgacagacgtttccgttgattctgtggacgctgccgcagacgccgcccgctccaacagggtgaccgtgttcccaatcggaatcggcgatcgctatgacgccgcccaactgcgaatcctggcaggtcccgcaggcgactccaacgtggtgaaactccaacgtattgaagacctgcctaccatggtaactctgggaaactcctttctgcataagttgtgcagtggatttgtgcgcatctgcatggatgaggacggtaacgagaaacgccccggagatgtctggactctgcccgatcagtgccatactgttacctgtcagcccgacggacagacccttctcaagtcccaccgcgtcaactgtgatagagggctgcggcccagctgtccaaactcccaaagtcctgtgaaagtggaggagacttgcggttgtcggtggacgtgcccctgcgtgtgcaccggctccagcaccagacatatcgtcactttcgacggacagaacttcaaacttacaggctcttgctcctacgttctgtttcagaacaaagaacaggacctggaggtgatactgcataatggtgcctgttccccgggggctaggcagggctgcatgaaatccattgaagtgaaacactctgccctcagcgttgagttgcattccgatatggaagttactgtgaatggacggctggtatcagtgccctatgtcgggggcaatatggaagtgaacgtctacggagccatcatgcatgaagtgcgctttaaccacctgggccatatctttaccttcaccccacagaataatgagtttcaactgcagttatctcccaagacctttgccagcaaaacttacggcctgtgcggtatctgcgatgagaatggcgccaatgattttatgttgagggatgggacggtgactaccgactggaaaactttggtccaggaatggacagtgcagaggcccggacagacctgtcagccaatcctggaggaacagtgtctggttcctgatagctcccattgtcaggtgcttctcctgcccctcttcgccgagtgtcataaggtcctggcccctgcaaccttttatgctatttgtcagcaggattcttgccatcaagagcaggtgtgcgaagttatcgcatcctatgcccacctgtgcagaactaacggggtttgcgtcgactggaggacccccgatttctgcgccatgtcttgccctccttccctggtgtacaatcattgtgagcatggctgcccccgtcattgcgatggcaacgtaagcagttgtggcgaccacccctcagaggggtgcttctgcccccccgataaagtgatgctggagggcagctgtgtgccagaggaggcatgtacccagtgcatcggagaggatggtgtccagcatcagttcctcgaggcgtgggttccagatcaccagccctgtcaaatctgcacttgcctgagtggccgaaaggtaaactgcactactcaaccatgtccaaccgcaaaggctcctacatgcggcctctgtgaggtggctcgcttgcgacagaacgctgaccagtgttgccccgaatatgaatgtgtgtgcgatcccgtctcttgcgacttgcctcccgttccacactgtgagcgggggctgcaacccaccctcaccaatcccggggagtgcaggccaaattttacctgcgcttgtaggaaggaagaatgcaagcgcgtgtcacccccgagctgcccccctcatcggctgcccaccttacgaaagactcaatgctgcgacgagtatgagtgtgcctgcaattgtgtaaactctacggtatcttgtcctctgggatatctcgcctcgaccgcgactaacgactgtgggtgtactaccaccacttgtctcccagataaggtctgtgtccacagatcaaccatctacccggtgggacagttttgggaagaaggttgcgatgtgtgtacatgcaccgatatggaagatgctgtgatgggcttgcgggtagcccaatgcagccaaaaaccctgcgaggacagttgtagatccgggttcacctacgtgttgcatgagggagagtgctgcggcagatgtctaccatccgcatgcgaagtggtgaccggcagtccacgcggtgattcccagagttcttggaaatccgtggggtctcagtgggcgtccccagagaatccatgcttgattaatgagtgtgtcagagtgaaggaggaggtgttcattcagcagcggaacgtgtcttgcccacagctggaagtgccagtgtgtccctccggcttccagctgtcttgtaaaacgtccgcctgctgtccctcctgtcggtgtgagaggatggaggcatgcatgcttaacggcaccgtgatcggccccggtaaaacagtaatgatcgacgtgtgtactacctgccgatgcatggtgcaggtcggggtcatctctggcttcaagctggaatgccgaaaaaccacttgcaacccatgtcccctgggatacaaggaagagaataatactggtgagtgctgcggccgctgcctgccaaccgcctgcacaatccagctgagaggtgggcaaataatgactttaaaacgagacgagacgttgcaggacgggtgcgacacccacttttgtaaagtgaatgagagaggggaatacttctgggaaaagcgagttactggatgccccccttttgacgaacataagtgcttggccgaggggggcaagataatgaagatccccggtacttgctgcgacacatgcgaggaacctgagtgtaatgacatcaccgcacgactacagtacgtaaaggtcgggtcttgcaagagcgaagtggaggtcgacatccactactgtcagggcaagtgcgcttctaaggcgatgtatagcatcgacattaatgacgtccaggaccagtgcagctgttgtagccctacccgcaccgagccgatgcaggtcgccctgcattgcaccaacgggtctgtggtttaccacgaagttctgaacgccatggaatgcaagtgtagcccaaggaaatgctctaag

SEQ ID NO: 21378 - DNA, 8439 bp, Artificial Sequence
  Description of Artificial Sequence: Synthetic coding sequence
atgatccccgcccggttcgcaggtgtgctgctggcactagccctgattctgcctggcactctgtgtgcggagggaaccaggggacgaagcagtactgccagatgcagtttgttcggctcagacttcgtgaacaccttcgacggctctatgtacagcttcgccggatactgtagttacttgctggctggcggatgccaaaaacggtcgttttctatcatcggagacttccagaacggtaaacgcgttagcctgtctgtgtacctcggagaattttttgatatccaccttttcgttaacggcacagttacccagggggatcagcgtgtgagtatgccatatgccagtaagggtttatatcttgagaccgaggcgggatattacaagctgagtggcgaagcctatggcttcgtggcgaggattgacgggtcgggtaatttccaggtcctcctgagtgacagatattttaataaaacctgcggcctgtgtgggaactttaacatctttgccgaggatgacttcatgacccaagagggtacccttacaagcgacccctatgacttcgccaactcctgggccctatcatcaggtgagcagtggtgtgaaagggcaagtcctcccagtagttcatgcaacatctcgagtggcgagatgcagaaaggcctctgggagcaatgccagctactgaaaagtacatctgtgttcgctcggtgccaccccctggtggaccctgagccttttgtagccttatgtgagaagactttatgcgagtgcgctgggggattggagtgtgcttgcccagccctgctggaatacgcgcggacctgtgcacaggaagggatggtcttgtacggctggactgaccatagcgcatgctccccggtttgccccgcagggatggagtacaggcaatgtgtatcaccatgtgcccggacttgccagtccctacacatcaacgaaatgtgccaggaaagatgcgtggacggctgctcttgccccgaagggcagctcctggacgaggggctgtgtgtggaatcgacagagtgtccttgcgtgcactctggtaagagatatccaccagggacgtccttgtctagggattgtaatacatgcatttgtagaaattctcagtggatatgctcaaatgaggaatgtcccggggagtgcttagttactggtcaaagtcattttaaatcattcgacaacaggtactttacgttcagcggaatttgccagtaccttctcgccagggactgccaagaccacagctttagtatcgtcatcgagacagttcagtgtgcagatgaccgcgatgcagtgtgcactcggagtgtcaccgttcggctgcccgggctacacaactcactggtgaagcttaagcacggcgccggagttgcgatggacggtcaggatgttcagctccctcttctaaaaggcgatctgaggattcaacatacggtgaccgcatcagtgagactatcatacggtgaggacctccaaatggattgggatggccgcggaaggctcctggttaagctttcacccgtgtacgcagggaaaacgtgcggcctttgtggcaattacaacgggaaccagggcgatgactttctaaccccttctggactagccgagcctagggtggaagactttggaaatgcatggaagctacacggggattgtcaagatctgcagaaacagcatagcgacccctgtgccctgaacccacgcatgactcggttctctgaggaagcctgcgccgttctgacttcccctactttcgaagcctgtcacagggccgtgtctcctctgccttacttgcggaactgtcgatacgacgtctgttcgtgttccgacggcagggagtgcctgtgtggcgccctggcctcatacgccgcagcatgtgctggaaggggcgtgagggtagcgtggcgggagcctgggcgatgcgagctaaactgtcctaagggccaggtatatctacagtgtggcaccccctgcaacctgacctgccggtccctctcctatccggatgaagagtgtaacgaggcatgtctggagggctgtttttgccctccgggcctgtacatggatgaaaggggggactgtgtgccaaaagcgcagtgtccttgctactacgacggagagatcttccagcccgaggacatattctccgaccaccatacgatgtgctactgcgaagatggctttatgcactgtaccatgagtggagtgcctggcagcctgttgccagacgcagtgttatcttctcccctgagccaccgaagcaaaaggtccctgtcttgccggcccccaatggtgaaattagtgtgtcccgctgataacctgcgggccgaaggccttgagtgtaccaagacctgccaaaactacgatctagagtgtatgagtatgggctgtgtgtccggttgtctatgcccaccaggaatggtgcgccacgaaaacaggtgtgtggctctcgagagatgcccctgcttccatcagggaaaagagtacgcccctggtgagaccgtcaaaatcggatgcaacacatgtgtttgtcaggaccggaagtggaattgcacggatcatgtctgtgacgccacttgtagcactattggtatggcgcactacctgacttttgatgggttgaaatacctgttccccggagaatgtcagtacgttctggtgcaggactactgcgggagcaacccagggacattccgcatcttggtaggcaacaagggatgcagtcatccgtcggtaaagtgcaagaaaagagtcactatattggtggagggtggtgagattgaactcttcgacggggaggtgaacgtaaaaaggcccatgaaagatgagactcattttgaagtggtcgagagcggcagatatattattctgctgttaggaaaagctctttctgttgtttgggaccggcacctgagcattagcgtggtcctgaaacagacataccaggaaaaagtgtgcggactatgcgggaattttgacggcattcagaacaacgacttaacctcaagcaatctgcaggtcgaggaggatccggtggactttggaaatagctggaaagtgtcatctcaatgtgccgatacccggaaagtcccgctcgactcatcccccgccacctgtcacaacaacatcatgaaacagaccatggtcgactccagttgtaggattctcacgtctgacgtgttccaggactgcaacaaactggtcgaccccgaaccttacttagatgtctgcatatacgacacttgctcttgcgaatcaattggtgattgcgcctgtttttgcgacacaatagctgcatatgcccatgtgtgtgctcagcacggtaaagtagttacctggcggactgccaccctgtgtccacaatcttgtgaggagaggaaccttcgcgaaaatggatatgaatgcgaatggaggtacaactcctgtgcgcccgcctgtcaggtaacttgtcagcatcccgagccgctcgcatgtcctgtacagtgcgttgaaggctgtcatgcgcactgtccacctggcaagattctggacgagctgctgcaaacttgcgttgaccctgaagactgcccggtttgcgaggtggccggtagacgattcgcatccggaaagaaagttacactcaatccttctgaccctgagcactgtcaaatctgtcattgcgatgtggtgaaccttacatgcgaggcatgtcaggagccaggcgggctagtcgtcccacctaccgacgccccagtgtctcctaccaccctgtatgttgaagatattagtgagccaccactgcacgatttttattgctccaggctgttagacctggtgttccttttagatggtagcagcaggcttagtgaggccgaatttgaggtgctaaaagcctttgtggttgatatgatggaaagacttcggattagccagaaatgggtccgcgtagcagtggtagagtatcacgatggctctcacgcctatatcggcctgaaggatcgcaagaggccatctgaactgagaaggattgcttcccaggtgaagtacgcagggtcccaagtagcctctacttctgaggtgttaaagtataccttgtttcagattttctcaaagatagatcggcctgaggccagccgtatcaccctgttgttaatggcttctcaggaaccacaacgaatgtcacggaattttgttcgctatgtccagggattgaagaaaaagaaggtgatagtaatcccggtcggtatcggcccacatgccaatttaaagcagatcaggctcattgagaagcaggcaccagagaataaggcgttcgtgctgtcttccgtggacgagctcgagcagcagcgtgacgagattgttagttacctgtgcgacctggccccagaggctccaccaccaaccttaccgccagacatggctcaggtgacagtggggccaggcctactgggagtgtcaacgcttgggccaaagagaaactccatggtcctggatgtggcgtttgtcttggaaggtagcgacaagataggcgaagctgacttcaatagaagtaaagagttcatggaagaggtaatccagagaatggacgtggggcaggattcgatccacgttacggtattgcagtactcctatatggtgacagtagaatatccattttcagaggcgcagtccaaaggcgatattctccaacgcgtgcgggagattcggtatcagggaggcaatcgcactaacaccggcctagccctgaggtatctttcagatcactcctttctcgttagccagggtgatcgcgagcaagcacccaatctcgtgtatatggtgacggggaatcctgctagcgacgaaatcaagagattgcctggagacatacaggtggtgcccatcggcgtcggtcctaatgcaaatgtacaggaactcgaacggattggatggccaaatgccccaattctgatacaggatttcgaaactcttccgcgggaggctccagacttagtgttgcagcgctgctgctctggggaaggtctgcagatcccgactttgtcacctgctccagattgtagccagcctttggatgtgatcctactgctggacggttcatcctccttcccagcgtcctacttcgacgagatgaaaagctttgcaaaggcatttatctccaaagctaatatcggcccgcggctaacacaagtgagcgtgctccagtatggatcgattactacaatcgacgtcccttggaacgtggtgcccgagaaagcgcatctcctcagtctggtggatgtgatgcagcgtgagggtggtccgtctcagattggcgacgctctgggtttcgcggtgaggtatttgacgtcagagatgcatggtgcccgacctggggcatccaaagcagtagtcatattggtcacagacgttagcgtggatagcgtggacgctgcagcagacgccgcccggtctaaccgggtcaccgtgtttccaatcgggattggagatcggtacgacgccgctcagctcaggatcttagccggacccgccggagatagtaacgtcgtgaaattacagcggatcgaggacctgcccacaatggtaacacttggcaattccttcttgcataaactctgctcaggctttgttcgtatctgtatggatgaggacgggaacgagaagcgaccaggtgacgtgtggacgcttcctgaccaatgtcacaccgtaacctgccagcctgacggacaaacacttttgaagtcacacagagtaaattgtgatcggggtctgcggccatcctgccctaactcacaatccccagtcaaagtagaggaaacctgtggttgcaggtggacctgcccttgtgtgtgcactggctcctccaccagacacatcgtcacttttgacggccagaactttaagttgactggttcctgcagttacgtgctgttccagaataaggagcaggacctcgaagtgatcttacacaatggggcttgcagccctggcgctcgccaaggatgcatgaaatcgatcgaggtgaaacattctgcactgagcgtcgaactgcacagtgacatggaagtgacggttaatgggagacttgtgagtgtcccgtatgtcggcggcaatatggaagtgaacgtctacggcgcgataatgcatgaagtgcgcttcaaccacctaggtcacatattcacttttactccccagaacaatgaattccagctgcagctaagccccaaaaccttcgccagcaaaacctatgggctttgtggtatctgtgacgagaacggcgccaatgacttcatgctgagagacggtacggtcactacagattggaaaactttggtgcaggaatggacggttcagcgccccggacaaacctgccagcccattttagaagagcagtgtctggttccagattcatctcattgtcaggtgctgctcctgcccctgtttgccgaatgccacaaagtgctggcccccgccaccttttacgcgatctgccagcaggacagctgccaccaggagcaggtatgcgaggtgattgccagctatgcccatctgtgtcgcacgaatggcgtctgcgtagactggagaacccccgacttctgcgccatgagttgcccgccgtccctcgtttacaaccactgtgagcacgggtgcccacgccattgcgacgggaacgtctcctcatgcggagatcacccctccgaggggtgcttctgcccaccagacaaagtcatgctggaagggtcgtgcgtgccggaggaggcctgtacacagtgcatcggtgaggacggagtgcagcaccagttcttagaggcctgggtgccagaccatcagccatgccagatttgcacctgcctctcgggccgcaaggtgaactgtacaacgcagccttgtcctacggctaaggcccctacatgtgggctctgcgaggttgccaggctgcggcagaacgcagatcaatgttgtcctgagtacgaatgcgtttgtgaccctgtgtcctgtgatttgccccctgttccccactgcgagagaggcctgcaaccaaccctcacgaaccctggagagtgccgccccaacttcacatgcgcttgtaggaaagaggagtgcaaacgggtatcacctccctcttgcccacctcataggctgcccactttacgcaagactcagtgttgcgatgaatacgagtgtgcttgtaattgcgtgaacagtacggtcagctgtcccctggggtaccttgccagcacagctacaaatgactgcgggtgcacgacgacaacctgtctgccagataaggtgtgtgtccacagatctactatctacccagtcggacagttctgggaggaagggtgtgacgtctgtacctgcaccgatatggaggacgctgtgatggggcttcgagttgctcagtgctcacagaaaccatgtgaggactcttgccgctccggcttcacatacgtcttgcatgaaggggagtgttgtgggcgttgtcttccatccgcctgcgaagtcgtcacaggttctccacgaggggacagccagtcatcttggaagtcggtcggaagtcagtgggccagcccggagaatccttgcctgatcaacgagtgcgtgcgtgtgaaagaagaggtgttcatacagcagcggaacgtttcttgtccacaattggaggtgccagtttgcccatcagggttccagctctcatgtaaaacttcggcatgttgcccctcctgccgctgtgaaagaatggaggcctgcatgttaaatgggaccgtgatcggacctgggaaaaccgtgatgatagacgtatgcaccacctgcaggtgtatggtacaggtcggggtgatctctggttttaaattagagtgccgcaagaccacatgtaacccatgtcctctcggttacaaggaggagaacaacactggagaatgctgcggtaggtgcctccccacagcttgtacaattcagctgagaggaggacaaatcatgacactcaagagagacgagacactgcaggatggctgcgatactcacttttgcaaagtcaacgagaggggcgagtacttttgggaaaaacgcgtgaccggctgcccaccatttgatgaacacaaatgtctggccgaaggagggaaaattatgaagataccaggaacgtgttgcgacacgtgtgaggaaccagagtgtaatgacataaccgccaggctgcaatacgtgaaagtgggctcctgtaaatccgaggtggaggtagacattcattattgccagggtaaatgcgcctctaaagcaatgtacagtattgatattaacgacgtccaggatcagtgctcttgctgctcacccactcgcacggagcctatgcaggttgcactgcactgcaccaacgggagtgttgtctatcatgaggtgttgaacgctatggagtgcaaatgttcacccagaaaatgtagtaaa

SEQ ID NO: 21379 - DNA, 8439 bp, Artificial Sequence
  Description of Artificial Sequence: Synthetic coding sequence
atgatccctgctagatttgcaggtgtactgctggcgcttgctctgattttgcctggcactctgtgcgcagaaggaactcgtggccgctcctccaccgctagatgttccctgttcggctcagacttcgtcaacacctttgatggcagtatgtactccttcgccggatattgtagctacctgcttgctggcggctgccagaaaaggtcattctctataatcggcgacttccagaatggaaagagagtgtctttgtccgtgtacctgggagagtttttcgacatccatctgtttgtcaacggtactgttacacagggcgatcagcgagtgagcatgccgtacgcatctaaagggttatacctggaaaccgaggcaggatattacaagctttctggtgaggcctatggtttcgtggctcgcattgatggaagtggcaactttcaggtgttgctgagcgatagatactttaacaaaacctgcggcctctgcggcaactttaacatctttgcagaagacgacttcatgacgcaagaaggcactcttacaagcgacccttacgactttgccaactcatgggcactcagctcaggggaacagtggtgcgagagagcatccccacctagctcttcatgtaacatttccagcggagaaatgcagaaaggcctgtgggagcaatgccaactactgaaaagcacctctgttttcgcacgctgtcaccctcttgttgatcccgagccgttcgtcgcactatgcgagaagaccctgtgcgaatgcgctggcggtctggaatgtgcttgccccgctttgcttgagtacgctcgaacatgcgctcaggaaggaatggtgctctatgggtggactgaccatagcgcgtgcagccctgtctgccccgctggaatggaatatcgccaatgtgtctccccatgtgccagaacctgccagagtctgcacatcaatgaaatgtgccaggagcgttgtgtggatggttgcagttgcccagaagggcaacttcttgatgagggactgtgtgtggaatcgactgagtgtccgtgcgtacacagcggcaagcgttacccacctggtacctccctgtcgcgggattgcaatacatgcatctgcagaaacagccagtggatttgttccaacgaagagtgtccaggagagtgcctggtcacaggacagtcacacttcaaaagctttgataacaggtactttacattttctggtatttgtcagtacctcctggctcgcgactgccaagaccactccttctccattgtcattgaaactgtgcagtgtgccgatgacagagacgccgtgtgcacgcgaagtgtgacggttcgcctgccaggactgcacaacagtctagtcaagctcaaacatggagctggggtcgctatggatggccaggacgtgcagttacctctgcttaagggggatttgagaattcagcatacagtcaccgctagcgtgaggctcagctatggagaggatcttcaaatggactgggacggacgcggcagactacttgtaaagttatccccagtgtacgcaggaaagacttgcggattatgtggaaactataacgggaaccagggggacgatttcctgactccatcggggctggcggaaccaagggtggaagatttcggaaacgcctggaaattgcatggcgattgccaagacctgcagaagcagcacagtgatccttgtgcattgaatccacggatgactaggttctctgaggaggcttgcgccgttcttactagcccaacctttgaggcatgccatagagccgtcagcccgcttccatatctccgcaactgtagatatgatgtttgctcatgttcagatggccgggagtgcctctgcggtgcactggcttcttacgcagctgcttgcgcaggtcgtggggttagagtcgcatggagagagcccggtagatgtgagctgaactgcccaaaagggcaggtgtacttgcagtgtggcacaccatgcaacctcacctgccgaagcttaagctaccccgacgaagaatgcaacgaagcctgtttggagggttgtttctgtcctcctgggttgtacatggacgagcgcggggactgcgtccctaaggcacagtgtccgtgctattacgacggcgaaatattccaacctgaggacatcttcagcgatcaccacaccatgtgttactgcgaggacggtttcatgcactgcaccatgagtggcgtcccaggcagcctgcttcccgatgctgttttgtcctcccctctgtcacacaggtcaaaaaggtctttatcctgcaggccccccatggtgaagctagtgtgtcccgctgacaacctgcgcgctgaggggctggaatgcactaaaacttgccagaactacgacctggagtgtatgtccatggggtgcgtgtcaggatgcctttgtcctccgggtatggtgaggcacgagaacaggtgtgtagccctggagagatgcccatgctttcatcaggggaaagagtacgctcccggcgagactgttaagattggctgtaacacctgcgtctgccaggacaggaaatggaattgtaccgaccacgtgtgcgacgctacatgctccaccatcggcatggcacactatttaacattcgatgggcttaagtatctgttcccaggagagtgccaatacgtcctggttcaagattactgtggttcaaatcctggaacctttcggatcttagttggaaacaagggttgttcacatcctagtgttaagtgcaaaaagcgcgtcacgatcttggtggagggtggagagatcgagctttttgacggagaggtgaatgttaaaaggccaatgaaagatgaaactcatttcgaagtagtagagagtggaagatatattatactgctgttgggcaaggccttgagcgtcgtctgggatagacacctgtccatatctgtcgtgctgaagcaaacatatcaggaaaaagtgtgcgggctttgcggcaattttgacggaattcagaacaacgatcttaccagctctaatctacaggtggaagaagaccccgtcgacttcggaaatagctggaaagtctccagtcagtgcgctgatacaagaaaggtgcccttggactcatcacctgccacttgtcataataatatcatgaagcagaccatggtcgatagctcctgtcgcatcctgactagcgatgtcttccaggactgcaacaaactggtggaccctgaaccatatctggatgtgtgcatctatgatacctgcagctgcgaatctatcggtgattgtgcgtgcttctgcgacaccatagctgcatatgcgcacgtatgtgcccagcacgggaaagtggtcacttggaggacagccacactgtgtccacaatcttgcgaggagaggaatctgagggaaaatggctacgagtgtgaatggagatacaacagctgcgctcctgcgtgtcaggtgacttgccaacacccagagcctctggcctgcccagtacagtgcgttgagggctgtcatgctcattgcccgccagggaaaatcctggatgagttactccagacatgtgtggacccagaggactgtccggtttgcgaggtagctggaaggaggtttgcttcgggtaaaaaggtgactcttaacccatcagacccagagcactgccaaatctgccattgcgatgtggtcaaccttacgtgcgaagcttgccaggagcccggcggtcttgtcgtgccacccacggacgctccagtgagccctacaactctctacgtcgaggatatatcggagccacctcttcatgacttttactgcagcagactgctcgatcttgtctttctactggacgggagctctcggctcagtgaggctgaattcgaagtcctgaaagccttcgtcgtggatatgatggagcggttaaggatcagtcaaaagtgggtacgggtggccgtggtcgagtaccacgatggatctcacgcatacatcggtcttaaggaccgtaagagacctagtgagctgagaaggatcgcaagccaggtcaaatacgctgggagtcaggtcgccagcacatctgaggtcttgaagtatacattgtttcaaattttctccaaaatcgacaggcctgaagcttcaagaatcaccctgcttctcatggcttctcaagaaccacagcggatgagtagaaactttgtgaggtacgttcaaggcttgaaaaaaaagaaggtcattgttataccagtgggaattggacctcatgctaacttgaaacaaataagactgatcgaaaagcaagcaccagaaaacaaagcttttgtactatcttcggtcgatgagctggaacagcaaagggatgaaatcgtctcttatctgtgcgatctggctccggaggcaccaccaccaaccctcccaccggatatggcccaggtgaccgtcggacccggccttctgggagtatccacattgggacctaaaaggaactctatggtgcttgatgtcgcctttgttctggagggatctgataaaatcggggaggccgattttaatcgctcaaaagaatttatggaagaggttatccagcgcatggatgtcggccaggactctatccatgtcacagtgcttcaatactcttatatggttactgtagaatacccgttttctgaggctcaatccaagggcgatatcctgcagcgcgtgcgcgaaatcaggtaccagggcggcaacaggaccaacacaggactggctctcaggtacctgagcgaccattctttcctggtgagccaaggcgacagagagcaggcgccaaacctcgtctacatggtcaccggaaacccagcctcagatgaaattaagcggcttcctggcgacatccaagtagtgccgatcggcgtcggcccgaatgctaatgtccaagaactggaacgtataggatggccaaacgctcctatcttgatccaggacttcgaaacccttccaagggaggctccagacctggtactgcaacgctgctgttccggtgaaggtctccaaatcccaactcttagccctgctccagattgctcccaacctctagacgtgatcttattgcttgatggctcgtccagcttcccagcaagctattttgatgagatgaagagctttgctaaggctttcatctctaaggcaaatatcggaccccgtctcacccaggtctctgtgcttcagtatggaagcattacaactatcgacgttccatggaacgtcgttcccgagaaagcccatcttctttccctggtcgatgtgatgcagagagagggaggtcccagccaaattggtgatgcactgggctttgctgtccgctacctaacaagcgagatgcacggcgcccgccctggagcttccaaagccgtggtgattctggttaccgatgttagcgtggatagcgtggacgctgccgctgacgccgctaggtcaaatagggtgaccgtctttcctatcggaatcggggataggtacgatgcagctcagttgaggatcctggcaggaccagccggcgacagcaacgtcgtgaagcttcagcgcatagaagacttgccaaccatggtcacgctcggcaatagcttcctgcataagctgtgcagcggatttgttcgcatctgcatggatgaggatggcaatgagaaacgtcccggagacgtgtggacacttcctgatcaatgtcacacagtgacctgccaaccagatggccaaaccctgctgaagtctcacagggtcaactgtgacaggggtttgaggccatcttgtcccaatagccaatcccccgtgaaagtggaggagacttgcggttgcagatggacctgcccttgtgtctgcactgggagtagcaccaggcatatcgtgacctttgacggccagaatttcaaacttaccggttcttgtagctatgtgctgttccaaaacaaggagcaagatcttgaggttattctgcacaatggtgcttgttcacccggcgctcgacagggctgtatgaaatccatcgaggtcaagcatagcgctttatcagtcgagctgcactccgacatggaagttacagtcaacggaagattagtcagtgtcccttacgtgggcggcaacatggaggtgaacgtctatggtgcaatcatgcacgaggtgcggttcaaccatctgggacacatctttactttcaccccgcaaaacaacgaattccagctgcagctgagtcctaaaacattcgctagcaaaacatatggtctgtgcggcatctgcgacgaaaacggtgccaacgatttcatgctcagagacggaactgtgaccacagactggaaaaccctggtccaggagtggactgtgcagcggcctggacagacttgccaaccaatactagaggaacagtgccttgtccccgacagctcacactgtcaggtgctgctgctgccactgttcgccgaatgccacaaggtactggcccctgcaactttctatgcaatctgccagcaagatagctgccaccaggagcaggtctgtgaagttatcgccagctatgctcatctgtgtagaaccaatggtgtgtgcgtcgattggcggactcctgatttttgcgctatgagctgccctccctctctggtctataatcactgcgagcacggctgccctagacattgtgacggtaacgtaagttcttgcggagatcacccatccgagggttgcttctgccctcctgacaaggtgatgctagagggctcatgcgtcccagaagaggcctgcacccagtgcatcggcgaggacggggtgcagcatcagtttttagaagcatgggtgccagaccaccagccatgtcaaatatgcacatgcttaagcggccgcaaggtgaattgcactacccagccctgccctacagccaaggcccccacctgcgggctatgcgaggtggctagactgcgacagaatgctgatcaatgttgccctgagtacgagtgtgtttgcgaccccgtttcatgcgaccttccacctgtgccacactgcgaacggggtctgcaaccgaccctcacaaaccctggtgaatgcagacctaactttacttgtgcttgcaggaaggaggaatgcaaacgagtcagcccccctagctgcccaccacacaggctgcctactctgcgaaagacccaatgctgtgacgaatacgagtgtgcctgcaattgcgtgaattccaccgtctcatgcccattgggctatttggcatcgacagccacgaacgactgtggatgcactaccactacctgtcttcccgataaggtgtgtgtgcataggtccactatctatccagtgggacagttctgggaggagggctgtgatgtgtgcacttgcaccgacatggaagacgcagtgatgggattgcgtgtggcacaatgcagccaaaaaccttgcgaagactcatgtagatcaggtttcacctatgtcctacacgaaggagagtgctgtggtaggtgcttgccgtcggcatgcgaagtagtaaccgggagccctagaggagacagccagagttcttggaaatcagttgggagccaatgggcatcccctgagaacccatgtttaattaatgaatgcgtgagagtgaaggaggaggtgttcatccagcagcgaaatgtgagctgcccacagctggaagtgcccgtgtgtccaagcggcttccaactctcgtgtaagaccagtgcttgctgtcctagctgtcggtgcgagcggatggaggcctgtatgctcaacggaaccgtaatcgggccaggaaagacagtaatgatcgatgtctgcaccacatgcaggtgcatggttcaggttggagtcatcagtggatttaagctggaatgccgtaagacaacctgcaacccctgtccccttggctacaaagaagagaacaacactggggaatgctgcggtcgctgcctgccgaccgcctgcaccatacaacttcgcggaggtcaaatcatgactcttaaacgggatgagaccttgcaagatggctgcgatacccacttttgcaaagtaaacgagaggggtgaatatttctgggagaagcgcgtgaccgggtgcccaccctttgatgaacacaagtgccttgctgagggaggaaagatcatgaaaattcccggaacctgttgtgacacatgcgaggagccggagtgtaacgatattacagccaggctgcagtatgtgaaagttggaagttgtaagtccgaggtggaagtggacatccactactgtcaaggaaaatgcgcctctaaagctatgtacagcatcgacatcaacgacgtgcaagatcagtgctcttgctgttcccctactcgcaccgaaccaatgcaagttgctctgcactgcacaaacggctctgtggtctaccatgaagtgctgaatgctatggagtgcaaatgcagtcccagaaagtgttctaag

SEQ ID NO: 21380 - DNA, 8439 bp, Artificial Sequence
  Description of Artificial Sequence: Synthetic coding sequence
atgataccagcacgcttcgctggtgttcttttggctttggccttgattctgcccggtactctctgtgccgagggcaccagaggccgctcctcaactgctcgctgttcactttttggctcagacttcgttaatacgttcgatggttccatgtactcatttgcgggatactgctcctacctgcttgcaggtggttgccagaagagatcctttagcattatcggcgactttcaaaatggcaagagggtttcactgagtgtatatctcggcgagttcttcgatatccatctctttgtcaacggaaccgtcactcaaggtgatcagagagtctccatgccctatgcgtccaagggactgtatctggagaccgaagccggttactacaaattgtcaggcgaagcttatggtttcgtcgctcgcatcgacggaagcggtaacttccaggtcctgctgtctgaccgctacttcaacaagacttgcggtctgtgtggtaatttcaacatctttgctgaagatgatttcatgacgcaggagggtactctgacctcagatccctacgatttcgcgaactcctgggctctttccagcggagagcagtggtgtgagagagcttcacctccttccagctcctgcaatatttcttctggcgaaatgcagaagggcctttgggaacaatgccagctcctgaagtccacatccgtgttcgctagatgtcaccccttggtcgacccagagccttttgtggccctgtgtgaaaagacactctgcgagtgcgctggtggcctggagtgtgcctgtccagctcttctggaatacgccaggacttgcgcacaggagggcatggtcctgtatggctggaccgatcactccgcctgttctccggtatgcccggccggtatggagtacaggcaatgcgtcagcccgtgcgctcgcacatgtcagtcactccacattaacgaaatgtgccaggagaggtgcgttgatggatgctcctgcccagaaggtcagcttttggatgagggactgtgcgtggagtccaccgaatgcccgtgcgtccactccggaaagcgctacccccccggaacatctctgtccagggactgcaatacatgtatctgccgcaacagtcaatggatctgttctaacgaggaatgtcccggcgaatgtttggtcactggacagtctcacttcaagagtttcgacaacaggtactttacattcagcggcatctgtcagtacctgctcgccagagattgtcaggaccacagtttcagcatcgtgatcgagaccgtgcagtgcgcagatgatagagacgcggtttgtacgcgcagcgttactgtccgcctgcctggcctgcataatagtcttgttaagctgaagcacggcgcaggcgtcgccatggacggacaggatgtgcagcttccccttttgaaaggcgatctgaggattcagcacactgtaaccgcttcagtacgcttgtcatacggcgaggatcttcaaatggattgggatggccgcggcagactgctggtgaagctctctcctgtctacgcaggcaagacatgcggcttgtgcggcaattacaatggcaatcagggtgacgattttctcactccctccggacttgcagaaccccgcgttgaagacttcggaaacgcctggaaactgcatggcgactgtcaggatctgcagaagcagcattccgacccctgtgcgctgaaccctaggatgaccaggttctccgaagaggcttgcgccgtgctcacttcacccacattcgaggcttgtcaccgcgctgtgtccccactgccctatctcaggaactgtagatacgacgtatgctcatgtagtgatggcagggaatgtctttgtggcgccctggcctcttatgcggccgcatgcgcaggtagaggagtgagggtggcctggcgcgaacctggtagatgtgaactcaattgtcccaagggtcaggtataccttcaatgcggtacgccctgcaatctcacctgtaggtccctttcttatcccgatgaggaatgtaatgaagcctgcctcgagggttgcttctgtccacctggcttgtatatggatgagcgcggcgactgcgtccccaaagcgcagtgtccgtgttactacgatggtgaaatttttcagcctgaggacattttctccgatcaccacaccatgtgttactgcgaggacggattcatgcactgtactatgagcggtgtccccggctcattgcttcccgacgccgtactgagctctcctctgtctcatcgctctaaaaggtctctgagttgccgccctcccatggttaagctggtttgtcctgccgataatctgagagcggaaggtctcgaatgcacaaagacctgccaaaattacgatttggagtgcatgtctatgggatgcgttagtggttgtctctgtcctccgggaatggtgaggcacgagaacaggtgcgttgccctggagagatgcccctgtttccaccaaggtaaggaatatgcgcctggtgagactgtcaagataggctgcaacacatgtgtgtgccaggacagaaagtggaactgtactgaccatgtctgcgatgctacctgcagcacaatcggtatggcgcactacttgacattcgatggactgaaatatttgtttccaggtgagtgccagtatgtgctggtgcaagattattgtggcagcaaccctggaacctttcgcattttggtcggtaataagggttgcagtcaccccagtgtgaagtgcaaaaaaagggtgacaatcctggtcgaaggcggcgagatcgagctgtttgatggagaggttaacgtgaagaggcccatgaaggacgagacgcacttcgaagtcgtggagtctggcagatacatcatcctcctgctcggaaaggcgctctcagtagtttgggaccgccacctgagcatcagtgtggtcttgaaacagacctatcaagagaaggtctgcggtttgtgtggaaatttcgacggcatccaaaataatgacctcacttcctctaacttgcaggtcgaggaggatcctgttgattttggaaattcctggaaagtgagtagccagtgcgcggacacgagaaaggttcctttggacagtagcccagcgacttgccacaataacataatgaaacagacgatggtggattcctcttgcaggatcctcacttccgacgtcttccaggattgtaacaaattggtggacccagagccttacttggacgtctgcatttacgatacatgctcatgcgaatccatcggtgattgcgcatgtttttgtgacaccatcgcggcctacgctcacgtgtgcgcacagcacggtaaagttgttacctggaggacagctactctttgcccacaatcctgcgaagagcgcaacctgcgcgaaaacggatatgagtgcgagtggcgctacaactcatgcgctccagcgtgtcaggtaacttgtcaacacccagaacctctcgcctgtccggtgcagtgcgtagaaggttgccacgcacactgtcctcccggaaagatactggatgagctgttgcaaacctgcgtggatcccgaagactgccctgtgtgcgaggtggcgggccgcagatttgccagtggtaagaaggtgacattgaatccatctgatcccgaacattgtcagatctgtcactgtgatgtcgtgaacctcacttgtgaagcatgtcaggaaccaggcggactcgtggtgccacccacagacgcaccagtttctccaacaacgctgtacgtggaggacatcagcgagccccccttgcacgatttctactgtagccgcttgctcgatctggtctttctgctcgacggctctagtaggctgagtgaggcggagttcgaagtgctgaaggcgttcgtcgtcgacatgatggaaaggctccgcatcagtcaaaagtgggtaagggtggccgtggtggagtatcacgacggttctcatgcctatattggcctcaaagataggaaaaggccctccgaattgaggcgcatcgccagccaggttaagtacgctggatctcaggtggccagcacatccgaagtactcaaatatactctgtttcaaatattttccaaaatcgatcgccctgaagccagtcgcatcacccttctcctgatggcctcccaagagccccaaagaatgagtagaaacttcgtgagatatgttcagggactgaagaagaaaaaagtgatagtcatcccggtgggcatcggtcctcacgccaatttgaaacagatccgcctgattgaaaaacaagcccccgagaacaaggcgttcgtgctgtcttcagttgacgagttggagcaacagcgcgacgagattgtcagctatctgtgtgatctcgctccagaagccccccctccgactctgccgccagacatggcccaggtgactgtgggacccggattgctgggtgtcagcaccctgggccctaagcgcaactctatggttcttgacgtcgctttcgtgctggaaggcagtgataagattggagaagcagattttaacaggtctaaagagttcatggaggaggtgattcagaggatggatgtgggccaagattcaatccatgtgacagtactgcaatactcttatatggtaaccgtggaatatccgttcagcgaggctcaatcaaagggcgacattctgcagagggtcagagagatcaggtatcagggaggaaatcgcactaacactggactcgccctcaggtacctttccgatcattcatttcttgtgtcccagggagacagggaacaggcccctaacctcgtttacatggtaactggcaaccctgctagcgatgagattaaaaggttgccgggcgacattcaggttgtgccgattggcgtcggccccaacgccaatgtgcaggagttggaacgcatcggatggcctaatgcaccgatcctgatacaggactttgagactttgccacgcgaggctcctgacctcgtcttgcagagatgctgtagcggagagggattgcagataccaacactgtcacctgcacctgactgcagccagccattggacgtgatcctcttgctggacggttcatcttccttccccgcgtcatactttgacgaaatgaaatcctttgcaaaagctttcattagtaaagccaacattggacctcgccttacacaggtgagtgtactgcagtatggttctataacgacaatcgacgtgccctggaatgtggtccctgagaaggcccatctcctctctcttgtggatgtgatgcagcgcgagggcggaccctcacaaatcggtgacgctctgggcttcgcagtgcgctatctcacaagcgaaatgcacggcgcaaggcctggcgcttctaaagctgtcgtcatcctcgtcactgacgtgtcagtggactccgtagacgctgctgctgatgccgccaggtccaacagggtcaccgttttccctatcggaatcggtgacaggtatgacgcagctcagctcaggatcttggccggccctgctggagattcaaacgtggtgaagctccagagaattgaagacttgcccacgatggttaccctcggaaacagttttctgcacaagctctgcagtggatttgtcagaatctgtatggacgaggatggtaacgagaagcgcccgggagacgtgtggacactcccagatcagtgccacacagtgacttgccaacccgatggccagaccctccttaagtcccatagggttaactgcgacagaggtctgaggccttcatgccccaatagtcagagtcccgtgaaggtggaggagacttgcggctgtcgctggacctgcccctgcgtttgcaccggcagttccactaggcacatcgttactttcgacggacagaatttcaagttgactggctcttgttcttacgtactcttccaaaataaagaacaagatctggaagtgattcttcataatggcgcctgctctcctggcgcaagacagggatgtatgaaaagcatagaggttaagcacagcgcactgtcagtggaactgcattcagatatggaagtgaccgtcaatggtagactcgtaagcgtcccctacgtgggtggaaacatggaggtaaatgtgtatggcgcaatcatgcacgaagttaggttcaatcacctgggtcacatcttcacctttactcctcagaataacgagtttcagctgcaactgagccccaagactttcgctagcaagacgtatggactgtgtggaatttgcgatgagaatggcgcgaacgacttcatgctgcgcgatggaacggtgaccactgactggaaaactctggtccaggagtggactgttcaaaggccaggtcaaacctgccaacctatcctcgaggagcaatgtctcgtgcccgattcatctcattgccaggtactgctccttccactgttcgccgaatgtcacaaggtactggctccagccactttctacgccatctgtcaacaggacagctgtcatcaggagcaggtgtgtgaggtaattgccagttacgctcacctgtgcaggacgaacggagtttgcgtggattggcgcactccagatttctgcgccatgtcttgccccccatccctcgtgtacaaccactgtgaacatggttgcccaagacattgcgacggaaacgtttcttcatgcggagatcatccaagtgagggttgtttctgcccacccgacaaggtcatgctcgaaggcagttgcgtgcccgaggaggcttgtactcagtgtattggcgaagacggagtgcaacatcagttcttggaggcctgggtcccagatcaccagccctgtcagatctgtacctgtttgtctggtagaaaagtcaattgtacgactcaaccctgccccactgcgaaggcccccacctgcggtctgtgtgaggtcgcaagactcagacaaaacgccgatcagtgctgtcccgaatacgagtgcgtgtgcgatccggtgtcttgtgatcttcctccagtgccgcactgcgaaaggggactccagcccactttgaccaatccaggcgagtgccgcccgaactttacctgcgcttgcagaaaggaagagtgtaaacgcgtctccccccctagctgcccccctcacaggctcccaaccttgcgcaaaacgcagtgctgcgatgaatacgaatgtgcttgcaattgcgttaactccaccgtttcttgtccacttggatacctggccagtacagccacaaacgactgtggatgtaccactactacctgcttgcctgacaaggtttgcgtgcaccgcagcacgatctatccggtcggtcagttctgggaagagggctgcgacgtgtgcacgtgcaccgacatggaggatgccgtgatgggcctgagagtggcacagtgtagccagaagccctgcgaagacagttgcaggagtggtttcacatatgtcctgcacgagggtgagtgttgtggtaggtgtctgccgtcagcatgtgaggttgtaaccggttctcccagaggtgacagtcagagctcttggaagtctgtgggctcacaatgggcgtcacccgagaatccttgcctcattaatgaatgtgtaagagttaaggaagaggtcttcatccaacagagaaacgtttcatgccctcaacttgaggtcccggtctgtccctctggcttccagttgagctgcaagacgagcgcgtgctgtccaagttgccgctgcgaacgcatggaggcttgtatgctgaatggcaccgtgatcggtcccggcaagaccgtaatgatcgatgtgtgtacaacttgtagatgtatggttcaagtcggcgtcatcagcggcttcaagctggaatgccgcaaaacaacttgtaatccgtgtccgctgggctataaagaggaaaacaacaccggcgaatgttgtggtaggtgcttgcccaccgcatgcactatccaactgagaggcggacaaatcatgacccttaaaagagacgagacattgcaggacggctgtgatactcatttttgtaaggtgaacgagagaggtgagtatttctgggagaagcgcgtgaccggctgccctccgtttgacgagcacaagtgcctcgccgagggcggcaaaatcatgaaaattccaggcacctgctgcgacacctgtgaggagcccgagtgtaatgacatcactgccaggctgcagtatgtaaaggttggctcctgcaaatccgaagtcgaagtggacatccactattgccagggtaaatgcgccagcaaggcaatgtactccatcgacatcaacgacgtacaagatcagtgctcttgctgctcacctaccaggaccgaaccaatgcaggtggccctccactgcaccaatggatctgttgtgtaccacgaagtgttgaacgctatggagtgtaaatgcagcccaaggaaatgcagcaaa

SEQ ID NO: 21381 - DNA, 8439 bp, Artificial Sequence
  Description of Artificial Sequence: Synthetic coding sequence
atgatcccagccagattcgccggtgttctcctcgcgttggcattgatcttgcccgggactctttgcgctgaaggaacaagagggagaagctctacagcccggtgctccctatttgggtcagactttgtcaacacgttcgacggctctatgtatagctttgcagggtattgttcctacttgttggctggagggtgtcagaaacgctcattttctattatcggtgacttccagaacggaaagcgagtgtctctgtccgtgtatctgggtgaattttttgacattcacttgttcgttaacggaaccgtaacacaaggagaccagcgagtatccatgccatatgcctccaagggcttatacctggagacagaggctggttattataaattgtctggggaagcttacgggttcgtagcacggattgatggctctggaaacttccaagtcctactctcagacaggtatttcaacaagacatgcgggctctgtgggaactttaacatattcgcggaggatgacttcatgacgcaggaaggtacacttacctccgacccttatgacttcgctaattcctgggcactgagctctggcgaacagtggtgtgaaagggcaagccccccctcatcatcctgtaacatctctagcggcgaaatgcaaaaaggcttgtgggaacaatgccagctactaaagtctaccagtgttttcgcccgttgtcaccccctcgtggaccctgaacccttcgtggctctgtgtgagaagacattgtgtgaatgtgctggtggacttgaatgtgcttgtcccgcactgcttgagtatgctcggacctgtgcccaggagggcatggtcctatacggatggacagaccacagcgcctgtagtcccgtatgccccgccggaatggaataccgtcagtgcgtgagtccttgcgctaggacttgccagtcactgcatatcaacgaaatgtgtcaggaacgatgtgtggatggatgttcatgtcctgaaggtcaactgcttgacgagggactctgtgtagagagcacggaatgcccctgcgttcactccgggaaacgctaccccccaggcacatccctttctcgggactgcaacacatgcatctgccgcaactcacagtggatttgctccaatgaggaatgccctggagagtgtttggtcacaggacagagtcattttaaatctttcgataaccggtacttcaccttctcaggcatatgccagtacctgctggccagggattgccaggatcactctttttctattgttattgagaccgtgcagtgcgcagacgacagagatgcagtttgcacgcgatctgttactgtacggttgccaggtcttcacaactcactcgtgaagctgaaacatggcgccggcgtggcaatggatgggcaggatgtacagttgccgctgctcaagggggacttgaggatccaacacactgtaaccgccagtgtgcgattgtcctatggcgaggacttacagatggactgggatggccggggacgtttgctcgtcaaactaagccccgtgtatgctggtaagacctgcggcctgtgtggcaactacaacggcaaccagggggacgatttcttgacaccttccggactagccgagccacgggttgaggactttggtaatgcctggaagttgcatggggattgccaggacctccagaaacagcacagcgatccgtgtgctctgaaccccaggatgacaaggttcagtgaagaggcatgcgccgtgctcacatcgccgacctttgaggcctgccacagagcagtgtccccactcccatacctgcgtaactgtcggtatgacgtgtgttcatgtagtgatggtcgcgagtgtctgtgcggtgccctcgcctcctatgccgctgcctgtgcaggtcggggagttagggtcgcctggagggagcccggtagatgcgaactgaattgtcctaaggggcaggtgtacttacagtgcggaacgccctgcaaccttacatgcaggagcctaagttacccggacgaggaatgcaacgaggcatgtctcgagggctgtttttgcccgcctggtctgtacatggatgaacgaggcgattgcgtcccaaaagcacagtgtccatgctactatgacggggagatttttcagccagaggacatcttctccgatcaccacacaatgtgctactgtgaggacgggtttatgcattgtactatgtcaggggtgccagggtccctcttacctgacgcggtccttagcagccccttgagccaccggagcaagcggtccctcagctgtagacccccaatggtaaaacttgtgtgccctgctgataaccttcgcgccgagggtctcgaatgcaccaagacctgtcagaactatgacctggagtgcatgtccatggggtgtgtctccggctgtctgtgccccccagggatggtcaggcatgagaaccgatgtgtcgcacttgagagatgcccgtgctttcaccaggggaaggagtatgcacctggcgaaacagtcaagataggatgtaacacatgcgtgtgccaagacaggaagtggaattgcaccgatcatgtctgtgacgccacgtgttcaacaatcggtatggctcactatttgaccttcgacggcctgaaatacctttttcctggcgaatgccaatacgttctcgtgcaggactactgtggctcaaatcctggtacattccggatactggtgggcaataagggctgtagccacccttcagtgaaatgtaaaaaaagggtgacgatcctggtggagggaggggaaatagagctctttgatggagaggtcaacgtaaagagaccaatgaaagacgagacacacttcgaagtagtggaaagcggcaggtacataattctcctgttgggcaaggccctaagtgttgtctgggatcggcatctgtcgattagcgtagtgctgaaacagacatatcaggaaaaagtttgtgggctctgtggcaactttgacggcatacagaataatgatctcacaagtagtaacctccaggtggaggaagaccccgttgacttcggcaattcttggaaagtgagtagccagtgcgctgatacaagaaaggtgcccctggacagttcccccgcgacttgtcataacaacatcatgaagcagaccatggtggatagcagttgccgcatactcacgtccgacgttttccaggattgcaataaactcgtcgatccggagccatacctggacgtatgcatctacgatacatgttcctgcgagagcatcggtgactgtgcttgcttctgtgatactatcgccgcctacgcgcacgtatgtgctcagcatggaaaggtcgtgacttggagaacagctactttgtgtccacagtcttgcgaggaacggaacctgagagaaaatgggtatgagtgtgaatggagatataacagttgcgcgcccgcgtgccaggtgacgtgtcagcatcccgaaccccttgcgtgtccagtacagtgtgtggaaggctgtcatgcacattgtccacccggtaagatccttgatgagcttctgcaaacttgtgttgacccggaggattgtccggtgtgcgaggtggcggggcgcagatttgctagcgggaagaaagtaacactgaaccccagcgacccagaacactgtcaaatctgtcactgcgatgtggtaaaccttacctgcgaggcttgtcaggagccaggcggcctggttgtgcctcctacggacgccccagtatcccctaccacactctacgtagaagacatcagtgagccacctctccatgatttctactgttcgagactgcttgatttggtgttcttgttggacgggtcctctaggttatccgaggccgagttcgaggtgctgaaagcttttgtcgtagatatgatggaaagactccgcatttctcagaaatgggtcagggttgctgtggttgaataccatgacggtagccatgcctacatcggactgaaggatcgtaaaaggccctcagagctccggaggattgcaagccaggtaaagtacgctggctcccaggtagctagtacaagtgaggtgctcaagtatacgctgtttcaaatctttagcaagattgatcgtcctgaggcttcaagaatcactctgttgcttatggccagccaggagccacaacgaatgagcaggaacttcgtgaggtatgtccagggactaaagaagaagaaagtgattgtcatacctgtcggaatcggaccccacgctaacctcaagcaaatccggctgattgagaagcaggcccccgaaaacaaagcctttgtgctttcatcagttgatgagttggaacaacagagggacgagatagtgtcgtacctctgcgatctcgcccccgaggcccctccccccactttaccacctgacatggctcaagtcaccgtgggcccaggcttgctaggcgtttctacccttgggcccaaaaggaactctatggtgttagacgtggctttcgtcttggagggcagcgacaagataggcgaggccgatttcaaccggtcgaaagaatttatggaggaggtgatccagcgcatggacgtgggtcaagattcaattcatgtgaccgtgctgcagtacagctacatggtgacagtagaatatccgttcagcgaagcccagagtaaaggcgacatcctgcagcgggtgagagaaatcaggtaccagggcggcaatcgcactaacacaggactggctctgaggtacctgtctgaccactccttcttggtctcacagggtgaccgcgaacaggctcccaacctggtgtacatggttacaggcaatcctgctagcgatgagatcaaaagactgcccggggacatccaggttgtgcctataggtgtgggacccaacgcgaatgtccaggaattagaacggatcggctggccaaacgcgcccattttgatacaggactttgagactcttccgcgagaagcccctgatctggttctacagcgctgctgcagcggggaggggctgcagatccccaccctttccccagctccggattgttcccagccactcgatgtgattttgcttcttgatgggtcttcgagttttccggctagctactttgacgagatgaagagctttgcaaaagcattcatctcaaaggcaaatataggcccacggctgactcaggtctcggtgcttcaatacgggtctattacaaccatcgatgtgccttggaacgtggtcccagaaaaagcacacctgctatctttagtggacgtgatgcagcgagaaggcggccctagtcagattggggatgcgctcggtttcgcagttagatacctcacaagtgagatgcatggcgctcgacctggcgcctccaaggcggtggtcatcctggttacagacgtaagcgtggattcagtggatgctgcggctgatgcagcaaggtccaacagggtcactgtttttccgatcggcatcggcgatagatacgatgccgcccagttaagaattctagctggtccggctggggattccaatgttgtcaagcttcagcgaattgaggacttaccaacgatggtgacgctcggcaactctttcctgcacaagctgtgctcggggttcgtgagaatatgcatggatgaagacggtaacgaaaagcggcctggcgatgtttggaccctgccggatcaatgtcatactgtcacttgccagcctgatggtcagacactgctcaaaagtcatcgcgttaattgcgaccggggtctgaggccgagctgcccaaatagccagtctcctgtgaaggtggaagagacgtgtggttgcagatggacatgtccttgtgtttgtactggatcctcgactagacacattgttactttcgatggccagaacttcaaactgacagggtcatgtagctatgtgcttttccagaacaaagagcaggacctggaggtcatcttgcacaacggagcatgctccccgggagctcgtcaaggctgcatgaaaagtatcgaggtgaaacactcagcattgagcgtggagctgcactccgatatggaggtgaccgttaatggaaggttagtatcggtgccgtacgtaggcgggaatatggaagtgaacgtttacggggcaataatgcatgaagttcgctttaaccatctgggccacatttttacgttcacgccccagaataatgagttccagcttcagctgagtcccaaaacgtttgcgtcaaagacatatgggctttgcggtatctgcgacgagaatggcgctaatgacttcatgctgcgcgacgggacagtaacaactgactggaagactctggttcaggaatggactgtccagcgccccggccaaacttgccagcccatactggaggagcagtgcttggtacctgattcctctcactgtcaggtcctccttctccccctgtttgctgaatgccacaaagtcctggcacctgccaccttttatgctatatgtcaacaagacagctgtcaccaagagcaggtgtgtgaggtgatcgccagttacgcgcacctgtgccgtaccaacggtgtttgtgtggactggagaacccccgacttctgcgctatgtcgtgccctcccagcttagtgtataaccactgcgagcacggctgccctcggcactgcgacggaaacgtttcctcttgcggggatcatccatcagaggggtgtttctgtccccccgacaaggtgatgttggagggaagctgtgtgccagaggaagcgtgcactcagtgcatcggtgaagacggagtacagcaccagttcttagaagcctgggtgcccgatcaccagccatgccagatctgtacttgtttgtctgggcgcaaagtcaattgcacaacgcagccctgtcccacagccaaggctcctacatgcggcctgtgtgaggtagcacgccttaggcagaatgcagaccagtgctgtcctgaatacgagtgtgtgtgtgatccagtcagttgtgacctgcccccagtcccacattgcgaaaggggcctgcagcctacccttacgaatccaggagagtgccgaccaaattttacctgtgcgtgtcgcaaggaagagtgcaaacgagtgtcacccccaagttgtccacctcacaggttgccgaccctgcggaagacccaatgctgtgacgaatacgagtgcgcttgtaactgtgttaactctaccgtgtcttgcccactgggttaccttgcctctactgcgaccaatgactgtggctgcacaaccacgacttgtctgccagataaagtatgcgtccaccgcagcactatatatcccgtggggcagttttgggaggaggggtgcgacgtgtgtacatgcaccgatatggaagacgccgtgatggggctgcgggttgcccagtgctctcagaaaccatgcgaagacagttgcaggtccggctttacctatgttctgcatgagggggagtgttgcggcagatgcctgccgtccgcttgcgaggtggtgactggaagtccccggggcgactcacagagttcttggaagtctgttggctcccagtgggcttctcccgagaatccatgcttaattaatgagtgcgtgcgtgtaaaagaggaggtatttattcagcaacgcaacgtaagttgtccgcagcttgaggtgcctgtgtgcccctcaggctttcagctgagctgtaaaacctccgcctgctgcccatcttgtaggtgtgaacgtatggaggcatgcatgctgaatggcactgtgatcgggcctgggaagacagttatgattgacgtatgtacgacctgcaggtgtatggtgcaggttggggtaatctctggattcaaactcgagtgtcggaagaccacttgcaacccatgcccactcgggtataaagaggagaacaataccggcgagtgctgtgggcgctgtctgccaacagcatgtacaattcagctgagaggtggccagatcatgaccttgaagcgggacgagactctgcaagatgggtgcgatacccacttttgcaaggtaaatgagaggggcgagtatttttgggagaagcgcgtgacggggtgtcctccctttgacgagcacaagtgcttggccgaaggaggcaagatcatgaaaatccccggaacttgctgtgatacttgcgaggaacctgaatgcaatgatataaccgctcggctgcagtacgtcaaagtgggtagctgtaagtctgaggtcgaggtggacatccattattgtcagggcaagtgcgcaagtaaagccatgtatagcatcgacatcaatgacgttcaggaccagtgctcgtgttgttctcccacacggacagagccaatgcaggtggcactgcactgtacgaatggctcagtggtatatcacgaagtgctcaatgccatggagtgcaagtgttctcctagaaaatgctctaaa

SEQ ID NO: 21382 - DNA, 8439 bp, Artificial Sequence
  Description of Artificial Sequence: Synthetic coding sequence
atgattcctgctaggttcgccggcgtgctgctggcactggcccttatcctgccgggcactctctgcgcagaggggaccagggggcgcagctctaccgcccgttgttcactgttcggctctgatttcgttaacacctttgatggttcaatgtatagcttcgcgggctattgttcatatctgctcgccggcgggtgccagaaacgtagtttctctatcattggcgattttcagaacggtaagcgagtctcattatccgtctatctaggtgagttttttgacatccacctcttcgtgaatggtaccgtaacacagggcgatcagagggttagcatgccttatgccagcaagggactgtacctggagacagaggccgggtactacaaactgtctggggaggcttacggtttcgtggcccgcattgacggctcaggcaattttcaggttctcctttccgaccggtactttaacaaaacctgcggactgtgcggtaacttcaatatcttcgccgaggacgatttcatgactcaagagggaactctgacctctgacccctatgactttgctaactcttgggccctgtcttctggggaacagtggtgtgagagagccagccctcccagttcctcatgcaacatttcatccggggaaatgcagaaggggctgtgggaacagtgccaactcctgaaaagcacatcagtgttcgcacgatgtcacccactggtcgaccccgagccattcgtagcgctctgcgagaagacgctgtgtgagtgcgcaggcggcttggagtgtgcgtgtcccgcactcctcgagtatgcgcggacctgcgcacaggaggggatggtgctatacgggtggacagaccattccgcctgttctccagtgtgccctgcgggcatggaataccgccagtgcgtgagcccatgtgcgagaacttgccagagccttcatataaacgaaatgtgtcaggaaaggtgcgtagatgggtgctcgtgtccagagggtcagttactcgatgaaggcctttgtgttgaatccaccgaatgcccatgcgtgcacagtggcaagagatatcccccaggaaccagcttgagccgggattgcaatacctgtatctgcagaaattcccagtggatatgctccaacgaggagtgcccaggtgagtgcctggtaacgggacagagccacttcaagagctttgataatcgttatttcacctttagtggcatctgtcaatacctcctcgctagggattgtcaggaccactcctttagcattgtgatcgagacagttcagtgtgctgacgatagggacgccgtctgcaccaggtctgtcacagtaaggctacctggccttcataacagtttggtgaaacttaagcacggtgcaggggttgcaatggacgggcaagacgtgcagctgcctctgctgaaaggagatcttagaatccagcacaccgtgaccgcgtctgtgcgtctgagttacggtgaagacttgcagatggattgggatgggcgtggccggttgctggtgaagctctctcctgtgtatgccggcaagacttgtggcctgtgcgggaattacaatggtaatcagggcgatgatttcttgactcccagtggtttagctgaacctcgagtagaggactttggcaacgcctggaaactgcatggcgattgtcaagatctgcagaaacagcactccgacccttgcgcccttaacccacgcatgacccgcttcagcgaggaggcttgcgcggtgttaaccagtccaaccttcgaagcttgtcaccgggccgtgtctcctctaccctacctcagaaactgtaggtacgacgtgtgcagctgcagcgacggaagagaatgcctttgcggcgctctcgcctcctacgctgcagcttgcgcagggcggggagtgcgcgtcgcttggcgcgaacccggccggtgcgagctgaattgccccaaaggccaggtctacctgcagtgtgggaccccttgtaacttgacatgccgctctctgtcctatccagatgaggagtgtaatgaggcttgcctggaaggctgtttctgccccccaggcctgtacatggacgagagaggggattgtgttcctaaagcacagtgcccctgttattatgacggggagatcttccagcccgaggatatattcagtgaccatcataccatgtgctactgcgaggacgggtttatgcactgcactatgtccggcgtgcccggctcgctcctgccagatgcggtgctcagctcccctctgagccaccgaagcaaacggagcctcagttgccggccccctatggtaaagctcgtctgccctgccgacaacctccgcgccgagggcctagaatgcactaagacttgccagaattacgatctggaatgcatgtccatggggtgtgtctcagggtgtctttgccctcccggtatggtccgccacgaaaaccggtgcgtcgcactggaaagatgtccgtgctttcatcagggaaaggagtatgcgcccggagagacggtgaagatcggctgcaacacttgtgtctgtcaggacagaaagtggaactgtacggatcatgtgtgcgacgccacgtgcagcacaattggcatggcgcattacctgacctttgatggcttgaaatacttgttccccggcgagtgtcaatatgttctagttcaggactattgcggttcgaatccagggactttccgcatcctggtaggcaataagggctgtagccatcccagtgtcaagtgcaaaaaacgagtgacaattttggtcgaaggcggcgagattgagctgttcgatggcgaggtgaacgtgaagaggccaatgaaggacgagacgcacttcgaagtggtcgagagtggcagatacattatactgctgctgggaaaggccttgagtgtcgtctgggacaggcacctgagtatttccgtggttctgaagcagacataccaggaaaaggtgtgcggtctgtgtggtaacttcgatgggatccagaataatgacctcacatcctccaacctgcaagtggaggaggatccagttgacttcgggaacagctggaaggtgtcatctcagtgtgcggatactcgcaaagtgcctctcgactcctcgccagccacctgtcacaataacataatgaagcagacaatggtagactccagctgtcgcattctgacctcagacgtgttccaggattgtaacaaactggtggatcccgaaccatatttggatgtgtgcatttatgacacatgcagttgcgagagcatcggagattgtgcatgtttctgtgacacgattgcagcttacgcccatgtatgtgcacagcatggtaaagtcgtgacttggcgcacggcaacactttgcccccagagctgcgaggagaggaacctgcgggaaaacggctatgagtgcgagtggcggtacaatagctgtgcccctgcttgtcaggtcacatgccagcatcccgaacccctggcctgccccgtgcagtgcgtggaagggtgtcacgcccattgcccccccgggaagatcctcgatgagctgcttcagacatgtgtcgacccagaggattgcccagtgtgcgaggtcgccggccgacgtttcgcgtctggaaaaaaagtgaccctgaatccaagtgaccctgagcactgccaaatctgtcattgtgacgtagttaacctgacctgcgaggcatgccaggaaccaggggggttggttgtcccacctactgacgccccagtgagtcctaccacgctatatgttgaagacatctcggagccaccgctgcacgacttctactgcagcagactgttggatctggtgttcctcttggatggatcctcgcgcctctcagaggccgagttcgaggtgcttaaggccttcgtggtggacatgatggaaaggctccgcattagccaaaagtgggtccgcgtggcagtggtggagtaccacgatggcagtcatgcttacattggcctcaaggatcggaagcgaccttcagagctccgccgaatcgcctctcaggtgaaatatgccgggtctcaggtggccagcacctctgaagtgctgaaatatactctctttcagatctttagcaagattgataggcccgaagccagccggattactctcctgctcatggcatcccaggagccgcagcgaatgagtagaaatttcgtgcgatatgtgcaggggttgaagaaaaaaaaggtcatcgtgattccagtgggcattggcccccatgcgaatctgaaacagattcgtcttatagaaaaacaggccccggaaaacaaagctttcgtcttatcctccgtcgacgagttggaacagcagcgagacgaaattgttagctacctgtgtgatctggccccagaggccccgcctcccacattgccacccgatatggcccaggtgactgtgggacccggcctgctcggggtctctactctgggccctaaacgtaattccatggtgttagatgttgccttcgtgctagagggttccgataagattggtgaagccgatttcaaccgcagtaaagaattcatggaggaagttatccagcgcatggacgtcggccaggactcaattcacgtgactgtgctccagtattcttatatggtcaccgtggagtaccccttcagcgaggcccagtccaagggagatatcctccaacgcgtgcgcgagattcgataccaggggggaaaccggaccaacaccggcctggcgctgagatatctgagcgatcactctttcctcgtgtctcagggcgatagggagcaggcgccgaacctggtgtatatggtgacgggcaatccagcgtccgacgaaataaaacgcctgccaggagacatacaggtggttcccatcggcgtgggccctaacgccaacgtccaggaactggagcgcatcggctggccgaatgctcctattctaatccaggacttcgaaaccctccctcgggaggcacctgatctcgtcctgcagcgctgttgctccggggagggccttcagattccaacactcagtcccgcgcccgattgctcacagcctctcgatgtgattctgctcctggacggctcctcaagcttccctgcctcttactttgatgaaatgaagtcttttgccaaggcttttattagcaaggccaatattggccctcggctgacccaggtgtctgtgcttcaatacggttccatcacaaccatcgacgtgccgtggaacgtggtgcccgaaaaagctcacctgctatctctcgtggacgtgatgcagcgagaagggggcccctcccagattggcgatgctctgggatttgccgtgcgatatctgacttccgagatgcacggtgcgaggccaggtgcttctaaggcggtggtgatcctggtgaccgatgtgtctgtggacagcgtggatgccgccgctgacgccgctcggagcaaccgagtgaccgtgttcccaataggcattggagataggtatgatgcagcacagctgcgaatcttagctggaccagccggagattcaaatgtggttaaactgcagagaattgaggacctacccactatggtcaccctgggtaattctttcctccacaaattgtgttctggtttcgtgcgaatttgtatggacgaggatgggaacgagaagcggcccggcgacgtgtggactttgcctgatcaatgtcatacggtcacatgccaacccgatggccagacgttgctgaaaagccaccgtgtcaattgtgatcgcgggctgcggcccagctgccccaactcccagtctccagtgaaagtcgaggaaacatgcggctgccgttggacctgtccatgcgtgtgcactggcagcagcacgcgccatatagtgacattcgatgggcaaaattttaaattaacaggaagctgcagctatgttttatttcagaacaaggaacaggacctggaggtgatcctgcacaacggcgcttgctccccaggcgctcggcagggctgtatgaagagtattgaggtgaaacactccgccctttccgtagaactacactccgacatggaggtgacagtgaatggccggcttgtcagcgtaccctatgtgggcggcaatatggaggtcaatgtgtacggcgcaatcatgcacgaagtcagatttaaccacttaggccatatctttacctttaccccccagaacaatgaattccagttacagttgagtccgaagacgttcgcatctaaaacatatgggttgtgcggaatctgtgatgagaatggtgccaatgactttatgttacgcgatggcaccgtcaccactgactggaagactctggtgcaagagtggaccgtgcagagaccaggccagacatgccagcccatcctcgaggaacagtgcctggtgcccgacagttctcactgtcaggtgcttctgctccctttgttcgctgagtgtcacaaggtgctcgctccggccacattttacgcaatatgtcagcaggacagttgtcaccaggaacaggtgtgcgaggtgatcgcaagttatgctcacttatgtcggacaaatggagtctgcgtggattggagaacgccagacttttgcgctatgtcatgcccccccagtttggtgtataatcactgcgagcacggttgtcccagacactgcgatggcaatgtgtcctcctgcggtgatcacccctccgagggttgtttttgccctccggataaggtcatgctcgaggggagctgcgtgccagaagaggcctgcacacaatgtataggagaagacggtgtccagcatcagttcctcgaggcatgggttccagatcaccaaccgtgtcaaatatgcacctgtctctccgggaggaaagtcaactgcaccacgcagccatgccccacggcgaaggcaccaacctgtggcttgtgcgaggttgccaggctgcggcagaacgctgatcagtgttgccctgaatatgaatgcgtgtgtgacccggtgtcctgtgacctgcccccagttccccactgcgagcgcggtctacagccgaccctgactaatcctggcgaatgccgccctaacttcacatgcgcatgcaggaaggaggagtgcaagagggtctcccccccctcctgcccaccgcaccggttgcctacacttaggaaaacgcaatgttgcgatgagtatgagtgtgcctgcaattgcgtgaattctacagtttcttgtccgctgggttacctagcctccactgccactaacgattgcggttgtacgacaacaacgtgtctgcccgacaaagtgtgcgtgcaccggtccaccatctacccggtgggccagttttgggaggaagggtgcgacgtgtgtacatgtacagatatggaggacgccgtgatgggactgcgcgtggcccagtgttcacagaaaccttgcgaagactcttgccggtcaggctttacctacgtgctgcacgagggcgagtgctgtgggcgatgcctgccttcagcctgcgaggtggtcacaggcagccctcgcggggactctcagtccagctggaagtcagtcggctcacagtgggcatcacccgagaacccctgtctgattaatgagtgcgttcgggtgaaagaggaggtatttatccagcagcgcaatgtcagctgcccacagctcgaggttcccgtctgccccagcggatttcagctctcttgtaagacgagtgcttgctgcccttcctgccgatgcgaaaggatggaggcctgtatgctaaatggtaccgtcatcggccccggtaaaaccgtgatgatcgacgtgtgtacgacttgcaggtgtatggtgcaggtgggcgtcatatccgggttcaagcttgaatgtcggaaaaccacatgcaacccatgcccactgggctacaaggaggagaacaatacaggggaatgctgtggacgctgcctgcctacggcttgcacaattcaactgcgtgggggccaaataatgacactgaaaagggacgagacgttgcaggacggatgtgatacacacttttgcaaagtcaacgaaaggggggagtacttctgggagaagcgcgtcaccggatgccctccattcgacgagcacaagtgtctggctgaagggggaaagattatgaagataccaggcacttgctgtgacacttgcgaagagcctgagtgcaacgatattaccgccagactgcagtacgttaaagttggatcctgcaagagtgaagtagaagttgatattcattattgtcaggggaaatgcgcttccaaagccatgtatagtatcgacattaacgacgtgcaagaccaatgcagttgttgctcccccaccaggactgaacctatgcaggtggctctgcactgtacaaatggtagcgtggtgtatcacgaggtgctgaatgcgatggagtgtaagtgcagccctcgcaagtgcagtaaa

SEQ ID NO: 21383 - DNA, 8439 bp, Artificial Sequence
  Description of Artificial Sequence: Synthetic coding sequence
atgatccctgcaaggttcgctggcgtgctgctggccttagccctcatcctgcccggaactctctgcgctgaagggacaagaggtcgaagcagtaccgctagatgctccctgttcggatcagacttcgttaatactttcgacggtagtatgtatagctttgctggctattgttcatatctgctagctggcggctgtcagaagagatctttcagcataattggagatttccagaatggtaaacgagtttccctgagcgtttacttaggtgaattcttcgatatccatcttttcgtcaatggaaccgtgacccagggcgatcaacgagtttccatgccctatgcatccaaagggctgtatctggagaccgaggccggctattataaacttagcggcgaggcctacggctttgtggcccggatagatgggagtggtaacttccaggtgctgctgtctgataggtactttaataaaacctgtggactgtgtggtaattttaatatattcgctgaggacgattttatgacccaggagggcaccctcacttcagatccatacgatttcgccaactcctgggctctcagctccggtgaacaatggtgcgaacgggcctcccctccaagttctagctgtaacatctcctccggcgaaatgcagaaggggttatgggaacagtgtcagctcctaaaatcaacctctgttttcgcccggtgccatcccctggtggatcccgaaccatttgtggctctatgcgagaagacactgtgtgagtgtgctggcgggctggagtgcgcatgcccagccctgctggaatacgctagaacttgcgctcaggaaggaatggttctgtatggatggacagatcactctgcatgctcacccgtgtgtcccgctggcatggagtaccggcagtgcgtgagcccctgcgcaaggacttgccagagcctgcatatcaatgaaatgtgccaggagaggtgcgtggatgggtgttcctgcccagagggccagctcctggacgaaggcttatgcgtagaatccaccgagtgtccttgcgtgcactctggcaaacgatatcctcccggaacaagtctgagtcgagactgtaacacttgcatctgtcggaactcccagtggatttgctctaacgaggagtgccctggcgagtgtctggtgaccgggcagagtcacttcaagtctttcgacaatcgttatttcacattctctgggatttgtcagtacctcctagcccgcgactgccaggatcactccttctctattgttattgagacagttcaatgcgcagacgatcgggatgccgtgtgtaccaggtctgtgaccgttaggttgccaggattgcataatagcctggtcaaattgaagcacggcgccggggtcgctatggacggccaggatgtacagctgccactcctgaagggcgacttaaggatacaacacacagtgacagcctctgtccggctgagctacggcgaggatctgcagatggactgggacgggcgaggaagactgctggtgaagttgtctcccgtttatgctggcaaaacatgcggcttatgtggaaattataatggcaaccagggggatgattttctaaccccatccgggctggccgagcctcgcgtggaggatttcgggaatgcatggaagctacacggagactgccaggatctccagaagcagcattctgacccctgtgctctcaacccaaggatgacaagattttcagaggaggcctgtgctgtcctcacctcacccacattcgaggcatgccacagagctgtttcccctctaccatatctgagaaactgtcgttatgatgtgtgttcctgcagtgatgggagagagtgtctgtgcggggcactggcttcatacgcagccgcctgtgcagggaggggagtgcgtgtggcttggagggagcctgggcgatgcgagcttaactgtcccaagggtcaagtgtaccttcaatgtgggacaccttgcaatctcacttgtcgcagcctctcctatcccgatgaggagtgcaacgaggcctgcctggagggctgcttctgtccccccgggctgtatatggatgaacgaggcgattgcgtgcccaaggctcagtgcccatgctactacgacggggaaattttccagcccgaagacattttctccgatcaccataccatgtgttactgtgaggatgggtttatgcactgtacaatgtccggcgtgcctggatctctcctgcctgatgcagtgctcagcagccctctatcccaccgttctaaaaggtctctgtcttgcagaccacctatggttaagttagtctgcccagctgataacctgcgagctgaagggctagagtgtaccaaaacttgtcagaactatgatttggagtgcatgagtatgggttgcgtctctgggtgcctgtgccctcctggcatggtgcggcatgagaaccgttgcgtggcactggaaagatgcccatgtttccatcaaggcaaagagtacgctcctggcgaaaccgttaaaatcggctgcaatacctgcgtctgccaggatcgaaaatggaattgtacagatcacgtttgcgatgccacttgttcaaccataggcatggcccactacctgacattcgacggactgaagtacctgttcccaggcgagtgccagtatgtactggtccaggactattgtgggtccaaccccggcacctttagaattctagtgggaaacaagggttgcagtcacccaagcgtgaagtgtaaaaagcgcgtgaccattctggtggagggaggcgaaatcgagttatttgacggtgaggtcaatgtgaagcgtcctatgaaggacgagacccatttcgaagtggtggaatccgggaggtatattatcttgcttttggggaaggccctctctgttgtatgggatcgacatctgtccattagcgtggttcttaaacagacttatcaggaaaaagtgtgtggcttatgcggcaatttcgacgggatccagaacaatgatctgacaagcagtaatctccaggtagaggaagacccagtggactttggaaactcatggaaggtgagcagtcagtgtgctgacacaaggaaggtcccactggattcctccccagcaacatgccacaataacattatgaagcagaccatggtggacagcagctgcaggatcttaaccagcgacgtgtttcaggattgcaataagctagtcgaccccgagccatacttggacgtgtgcatttatgacacatgttcctgtgagtccataggcgattgtgcatgcttttgtgacacaatagctgcttacgcacacgtgtgcgcccagcacgggaaggttgtgacatggcgtaccgcaaccctgtgtccccagtcctgtgaggaaagaaatctgcgggagaacgggtacgagtgcgagtggcgttacaatagctgtgctcctgcatgccaggttacatgtcaacacccagagcccctggcctgccctgtacagtgtgtagaaggatgccatgcccactgccctcccggtaaaatcttagatgaactcttacagacttgcgtcgatccagaagattgccccgtgtgtgaagtggccggtcgcagattcgcctctgggaagaaggtgacactcaacccgtccgacccagagcattgtcagatttgtcactgtgacgtggtcaatctgacttgtgaggcctgtcaggaacctggcggccttgtcgtcccacctactgatgctcctgtgtccccaaccacactctacgtggaggatataagcgaacctcctctccacgacttctattgctccaggctgctggacctggtgttcctcctggacggctcatctcggttatccgaggcagaatttgaggtcttgaaggcttttgttgtcgatatgatggagaggttgcggatctctcaaaaatgggtcagagttgctgttgtcgaatatcatgacggcagtcacgcctatataggtctgaaagaccgtaaacgcccttctgaactgcggcggatagcaagccaagtgaaatatgccggctcccaggtcgcctccaccagtgaggtgctgaagtacaccctattccagattttctccaagatcgatcggccagaggccagcaggatcacactgcttttaatggccagtcaggagccccaacggatgtcaaggaacttcgtgcgctacgttcaggggttgaaaaaaaagaaagtgatcgtgataccagtcgggattgggccccatgctaatctgaagcaaattcgcttgattgagaagcaggcccctgaaaacaaggccttcgtccttagttccgttgatgaactggagcagcagagagacgagatagtgtcttatctgtgtgacttggcacccgaggctcctccgcccaccctccctcccgacatggcacaggtcaccgtgggtcccggtctgctgggggtgtccaccctgggcccaaagaggaattctatggtgctggacgtggctttcgtgttagagggcagcgataagatcggtgaggctgacttcaacaggagtaaggaatttatggaggaagtgatccagcgaatggacgttggccaggatagcatacacgttaccgttttacagtattcctatatggtgactgtcgaatacccattcagcgaggcccagagcaagggcgatattctccagagagttagggagatacgctaccaaggtgggaaccgtacaaatactggattagccctgagatacctgagcgatcatagctttctagtgtcacagggcgatagagaacaggctccaaacctggtgtatatggtcaccggcaatcccgcctctgatgagatcaaacgcctacctggcgatatacaggtggtgcccatcggagtgggtcccaatgctaacgtgcaggaactggagcgcatcggctggcctaacgcacctatcttaattcaggatttcgagacactgccaagagaagcccccgatctagtcctccagcgctgttgcagcggcgaggggctccagatcccaacactgagcccagctccagattgtagccaaccattggacgtgatactccttttagatggttctagttcctttcctgcttcttattttgatgagatgaagtctttcgctaaagcatttattagcaaagctaacattggtccacgcctgacccaggtctccgtgctgcagtatggatctatcaccactatagacgtgccctggaacgtggtgcctgagaaggcacatctgctatccctggtggatgttatgcagagagaaggcggccctagccaaatcggagacgctcttggattcgcagtgcgatacctgacatctgaaatgcacggcgcccgtcctggagccagcaaagccgtggtgattctggtgaccgacgtgtctgtggacagcgtcgacgccgccgccgatgccgccagatccaatagagtgaccgtgttccccattgggattggggaccgctacgatgcagcccaactgcgcatactggctggacctgctggcgatagtaatgttgtcaagctgcagaggatcgaagatctgccaacaatggtgacactaggcaactccttcctccataagctctgcagtgggtttgttcggatttgtatggacgaggacggcaatgagaagcgcccgggcgatgtgtggactctaccagaccaatgccacactgtgacatgccagccagacggccaaacactgctgaaaagccacagagttaattgcgataggggccttcggcccagttgtcccaacagccaatctccagtgaaagtagaagagacttgcggatgtagatggacctgtccttgcgtctgcactggctcaagtacacggcacattgtgactttcgatggccagaacttcaagctgacagggtcctgtagttatgttctattccagaacaaggaacaggacctcgaagtgatcttgcacaacggagcttgctctccaggtgcacggcaaggctgtatgaagtcaatagaggtcaagcattccgccctatcagtcgagctgcatagtgacatggaggtaactgtgaatggccgcctagtgagcgttccctatgtgggagggaacatggaggtcaacgtgtacggagccatcatgcacgaggttagattcaatcatctgggccatatatttaccttcacacctcagaataacgaattccagctacagctgtccccaaaaaccttcgcctccaagacttacggtctgtgtgggatatgtgatgagaacggagcaaatgactttatgttaagggatggtaccgtcaccaccgactggaaaactctggttcaggagtggactgtgcagagacctggccaaacttgtcagcctattttggaggaacagtgcttagtgcctgattcctcccactgtcaggtgctcctgctgccgctgttcgccgaatgccacaaggtactggctcccgcaaccttttacgcaatttgtcagcaggacagctgtcaccaggagcaggtgtgcgaggttattgcctcttatgcacatctgtgtcgtactaacggcgtttgcgttgactggcgaacccctgacttctgcgctatgtcctgtcccccttcattggtctataaccattgtgaacacggctgtcctagacattgtgatggaaacgtatcttcttgtggagaccacccttcagagggctgtttttgcccaccagacaaggtgatgctcgaaggcagttgcgttcccgaagaggcctgtacccaatgtatcggggaagatggggttcagcaccagtttctcgaggcctgggtgcccgaccatcaaccctgtcaaatttgtacctgcctaagcggaaggaaggtgaactgcactacacagccatgccctaccgcaaaggccccaacctgtggtttgtgtgaggtggccagactgcggcagaacgctgaccaatgctgtcctgagtatgaatgcgtctgcgaccccgtgagctgcgacctgcctcccgtcccacattgcgaacgtggcctacaacccaccctcactaatccaggcgaatgtagacctaacttcacctgcgcttgtaggaaagaagagtgcaagcgcgtgagccccccctcttgccctccacacaggctaccaacattgcgcaaaacacaatgctgtgacgagtatgagtgcgcttgcaactgcgtgaacagtacagtgagctgcccactgggctatctcgccagcactgctactaatgattgcgggtgtacaaccacaacttgcttaccagacaaggtttgtgtacatcggagcaccatatatcctgtaggccagttttgggaagagggctgcgatgtgtgcacctgtacagacatggaggacgctgtgatgggcctgcgcgtggcacagtgtagccagaagccttgcgaagatagctgccggagtggctttacctatgtgctgcatgaaggggagtgctgcgggaggtgtctgccaagcgcttgcgaggtggttaccggctccccaaggggcgacagccagagcagttggaaatctgtggggtctcagtgggcatcacccgagaacccatgtttaataaatgagtgcgtgagagtgaaggaagaagttttcatccagcagcgcaacgtgagttgccctcagctagaggtgccagtctgtccctccggcttccagctgtcttgtaagacttcagcctgctgtccttcttgtcggtgcgagcgaatggaggcatgtatgctaaacgggaccgttatcgggccagggaaaacagttatgattgacgtgtgtaccacctgcagatgcatggttcaggtgggcgtgatcagcggattcaaattagaatgtagaaagactacctgcaatccatgccctttggggtacaaggaggaaaacaacacaggcgaatgttgcggcaggtgcctgcctaccgcctgcactattcaacttcggggcggccagatcatgactttaaagagagacgaaactcttcaggatggctgcgacacccatttttgcaaagttaatgagcgcggcgagtacttttgggagaagagggtgacaggctgtcccccattcgatgagcacaaatgcctggccgaaggcggtaagatcatgaagatacccggcacctgctgtgatacctgtgaggagcctgaatgtaatgatattacagccagactgcagtacgtgaaggtcggctcttgtaaatcagaagtggaggttgacatccactactgtcaggggaagtgcgcatccaaggcaatgtattctatagatatcaacgatgttcaggaccagtgctcctgctgtagccccacccggactgagccaatgcaggtggcattacactgtacaaatggctcagtcgtgtaccacgaagtcctgaatgccatggagtgcaaatgttcccctcgtaaatgctctaag

SEQ ID NO: 21384 - DNA, 8439 bp, Artificial Sequence
  Description of Artificial Sequence: Synthetic coding sequence
atgatcccagctaggtttgccggagtcctcctcgccctcgcactgatactccccgggacactctgcgctgaagggacacggggacggtcatctactgcaaggtgctctctgtttggaagtgatttcgtcaatacattcgatggatccatgtactccttcgcagggtactgttcatatctgctcgccggaggatgtcagaaacggtccttctcaattataggagattttcaaaatggaaaacgggtgtctctatccgtgtatctgggagagttctttgatattcacttgtttgtcaacgggactgtgacacagggagatcagagagtcagtatgccctatgcctcaaaagggctctacttggaaacagaagctggatactacaaactttcaggggaggcctacgggtttgtcgctcgcatcgatgggagtggaaactttcaggtgcttctctcagatcgatatttcaataaaacatgtggactttgtgggaactttaacatctttgccgaagacgatttcatgacacaggaaggaacattaacatcggatccttatgatttcgctaactcctgggctttatcctcaggggaacagtggtgtgaacgagccagtcccccctcttcctcttgcaacatttctagtggggagatgcagaaaggactgtgggaacagtgtcagcttctgaaatccactagtgtcttcgccagatgtcatccactggtcgatcctgagcccttcgtggctctctgtgagaaaacactctgcgaatgtgctgggggactagaatgtgcctgtcccgcattactagaatatgccagaacatgtgcccaggaaggaatggttctatatgggtggactgatcatagtgcgtgtagtcctgtctgtccagctgggatggaatacaggcagtgtgtgagtccctgtgctagaacatgtcagtccttgcatattaacgagatgtgccaggagcgctgtgtggatggatgctcctgtcccgaagggcagctactcgatgaagggctttgtgtggagtccacagagtgtccttgtgttcattcagggaaacggtatccccctggaacttctcttagtcgcgactgcaatacatgtatctgtagaaactctcagtggatatgtagtaatgaagaatgccccggggaatgtctcgtcacagggcagtcacattttaagtcctttgataacaggtattttacattctccggaatctgtcagtatttactcgccagggattgccaagaccattcttttagtatcgtaatagaaactgtgcagtgcgccgatgacagagatgccgtttgcactagatccgtgactgtgcggttacccgggctccacaattcactcgtcaaattaaagcatggggccggagttgctatggatgggcaggatgtgcagttacccttactgaaaggggatcttaggattcagcatactgtaacagcctccgtgcggctttcctatggggaagacttacagatggattgggatggacgagggcggctgctggtgaaattaagtcccgtttatgcagggaaaacatgtggactgtgtgggaattacaatgggaatcagggggacgactttcttacaccctccgggctggcggaacctcgagtggaagattttggaaacgcctggaaactgcatggggattgtcaggatcttcagaaacagcacagtgacccttgcgcactcaacccccggatgacgcgattcagtgaagaagcatgcgccgtcctcactagtcctacattcgaggcatgtcatcgggccgtgagtcctctcccatatcttagaaactgcagatatgatgtgtgtagttgttctgatggacgggaatgcctgtgtggggcactcgcctcttatgcagctgcatgcgctggacggggagtgcgggtcgcctggagagagcctgggaggtgtgaattaaattgccctaagggacaggtctatctccagtgcgggacaccatgtaaccttacatgtaggtctctgtcatatcccgatgaagagtgtaacgaagcttgcctggaagggtgtttttgtccccccgggctctatatggatgaacgaggagattgtgtccctaaggcccagtgtccatgttattatgatggggaaatattccagcctgaagatatattctctgatcatcacacaatgtgttactgtgaagatgggtttatgcactgcacaatgtcgggggttccaggaagtcttctgcccgatgcggtgctatcatcacctctgtcacaccggtcgaaaaggtccctgagttgccgacccccaatggtgaagttggtgtgtccagcagataacttacgcgctgaagggcttgaatgtacgaaaacatgtcagaactatgatctggaatgtatgtcaatggggtgcgtatcagggtgcctttgccccccaggaatggtgagacacgaaaataggtgtgtagctctggaaagatgcccctgctttcaccaggggaaagaatatgctccaggggaaacagtgaaaatcggatgcaatacttgtgtttgccaggatcggaagtggaattgcacagatcacgtgtgtgatgcaacatgtagtactatcggaatggctcattatctcacatttgacggattaaaatatctgttcccaggggaatgtcagtatgttctggttcaggattactgcggatctaaccctgggacatttcgcatcctcgtggggaacaaagggtgctctcacccttcagtgaaatgtaaaaaacgcgtaacaatcttagttgaaggaggagaaatagaactcttcgatggagaggtgaatgtcaaaagacccatgaaagacgaaacacacttcgaggtggtcgaatccggaaggtatataatccttctcctcggaaaagctttgtctgtcgtctgggataggcacctgtctatctcagtcgtcctcaagcagacttaccaggaaaaagtctgtggactatgtggaaattttgatggaatccagaacaatgatctcacttcttcaaacttgcaggtcgaagaagaccccgtggatttcggaaattcatggaaggtctcttcacagtgtgctgatacaagaaaagtccccttagactcttccccagccacatgccacaacaacattatgaaacagacaatggtggattcgagttgtcgcatcctcacttccgatgtattccaggattgcaacaaactcgttgatccagagccatatcttgacgtgtgtatatatgatacatgttcatgtgagtctattggagattgcgcatgcttctgtgatacaatcgccgcctacgcccatgtttgcgcacagcacgggaaagttgttacatggcggactgctactctgtgtccacagtcttgtgaagaacggaacttgagagaaaatggatatgaatgtgaatggcggtataattcctgcgccccggcatgtcaggtgacttgtcagcaccccgagcccctggcatgtcccgtgcagtgcgtcgaggggtgccatgcacattgccctccgggaaaaatcctcgatgagcttctgcagacatgcgtagatcccgaagattgtcctgtttgtgaggttgcaggacggagatttgcaagtgggaaaaaggtgacactgaacccatccgatcccgaacattgccagatctgtcactgtgatgtggttaatcttacttgtgaagcatgccaggaacccggaggattagtggtccccccaactgacgcacctgtatccccaactactctatatgtggaagatatatcagaacctcctctgcatgatttttattgctctcggctattagacttagtgttccttttagacgggtcctcaaggttgtcagaagcagaattcgaagtattaaaagcctttgtggttgacatgatggaacgacttcgcatcagtcagaaatgggtgcgggtagctgtggtcgagtatcacgatggatctcacgcttatatcgggcttaaggaccggaaacgcccatccgaactcaggagaatcgcttctcaggtgaaatacgcaggatcccaggtcgcctccactagtgaagtgctcaaatatacactatttcagattttttctaaaatagatcggcctgaagcttcacgcattacactgctcctaatggcttctcaggaaccacagcggatgagtaggaattttgttcgctatgtgcagggactgaaaaaaaaaaaagtgattgtgattccagtggggatcgggcctcatgctaatcttaaacagatacgacttatcgaaaaacaggcaccagaaaacaaagcatttgtgctgtcttctgtagatgagctggaacagcagagggatgaaatagtttcctatctttgtgatctagcccccgaggccccccctccaacgcttcctcccgatatggcacaagtgacagtcggaccggggctactgggagttagtacacttggacctaaaagaaactctatggttctcgacgttgctttcgtgctcgaagggtcagataaaattggggaagctgatttcaacaggtcaaaagaatttatggaagaagtaatccagcggatggatgtagggcaggattccatccacgtgactgttctgcagtactcctatatggtgactgtcgaataccccttttctgaagctcagtcaaaaggggatattttacagagggtacgggaaataaggtaccaaggggggaaccgcactaatacagggcttgctctccggtatctctctgatcactctttcctcgtgtcacagggggatagagaacaggctcccaatcttgtctacatggtcacaggaaatccagcaagtgatgagataaagaggctacccggggatatccaggtggtgcctataggggttgggcccaatgcaaacgtacaggaactggagaggatcggatggcccaacgctcccatactcatccaggattttgaaacactcccacgtgaggcccctgatctggtgctgcagcggtgctgctctggagagggacttcagatcccaacactttctcctgcccccgattgctcacagcccctcgacgtcatactccttctcgatgggtcttcatcatttcctgcctcgtattttgacgagatgaaatctttcgctaaggctttcatatccaaagccaacataggacccaggctcactcaggtcagtgtactgcagtatggaagtattactacaattgatgtcccatggaacgtggtccctgaaaaagcgcatctgctctcattagttgatgttatgcagagagaaggaggaccctcccagataggagacgccttgggattcgccgtaagatacctgacatctgaaatgcatggagccaggccaggagcttctaaagctgtggtgatcctggtaactgatgtgtctgtagattcggtcgatgctgcagctgatgccgcccggtctaacagagtgactgtctttcccatagggatcggggatcggtatgacgccgcccagcttcggattcttgccgggccagcaggagattctaacgtggtaaaactacagcggatcgaagatctgcctacaatggtgacgctcggaaattccttcttacacaaactgtgctcgggattcgtgagaatttgtatggatgaagatgggaatgaaaaacggcccggagatgtgtggacactccctgaccagtgtcatacagttacatgtcagcccgatgggcagacactcttaaaatcccaccgggttaactgtgatcgcggactgaggcctagttgtccaaattcccagagtccagtcaaagtggaagaaacatgtggatgcaggtggacttgtccctgcgtatgtacagggtcttcaactagacatatcgtgacatttgatgggcagaatttcaaactaactgggtcttgttcatacgtactctttcagaacaaagagcaggatctcgaagtaattctccataacggagcgtgctcccctggagcccgacaggggtgtatgaaaagtatcgaggtgaagcattcggccctctctgtggagcttcattctgatatggaggtgacagtgaacggacggcttgtgtccgttccgtatgtggggggaaatatggaagtcaatgtctatggagcaattatgcacgaggtgcgtttcaaccacctcggacacattttcacttttactcctcagaacaatgaatttcagctccagctctctcccaaaactttcgcctctaaaacatatggactttgcgggatatgtgacgaaaatggggccaacgattttatgttacgcgatgggactgtcactactgactggaaaactctcgtacaggagtggacagtccagcggccagggcagacttgtcagcctatcctggaagagcagtgtctcgttcctgattcttctcactgtcaggtgttattgctccctctgtttgcagaatgtcataaagtcctagccccagctacattctatgcaatctgccagcaggattcatgccatcaggaacaggtgtgtgaagtcattgcaagttacgcacacctttgtcgcactaacggggtatgtgtcgattggcggactccagacttttgtgcgatgtcctgtccgccctccttggtctataaccattgcgaacacgggtgccctcgacattgtgacgggaacgtgagtagttgtggggatcatccctcagaagggtgcttctgtccccccgataaagtaatgctcgaagggagttgcgtccccgaagaagcctgcacacagtgcatcggagaggatggagtgcagcaccagtttcttgaagcttgggtccctgatcaccagccctgtcaaatctgtacttgcttgtctggacgtaaagtgaattgcacaacacagccctgtcctactgctaaagctcccacttgcggactatgtgaggtcgctagactaaggcagaatgccgatcagtgctgtcccgaatacgaatgcgtttgcgaccctgtcagttgtgacctccccccagtaccacactgcgagcgcgggttgcagcccacactaacaaacccaggagagtgtcggcctaacttcacatgtgcttgtcggaaagaagaatgtaaaagggtttcaccccctagttgtcccccccacaggcttcctacacttaggaaaacgcagtgttgtgatgaatacgagtgcgcatgcaactgcgtgaactctactgtctcctgtcctcttgggtacttggcttccacagcaactaatgattgtggatgtactacaactacatgtctgcctgataaagtttgtgtgcacaggtctacaatctatccagtgggacagttttgggaagaagggtgtgacgtttgcacatgtactgatatggaagatgcagttatggggctcagagtggcacaatgttcacagaaaccatgcgaagattcctgtaggtctggattcacttatgtcctacatgaaggagagtgctgtgggagatgtctcccttcagcttgcgaagtcgtaactggaagtccaagaggagattcccagtcttcctggaaaagtgtcgggtctcagtgggcttcacctgagaacccctgcttgataaacgaatgtgtgagggtgaaagaggaagtattcatacagcagagaaatgtgtcatgtcctcagttagaggtgcctgtatgcccctctgggtttcagttatcttgtaaaacatcggcctgttgtccttcatgtagatgtgaacgtatggaagcttgcatgctgaacgggacagtgatagggccagggaaaactgtgatgatcgacgtttgcacaacttgtcgatgcatggtgcaggttggggtcatctcgggattcaaactggaatgtagaaagacaacatgtaacccctgccccttaggatataaagaagaaaacaatactggggaatgctgtggaaggtgtcttcctacagcctgtacaattcagctgaggggaggacaaataatgacactcaaacgcgatgaaacactacaggatgggtgcgatacacacttctgtaaagtaaatgaaaggggggaatatttttgggaaaaaagagtgactggatgtcctcctttcgacgaacacaagtgtctggcagaggggggaaaaattatgaaaatccctggaacttgttgcgacacttgcgaagaacccgagtgtaacgatatcactgcacggcttcagtatgttaaagtagggtcttgtaaatccgaagtggaagtggatatccattattgtcaggggaaatgtgcaagtaaagcaatgtattcaatcgacatcaatgatgtgcaggaccagtgttcctgttgctccccaacaaggacggaacccatgcaggtggctctgcattgcactaacggatccgtggtgtaccacgaagttctgaacgccatggagtgcaaatgtagtccccggaaatgttctaaa

SEQ ID NO: 21385 - DNA, 8439 bp, Artificial Sequence
  Description of Artificial Sequence: Synthetic coding sequence
atgattccagctagatttgcaggtgttttattagctttagctcttattttaccaggaacattatgtgctgaaggaactagaggaagatcaagtacagctagatgttccttattcggttcagactttgtaaatacttttgatggatctatgtattctttcgcagggtattgtagttatttattagcaggtggatgtcaaaaaagaagtttttctataattggggattttcaaaatggtaaaagagtaagtttatcagtatatcttggtgaattctttgacattcatttatttgttaatggaacagtaactcaaggtgatcagcgtgtttcaatgccatatgcatcaaaaggattgtatttagaaactgaagcaggatattataaacttagtggagaagcatatggatttgtagctagaattgatggaagtggaaacttccaagttttactttcagatagatattttaataaaacttgtggactttgtggaaattttaatatttttgctgaggatgatttcatgactcaagaaggaacacttacatctgatccatatgattttgctaatagttgggcattgtcaagtggtgaacaatggtgtgaaagagcatcaccaccatcatcatcatgtaatatttcatctggagaaatgcaaaaaggattatgggaacaatgtcaattacttaaaagtacatcagtttttgcaagatgtcatccacttgttgatccagagccatttgttgctctctgtgaaaaaactttgtgtgaatgtgctggaggacttgaatgtgcatgtccagctcttttagaatatgctagaacatgtgctcaagaaggaatggttttatatggatggactgatcattcagcatgtagtcctgtatgtccagcaggaatggaatatcgacaatgtgtatctccttgtgcaagaacttgtcaatctcttcatattaatgaaatgtgtcaagaaagatgtgttgatggatgttcatgtccagaaggacaacttttagatgaaggattatgtgttgaatcaacagaatgtccatgtgttcatagcggaaaaagatatccaccaggaactagtttaagtcgtgattgtaatacatgtatatgcagaaattcacaatggatttgtagtaatgaagaatgtccaggtgaatgtttggttaccggacaatctcatttcaaatcatttgataatcgttactttactttttcaggaatttgtcaatatcttttagcaagagattgtcaagaccattcattttcaattgttatagaaactgttcaatgtgcagatgatagagatgctgtttgtactaggtcagttacagttagattaccaggacttcataatagccttgttaaacttaaacatggtgcaggtgtggcaatggatggacaagatgttcaacttcctttgcttaagggagatttaagaattcagcatactgtaacagcttcagttagacttagttatggtgaagatttacaaatggattgggatggaagaggaagactacttgttaaattaagtccagtatatgctggaaagacttgtggattatgtggtaattataatggtaatcaaggggacgatttcttaacaccatcaggtttagcagaaccacgagtagaagattttggtaatgcctggaaacttcatggagattgtcaagatttacaaaaacaacactcagacccatgtgctcttaaccctagaatgactcgtttctcagaagaagcttgtgctgtattaactagtccaacttttgaagcttgtcacagagctgtctcaccattaccatatctaagaaattgtagatatgatgtctgtagttgttccgacgggagagagtgtctttgtggagcattagcatcatatgcagctgcttgtgctggaagaggagtccgagtggcctggagagaaccaggaagatgtgaattaaattgccctaaaggacaagtttatcttcagtgtggaactccatgtaatcttacttgtagatctttatcatatccagatgaagaatgtaatgaagcttgtttagaaggttgtttttgtccaccaggattatatatggatgaaagaggagattgtgttccaaaagcacaatgtccatgctattatgatggagaaatttttcaaccagaagatatttttagtgatcatcatactatgtgttattgtgaggatggatttatgcattgtactatgagcggtgttccaggttctcttttaccagatgcagttctttcatctccattatcacatagatctaagcgttctttgagttgtcgtccaccaatggttaaacttgtatgtccagcagataatttaagagcagaaggacttgaatgtactaaaacatgtcaaaactatgatcttgaatgtatgtcaatgggatgtgttagtggatgtttatgtcctccaggaatggttagacatgaaaatagatgtgtagcattagaaagatgtccatgttttcatcaaggaaaggagtatgccccaggagaaacagttaaaattggttgtaatacatgtgtgtgtcaagacagaaaatggaattgtactgatcatgtctgtgatgctacttgttctacaattggaatggctcattatttaacatttgatggactcaaatatttatttccaggtgaatgccaatatgtcttagtacaagactattgtggttcaaatcctggtacattcagaatattagttggtaataaagggtgctctcatcctagtgttaaatgtaaaaaaagagttacaattttagtagagggaggagaaattgaattatttgatggagaggtcaatgttaaacgaccaatgaaagatgaaactcattttgaagtagttgaaagtggacgatatattatattattattgggaaaagctttaagtgttgtatgggatagacatttatcaatttcagttgttctaaaacagacatatcaagaaaaagtatgtggactttgtggaaattttgatggaatccaaaataatgatcttacaagttcaaatttacaagttgaagaagatcctgttgattttggaaatagttggaaagttagtagtcaatgtgctgatacaagaaaagttccacttgattcatcaccagctacatgtcataataatattatgaaacaaacaatggtagattcttcttgtagaattttaacttcagatgtatttcaagattgtaacaaattggtagatccagaaccttatttggatgtatgtatttatgatacatgttcatgtgaaagtattggtgattgtgcatgtttttgtgatacaattgcagcttatgctcatgtttgtgctcaacatggaaaggtagttacatggagaacagcaaccttatgtcctcaaagttgtgaagaaagaaatttaagagaaaatggatatgaatgtgaatggagatataatagttgtgcaccagcatgtcaagtaacttgtcaacatcctgaaccacttgcatgtccagtacaatgtgtggaaggatgtcatgctcattgcccaccaggaaagattttagatgaattgcttcaaacatgtgttgatccagaagattgtcctgtttgtgaggtagctggaagaaggtttgcatctggaaagaaagttactcttaatccttctgatccagaacattgtcaaatttgtcattgtgatgttgttaatttaacatgtgaagcttgtcaagaaccaggaggtttggtagttccaccaactgatgctcctgtatcaccaacaacattatatgtagaagatatttctgaacctccacttcacgacttttattgctcaagattattggatttagtattcttattggatggatcatcaagattaagtgaagctgaatttgaagtactaaaagctttcgtagttgatatgatggaaagacttagaattagtcaaaaatgggtaagagtggctgttgttgaatatcatgatggttctcatgcttatattggattaaaagatagaaaaagaccatcagaacttaggagaattgctagtcaagttaagtatgcaggttcacaagttgcaagcacttcagaagtactcaaatatacactttttcaaattttctctaagattgatagaccagaagcttcaagaattacattacttttaatggcttctcaagaaccacaaagaatgagtagaaattttgttagatacgtgcaaggattaaaaaaaaaaaaagttattgttattccagttggtattggaccacatgctaatttaaaacaaattagacttattgaaaaacaagcaccagaaaataaggcatttgttttaagttctgttgatgaacttgaacaacagcgtgacgaaattgttagttatttgtgtgatttagcaccagaagcaccaccacctacacttccaccagatatggctcaagttacagttggtccaggtttattaggagtttcaactcttggaccaaaaagaaattcaatggtattggacgttgcatttgttcttgaaggttcagataaaattggagaagcagatttcaatcgttcaaaagaatttatggaagaagttattcaaagaatggatgtaggtcaagatagtattcatgttactgttcttcaatactcttacatggttacagttgaatatccattttctgaagctcaatcgaaaggagacatcttacaaagagttagagagataagatatcaagggggaaatagaacaaatactggacttgcacttcgatatctttcagatcattcttttcttgttagtcaaggggatagagaacaagcaccaaatcttgtctatatggttacaggaaatccagcatcagacgaaattaagagattacctggagatattcaagttgtaccaattggagtaggtccaaatgctaatgtacaagagttagagagaattggatggccaaacgctccaattttaattcaagattttgaaactttaccaagagaagctcctgatttagttttacaaagatgttgttctggagaaggattacaaattcctacgttaagtcctgcaccagattgttcacaaccattagatgttattttattgcttgatggatcatcttcttttccagcttcatattttgatgaaatgaaatcttttgctaaagcatttatttctaaagctaacataggaccaagattaactcaagttagtgtacttcaatatggaagtattacaaccatagatgtaccttggaacgtggttcctgaaaaagctcatttgttatctcttgttgatgtaatgcaacgagaaggaggaccatcacaaattggagatgctttgggattcgctgttagatacttaactagtgaaatgcatggtgctcgtccaggagcatcaaaggctgttgtgattttagttaccgatgtttcagttgattcagttgacgcagcagctgatgctgcaagatcaaatagagtaacagtttttccaattggaataggagatcgttatgatgctgcacaattaagaatattagcaggaccagcaggagatagcaatgtagtaaagcttcaaagaattgaagatcttccaactatggtaacattaggaaacagttttttacataaattatgttctggatttgttcgaatttgtatggatgaagatggaaatgaaaaaagaccaggagacgtttggactttaccagatcaatgtcatactgttacttgccaaccagatgggcaaactttacttaagtcacatagagtaaattgcgatagaggattaagacctagttgtccaaattcacaaagtccagttaaagttgaagaaacatgtggatgtagatggacatgcccatgtgtttgtactggttcttcaactcgacatattgttacttttgatggacaaaattttaaattaactggaagttgtagttatgtacttttccaaaataaagaacaagatttagaagttatattacataatggagcttgttcaccaggagcacgtcaaggatgtatgaaatctatagaggttaaacattctgcattatctgttgagttacatagtgacatggaagtaactgttaatggaagattagtttcagtaccatatgttggaggaaatatggaagtaaatgtttatggtgctattatgcatgaagttcgatttaatcatttaggacacatttttacattcacacctcagaacaatgaatttcaattacaactttcaccaaaaacattcgcttctaagacttatggattatgtggtatatgtgatgagaatggtgctaacgattttatgcttagagatggtaccgttactactgattggaaaacacttgttcaagaatggacagttcaaagaccaggtcaaacatgtcaacctattttggaagaacaatgtttagtaccagatagttctcattgtcaagttttgttattaccactttttgcagaatgccataaagttttagcaccagcaactttttacgctatttgtcaacaagattcctgtcatcaagaacaagtatgtgaagtaatcgcatcatatgcacatctttgtagaacaaatggtgtatgtgttgattggagaacaccagatttttgtgctatgtcatgtccaccatcattagtttataatcactgtgaacatggttgcccacgacattgtgatggaaatgtatcaagttgtggagatcatccaagtgaaggatgcttttgtccacctgataaagttatgttagaaggatcgtgcgttccagaggaagcttgtacacaatgtattggagaagatggagttcaacatcaatttttagaagcatgggttccagaccatcaaccatgtcaaatatgtacctgtctttcaggtagaaaggtgaattgtacaactcaaccatgtccaactgctaaggcaccaacttgtggattatgtgaagtagctagattaagacaaaacgctgaccaatgttgtcctgaatatgaatgtgtttgtgatccagtgagttgtgacttaccaccagtacctcattgtgaaagaggattacaaccaacattaacaaatcctggagaatgccgtccaaattttacatgtgcttgtagaaaagaagaatgtaaaagagtgtctccaccatcttgtccacctcatagattaccaactttaagaaaaacacaatgttgtgacgaatatgaatgtgcatgtaattgtgttaacagtacagttagttgcccattaggatatttagcatctacagctactaatgattgtggttgcacaacaactacatgtttaccagataaggtttgtgttcatcgttcaacaatttatccagtaggtcaattttgggaagaaggatgtgacgtatgcacttgtacagatatggaagatgcagttatgggattaagagttgctcaatgttctcaaaaaccttgtgaagattcatgtagaagtggattcacttatgttttgcatgaaggtgaatgttgtggaagatgtttaccatctgcatgtgaagttgttactgggtctccacgaggagattctcaaagttcttggaaatctgttggtagtcaatgggcttcaccagaaaatccatgtcttattaatgaatgtgttagagttaaagaagaagtatttattcaacaaagaaacgtttcatgtccacaattggaagtaccagtttgtccatcaggatttcaattgagctgtaaaaccagtgcttgttgtccatcatgtcgttgtgagagaatggaagcatgtatgttaaatggaactgtgattggtccaggaaagactgtaatgattgatgtgtgtactacatgtagatgtatggttcaagttggagttattagtggatttaaacttgaatgtcgtaaaactacttgtaatccatgtccattaggatataaggaagaaaataatacaggagagtgttgtggaagatgtcttccaacagcatgtacaattcaattaagaggaggacaaattatgacattaaagagagatgaaacattacaagatggttgtgatacacatttctgcaaagtaaatgaaagaggagaatatttttgggaaaagagagtcacaggatgtcctccatttgatgaacataagtgtttagcagaaggaggaaagattatgaaaatcccaggaacttgctgtgatacttgtgaagagccagaatgtaatgatataactgctagattacaatatgttaaggttgggtcatgtaaatcagaagttgaagttgatattcattattgtcaaggtaaatgcgcttcaaaagcaatgtatagtattgacattaatgacgttcaagatcaatgtagttgttgctctccaactagaacagaacctatgcaggtagcattacattgtactaatggttcagttgtatatcatgaagttcttaatgctatggaatgtaagtgttcaccaagaaaatgtagtaaa

SEQ ID NO: 21386 - DNA, 8439 bp, Artificial Sequence
  Description of Artificial Sequence: Synthetic coding sequence
atgattcccgccagattcgccggcgtcttgctggctctggccctgattctgccgggaactctgtgtgctgaaggaaccaggggaaggagctccaccgcccggtgcagtctgttcggaagtgatttcgtgaacacatttgatggctcaatgtatagcttcgcaggatattgctcctatctgctcgccggtgggtgtcagaagcgatccttctcgatcattggcgatttccagaatggcaagcgcgtatccctgagtgtgtatctgggggagttttttgatatacatctcttcgtgaacggaacagtcacccaaggtgaccagagggtgagtatgccatacgctagcaaaggactctatttagagaccgaggccgggtattacaagctgtccggcgaggcttacggtttcgtggccaggatcgatggatctggcaatttccaggtgctccttagtgataggtattttaacaaaacctgcgggctgtgtggaaatttcaatattttcgccgaggatgattttatgacacaggaaggaacactaacgtctgacccttatgacttcgccaatagctgggcattgtcttccggtgagcaatggtgtgagagagcgtctcccccttcatcctcttgcaacatttcatcaggggagatgcagaagggcttatgggagcaatgccagctattgaagagcacttcagtgtttgcccgctgccacccccttgtggacccagaacccttcgtcgccttatgcgaaaaaacactttgtgaatgcgcgggaggactggaatgcgcatgccccgcgttgctcgaatatgccagaacatgcgctcaagagggaatggtgctgtacgggtggaccgatcactccgcctgtagccccgtttgtccagcaggtatggaatacaggcagtgcgtgtcgccctgtgcccgtacctgccaatcactccatatcaacgaaatgtgtcaggaaaggtgtgtagatggatgttcctgtcccgaagggcaactgctggatgagggactttgtgtggaatccacggaatgcccctgcgtacattctggaaagagatacccaccgggaacaagtttatctcgggactgtaatacctgcatctgccgtaactcacaatggatctgctctaatgaagagtgcccaggcgagtgcctagtaactggtcagtctcactttaagagctttgacaatcggtacttcaccttcagcgggatctgccaatatctgctggcgcgagactgccaggatcattcgttcagtatagtgatagaaaccgttcaatgtgcagatgacagagacgctgtgtgtacccgttccgtgaccgttcgcctgcccggccttcataattctctagtgaagttaaagcatggggcaggcgtagccatggacggacaggatgtgcagctcccactcctcaagggcgacctgagaatccagcataccgtgaccgcgagcgtccgtctcagctacggggaggatctgcagatggattgggatggccggggccggttattggtgaaattgagtcccgtatatgcgggcaagacctgcgggctgtgcggtaactacaatggaaatcaaggcgacgatttcctgactccgagtgggctggctgagcccagggtggaggactttggtaatgcctggaaattgcacggagactgccaagaccttcagaagcagcacagtgacccatgcgcactcaacccgaggatgacacgctttagcgaagaagcgtgtgccgtccttaccagtcccacgttcgaggcctgtcacagggccgtatctcctctgccttaccttagaaactgtcggtacgatgtgtgtagctgttctgatggtcgcgagtgcctgtgtggagccttagcctcatacgcggcggcatgtgctggccggggcgtccgcgtagcttggcgagaaccagggcggtgcgagctgaattgccctaagggacaggtgtacctccagtgcggcaccccctgcaacttgacttgcaggagcctgagctatcccgacgaggagtgtaacgaagcgtgtctggagggttgcttctgtcctccgggcctgtatatggacgaacggggcgattgcgtgccaaaggcccagtgtccgtgttattacgatggagaaatctttcaaccggaggatattttttcagaccaccacacaatgtgctactgcgaggatggtttcatgcattgtacaatgagtggagtacccggctctctgctgcccgacgcagtattgtcctcgcctctcagtcacagatctaagaggagcctgagctgtcgaccgcctatggtaaaactggtgtgtcctgctgacaatttgagggccgaaggccttgaatgtaccaagacgtgccagaactatgaccttgaatgcatgtccatgggctgtgtgagtggatgtctctgcccaccaggaatggtgcgccatgagaatcgatgcgtcgcgctggagagatgcccctgctttcaccaggggaaggagtacgcgccaggagaaacagtgaaaatcggctgcaatacatgtgtttgtcaagataggaaatggaattgtaccgatcacgtgtgcgacgcaacttgtagtaccattggaatggcccattatctgacctttgatggcctgaaatacctgttccctggcgagtgtcagtacgtcctcgtgcaggactattgcgggagcaaccctgggaccttccgcatactagtgggtaacaagggatgctcacatccttctgtcaaatgcaagaagagagtaacgatcttggtggaaggcggtgagatcgaactgtttgacggagaagtcaatgtgaagaggcctatgaaggacgagacccactttgaagtcgtcgagtcaggccggtacatcatcttattgctgggcaaggctctgagcgtcgtgtgggaccggcatctgagcatttctgtggtgctcaaacagacataccaggagaaggtatgcggcctgtgcgggaactttgacggtattcagaataatgaccttactagtagcaatctccaggttgaggaagaccccgttgactttgggaactcttggaaagtctcgagccagtgcgccgataccaggaaggttcctctcgacagcagcccagccacttgtcacaataacattatgaaacagacaatggtggattcttcatgcagaatcttaaccagcgatgtgttccaagactgcaataagctagtcgatccagaaccttatttggatgtatgcatctacgacacttgtagctgcgaaagtataggcgattgtgcctgcttctgtgatacaattgctgcgtatgcacatgtgtgcgctcagcatggcaaagtggtcacctggagaactgctaccttatgcccccagtcttgtgaagagaggaaccttcgagaaaatggctatgagtgcgaatggagatataattcttgcgcgccagcttgtcaggtgacgtgccaacaccctgaaccgctggcttgccctgtccaatgcgttgaggggtgccacgctcactgccccccaggcaagattctcgacgagctgttgcagacatgcgtagaccccgaggactgcccagtatgtgaagttgcgggtcgaaggttcgctagcggaaaaaaggtgactctgaacccttcggaccccgagcactgccaaatctgccattgcgatgtagtcaatctaacctgcgaggcctgccaagagcccggaggtttagtagtgccccccaccgatgccccagtttcacccactaccctgtacgtggaggacatttccgagcccccgctgcatgatttttactgttctcggttgcttgatctggtcttcctgctggatggcagttcgaggttgagcgaggccgagttcgaggtgcttaaagcttttgtggttgatatgatggagagactgaggatttctcagaaatgggtgcgggtcgcggtcgtcgaatatcacgatggaagtcacgcctacattggcctcaaggaccggaagaggccttctgagttaagacgaatagctagccaagtgaagtatgcagggtcccaagtggccagtacaagtgaggtgttgaagtatacgctcttccagatctttagcaagatcgatagacctgaggcctcacgtatcacactccttcttatggccagtcaggagccgcaaagaatgtcccgtaattttgtgcggtatgtgcaggggcttaagaaaaagaaagtcatcgtaatacccgtggggattggaccgcacgcgaaccttaagcaaatccgcctcatcgagaagcaggcaccggagaacaaagctttcgtgctcagcagtgtggacgaacttgagcagcagagggacgagatcgtgagctacctgtgtgatctggcaccagaggccccacctcctacgttaccccccgatatggcacaagtgacggtagggccaggacttcttggagtatccacactgggtcctaagcggaattcgatggtcctggatgtggcttttgtcctcgaggggtccgacaaaataggcgaggccgacttcaaccgttccaaggagttcatggaagaggtgatacaaagaatggacgttggccaggactcaatacacgtaacagtgctgcagtattcctatatggtaactgtggaatatccattttcagaggctcagtcaaagggcgacatcttgcagcgagtaagagagatccgatatcagggggggaatcgcaccaacacggggctggcactgcgatatctctctgatcatagctttctggtttcccaaggggatcgggaacaggctccaaatttggtttatatggtaaccggcaatcctgcctccgatgagataaagcggctgcctggagacatccaggtagttcccatcggagtcggccctaacgcaaacgtgcaggaattagagcggatcggttggccgaacgccccgatcttgatccaggatttcgagactctgcctagggaggctccagatctggttctccagcggtgttgtagtggcgaggggctgcagattcctactctctctcccgctccggactgctcccagcctctcgacgttatattgctgctggacgggtcctctagctttcctgccagctatttcgacgaaatgaagagttttgctaaagccttcatctccaaggcaaacatcggccccagattgacccaggtgagcgtcctgcagtacggttcgatcaccaccatcgatgttccgtggaacgttgttcccgagaaggcgcaccttctgtcactagtggacgtcatgcagcgagagggtggtccatcacaaattggcgacgccctaggctttgccgtgaggtatctcacatctgaaatgcacggggcgagaccaggcgcctctaaagcggtggttatcctggtgacggatgtctctgtggacagcgtcgatgctgccgccgatgcagcccggagcaaccgggtcaccgtctttccaatcggtatcggagaccggtatgacgcagctcagctgagaatactggctggcccggctggagactccaacgttgttaaactgcagagaattgaggacttaccaacaatggtgaccttaggcaattcttttttgcacaagctctgcagcgggttcgttagaatctgtatggatgaggatggcaatgaaaagagacccggggacgtgtggaccctgccagaccagtgtcacacagtgacctgtcaacctgatggccagaccctgctgaaatcccacagagtgaattgcgatcgcggattgcgtccgtcctgcccaaacagccagtctccagttaaagtggaggaaacctgtggctgtagatggacctgcccttgtgtgtgtacaggaagtagcacaagacacatcgtgacttttgacgggcagaacttcaaattgacgggttcttgctcatacgtgctttttcagaataaggagcaggatctggaggtgatcctccacaacggagcttgttcaccaggtgcgagacaaggatgtatgaagtccatcgaagtgaagcacagtgccctgtctgtcgaactgcattccgatatggaggtgaccgtgaacgggcgattagtatccgtgccctatgtgggcgggaatatggaggtaaacgtgtatggtgccattatgcatgaagtgaggttcaatcacctggggcatattttcactttcaccccccagaacaacgaatttcaactgcagctttctcctaagacctttgcctccaagacatatggcttgtgcgggatctgtgatgaaaatggcgcgaacgattttatgttgcgggatggcacagttaccaccgactggaaaaccctggttcaggagtggaccgtgcagcgcccaggtcagacttgccaaccgattctggaggaacagtgcctggtgcctgattcctcccattgtcaggtactgctgttgccactgtttgcggagtgccacaaggtcctggcaccagcgaccttctacgcgatctgtcagcaggattcttgccaccaggaacaggtctgcgaggtgatcgcctcatatgcacacctctgtaggaccaacggcgtgtgcgtagattggcggactcccgacttttgcgcaatgtcatgcccaccctctcttgtctataaccactgcgagcatgggtgtccacgccattgcgacgggaatgtgagttcttgcggcgaccatccgagtgaagggtgcttctgcccccctgacaaggtgatgctcgaggggtcctgcgtgccggaggaagcttgcacacagtgtataggagaggatggggtgcaacatcagttcctggaagcctgggtgccagaccatcagccctgtcagatttgcacttgtctgtctggccgcaaagtgaactgtaccacccagccatgcccgaccgcgaaggcaccaacttgcgggctttgcgaggtggcacgcttacgccagaatgctgaccaatgttgcccagagtacgaatgtgtttgcgacccagtgtcctgcgacctgcccccagtacctcactgcgagcggggcctgcagcccaccctgacaaatcctggcgagtgtaggccgaactttacttgcgcatgtcgaaaagaagagtgtaaaagggtctcccccccgagctgtccaccccacagactgccaaccttgcggaaaacacaatgctgtgacgagtacgaatgcgcatgtaactgcgtaaacagcacggtgagttgccctctgggatatctggcctccactgccacaaacgattgcggatgcaccacaaccacttgtcttcctgataaggtctgcgtgcacagatcaacaatttatccagtcgggcagttttgggaagaggggtgcgacgtctgtacatgcaccgacatggaagacgccgtgatgggtctgcgagtggcgcagtgctcacaaaaaccgtgcgaggatagctgccggagtggttttacctatgtgctccatgagggcgaatgctgcgggcggtgtctgccatccgcctgtgaggtcgtcactggctcgcctcggggtgacagtcagagctcctggaaatccgtcggtagtcagtgggccagtcctgaaaacccctgcttgattaacgaatgcgttcgtgtgaaagaagaagtgtttatacagcagcggaatgtgtcttgcccacagttagaagtgcccgtgtgccccagcgggttccagctgtcttgtaagacatctgcctgttgcccgtcttgccgatgtgagcggatggaggcttgtatgctcaatggaactgtgattggtccaggcaaaacagtaatgatcgatgtgtgcacgacatgtcggtgcatggttcaggtgggtgtgatctctgggttcaaacttgaatgcagaaaaactacatgcaatccttgtccgctaggatataaggaggagaataataccggcgagtgttgcggcagatgtctacccaccgcctgtactatccagcttcgcggtggccagatcatgactctgaaaagggacgagaccctgcaggacggatgtgatacccatttttgcaaggtgaatgagagaggagaatacttttgggagaagcgggttaccggttgcccaccatttgacgagcacaaatgtttggccgaaggaggcaagattatgaaaatacctggaacatgttgtgacacatgcgaggagccggaatgtaatgacataacagctagactacagtatgtgaaggtgggaagctgcaagtctgaagttgaagtagatattcactattgccaaggcaagtgcgctagcaaggccatgtactctatcgacatcaacgatgtccaggatcagtgctcttgctgtagcccaacgcggacagagccaatgcaggtagcactgcattgtaccaacggctctgtcgtttatcacgaggtgctcaacgctatggagtgcaaatgctccccacgtaagtgctccaag

SEQ ID NO: 21387 - DNA, 8439 bp, Artificial Sequence
  Description of Artificial Sequence: Synthetic coding sequence
atgattcctgccagatttgccggcgtgctgctggcgctggccctgattctcccaggaacgctgtgtgccgaaggaacacggggtaggtccagtactgcgcgctgtagcctgttcggtagcgactttgtcaataccttcgacggcagcatgtattcctttgccggttactgctcttatctgttggcgggaggatgccaaaagaggtcctttagcatcataggagattttcagaacggcaagagggtctccttgtccgtgtatttgggcgagttcttcgacattcacctgttcgtgaatggaacagtgacacagggggaccagcgggtctcaatgccttacgccagtaagggtctctatcttgaaaccgaagcaggctactataagctctctggggaggcttacggcttcgtcgcgcggatcgacggctccgggaattttcaggtcctgctctctgatcggtatttcaataagacatgcggtctgtgtggcaactttaatattttcgccgaagatgatttcatgacacaggagggtacattgacgagcgatccttatgacttcgccaatagctgggccctgtcctctggcgaacaatggtgtgaaagagcgtccccccccagtagctcctgtaacatctcttccggcgagatgcagaagggtctgtgggagcaatgccaactgctgaagtcaacctctgtgttcgccaggtgccacccccttgtcgaccctgagccgttcgttgcgctctgtgaaaagactctgtgcgagtgtgcaggcggactcgagtgtgcatgtcctgcgctgctggagtatgctaggacttgcgctcaggagggaatggtgctgtacggttggacagatcactctgcttgttctccggtgtgcccagctggtatggaatatagacagtgtgtcagcccgtgcgcccgaacgtgtcagagccttcatataaacgaaatgtgccaggagagatgcgtggatggttgttcatgcccggaaggacagctgctggacgaaggcctctgtgtggagtctaccgagtgcccctgcgtgcactctgggaagcggtacccaccaggcaccagtctgtcccgggattgtaatacctgtatctgtcgaaactcacagtggatttgcagcaatgaggaatgtcccggtgaatgtttggtaactggccagagccatttcaaaagtttcgacaatagatattttacatttagtggcatctgccagtatctcctcgccagggactgtcaggatcactcctttagcattgtcatcgagactgtacagtgtgcggacgaccgcgacgctgtgtgtacccggagtgtgacagtccggctgcccgggcttcataattccctcgtcaaactgaaacacggggcaggcgtagccatggatggtcaggatgtgcaactgccgttgctgaaaggcgatctgaggatccagcacacggtgactgcatcagtcaggctgagctacggggaggaccttcagatggattgggacggccgcggcaggttgctcgtgaagttgtcccccgtctatgctggaaaaacctgcgggctctgtggtaactacaatggcaatcagggggacgacttcttgacaccctctggccttgccgagcccagagttgaggactttggcaacgcgtggaagttgcatggcgactgccaggaccttcaaaagcaacatagcgatccctgtgccctgaatcctcggatgacccgcttcagcgaggaggcttgcgccgttctgacatctcctactttcgaagcctgccaccgggcggtatctcctctgccctaccttcggaattgcagatacgatgtgtgtagttgttcagacggccgagagtgcctgtgcggtgccctggcatcttacgccgctgcatgcgctggcaggggggtcagagtggcctggcgggagcctggtcgatgtgaacttaattgccctaaggggcaagtatatttgcaatgcggaactccttgcaatctgacatgtcgcagtttgtcttatccagatgaggaatgcaacgaggcctgcctcgaggggtgcttctgtccccctgggttgtatatggatgagcggggggattgtgtgcctaaggcccagtgcccatgctactatgacggcgagatcttccagcctgaggacatctttagtgaccaccacacaatgtgttattgtgaggatgggttcatgcattgcactatgagcggtgtgcctgggtccttgctgccagatgccgtgctcagtagccccctctcccacaggtccaagcggagcctctcctgccgccctcccatggtaaaactcgtgtgcccagccgacaacctgcgcgccgagggcttggagtgtacgaaaacttgccaaaactatgacctggagtgtatgtccatgggctgcgttagcggatgcctctgtccacccggcatggtgagacacgaaaaccgctgtgttgcactcgaacgctgtccttgctttcaccaggggaaagaatatgcaccaggggagactgtcaagatcggctgtaatacctgcgtgtgtcaggacaggaaatggaactgtaccgaccatgtctgcgatgccacctgctccacaatcggaatggcccattaccttacctttgacggcctcaagtacctctttcctggggaatgtcagtacgttctggtccaagattattgcggatctaaccccggtaccttccggatcctcgtgggtaataaaggatgctctcaccccagcgtcaaatgtaagaagcgcgtgacgatcctggtggaaggtggcgaaatcgagctgtttgacggcgaagtgaatgtgaaaagacccatgaaagacgaaacacacttcgaggtcgttgagagcggaagatatattatccttttgctgggaaaggctctttctgtggtttgggatcgccacctctccatctccgtggttctgaagcagacctaccaagagaaggtttgtgggctctgtggaaacttcgacggaatccagaataatgaccttacaagcagcaacttgcaggtggaagaggatcccgtcgacttcggtaacagttggaaagtgagctcccagtgtgcggatacccggaaggtgcccctggactcctctcccgcaacatgtcataacaacatcatgaagcaaacaatggtggattcctcttgtcgaatcctgacatctgatgtgtttcaggactgcaataagctggtggacccagagccatatctggacgtctgcatttacgacacctgttcctgtgaatccatcggcgactgcgcttgtttttgcgacacaatcgccgcatacgctcatgtctgcgctcagcatgggaaggtggtcacgtggaggacggccacactctgccctcagagttgtgaggagagaaacctgcgcgagaacggctacgaatgtgaatggcgctataacagctgtgcccccgcttgtcaagtgacctgtcagcaccccgaaccactggcctgccctgttcagtgcgttgaggggtgtcatgctcattgtcccccggggaagatactggacgagctgctccagacatgcgttgatcccgaggattgccctgtctgcgaggtggctgggcggcggttcgcctctgggaaaaaggtcactctgaacccatctgacccggagcactgtcagatttgtcattgcgatgtggtgaacttgacttgcgaggcatgccaggagcccgggggcctggtcgtgccgccaaccgatgctcccgtgagcccaaccactctgtacgtagaagatattagcgaaccccctctgcacgatttctactgcagtcggctcctggatcttgtattcctgctcgacgggagttctcgcttgagcgaagcggagtttgaggtgctgaaggcatttgtggtggatatgatggaaaggctgagaatcagccagaagtgggtccgcgtcgccgtggtggaatatcacgatgggagccatgcttacattggcctgaaagaccgaaagcgcccctctgagctgcgcagaatcgcaagccaggtgaagtacgccggcagtcaggtggcaagcacaagcgaggtgctgaagtacacgctgtttcaaatattttccaagattgatcggcctgaggcctcacgcattaccctgctcctgatggcctcacaggaaccccaaagaatgtcacggaattttgtgagatatgtgcaaggtctcaagaaaaagaaggtgatcgtcattcccgtaggcatcgggccccacgcgaatttgaaacagatccggctgattgagaagcaggcaccagaaaacaaggcctttgttcttagttccgttgacgaattggaacagcagcgagacgaaatagtgtcctatctgtgcgatttggcccctgaggcccctcctcctacgcttccccccgatatggcacaggtcacagtggggcctggactcctcggcgtgtccacactggggccaaagcggaactctatggtcctggacgtcgctttcgtactcgaaggaagcgacaagattggagaggccgacttcaacagatctaaagaattcatggaggaggtgatccagcggatggacgtcggccaagatagtattcatgtcactgtcttgcagtacagctatatggtgacggtggagtacccgttcagtgaggcccagtctaagggggatattctccagagggtccgagagatccggtaccaaggggggaaccggaccaacactgggttggctctgaggtaccttagcgatcattccttcctggtgtcacagggcgacagggagcaggcccccaatctcgtctacatggttactgggaaccccgcaagcgatgagatcaagcggttgcccggagatattcaagtggtaccaattggcgtgggtcccaatgcgaacgtgcaggagttggaacgaatcgggtggcccaatgcccctattcttatccaggatttcgaaactcttccccgggaggcccccgatctcgtgctgcagaggtgttgctctggtgagggattgcagataccgaccttgtccccggctccagattgcagtcagcccttggacgtgatactgttgctggatggctcatcttcctttcctgcaagctattttgacgaaatgaagtcatttgcaaaagccttcatttctaaggcgaatataggaccaaggctgacccaagttagcgtgctccagtacggttcaatcaccacaattgatgtaccttggaatgtggttcccgagaaggcccacctcttgtccttggttgacgtgatgcagcgagagggaggccctagccagattggtgacgccctcggcttcgctgtccgctacctgacgtctgagatgcacggtgcacgaccgggcgcctctaaggcagtggttattctcgtcacggatgtgagtgtggatagtgtggatgcagccgccgatgcggcaagatctaatcgagtgaccgtcttccccatcggtatcggagaccggtacgacgcagctcagctgcgcattctggctggcccagccggtgactctaatgtcgtgaaactccagaggatcgaagacctgcctaccatggtgaccctgggaaactctttcctccacaagctgtgctccggttttgtccggatttgtatggacgaagacggtaatgaaaagagacccggggacgtgtggaccctgccggaccagtgtcacaccgtaacttgtcagccggatggccaaacattgctgaaatcccatcgagtcaactgcgacagagggctcagaccttcctgcccgaactctcagtcacccgttaaggtggaggagacatgtggatgtagatggacctgcccttgcgtttgcactggatctagtacaaggcacattgttaccttcgatgggcaaaattttaaactgacaggatcctgcagctatgtgttgtttcaaaacaaggagcaggaccttgaggtcatcctgcataacggcgcctgttctcccggcgcgcggcagggctgtatgaagagtatcgaggtaaaacactcagccctgtccgtggaactgcattccgacatggaagttactgtcaacggcaggctcgtgtcagtgccctatgtgggcggaaatatggaggtcaatgtctacggcgccatcatgcacgaggtacgcttcaaccatctcggccacatcttcacatttactcctcagaataatgagtttcagctgcagttgagtcccaaaacctttgccagtaaaacctatggtttgtgcggaatctgtgacgagaatggggctaatgactttatgcttagggacggcacagtcacgactgattggaaaactcttgtccaggagtggacagtgcaaaggcctggccagacctgtcagcccatactggaggagcagtgcctcgtgccggattcatcccactgtcaagtgcttctcctgccgctgtttgcagaatgccataaggttctcgcgccggccacattctatgcaatttgtcagcaggatagttgccaccaggagcaggtctgtgaggtgattgcctcatatgcgcatctctgtcggaccaatggcgtctgtgtggattggcgcaccccggacttctgtgcgatgtcatgcccgccctccctcgtgtataatcattgtgagcatggctgcccccggcactgtgacggaaatgtgagctcatgcggcgatcacccaagcgaagggtgtttctgccctccagacaaagtgatgctggaagggagctgtgtcccagaggaggcctgcacgcagtgcatcggcgaagacggcgtacagcaccagtttctggaagcttgggtccctgaccaccaaccttgtcagatctgtacatgtctgtctggtagaaaggtaaattgcacaacccagccttgcccaaccgctaaggcacccacctgtggactctgtgaagtggcccggctccggcagaacgccgaccagtgctgtccagaatatgagtgtgtctgcgaccctgtctcctgcgatctgcccccggtgccccattgtgagaggggtctccagcctacactcactaacccaggggaatgtaggccaaatttcacttgtgcttgccggaaggaggagtgtaagagagtgagccccccttcttgtcccccacaccggctccccacactgcggaagactcaatgctgcgacgagtacgagtgtgcatgcaattgcgtcaatagtacagtgagctgtcctctcggttatctcgcatctacagccacaaacgactgtggatgtacaactacaacctgcctgcctgataaggtgtgcgtgcaccggtctacaatctatcccgtggggcaattttgggaggaagggtgcgacgtatgtacctgtacagacatggaggacgccgtgatgggcctgagagtagcccaatgttcccaaaaaccctgtgaggactcctgtagaagcggctttacctatgtccttcacgagggagaatgttgtggtcgctgtctgccgtccgcgtgtgaagtggtgacaggatctccccgcggggacagccagtctagctggaaaagcgttggcagccagtgggccagccctgaaaatccatgtcttattaatgagtgcgtacgcgtgaaagaggaagtgtttattcagcagagaaatgtttcctgcccgcaactcgaggttcccgtgtgtcctagtggatttcagctgagttgcaaaaccagtgcgtgctgtccatcctgccgatgtgaaagaatggaagcttgcatgctcaatggcactgtcatcggaccggggaagactgtgatgattgacgtctgtacaacttgcagatgtatggtacaagtgggggtcatttctggctttaagctggaatgcaggaaaacgacgtgcaacccctgcccactgggttacaaggaggagaacaataccggtgaatgttgcggtaggtgcctgccaactgcatgcaccattcagttgaggggggggcagattatgactttgaaaagggacgaaactctgcaagacgggtgcgatacccatttttgtaaggtcaatgagcgcggagagtatttctgggaaaagcgcgtgaccggttgtccaccttttgatgaacacaagtgtctcgccgagggtggtaagatcatgaaaattcctggaacatgttgtgacacatgcgaggaaccagagtgcaacgacattaccgcacgattgcagtacgtgaaggttggatcatgcaagagcgaggtcgaagttgacatccactattgtcaaggtaaatgtgcatctaaggccatgtacagtatcgatatcaacgatgtgcaagaccaatgctcatgttgctctccgaccagaacagagccaatgcaagtggctttgcactgtacgaacgggtctgtggtgtatcacgaagtgctgaacgctatggaatgcaagtgttccccaagaaaatgttctaaa

SEQ ID NO: 21388 - DNA, 8439 bp, Artificial Sequence
  Description of Artificial Sequence: Synthetic coding sequence
atgatccccgccagattcgcgggagtactgctcgctctggcacttattttacccgggacactctgcgcagaagggactagagggcggtcttccactgctaggtgctccctctttgggagtgatttcgtgaatactttcgatggatccatgtatagtttcgctgggtactgctcctacctacttgcaggaggatgccagaaacggagtttttccatcattggggacttccagaacggaaagagagtgagtttatcagtgtacttaggagaatttttcgatatacacctcttcgtgaatggaacagttacacagggagatcagcgggtaagtatgccatacgcctcaaagggactttatttggaaactgaagcaggatactataaattatctggggaggcctatgggtttgtggcaaggatcgacgggtcagggaactttcaggtccttctctccgatcggtacttcaataaaacttgcggactatgtgggaatttcaacatattcgccgaagatgactttatgactcaagaggggactctaacttccgatccttacgattttgcaaatagttgggccctctcgagtggggaacagtggtgcgagcgcgcctctccaccctcgtcctcatgcaatatttcaagtggggaaatgcaaaaaggactctgggaacagtgccagctcctcaaatccacgtctgtatttgctaggtgtcaccctttagtcgatcccgaaccattcgtcgcattgtgcgaaaaaacactttgtgaatgtgccggaggactcgaatgcgcctgtcctgcacttttggaatatgccagaacatgtgcccaggaagggatggtgctctacgggtggactgatcattccgcatgttcgccagtgtgtcccgcggggatggagtatcgacagtgcgtttcaccttgcgctagaacttgccagtctctgcacattaacgaaatgtgccaggagcgctgcgtggatgggtgttcttgccctgaagggcagctgctggacgaagggctctgcgtcgagtccacagagtgtccatgtgtgcactcaggaaaacgatatccccctggaacatccctgtctcgggattgtaacacatgtatctgtcgaaattcacagtggatctgtagtaatgaagaatgcccaggagaatgtttggtgacagggcagtcccactttaagagtttcgataatagatactttacattcagtggaatctgccagtatttactcgccagggactgccaagatcattctttttctatagtgattgaaactgtacagtgtgctgacgatcgggatgctgtttgtactagaagtgtgacagtaagactaccagggttgcacaacagtctggtgaaactgaagcatggggccggagtggccatggatgggcaggatgtgcagttaccacttctaaaaggagatcttaggatacagcatacagttacagcttccgttaggctctcttatggggaggatctccagatggattgggatgggcggggacgccttttagtgaaactaagtccagtgtatgcagggaagacatgtggactctgcggaaattataacgggaatcagggggatgattttctcacacctagtgggctggccgaaccacgggtggaagatttcggaaacgcttggaaactgcacggggactgccaggaccttcagaaacagcattctgatccctgcgctctcaacccaaggatgactaggttttctgaggaagcttgtgctgtgctcactagtcctacattcgaagcctgtcatagagccgtttcaccactcccttatctcagaaactgtcggtacgatgtttgcagttgctcagatgggcgggagtgtctctgcggggctctggcctcttatgccgctgcctgtgctggacggggagttagggttgcatggagggagcctggacggtgtgaactaaattgccccaaagggcaggtctacttacaatgcgggactccctgtaatctgacatgcagatcactcagttatcctgatgaggaatgtaacgaggcttgcctggaagggtgtttttgccctcctgggttatacatggatgagcggggggactgtgtgcccaaagcccagtgcccctgttattatgatggggaaatcttccagcccgaagatatattttccgatcaccacactatgtgctactgcgaagatgggtttatgcattgtacaatgtctggggtgcccgggtctctccttcccgatgctgtactatcttctcccctgtctcatcgctccaaaagatcactttcctgtaggcccccgatggtaaaactagtctgccctgctgataacctcagagccgaaggactcgaatgcactaaaacatgtcagaactatgatctcgagtgtatgtccatggggtgtgtgtccgggtgtctttgtccacctgggatggtgcggcacgaaaatagatgtgttgcacttgaaagatgtccatgttttcatcaggggaaagagtacgcccctggagaaacagtcaaaataggatgtaatacatgcgtgtgccaggatcgcaaatggaactgcacagatcatgtgtgtgatgctacatgctctacaatcggaatggctcattatctgacatttgatggactcaaatatctcttccccggagaatgtcagtatgtgctagtccaggattactgtgggagtaatccaggaacttttcgtatccttgtggggaataaagggtgctcacacccctctgtgaaatgcaaaaaacgggtgacaatcctggtagaaggaggagaaatcgaacttttcgatggagaagtgaatgttaaaaggcccatgaaggatgaaacacacttcgaagtggttgaatccggaagatacatcatcctgcttctcgggaaggctctctctgtggtatgggatagacacctctcgatttccgtggttcttaagcagacttatcaggaaaaagtctgtgggctctgtggaaattttgacggaatccagaacaacgaccttacaagttcaaatctgcaggtggaagaagatcctgttgatttcgggaattcctggaaggtgtcttcccagtgtgctgacactagaaaagtacctctcgattcatcccccgccacttgtcacaataatattatgaaacagactatggtagattccagttgcaggatcctcacttccgatgtttttcaggattgtaacaaactagttgatcccgaaccatatcttgatgtatgtatttatgatacttgttcatgcgaatccattggggactgtgcttgcttctgtgatactatcgcagcatacgcccacgtctgcgcccagcacgggaaagtcgtgacttggagaacagcgactttatgtcctcagtcatgcgaagaaagaaacttacgagaaaatggatatgaatgcgagtggcgatataattcctgtgctcctgcctgccaggttacgtgccagcatcccgaaccactcgcgtgtcctgttcagtgtgtggaagggtgccatgcccactgtcctcccgggaaaattcttgatgaactactccagacttgtgtcgatcccgaagattgcccagtatgtgaagttgccgggcgacgctttgcatctgggaaaaaagtaactcttaatccatccgatcctgaacattgccagatctgccattgtgatgtggtgaatcttacatgcgaggcttgtcaggagcctggaggactggtagtcccccctactgatgcgcctgtctctccaacaacgctatatgtcgaggatatatcagaaccccccctgcacgatttttattgctcaagactcctagaccttgtattcctcctcgatgggtcatctcgactaagtgaagccgagttcgaagtgttgaaggccttcgtggtcgacatgatggaacgcctaaggatatcacagaaatgggtgagggttgctgtcgtcgaataccatgatggatctcatgcatatatagggcttaaagaccggaaaagaccctctgaacttaggcgaatagcgagtcaggtgaaatatgctggatctcaggttgcctcaacttccgaagtgctaaaatatactctctttcagatattctctaaaatagatcggccagaggctagtagaataacacttttgctgatggcgtcccaagaaccccaacgaatgtccagaaattttgtgaggtacgtgcaggggttaaagaaaaaaaaagtaattgtcatccctgttggaattggacctcacgcaaatttaaaacagatccggcttattgaaaagcaggcccccgagaacaaagcctttgtactctcctcagtcgatgagctagaacagcagcgcgatgaaatcgtgtcatatctgtgtgatctagcacccgaagccccccctcccacattacctccagacatggctcaggtgactgtggggccggggcttttaggagtttctactcttggacccaaaaggaactctatggtgctagatgtggcatttgtacttgaaggaagtgataaaattggggaagctgacttcaatagatcgaaggaatttatggaagaggtgatacagcgcatggatgtggggcaggactcgatccatgtgactgtgctacagtattcttatatggttactgtagaatatcccttttctgaagctcagtctaaaggggatattcttcagcgagtcagagagataagataccagggggggaatcggacaaacacagggctcgcacttcggtacctgtccgatcattcattcctggtatctcagggagatcgcgaacaggcccctaacctggtgtatatggtgactgggaacccagcttcggatgaaattaaacggcttcctggagatatccaggtcgttcctataggagtagggcctaacgctaatgtgcaggaactggaacggataggatggcccaatgccccaatcttaatacaggatttcgaaactctcccccgggaggcaccagatctggtactacagcgatgctgttcaggagaagggctccagattccaacactctcccccgccccagattgcagtcagcccctagatgtgatactacttctcgatgggtcttccagtttccctgcctcttatttcgatgaaatgaaatcctttgcaaaggcctttatatctaaggccaacatcgggccacggctaactcaggtgtccgtgctccagtatgggtcaattacaacaatcgacgtgccctggaacgttgtgccagagaaagcacacctcctcagtctcgttgatgtgatgcagagagaaggagggcctagtcagatcggagatgctctcggatttgcagtacgctatttgacttcagaaatgcacggagctcggcccggggccagtaaggctgtggtgattcttgtaacagatgtgtcagtggattcagttgatgcagccgctgacgccgctaggagtaacagggtaacagtatttccaatcggaataggagataggtatgatgctgcacaactccggatccttgctggaccagctggggattcaaatgtggttaagttacagagaatagaagatcttcctacaatggtaacattagggaattcttttctacataagctgtgttccgggttcgtgcgcatatgcatggatgaggatggaaacgagaaaagacctggggatgtatggacactcccagatcagtgtcatactgtaacttgtcagcccgatggacagacacttctaaaatctcacagagtgaactgcgataggggactcaggcccagttgtcccaactcacaatcaccagtaaaggtagaagaaacttgtgggtgtagatggacttgcccttgtgtctgtactggatcatccacacggcacatagtcacattcgacggacagaatttcaaactgactggatcgtgtagttacgttttatttcagaacaaggaacaggacctcgaggtgatcctgcataatggggcctgctctccaggagcgagacagggatgcatgaaaagtatcgaagtaaaacatagtgcactgagtgtagagcttcactcagacatggaggtgactgtgaatggacgcctcgtgagtgtgccttatgtcggagggaacatggaggttaacgtgtatggggccataatgcacgaagtccgcttcaatcatctgggacatatctttacatttacaccccagaacaatgaatttcagctccagctctcccccaaaactttcgctagtaaaacatatggactgtgcgggatttgcgatgaaaatggagcaaatgattttatgcttagagatgggactgtaacaactgactggaaaactttggttcaggaatggactgttcagcggcccgggcagacatgccagcctatccttgaagagcagtgtctcgttcctgacagtagtcactgccaggtgctactcctccccctgttcgccgaatgtcacaaagtcttagctccagccactttttatgcaatctgtcaacaggattcttgccatcaggaacaggtgtgcgaggttatcgcctcttacgcacacctctgccgcactaatggagtttgtgtggattggagaacacctgatttctgcgcgatgtcctgtcccccttcactcgtgtataatcactgtgaacatgggtgtcctagacactgtgacggaaatgtttcctcctgtggagaccatccatcggagggatgcttttgtccgcctgataaagtcatgctcgaagggtcatgcgttcctgaagaagcatgcactcagtgcataggagaagatggggttcagcatcagtttcttgaggcctgggttcccgaccaccagccttgtcaaatctgtacttgtctatccggaagaaaggtgaattgcactacacagccttgtcctacagccaaagcccccacatgcggactctgtgaggtggccagattgagacagaacgctgatcagtgctgccccgaatatgaatgtgtttgcgatccagtttcttgtgaccttccacccgtgcctcattgtgaacggggactacagcctacactcacaaacccaggggagtgcaggcccaatttcacatgtgcctgcaggaaagaagaatgtaagcgggtgagtccaccctcatgtcccccacacagactccccacactacgcaaaacacagtgctgtgatgaatatgaatgcgcgtgtaactgcgttaactccacagtgagttgccccctggggtatctcgcttccactgcaacaaatgactgtgggtgtactactactacatgtctgcctgataaagtgtgtgtccaccggtccactatatatcctgttggacagttttgggaagaagggtgcgacgtttgtacatgcacagatatggaagacgccgtgatggggctgcgggtggcacagtgtagtcagaaaccctgtgaagattcctgcaggtccggattcacttacgtcttacacgaaggggaatgctgtggacggtgcctcccctctgcctgcgaggtggtcacagggagtccccggggagatagtcagtcttcctggaaaagtgtggggtctcaatgggcctcccctgaaaatccctgtctaattaatgaatgtgtacgagtcaaagaagaagtttttatccagcagcggaatgtttcctgccctcagcttgaagtgcctgtgtgcccctccggattccagctgtcttgtaagacgtctgcttgctgtcccagttgcagatgcgaaaggatggaggcgtgtatgcttaacggaacagttatcggacctgggaaaacagtaatgattgatgtgtgcacaacatgccggtgtatggtgcaagtgggagtgattagtggattcaaattagaatgtcgaaaaactacatgcaatccttgtccactcgggtataaagaagagaacaatactggagaatgttgtggacgctgtcttcccacagcttgtacaatccagctgcgcggggggcagattatgactctgaaacgcgatgaaacactacaggatgggtgcgatactcacttttgtaaggtgaacgaacggggagagtatttttgggaaaaacgagtcactgggtgccccccattcgatgaacataaatgtctcgccgaaggaggaaaaattatgaagataccagggacttgctgtgatacttgcgaggaacccgaatgcaatgatataacagctagattacagtatgtgaaagtgggatcttgtaaatctgaggtcgaagtcgatatacactattgccaggggaagtgtgcctctaaagcgatgtattccatagatatcaacgatgtccaagatcagtgtagttgttgcagtcctacaaggactgaacccatgcaggtggccttacattgtacaaacgggtccgtggtgtatcatgaagtgttaaatgcaatggaatgcaaatgctctcctaggaagtgttccaaa

SEQ ID NO: 21389 - DNA, 8439 bp, Artificial Sequence
  Description of Artificial Sequence: Synthetic coding sequence
atgatacccgcaaggtttgctggggtactattggctctcgctctgattctgccaggtaccttgtgcgccgaagggacacgaggcaggtccagcacagctagatgctctctttttggcagcgatttcgttaatacttttgacgggtctatgtattcattcgccggctattgtagctatctgctggccggaggttgtcagaaaagaagcttctcgatcatcggagacttccagaacggaaagagagtctctttgtccgtgtacctaggcgaattttttgatatccacttattcgtgaacggaaccgtgacccagggtgatcagagggtgtcaatgccctatgcctctaagggtctatatctcgagaccgaagctggatactacaagctaagtggggaagcctacggattcgtggcaaggatcgatggaagcgggaatttccaggtgctcttatccgatcgttattttaataagacctgtggcctgtgcggaaacttcaatatatttgccgaggatgattttatgacccaagaaggtactttgacatcggacccatatgacttcgccaattcatgggctctgtcttcgggagaacagtggtgtgagagagcctcccctcccagctcctcctgcaatatctcatccggcgagatgcagaaaggactgtgggaacagtgtcagctgttgaagagcacatcggtctttgcccgttgccaccccctggtagacccagaaccctttgtggccctttgcgaaaagacactgtgcgaatgtgctggtggactggagtgcgcttgcccagccttgcttgagtacgcccgcacctgtgctcaagaaggcatggttttatatgggtggaccgaccactccgcctgttcgccagtctgtccagctggcatggagtacagacaatgcgtgagcccttgcgctaggacatgtcagtctcttcatatcaatgagatgtgccaggagaggtgtgtagacggatgcagttgccccgagggacagctgttggatgaaggcctgtgtgtcgaaagtaccgagtgcccctgtgtccactcaggcaaaaggtatccacccggtacatccctgtcgcgagactgcaatacttgcatctgccgtaatagccaatggatttgttccaatgaagagtgtccaggcgagtgtctggtgacaggccagtcccactttaagtcatttgacaacagatacttcacctttagcggaatttgccagtacctcctggcccgagactgccaagaccatagcttcagtatcgtgatagaaaccgtgcagtgcgctgacgaccgagacgcggtgtgcactagatccgtgacggtcaggctgcccgggcttcataatagcctggtgaaactgaaacatggcgcaggagtggcaatggatgggcaggacgttcaactgccactgcttaaaggcgacctgagaatccagcacactgtcactgcatcagtccgactgtcttacggtgaagacctgcagatggattgggatggtagaggcaggctactggttaagttaagcccagtatacgccggcaaaacctgcggactctgtggcaattataatggtaaccagggtgatgattttctgacaccgagtggcctcgccgaacctagggtcgaggacttcggcaacgcgtggaagctgcacggagactgtcaggatttgcagaagcagcatagtgatccgtgcgccctgaatcctagaatgacgaggttcagcgaagaagcatgtgcagtgctgacaagtccaacatttgaagcgtgtcaccgcgctgtgtccccactgccctatctgaggaattgtaggtatgacgtgtgctcttgctcggatgggcgagaatgcctgtgcggggctctggctagttacgctgccgcctgtgcaggtcgaggcgtccgggtggcttggagagaacctgggcgttgcgaattgaactgtcctaaaggtcaggtttaccttcagtgcggcacaccatgcaacttgacctgtcgttccctcagctaccctgacgaggaatgcaatgaggcctgcctggagggatgcttctgtccccctggcctttatatggatgagcgaggcgattgcgtcccaaaggcccagtgtccctgctactatgacggcgaaatatttcagcctgaggacatattctcagaccaccatactatgtgttactgtgaagatggattcatgcactgtaccatgtcaggcgtgcccggcagcctgttgcccgacgctgtcttgtctagccctctttctcatcgaagcaagaggtccctctcatgccgtccccccatggtgaaactcgtatgccctgcggataatcttcgggcagagggattagaatgcacaaagacttgtcagaactacgatttagaatgcatgagtatggggtgtgtctccggctgcctttgtcctcccggtatggtgcggcacgaaaaccgatgtgttgccctggaaaggtgcccttgtttccaccaggggaaagagtacgctcctggagagacagtgaagattggatgcaatacgtgcgtgtgtcaggatagaaagtggaattgtacagatcatgtgtgcgatgccacttgtagtactataggcatggcacattacctgaccttcgatggccttaagtatctattccctggcgaatgccagtatgtgctggtgcaagattattgtggctccaatcctggaacgttccgaattttggtcggaaacaaaggttgcagccatcctagtgtaaagtgcaagaaaagagtaaccatccttgttgagggcggagaaattgagcttttcgatggagaggtaaacgtgaagagaccaatgaaagatgagactcactttgaagtggtcgagtctggtagatatattatccttctgcttggtaaggcactgtctgtggtgtgggatcgccatctgagtatttccgtagtactcaagcagacctaccaggaaaaggtctgtggtttatgtgggaattttgatggaattcaaaacaacgacctgactagctccaacctgcaggtcgaagaggaccccgtggatttcgggaactcatggaaggtcagctcccagtgtgcggacacccgaaaggtacctctggattccagccctgcaacttgccataataatattatgaagcagactatggtggactcatcctgccgaattctcaccagtgacgtgttccaggattgcaacaagttggtggaccccgagccatacctggatgtgtgtatttacgacacatgctcctgtgagtccattggcgactgtgcatgtttttgtgatacgatagccgcctacgcccacgtgtgcgctcagcacggtaaagtggtgacttggaggacagcaaccctgtgccctcaaagctgcgaagagagaaatctcagggaaaacgggtatgagtgcgagtggcgatataacagttgcgcccccgcgtgccaggtgacatgtcaacacccagaacctttggcttgtcctgtgcagtgtgtagaaggctgtcatgctcactgtccacccggcaagatattggacgaacttctgcagacttgtgtcgaccctgaagactgcccagtttgtgaggttgccgggaggcgttttgctagtggaaaaaaggtcactctaaatccttctgatcccgagcactgccagatttgtcactgtgacgtggtgaatctgacatgtgaggcctgtcaagaacccggtggcctggtggtgccccctactgacgcccccgtaagccccactacattgtatgtcgaagacatcagcgagcctccactccatgatttctactgtagccgtctgctagatttggtttttctgttggacggttccagcaggttaagtgaggccgagttcgaagtgttgaaagccttcgttgttgacatgatggaaagactccggatcagccagaaatgggtgagagtggccgtcgtcgagtaccacgacggttcccacgcgtatatcgggctgaaggacaggaaaaggccgtctgaactgagaaggatcgcttctcaggtcaagtatgctgggagccaggtagcctccacctctgaggtgcttaagtataccctgttccagattttttcaaaaatagataggccagaagcatcacggattaccctccttctgatggccagtcaggagccccagaggatgagcagaaacttcgtaaggtacgtgcaaggcctgaaaaaaaagaaggttatcgtcatccctgtgggaatcggaccacacgcaaatttgaaacaaatacgactgatcgagaagcaggccccagaaaataaggccttcgtgctttccagcgttgatgagctggagcagcagcgcgatgagatagtctcttacctctgtgatctcgctccagaagccccaccccctacccttccaccagacatggctcaggttacagtgggtccaggtttactgggcgtctcaacccttgggcccaagcgcaactcaatggtcttggatgtggccttcgtgctcgaagggtccgacaagataggggaagccgacttcaataggtcgaaggagttcatggaggaggtgatccagcgaatggacgtcggccaagattccatccatgtgacagtcctgcaatattcatatatggttacagtggagtaccctttcagcgaggcccagtccaagggcgacatactgcaaagggtgcgtgagattcgctaccaaggggggaatcgtaccaataccggattagccttgcgatacctgtcagaccactcatttttggtctcccaaggcgacagggagcaggcgcccaatcttgtttatatggtcaccgggaaccctgcctccgacgagatcaagcgattgcccggcgatatccaggtggtcccaattggagtaggacccaacgcaaacgtccaggagctggaaagaataggctggcccaatgctcccattctcatacaagattttgagaccctccctagggaagcacctgaccttgtgttgcagcggtgttgttcgggcgagggacttcagattcccaccctgtcacctgccccagactgcagccagccactcgacgttatcctgctgcttgacggttcttcctctttccccgcctcctacttcgatgaaatgaagagctttgcgaaagcctttatttcgaaggcaaacatcggacccaggttaacacaggtgtctgtacttcagtatggctctataacgacgatcgatgtgccgtggaacgtcgttcccgagaaagcacatctgctaagtttggtggacgtgatgcagagagagggaggaccatcccagatcggtgatgccctgggctttgccgtccgatacttgacctcggaaatgcacggcgcacgaccaggcgcgtctaaggcagtggtgatcttggtgaccgacgtgtctgtggactctgtggacgccgctgcggatgcagccaggtccaaccgagtaaccgtctttcccatcgggattggcgaccggtacgacgcagctcagctgagaatactggcaggccctgcaggagacagcaacgtggtcaagctgcaacgaattgaagatcttcccacaatggttaccttaggtaattcgttcctgcacaagttgtgctcaggattcgtaagaatttgcatggacgaagatggcaatgaaaaaagacctggcgatgtctggactttacctgatcagtgtcacaccgtaacctgccagcctgacggtcagaccttactaaaaagccatcgtgtcaactgcgacaggggtctgagacccagttgtcctaattcacagtcccctgtgaaagttgaggagacttgcggatgccgatggacatgtccctgcgtttgcactggctccagtaccaggcatatcgtgacattcgatggccaaaatttcaagcttactggctcttgttcatacgtgctttttcagaacaaggaacaagatctcgaagtcatcctgcacaatggcgcttgcagtcccggcgcccgacagggatgcatgaagagcattgaggttaagcacagcgccctgtctgtggagctccattctgatatggaggtaaccgtcaacggtagactggtgtccgtgccttatgtcggcggtaacatggaggttaatgtgtatggggccataatgcacgaggtgagatttaatcacttggggcatatctttactttcaccccccagaataatgagttccaacttcagctttcccccaagacgtttgccagtaagacttacggcctatgcggtatatgcgacgagaacggcgccaacgattttatgctcagggacggcactgtcaccaccgattggaaaaccctggtgcaagagtggactgtgcagcgacccggacagacctgtcagccaatcctcgaagaacaatgtctggtgcccgattccagccattgccaggtgctgctgctgcccctgttcgccgagtgccacaaagtcctggccccggccacgttctacgctatttgtcagcaagatagctgccatcaggaacaggtctgcgaggtgattgcatcatatgcccacttatgtagaacaaatggcgtgtgcgtcgactggcggaccccggatttttgcgctatgtcttgtccccccagtctggtgtataaccattgtgaacatggctgtcccaggcactgtgacgggaacgtgtcttcatgcggtgatcacccaagcgagggttgcttctgccctcctgataaggtgatgctcgaaggttcgtgcgtgcctgaagaagcctgcactcaatgcattggagaagatggggtccaacaccagttcctggaggcttgggtgcccgaccaccagccatgccaaatctgtacttgcctaagcgggaggaaggtgaattgcaccacccagccctgtccgacagcgaaagcgcctacttgtggactgtgtgaagtggctcgactgagacaaaatgcggaccagtgttgtcccgagtatgaatgcgtgtgcgatcctgtgtcttgcgatctcccccctgtcccacactgtgagcgcgggctgcagccaactctgacgaatcccggagaatgtaggcccaactttacttgtgcctgtagaaaggaagaatgcaaaagggtgagccctcccagctgcccaccacaccggttgcccacccttcgaaagactcagtgctgtgacgaatatgagtgcgcatgcaattgcgtaaacagcacggtcagctgccccttaggatacctcgctagcacagcaacaaacgactgtggctgtaccacgactacttgtctccctgataaagtctgcgtgcaccgcagcacaatttatccggtgggccaattctgggaggaagggtgcgacgtttgcacttgtactgatatggaggacgctgtcatgggcctgcgagtggcacagtgttcacagaaaccttgcgaggattcttgccgatccggcttcacgtatgtgctgcacgaaggcgaatgttgcggtcgatgtctgccatcggcctgtgaagtcgtcactggaagcccacggggggacagccagagttcatggaagagcgtaggaagccagtgggcctcccccgaaaacccatgtctaattaatgaatgtgtgagggtgaaagaagaggtgtttatccagcaacgaaacgtgagctgtccacagttggaagtgccagtctgcccatcaggcttccaactgtcttgcaaaacatctgcctgctgcccaagctgtagatgcgagcgaatggaggcttgtatgctgaatgggaccgtgatcggaccaggaaaaactgtaatgatagacgtgtgtactacatgtagatgtatggtgcaggtgggagtcatcagcggattcaagctagaatgtagaaaaacaacttgtaatccctgcccactgggctacaaagaagagaacaatacaggcgaatgttgcggtcgctgcctccctacagcctgcacaatccagctacggggtggccagatcatgactctgaagagggatgagactttgcaagatggttgcgacacccacttctgcaaggtcaatgaaagaggtgagtacttctgggagaagagggttaccggctgccctccctttgatgaacataagtgtctggctgagggaggtaaaattatgaagattcccggcacctgttgcgatacttgtgaagagcctgagtgtaacgatatcaccgcacgattacagtacgtaaaggtcggcagctgtaaatccgaagtggaggtggacatccattactgccagggaaaatgtgcgtcaaaggcgatgtatagtatcgatataaacgatgtgcaggaccagtgttcctgttgcagcccaacccgaactgaaccaatgcaggtagcattacattgcacaaacgggagcgtggtgtatcacgaagtgctgaacgctatggagtgcaaatgctcccctagaaaatgttctaag

SEQ ID NO: 21390 - DNA, 8439 bp, Artificial Sequence
  Description of Artificial Sequence: Synthetic coding sequence
atgataccagcccggttcgccggcgtccttctggcactcgccctgatcctaccgggaacactgtgcgccgagggcacgcggggccgttctagcacagctcggtgcagcttatttggaagtgacttcgtgaacactttcgacgggtccatgtacagctttgccggttactgtagttacttactggcgggaggctgccagaagcggtccttcagtataatcggggacttccagaatgggaaacgggtgagcttgtcagtctatctgggagagtttttcgacatccatcttttcgtgaacggcacagtgacccagggggaccagagggtttcaatgccttacgcctcaaaaggcctgtacttagagacagaggctggatattataaattgtccggcgaggcttatgggttcgtggcgcgtatagatgggagtggaaatttccaggttctcctaagtgacaggtacttcaataagacttgcggcctgtgtgggaactttaacatctttgctgaagatgatttcatgactcaagagggtacgctcacatctgacccctatgacttcgcgaattcatgggcgctaagttctggggaacagtggtgtgaaagggcaagcccaccctcttccagctgcaatatctcatctggagagatgcagaagggcctttgggagcagtgccagctcctcaagtccaccagtgtctttgctagatgccacccccttgtggatcctgaacccttcgtcgctctgtgtgagaagacgctgtgcgagtgtgccggtggcttggaatgtgcctgtcctgctctgctcgagtatgccagaacctgtgctcaggagggaatggtgctttatgggtggactgaccactcagcatgctccccggtgtgtcccgccggaatggagtatcgccagtgtgtctcaccgtgtgctcggacctgtcagtctctacacataaacgaaatgtgccaggagcgctgtgttgatggctgcagctgtcccgagggacagctactggatgaaggactttgcgtcgagagcaccgagtgtccttgtgtccactctggaaagcggtatccccccggtacctccctgagtcgggactgtaatacctgtatctgtcgtaacagccagtggatatgttcgaacgaagagtgccccggcgagtgtctggtgacaggccagtcccattttaagagcttcgataatcggtacttcactttctctggaatctgccagtacctgctcgcccgggactgccaagaccattccttcagtattgtaatagagacggtgcagtgtgctgacgatagagacgctgtgtgcactaggagcgtcacagtgcgactaccaggacttcataattctctggtcaagctcaagcatggggccggagtcgcaatggatgggcaggatgtgcagctccctctgttgaaaggagatctcaggattcagcacaccgtaacggcttctgtccgtctgagttacggcgaggatttacagatggactgggatgggagggggcggttactggtgaagctgtcgcccgtctatgccggaaaaacatgtggtctttgcggtaactataacggaaatcagggtgacgatttcctgactccaagcggcttagccgaaccccgagtggaggatttcggcaacgcttggaaattgcatggggattgccaagacctccaaaaacagcactcggacccatgcgctctcaatcccagaatgacccgattctccgaagaagcctgtgctgtattgacatcacctaccttcgaggcatgtcatcgagcagtgtctccgcttccctatctgagaaactgtcggtacgatgtatgcagttgttctgatggacgtgagtgcttgtgtggagcgctggcctcatacgcggccgcctgcgctggacgcggagtgcgcgtggcttggagagagcccggccggtgcgaacttaattgcccaaagggccaggtgtatctccagtgcgggacgccctgtaaccttacgtgtaggagtctgtcttatcctgatgaagagtgtaacgaagcttgtttggagggctgtttttgtcctcccggcctgtatatggacgaaagaggcgactgtgttcccaaagcccagtgtccatgctactatgatggtgagatctttcagcccgaagacattttttcagaccatcacacaatgtgctattgtgaagatggcttcatgcactgcactatgtctggcgtcccaggatctctgctccctgacgccgtgctctcttctccactgagccaccggagtaagcggtccctgtcttgtcggccgcctatggtgaagctcgtgtgtcccgccgataacctgcgcgcagaggggctggaatgcactaagacttgccaaaattatgacctggagtgtatgtcaatggggtgtgttagcggatgcctatgcccccctgggatggtcagacatgaaaacagatgtgtggcccttgagagatgcccctgcttccatcaggggaaagaatatgctcctggtgagacagtgaagatcggctgtaacacgtgtgtgtgccaggaccggaaatggaattgcacggaccacgtttgtgacgcgacttgctctacaatcgggatggctcactatttgacatttgacgggttgaagtacctgtttcccggggagtgccaatatgtgttagtacaggattactgtgggtctaatcctggtactttcagaattctcgttggaaacaagggatgcagccatccttctgtcaaatgcaagaagcgtgtgactatcctagtggagggaggagagattgaacttttcgatggcgaggtcaacgtcaagcggcccatgaaggatgagacccacttcgaggtcgtagagtcagggaggtacatcattctgctcctcggcaaagcactgagcgtggtgtgggatcgccatctctctattagcgttgtgctcaagcagacttatcaggagaaagtgtgcgggctgtgtggaaattttgacgggatccagaataacgacctgactagcagcaatctccaggtagaagaagatccggtcgatttcggtaatagctggaaggtgtcatcacaatgtgccgatacaagaaaggttccactcgactcttcccccgctacctgccataataatatcatgaaacaaactatggtggatagtagctgccgcattcttacatcagatgtttttcaggattgcaacaagttggtggaccctgaaccatatctcgatgtgtgtatttacgatacatgctcatgcgagagcataggcgattgtgcttgtttttgtgacaccatagccgcctacgcacatgtgtgcgcacagcacggaaaggttgttacctggcgcacagcaaccctttgtccgcagtcgtgcgaagagcggaatttacgggaaaacgggtacgagtgcgaatggcgctacaattcatgcgcaccggcatgccaggtgacgtgccagcacccagaacctcttgcgtgtcccgtgcagtgcgtggagggatgtcacgcgcattgccctccaggaaagattcttgacgagctccttcaaacttgtgtggacccggaggactgcccggtttgcgaagtggccgggcggcgctttgcgtcaggaaagaaagtcactcttaaccccagtgacccagaacactgtcagatatgccattgcgatgtagtaaatttgacatgcgaggcatgccaggagccgggaggattggtggtacctccaaccgatgcccctgtcagtccgaccactctgtacgtagaggatatctctgaaccccccctacatgatttctattgttcacgcttgctggacttggtgttcctgctggacgggtcttcgcggctgtcagaggctgagttcgaagtcttgaaagcttttgtggtggacatgatggaaagactccgcattagtcagaagtgggtcagagtggcagtggtcgagtaccacgacggatcacacgcttatattggtcttaaggatcgcaagcgaccaagtgaacttcgcagaatcgcttcccaggtgaaatatgccgggagtcaagtggcttcaactagtgaagtgctgaagtatacgctgtttcagatctttagcaagatagatcgtccggaggccagccgtataaccctgctgctgatggctagtcaagagccccagaggatgagccggaatttcgtacgctatgtgcaagggctcaagaaaaaaaaggtgatcgtcatcccagtggggatcgggccgcacgccaatttgaagcagattcgattaatcgaaaagcaggcacccgaaaacaaggcgtttgtgctgtcatctgtggatgagcttgagcagcagcgagacgaaatagtgagctacctgtgtgatctagcacctgaggccccaccccctaccctcccacctgatatggctcaagttacagtcggaccaggcctcctgggcgtctcgacgttgggacccaaacgcaacagcatggtcttagacgtggccttcgttctcgagggatccgacaaaataggggaggcagatttcaacaggagcaaagagttcatggaggaggtcatccagagaatggacgtgggccaggattcaatccatgtgactgtactacagtattcttatatggtgactgttgagtatcctttctccgaggcccagtccaagggcgacatcttacagagagttcgcgaaatccgctatcagggtggcaaccggactaatacaggtctcgcactcaggtaccttagcgaccattccttcctcgtctctcagggagaccgcgagcaagcacccaatctggtgtacatggtcaccggcaacccagcatcagacgaaatcaagcggctgcccggcgacatacaggtagtccccatcggcgttggaccgaacgcaaacgtgcaagaacttgagcggatcggttggcctaacgccccaatcctgatccaagactttgaaactctgccccgcgaagcgcccgatcttgtgctgcagagatgctgctcgggggaaggactccagatcccaacactgtctccggctcccgactgcagtcaaccactcgatgtgatcctactactggatgggtcgagcagcttcccagcatcttacttcgacgagatgaaatcgtttgccaaagcttttatcagtaaagcgaatattggcccacggttgacccaagtgtcagtgttgcagtacggttcaatcaccaccattgacgtgccctggaacgtcgtccctgagaaagctcaccttctcagcctggtcgacgtgatgcagagagaaggaggcccaagtcagattggggatgctttgggctttgcggtgcggtacctaacgtcagaaatgcacggagccaggcctggagcctccaaggcagttgtgatacttgttaccgacgtttcagttgatagtgtcgatgccgcggctgacgcagccaggtccaacagggtgactgtgtttcccatagggatcggggatcggtacgatgcagcccagctgcggattctcgcaggacccgctggtgatagtaatgtggtgaagctgcaaaggatagaagacttgccgacaatggtgaccctgggaaactcattcttgcacaagctgtgtagcggcttcgtgcggatttgcatggatgaggacgggaatgaaaaacgacctggagacgtgtggacccttcctgatcaatgtcatacagtaacctgtcaacctgacggtcagaccctgctgaaaagccaccgggtgaactgtgaccgcggcctccgaccttcctgtcccaacagccagtcacctgtgaaggtcgaggagacgtgtggttgtcgttggacctgtccatgtgtatgcaccgggagcagcacacggcacattgttactttcgacggtcagaactttaagcttacggggagttgcagctatgtattgtttcagaataaagagcaggacttagaagttattctgcacaacggcgcgtgcagccccggggctcgacagggatgcatgaaaagtattgaagtgaaacatagcgctctatctgttgagctccacagtgacatggaagtgactgtgaacgggcgattagtgtcagtaccatacgtgggaggcaatatggaagtgaacgtgtacggcgcgattatgcacgaagtgcggtttaaccacctggggcatatcttcacatttaccccccagaacaacgaattccagctccagctgtctccaaaaacatttgcctctaaaacatacgggctgtgcggaatttgcgacgagaacggcgcaaatgacttcatgctccgtgacggcacagtgaccaccgactggaaaaccctggtacaggagtggacggtgcaacgcccgggccagacatgccagcctatcctggaggaacagtgcctggtccccgattcttctcattgtcaggtgctgttgcttcctctgtttgcagagtgtcataaagtcttggcgcctgccacattttatgcaatctgtcagcaagattcctgtcaccaggagcaggtgtgtgaggtgattgcttcctatgctcatctatgcaggacaaacggggtgtgcgtggactggagaaccccggatttctgtgcgatgtcatgccccccttccctggtttacaatcactgcgagcacggctgtccaaggcactgtgacggtaatgtgagctcgtgtggcgatcacccctcagagggatgcttctgtccccccgacaaggtaatgctggaaggctcttgcgtacctgaggaggcatgcacccagtgtattggcgaggacggtgttcaacaccagtttctcgaagcctgggttccggatcaccaaccctgtcagatctgcacctgcttgtctgggcgcaaggtgaactgcaccactcagccatgcccaactgcaaaagccccaacatgtgggttgtgcgaggttgccagactgagacagaacgccgatcagtgctgcccagagtacgagtgtgtttgcgacccagtgtcctgcgacttgccccctgttccacactgtgaaaggggactacagcccacactgacgaatcccggtgaatgcagacctaattttacttgtgcctgccgcaaggaggaatgcaagcgcgtcagcccgcccagttgcccccctcataggctgccaaccttgaggaagacccaatgttgtgacgagtacgaatgcgcctgtaattgcgtaaactcgactgtctcatgtccactaggctacttagcctccaccgcgacaaacgactgtggatgcaccaccacaacctgtctgcctgataaagtgtgtgtccaccggtccactatttaccctgtcgggcagttttgggaagagggatgcgatgtctgcacttgcaccgacatggaggatgcagtgatgggtctgcgcgtggctcagtgcagccagaaaccatgcgaagattcttgcagatcgggattcacatacgttctccatgaaggggagtgttgtggtcgatgcctgcccagtgcatgtgaggtggtaaccggctctccccgaggggactcacagtctagctggaaatctgtaggaagtcagtgggcgagtcccgaaaatccctgtctcataaacgagtgcgtgcgcgtgaaggaagaggtcttcattcagcagcggaatgtcagctgtccccagctcgaggttcccgtctgtccatctgggtttcagctgtcatgtaaaacctccgcctgttgtcctagttgccgctgtgagagaatggaagcctgtatgcttaacggtacggtaatcgggcctggaaaaacagtcatgatcgacgtctgtaccacctgcaggtgtatggttcaggtgggtgtcataagtggttttaaactggagtgtcgaaagaccacctgcaatccatgtccactcggctacaaggaggagaacaataccggtgagtgttgcgggcgctgcctgcccacggcatgcacaattcagctcagaggcggccagatcatgaccctgaagagggacgagaccctccaggacgggtgcgacacccacttttgcaaagtgaacgaacggggggagtatttttgggaaaaaagggtaaccggatgtccaccattcgacgagcacaaatgtctggccgaaggcggcaaaataatgaagattccaggcacatgttgtgacacttgtgaggagcctgagtgcaatgatattactgcacggttacaatatgtgaaggtagggtcctgcaagagcgaagtggaggttgacattcattactgccaaggtaaatgcgccagcaaggccatgtactctatagacattaacgacgttcaagaccaatgttcttgttgcagccccacgaggacggaacccatgcaggtggctctgcactgcacgaacgggagcgtcgtttatcacgaagtcctgaatgctatggagtgtaagtgctctccaaggaagtgctctaag

SEQ ID NO: 21391 - DNA, 8439 bp, Artificial Sequence
  Description of Artificial Sequence: Synthetic coding sequence
atgattcctgcaagatttgctggcgtgcttctggccctagcgttaatcctgccaggcacgctttgcgcagagggcacccgggggcgcagcagtactgccaggtgctcactttttgggtcagacttcgtgaacacattcgatgggagcatgtactcattcgcggggtactgtagctacctgctggccggtggatgccagaaaaggagcttctccattattggcgacttccaaaacgggaaaagggtttccttatcagtgtacttgggcgagttctttgatatccacctgtttgtcaacgggaccgtgacccaaggcgaccagcgtgtatcaatgccatatgcgtccaagggcctttacctcgaaacggaagctggttactacaaactgagcggagaggcttatgggtttgttgctaggatcgacggcagcggaaatttccaggtgttgctgtccgaccgctatttcaacaagacatgcgggctctgcgggaacttcaacatcttcgcagaggacgactttatgacacaagagggaaccctgacttcagatccctatgactttgcaaacagttgggccttgtcaagcggggagcagtggtgtgagagggcttctcctccctccagttcatgtaacatatcaagcggggagatgcagaaaggcctgtgggagcagtgtcaactccttaaatcaacaagcgtctttgcacgatgtcatcccctggtggatcctgagcccttcgtagccctttgcgagaagacactgtgcgagtgcgccggcggactggagtgtgcttgtcctgcactgctcgaatatgctagaacatgcgcacaggaggggatggtcctgtatggctggactgaccattccgcctgtagtcccgtttgccctgccggcatggagtatcggcaatgcgtttccccgtgcgcaaggacctgtcagagtctgcatatcaatgagatgtgtcaagagcgctgcgtcgatgggtgcagttgcccagaaggacagctgcttgatgaaggactgtgcgtcgagtcgactgagtgtccgtgcgtgcattcagggaaacggtacccaccaggcacatccctgtcccgagattgcaatacctgtatttgccggaattctcagtggatctgctctaatgaggaatgccccggggaatgtcttgtcacaggccagtctcatttcaagtctttcgataatagatatttcaccttctcgggtatttgtcagtacttgttagcccgggactgccaggaccacagctttagtatcgtgatcgaaaccgtccagtgtgctgatgatcgagacgcagtgtgtacacggagcgtcactgtacgtcttcctggattacacaactccttggtcaaactcaaacacggcgctggcgtcgcgatggatggccaggatgtacaactgccactgttaaagggggacttaaggatccaacacactgttactgcgtcagttcgcttgtcttacggcgaagatctccaaatggactgggatggtagaggacggctccttgtgaagctgagccccgtgtacgcgggcaaaacttgcgggttatgtgggaactacaatggcaaccagggcgatgatttcttgacgcccagtggactcgccgaacctagggtggaggattttggaaatgcctggaagctacatggggattgccaagacttgcagaagcagcactcagatccttgtgccctgaaccctagaatgaccaggttttctgaggaagcttgcgcggtgttaacaagcccaacgttcgaagcgtgtcacagagccgtctcccctctgccctatctgcgcaattgtcgctatgatgtctgttcatgctccgacggccgcgaatgtctttgtggcgcgttggccagctatgccgccgcgtgcgcgggaagaggcgtccgcgtggcctggagagagccaggccgctgcgagctaaattgtccgaaaggccaggtgtatctgcagtgcggaacaccatgcaacctgacatgtcgtagtctgagctaccccgatgaggaatgcaacgaggcatgcctggaaggctgcttctgtcccccaggcctctatatggacgagcggggagactgcgtacccaaagcccaatgtccgtgttattacgacggagagatctttcagccagaggatatcttcagcgaccaccacacgatgtgctattgtgaggacgggtttatgcactgtactatgagcggggtcccaggatccctactacccgatgcagtgctgtcttctcccctctcgcaccgcagcaagcggtccctctcatgccgaccacctatggttaagctggtgtgcccagccgataaccttagggccgaaggacttgagtgcaccaagacctgtcaaaactatgatctggagtgtatgtcaatgggctgcgttagcggttgcctgtgcccaccgggcatggttcgccatgaaaataggtgcgtcgcactggagcggtgcccatgtttccaccagggaaaagagtacgctccaggggagacagtaaagatcgggtgtaatacatgcgtgtgtcaggatcgcaagtggaattgcactgaccacgtgtgcgacgccacatgctcgaccatcggcatggcccactacctgacgttcgacggccttaaatacctgtttcctggggaatgccagtacgtgctcgtacaagactattgtggctcaaaccctggcacctttcgaatcctcgtgggtaataaggggtgttcccacccttcagtcaagtgcaagaagcgtgttactatactggtggagggaggggaaattgagctgtttgatggagaagtaaacgtgaagcgaccgatgaaagatgagacacactttgaggtggttgagtccgggcgctatatcatactcctgctcggcaaagcgctgagcgtggtttgggataggcacctgtccattagtgtagttctaaagcagacttaccaggaaaaagtgtgcggtttgtgcggaaacttcgatggcattcagaacaacgatctcacgagctctaatctgcaagtggaagaggatccagttgacttcggcaattcttggaaggtttcgagtcagtgcgctgatacacgcaaagtgccactcgatagttcgccagccacctgccacaataacatcatgaagcaaactatggttgactccagttgcaggatcttgacttccgatgttttccaggattgtaacaagcttgtcgaccccgaaccgtacttggacgtatgcatctacgatacctgctcatgcgagtccatcggtgattgcgcctgcttctgcgatactattgcagcatatgctcacgtttgtgcccaacatggcaaggtggtgacttggcggactgccaccctgtgtccccaatcgtgcgaagagagaaacttgagagaaaacggctatgagtgtgaatggcgatacaatagctgcgcccccgcttgtcaggtgacatgccagcatccagagcctctagcttgtcctgttcagtgtgtggaggggtgtcacgcacactgtccccccgggaagatcctcgacgaactgctccagacgtgtgtagatccagaagattgtccagtgtgcgaagtagcgggccgacgtttcgcttccggcaagaaggtgactctgaacccctcagaccctgagcactgccagatttgccactgcgacgtagtcaacctcacatgcgaagcttgccaggagcccggcggcctggtggtgccaccaaccgacgccccggtgagccctacgaccctgtacgtcgaggacatttcggagcctccgcttcatgacttttactgttcccggctgttggacctcgtgttcttgctggacggatcctcacgactttcagaggccgagtttgaagtgctaaaagcctttgtggtggatatgatggaaagattgaggatatcacagaaatgggtacgcgtggcagtcgtggagtaccacgatgggagtcacgcctacattggtctcaaggatcgtaagcgcccatccgaactcagacgcatagctagtcaggtcaaatacgccgggagccaggtggcttcgaccagcgaggtacttaaatacaccctgtttcagatcttttctaagatcgatcggcccgaagcttccaggatcactctgcttctgatggcctcacaggaaccgcagcgcatgagtagaaactttgtaaggtacgtacagggtcttaaaaaaaagaaggttatagtcatcccagtggggattggtccccacgccaatttgaagcagatccggctgattgagaaacaagccccagaaaataaagcatttgtgttatcttcggttgatgagctggaacagcagcgggacgaaattgtaagttacctttgcgacctcgcaccagaggcgcccccgccaaccctaccacccgacatggctcaagtaacagttggcccggggcttctcggcgtgtctacactgggaccgaagagaaattccatggtgttggatgtcgcgtttgtgctggagggctctgataaaatcggcgaggccgatttcaaccggtcgaaggaatttatggaggaagtgattcagagaatggatgtgggccaggactccatccatgtcacagttcttcaatacagctacatggtgactgtggaatatcctttctctgaagcacagtcgaaaggggacatccttcaaagggtccgtgagattcggtaccagggcggcaatcggaccaataccggcctggccctgaggtatttatccgaccactctttcctggtgtcccagggagaccgcgagcaggctccaaacctggtctacatggtgactggtaacccagcatccgacgaaattaagcggttgccaggcgacattcaagtggtcccaattggggttgggcccaacgctaatgtgcaggaattggaaaggatcgggtggccgaatgccccaattctgatccaggatttcgaaaccttgccacgagaagcgcccgatctcgttttacagcggtgctgtagcggcgagggcctgcagattccaacgctttcacctgcccccgactgctcccagcccctggacgtaatactgctgcttgacgggtcatcgtcatttccagccagttattttgatgagatgaaatcgtttgccaaggccttcattagcaaagctaacataggtcctcgcctcactcaggtgtcagtgctgcagtacggttccatcaccacaatcgacgttccttggaacgtcgtccccgaaaaggcacatctcttgtcattggttgacgtcatgcaacgcgaaggcgggccctcacaaattggggacgcccttggcttcgcagtgagatatttgacttctgaaatgcacggcgcaagaccgggcgcaagcaaggctgtggtgatactcgttacagacgtatcagtggattcagtagacgccgccgctgatgccgcgcgttctaaccgtgtcaccgtgttcccaatcggcataggcgaccgctatgatgctgcccaattgaggatcctggccggacccgccggcgacagtaacgtcgttaagttacagcggatcgaggaccttcctacaatggtcacactaggaaactcgtttcttcataagctgtgctccggctttgtgaggatctgtatggacgaagatggtaacgaaaagcgcccgggggacgtttggacattgcccgaccaatgccacacggtgacctgccagcccgatggtcagaccctacttaagagccatagggtgaattgtgaccgcgggcttaggccttcttgtccaaattctcagtctcccgtgaaagtggaagaaacctgcggctgccgttggacttgtccatgtgtctgcacggggagttctacccggcacattgttaccttcgatgggcaaaactttaagctgacgggtagctgtagctatgtcctcttccagaacaaagagcaggatctcgaggtgatactgcataacggcgcatgttctccaggagcccgtcagggctgcatgaaaagtatagaggttaaacacagtgccctgagcgttgaactgcacagtgatatggaggtgaccgtaaatggccgactggtgtcggttccatatgttggcggtaacatggaagttaacgtgtacggggccattatgcacgaagtaagattcaatcacctgggtcatatctttacattcacacctcagaacaacgagtttcaactccagctgtcacccaagacgttcgccagcaaaacttatggcttgtgtgggatctgtgacgagaatggcgcaaacgactttatgctgagagacgggacagtaactactgactggaaaactctggtgcaggaatggacagttcaaaggccaggccagacgtgccaacctatactcgaagagcagtgtttggtgcctgactccagccactgtcaggtgctcttgctgcccctctttgcggagtgtcacaaggttctggcgccagccacattctatgcgatatgtcaacaggatagttgccatcaggaacaggtgtgtgaagtaatagctagctacgctcacttgtgccgaacaaatggtgtgtgtgtggactggcgcactcctgatttttgcgccatgagctgcccacctagcctcgtctataaccattgtgaacacggctgccccaggcattgcgacggcaacgtatcctcatgcggtgaccatccatccgaagggtgtttttgcccccccgacaaggtcatgctggagggaagctgtgtgcctgaagaggcttgcacccagtgtatcggcgaggatggagttcagcatcagttcttagaagcttgggtgccagaccaccagccttgccaaatttgcacatgcctgagcggcagaaaagtcaactgtaccacacagccttgtcctactgctaaagcacctacatgcggactctgtgaagttgcccggctcaggcagaacgcggatcagtgctgtcctgaatatgagtgtgtctgcgatcccgtgtcctgcgatcttccaccggtgccacactgtgagaggggactgcaacccacactgacaaatcccggagagtgccggccaaacttcacgtgcgcatgtcggaaagaagaatgcaagcgagtaagtcccccgtcttgccccccacaccggctccccactctccggaaaactcagtgctgcgacgagtatgaatgcgcgtgcaactgcgtgaacagcacggtctcttgccctctgggctatcttgccagtaccgctacaaacgactgtggctgtaccaccacaacatgcctgccggacaaggtgtgcgtgcacaggagcaccatctaccccgtggggcagttctgggaagaaggttgcgatgtctgcacttgtacggatatggaggatgccgtcatggggcttagggttgcccaatgtagccagaagccctgcgaggacagctgccgatctggttttacttatgtgctccacgagggtgaatgctgcggaagatgcctacccagtgcctgcgaggttgtgaccggctctcctcgaggagactcacagtcttcctggaaatccgtcggaagccaatgggcgtcccccgaaaacccatgtctgataaatgaatgcgtgcgagtgaaggaggaagtgtttattcagcaaagaaatgtttcttgtccccagctggaggtgccagtgtgcccctctggattccaattgtcatgcaagacgtcagcttgctgtccttcgtgccgctgcgaaaggatggaggcctgcatgttgaacggaacggtcatcggccctgggaagacagttatgattgatgtgtgcactacctgcaggtgtatggttcaggtgggtgttattagcggatttaagttggagtgtagaaagacaacatgcaacccatgcccactggggtacaaagaagaaaataacacgggagagtgctgtggaagatgtctccctactgcttgcactatacagttgcgggggggacagatcatgacgctcaagagagatgaaacccttcaggatgggtgtgacactcacttttgcaaggtgaatgaacgcggggaatacttttgggagaagcgcgttactggttgccccccgtttgatgagcacaagtgcctggccgagggcggaaaaataatgaagatacccggaacgtgctgcgatacttgcgaagaacctgagtgcaatgacataacagcccgccttcagtatgtcaaagtgggctcatgtaaatccgaggttgaggtcgatattcactattgtcaagggaagtgtgcatcgaaagctatgtactccattgatatcaatgacgtgcaggaccagtgttcttgctgttcaccaactcgcacagagcctatgcaagtggctctccactgcaccaacggatctgtggtgtatcacgaagtgctgaatgccatggagtgtaagtgtagccctaggaagtgctcaaag

SEQ ID NO: 21392 - DNA, 8439 bp, Artificial Sequence
  Description of Artificial Sequence: Synthetic coding sequence
atgattccagctcgatttgcgggagttcttttggctcttgctcttattctaccgggcaccttgtgcgcagagggaactcgaggtcgtagttcaactgcgagatgttccttgttcggttccgatttcgtcaacacgttcgatggatcaatgtacagttttgctggatactgttcatacctccttgcaggcggctgccaaaaacgatcgttcagcattatcggagactttcaaaatggaaagcgagtttccctcagtgtatatttaggtgagttctttgacattcatcttttcgtaaatggcactgttacacaaggtgaccagcgtgtatcaatgccctatgcttcaaaaggactttatcttgaaactgaagcaggatactataaactctctggagaggcatatggcttcgtcgcgcgtattgatgggtcgggtaactttcaagttcttctttctgatcgttattttaacaagacgtgcggactttgcggaaacttcaatattttcgcagaagatgattttatgacccaagaaggtacactgacatctgatccgtatgacttcgccaacagctgggcattatcctctggagagcaatggtgtgagagagcatcgcctccgtcgtcaagttgcaacataagttcaggagaaatgcaaaaaggcctgtgggaacaatgccagttgctgaagtccacaagtgtttttgcacgttgtcatccacttgtggatccagaaccgttcgtagctttgtgtgagaaaactctttgcgaatgtgctggtggactggaatgcgcatgcccagcactccttgagtatgcacgtacttgtgcacaagaaggtatggtcctgtatggatggacagatcatagtgcttgtagcccagtgtgtccagccggaatggagtaccgacagtgcgtttcgccttgcgcacgtacgtgtcagtctctccatattaatgaaatgtgccaggaacgatgtgttgatggctgctcctgcccagagggtcaattacttgacgaaggactttgtgtcgagtcaacagaatgtccatgtgtgcattcgggtaagcggtatccaccgggaacctcactttccagagattgcaacacctgtatctgccgtaactcgcaatggatatgtagtaatgaagaatgcccgggagaatgcttggtgacaggccaatctcatttcaaatccttcgataaccgatattttacattttcgggaatctgtcaatacctgttggcgcgagattgccaagatcactcattctccattgtgatcgaaacagttcaatgcgccgatgatagagatgctgtttgtacgagatcagttacagtccgtttacccggccttcataacagccttgtcaagttgaagcacggagctggagtggctatggatggacaagatgtacaattgccacttctcaaaggtgatcttcgtattcaacataccgttactgcatctgttcggctttcatacggagaagatcttcaaatggactgggatgggaggggtcgtcttctggtcaaattgagccctgtttacgcaggaaagacctgcggactttgcggaaattataatggtaaccaaggggacgatttccttactccgtctggtttggcggagccacgagtagaagatttcggaaatgcatggaaattgcacggcgattgtcaagaccttcaaaagcaacattccgacccgtgtgctttgaatccgagaatgactcgattttcagaggaagcatgcgctgtcctgacatctccaacattcgaggcctgccatcgtgcagtctcgccacttccatacttgagaaattgcaggtatgatgtttgctcatgttccgatggtcgtgaatgcctttgcggtgccttggctagttacgcagctgcttgtgcgggaagaggggtgagagttgcttggcgtgaaccaggccgttgtgaacttaattgcccaaaaggtcaggtgtatctgcaatgtggtactccatgcaatttaacttgtcgttccttgtcgtatccggatgaagaatgcaatgaggcttgcttggaaggttgcttctgcccgcctggactttatatggacgagagaggcgattgtgttcccaaggcacaatgtccatgttactacgatggagaaatcttccaaccagaagatattttttcagatcatcatactatgtgttactgcgaggatggtttcatgcattgtactatgtccggagtaccaggatcactgctaccagacgctgtgctttccagtccattgtctcatcgttcaaagcggagcctttcttgcaggccaccaatggtgaagctcgtgtgcccagccgataatctccgcgctgaaggactagagtgcaccaaaacatgtcaaaattacgatttggagtgcatgtccatgggctgtgtgtctggatgcttgtgtccaccaggaatggttcggcatgaaaatcgttgtgttgcccttgaacggtgcccgtgctttcatcagggtaaagagtatgcaccaggtgagaccgttaagattggatgcaatacttgtgtttgtcaagatagaaaatggaactgtaccgatcacgtttgcgatgctacttgctccactatcggtatggcacattatctgactttcgatggacttaaatacttattcccaggagaatgtcagtatgtcctggtgcaggattactgcggctctaatccgggaaccttcagaattcttgttggaaacaagggatgctcccatccaagcgtcaaatgcaaaaaaagagtaacaattttggtggaaggaggagagatcgaactttttgacggcgaggttaatgtgaagagacctatgaaagatgagactcatttcgaggttgtggaatccggtcgatatatcatactcctcttaggtaaagccctttctgtggtgtgggatcgacacttatcaatttccgtagtactcaagcagacttatcaggaaaaagtctgcggtctttgtgggaatttcgacggaatacagaacaacgatcttacgagttctaacctccaagtggaagaagatcctgtggacttcggcaattcatggaaagtgtcgtctcaatgcgcggatacccgcaaagtgccgttggattcatcaccagctacgtgccacaataacattatgaagcaaactatggttgattcatcgtgtagaattctgacttctgatgtatttcaggattgtaacaaactcgtagatccagaaccttacttagatgtatgcatttacgacacttgctcatgcgagagtatcggagattgtgcatgtttctgtgacacaattgccgcttatgcccatgtatgtgctcaacatggaaaagtagtaacctggagaacagcaactctctgtccacaatcatgcgaggaacgtaatctcagagaaaatggttacgagtgtgagtggcgttacaacagttgtgcaccagcatgccaagtcacgtgtcaacacccggagccattggcatgcccagttcaatgcgtggaaggatgtcacgcacattgccccccgggaaaaatccttgatgaacttctacaaacgtgtgtggatcccgaggattgtcctgtctgtgaggtggctggtagaagattcgcatcgggaaagaaggttactctgaacccgtctgatccagagcattgccaaatttgccactgtgatgtggttaatcttacatgtgaggcatgccaagaaccgggaggattagttgttccgccaactgatgccccagtgtcaccaactactctttatgtagaagacattagtgagccaccccttcatgatttctattgtagtcgattactcgatttggtttttttactggacggttcatcgcgtctatcagaagcggagttcgaagttttgaaagccttcgtagtagatatgatggaaaggttacgtatttctcagaaatgggtgagggtcgcagttgtggagtatcacgatggtagccatgcttacatcggattgaaagacagaaaacgtccctcggaacttcgacgtattgcctcacaagttaagtatgcgggatcacaagtggcgtctacgtcagaagtacttaagtatactctttttcaaattttttctaaaatcgaccgcccagaagcgtctagaattaccttgcttctgatggcatcacaggaaccacagaggatgtctcgaaactttgtacgatatgttcaaggactgaagaaaaaaaaggtaattgtcattccggttggaatcgggccacacgcaaacttaaaacaaattcgcctgattgaaaaacaagcaccggaaaataaggcctttgttctgtcgtctgtggatgaattagagcagcaacgagatgagattgtttcctacttatgcgatcttgctccagaagctcccccgccaacactgccaccagatatggctcaagtgacggttggaccaggcctcttgggtgtttcaactcttggtcctaagcgtaactcaatggttcttgatgtggcattcgtgttagaggggtcagataaaatcggtgaagcagactttaataggtcgaaggagtttatggaagaggtgatacaacggatggacgtcgggcaagattccattcatgtaacagtcctccagtatagctatatggttacagtcgaatatccattttcggaagcacaatccaaaggagatattctccaacgtgtcagagagataagatatcaaggaggaaatcggacgaacactggattggctttgcgatacttatctgatcattcttttctggtgtctcaaggagatcgcgaacaagctcctaacttagtatacatggttacaggaaatccagcttctgatgaaattaaaaggcttccgggagatattcaagtggtaccgataggggttggaccaaatgcaaatgtacaagaacttgagcgtatcggttggccgaatgccccaattctaattcaggatttcgagaccctacccagggaggctccagaccttgttctacaaagatgctgctctggagaaggacttcaaattcctactctcagtccagctccggattgttctcaacctttggatgtcatcttgctattggatgggagctcttcatttccagcatcatattttgacgaaatgaaatcatttgcaaaagcattcattagtaaggctaatattggacctagacttactcaagtgagtgtgctgcagtatggatcgatcacaacaatcgatgtgccatggaatgtcgttccggaaaaggcacatcttctctctctggtagatgtgatgcagcgcgagggcggaccttctcaaattggagatgccttgggcttcgcagtccgatatttgacatcagaaatgcatggggcacgaccaggagcttcaaaagccgttgtgattctggtgactgatgtgagtgttgactccgtagatgctgctgcagatgctgccagaagtaatcgtgtgactgtttttccaattggaattggagacagatacgatgctgctcaactccgtatcctcgcaggacctgcgggggactccaacgtggtcaagttgcagcggattgaggatctaccaacgatggttacgttaggtaactcattccttcacaagttatgctccggatttgttcgtatctgtatggacgaggatggaaacgaaaaacgtccaggagatgtatggactcttccagatcagtgccataccgtaacttgtcagccagatgggcagactctgcttaaatcacatcgagttaattgcgacagaggattgagaccgtcctgcccaaattcgcaatctccagtgaaagtggaggaaacttgcggatgccgttggacatgcccatgcgtgtgtactggaagctcgacacgtcatatcgttacattcgacggacaaaatttcaaattgactggatcgtgctcatatgtgctttttcagaataaagaacaagatctagaagttatattgcacaacggagcttgttccccaggagctcgacagggttgtatgaaatcaattgaagttaaacactcagctctttccgtagaactccattccgatatggaagtgacagttaatggacgactggtgtcagtgccatacgtgggaggaaacatggaggttaacgtatacggagcaattatgcatgaagtaagatttaatcatttaggacacatcttcacgttcacaccacaaaacaacgagttccagctacaattgtctccgaagacgttcgctagtaagacttatggactttgtggaatatgcgatgaaaatggagcaaatgatttcatgttgcgtgacggtactgttaccacagactggaaaacactcgtgcaggaatggacggtacaacgtccaggacaaacatgtcagcctattcttgaagagcagtgtctagtgccagactcgtcacattgtcaagtgcttttgttgcccctttttgctgaatgccataaagtgctggctccggcaacattctatgccatttgccaacaagatagttgtcatcaggaacaggtctgcgaggtgattgcttcttatgcccatttgtgccgaacaaatggtgtatgtgtcgattggcgcactcccgacttttgtgctatgagctgtcccccatctctcgtttataatcattgtgaacacggatgcccgcgtcactgcgatggaaacgtgtcgagttgtggtgatcacccatcggaaggatgtttttgtcctccagataaggtgatgctggaaggatcgtgcgtccctgaagaggcctgtacacaatgcatcggcgaggatggagtccaacaccaatttctagaggcttgggtacctgatcaccaaccatgtcaaatctgcacctgtctttccgggagaaaggtgaattgcacgacccaaccatgtcctactgctaaagcaccaacttgtggtctgtgcgaagttgcgcgtctacgacaaaacgcagaccaatgctgcccagagtatgaatgcgtgtgcgacccagtttcatgcgatctcccgccagtaccccattgtgaaaggggtctacaacccacactgacaaacccaggagaatgcaggcctaacttcacgtgtgcttgccgtaaagaagagtgtaagagagtttccccgcctagttgcccaccccatcgcttaccaactctgcgcaaaacacaatgttgtgatgaatatgaatgtgcgtgcaattgtgtgaattctactgtgtcttgcccattaggttatcttgcttctactgctacaaatgattgtggttgcacaacaaccacctgcttgcccgataaagtttgtgtccataggtcaactatttatccagtaggtcaattctgggaggaaggatgtgacgtctgtacttgcactgacatggaggatgctgttatgggcctccgtgtggctcaatgttctcaaaaaccgtgtgaagattcgtgccgcagtggtttcacgtatgtattgcatgagggagaatgttgtggccgatgtttgccgtcagcctgcgaagtggttacaggatctccacgaggagattctcaaagctcgtggaaatcagttggatcccaatgggcatcgccagaaaatccttgtttaattaatgaatgtgtccgagttaaagaggaggtttttattcagcaaagaaacgtctcctgcccacaattagaagtgcctgtgtgtccatcgggctttcagctctcttgtaaaacttcagcatgctgcccatcatgtagatgtgagcgtatggaagcgtgcatgctcaacggtacagttatcggccctggaaaaacggttatgattgatgtttgcactacatgccgttgtatggtccaagtgggagtgatttcgggatttaagcttgaatgtcgtaaaaccacgtgtaacccatgcccactcggatacaaagaagaaaataacacaggcgaatgctgtggcaggtgcttgccaactgcttgtacgatacaacttagaggcgggcaaattatgaccttgaaacgagacgaaacacttcaagacggttgcgatactcatttctgcaaggtcaatgaaaggggagaatatttttgggagaagcgcgttacgggttgcccgccttttgacgagcataagtgtctagctgaaggaggaaaaatcatgaagatcccaggaacctgttgtgatacatgtgaggagccagaatgcaatgatattacggctagattgcaatacgtgaaagttggttcttgtaaatcagaagtagaggtcgacatccactactgtcaaggaaagtgcgcttccaaagcgatgtacagcattgatatcaatgatgtgcaggatcaatgctcttgctgttccccaacgagaactgaacctatgcaagttgctcttcattgtacaaacggctcagtggtgtatcacgaagtgcttaacgcgatggagtgtaaatgttcaccacgcaagtgctcgaaa

SEQ ID NO: 21393 - DNA, 8439 bp, Artificial Sequence
  Description of Artificial Sequence: Synthetic coding sequence
atgattccagcccgattcgccggggtgcttctcgcactggctctaatcctcccgggtacattatgtgcagaggggacgcggggtagaagcagcactgcccggtgttcattgtttggctccgatttcgtgaacacattcgatggctctatgtactcattcgctgggtattgcagctacctgctcgcgggtggatgccagaagagaagcttttccattatcggcgacttccagaacgggaagagagtttctttatccgtgtatctaggagagttcttcgatattcatctgtttgttaatggtacagttacacaaggcgaccagcgagtttcaatgccttacgcatctaagggcctgtacttagagaccgaggctggatactacaaattgtccggagaggcatacgggttcgtcgcgcggatcgacggcagcggaaatttccaagtgctgctgtccgatcggtacttcaataaaacttgtggcctctgtggaaattttaacatcttcgctgaggatgattttatgacgcaggaaggtactctgacctccgatccctacgactttgcaaacagctgggccctaagcagtggagagcagtggtgcgagagggcgagcccaccatctagctcgtgtaatatttcttctggcgagatgcagaagggcttgtgggaacagtgccagctgctgaagagcacatcggtgtttgccaggtgccacccgctagttgacccagaacctttcgtggccctctgtgagaagacactgtgtgagtgtgcggggggcctcgagtgcgcttgtcccgctcttctggaatatgctagaacctgcgcccaagaagggatggtcttgtatgggtggacagaccattccgcatgcagccctgtgtgcccagctggaatggagtaccgccaatgcgtaagcccttgcgcccgcacatgccagtctctgcacataaacgagatgtgtcaagaacgttgcgtcgacggctgctcatgtccagaaggccagctactggacgaggggctctgcgtcgagagtacagaatgcccttgcgtgcactctggcaaaaggtatcctcctggaacctcactgagtcgtgactgtaatacttgcatctgtagaaacagtcagtggatctgctctaacgaagagtgtcctggggagtgccttgtaaccgggcaaagtcacttcaaatctttcgacaaccggtacttcactttctctggaatctgtcagtaccttctcgcacgtgattgccaggaccactccttcagcatcgtaatcgagacagttcagtgcgctgatgaccgtgatgcagtttgcacccgttcagtcaccgtgaggctccccggattgcataacagtctcgtgaaactgaagcacggcgctggggtggccatggacggtcaggatgtgcagctccctcttcttaagggtgatttgaggattcagcacaccgtcaccgccagcgtaaggctgagttacggggaagacctgcagatggactgggacggacgaggccgacttctggtcaaattaagtcccgtgtatgcagggaaaacctgtgggctgtgtggcaattacaacggaaaccagggagacgattttctgacacctagtggacttgcggaaccacgtgtggaggattttggaaatgcttggaaactgcacggcgattgtcaggatttgcagaagcagcactcagacccttgcgctctaaaccctagaatgacccgcttttcggaggaggcctgcgctgtcctcacttctcctacttttgaagcttgccacagggctgtgtccccgttgccgtacctgcgtaattgtcggtacgatgtgtgttcctgcagcgatggcagggagtgcctatgcggagcactggcaagttatgccgcagcttgcgcgggaagaggggtgcgagtggcttggcgcgagcccggccgctgtgagctaaattgtccaaaggggcaggtgtacctgcagtgtggaactccgtgtaacctaacctgtaggtccctgtcttacccggatgaggagtgtaatgaggcctgccttgagggctgcttttgccccccaggcctgtatatggacgagcgcggggattgcgtcccaaaagcgcagtgtccatgttattacgatggggaaatatttcagcccgaggatatcttttctgaccatcatacaatgtgttattgtgaggacggtttcatgcactgtaccatgtcgggggtgcccggaagcctattaccggatgcggttctctcctcacccctgtcccaccggtccaagagaagcctgtcctgtcggcctccaatggtcaagttagtgtgtcccgcagacaacctgagggctgagggattggaatgcactaagacttgccagaattacgatctggagtgtatgtctatggggtgtgtcagcgggtgcttgtgtccacccggaatggtacggcacgaaaatagatgtgtggcgttagagcgctgtccatgtttccatcagggaaaggagtatgccccaggcgaaactgttaagattggctgtaacacttgcgtgtgccaggaccggaaatggaactgtactgaccacgtgtgtgacgcaacgtgtagcacaattggaatggcccactatctgactttcgatggcttgaaatatctgttcccaggtgaatgccagtatgtgttggtccaagattactgcggctccaatcctgggacatttcggatcctcgtcgggaataagggatgttcacatccctcagtcaaatgcaaaaaacgcgtaacgatcctggttgagggaggcgaaatagaactctttgatggcgaggtgaatgtgaagcgaccaatgaaggatgaaacgcattttgaagtggtggaaagcggacgctatatcattctgctccttgggaaagctctgtcagttgtttgggatagacacctcagcatcagcgtggtgctgaagcagacgtaccaagagaaagtgtgcgggctttgtggcaacttcgatggcatccagaataatgatctaacctcgagtaatctgcaggtggaggaggacccagtggacttcggcaactcatggaaagtgtctagtcagtgtgcagacacaaggaaagtgccactggacagctctccggccacctgtcataataacattatgaagcagacaatggtggactcatcctgtcgaattttgacttcagatgtgttccaagactgtaataaacttgtggatcctgaaccatatctggacgtgtgtatatacgacacttgcagttgcgagtcgatcggtgattgtgcctgcttttgtgatacaatcgctgcctacgcccacgtctgtgcccagcacgggaaagtcgttacttggcggactgccaccttgtgtcctcagtcttgcgaagagagaaacctgcgagaaaatggttatgagtgcgaatggcgctacaacagctgcgcccccgcttgccaggtgacatgccagcacccggagcctctggcgtgtcccgttcaatgtgtagaaggatgtcatgcgcactgcccacccggaaagatattggatgaattactccaaacctgcgtggatcccgaagattgccccgtgtgcgaggtagccggcaggaggttcgcgtccggcaaaaaggtaaccctgaacccttctgacccagagcactgtcaaatttgtcactgtgatgtggtgaatttgacctgcgaagcatgtcaggagcctggtgggctcgtggtccccccaaccgacgccccagtgtctccaacaacactatatgttgaggacatctccgaacccccattgcacgacttctactgcagccggctgctggacctggtgttccttttagacggatcttcacgactctccgaagccgaattcgaagtgctcaaagcatttgtcgtagacatgatggagcgtctgcgtatcagtcaaaagtgggtcagagtggccgttgtggagtatcacgatgggagccacgcatacatcggtttgaaggaccggaagaggccctccgaactgcgccggatcgctagccaggtgaaatacgccggcagccaggttgcgtccactagtgaggtccttaagtataccctgtttcaaatttttagcaagattgatcgtcccgaagcctcccgaataacactcctgctgatggcctctcaagagccccagcgcatgagccgaaatttcgtgcgctatgtccaaggcctgaaaaagaagaaggtgatagttattcctgtaggcattggcccgcatgcaaatttgaaacagatcaggttgattgagaagcaggcgcccgaaaataaggcttttgttctgtcgtctgtggatgagcttgagcagcagagagatgagatagtgtcgtacttgtgtgacctcgctcccgaggctcctccacctaccctacctcctgatatggctcaggtgaccgtgggtcccggactgcttggagtctcaactctggggccgaaacgcaactccatggtgttagacgttgccttcgtcttagaaggaagcgataaaatcggcgaggctgattttaacaggtcaaaggagttcatggaggaagtgattcagcggatggacgttggccaggactctattcatgtgacagtactacaatactcctacatggttaccgtggaatatccgttttcagaggcgcagtcaaaaggagacatccttcagcgtgtacgcgaaattcgctaccagggtggtaataggactaacaccggtttagctctaagatacctctctgatcattctttcctggtgtctcagggtgaccgagaacaggcgccaaatcttgtttacatggtcaccgggaaccctgcttcagacgagatcaaaaggttgcctggcgatatacaggtcgtgccaataggagtaggacccaacgccaatgttcaggagctggagcgcattggatggcccaatgccccaatcctgatccaggactttgagacactgcctcgggaggcacccgacctcgtactgcagcggtgttgctcaggcgagggcctccagattccaacactttcccccgccccggattgctctcagcctctggatgttatcctacttctcgacgggagctccagcttccctgcgtcttatttcgacgagatgaaatcattcgccaaagctttcattagcaaggcgaacatcggaccccgactgactcaggtctccgtattacagtacggaagcattactactatcgacgtgccatggaacgtcgtgcctgagaaggcacatctgctgtcacttgtggatgtgatgcaacgcgagggcgggccttcacagatcggcgatgctctcggctttgctgttaggtacttgacctcagaaatgcacggcgcccgaccaggcgcaagtaaagccgtggttatcttggtcacagacgtttctgtggacagcgttgatgctgcagcggatgctgctcggtctaacagggtgaccgtgtttccaattggcatcggtgaccggtacgatgccgctcagctgcggatactagcagggcccgctggggacagcaacgtggtgaagctccagcgtatagaagatttgccaacaatggttactctgggaaactccttccttcacaaactgtgtagcggctttgtcaggatttgtatggatgaagatggcaatgagaagcgtcccggcgacgtgtggacactgcctgaccagtgtcatactgttacgtgccagccagacggccagactttattgaagtcccaccgggtgaattgcgaccggggtctgaggccctcctgccccaactcccagtcacccgtcaaggtggaagaaacgtgtggatgtcgatggacttgcccctgtgtatgtaccggctcctcgaccaggcacattgttacatttgacgggcaaaactttaaactgactggaagctgctcctatgttctcttccagaataaagaacaggacctcgaggttattctgcacaacggggcctgttctcccggagcaaggcagggctgtatgaaatctatcgaggtcaagcattctgccctaagtgtagaactgcactcagacatggaagtgacggtgaacgggcggcttgttagtgttccctatgtaggtggcaatatggaagtcaatgtctatggggccataatgcatgaagtcagatttaaccaccttggtcacatatttacttttacgccccagaataacgagtttcagcttcagttgagcccaaaaacctttgcgagcaagacctacgggctgtgcgggatctgtgacgagaacggagctaatgatttcatgctgcgcgacgggacggttacaaccgattggaaaacactggtgcaggaatggaccgtgcagaggcccggacagacgtgccagcctatactggaggagcagtgtctcgtccccgacagcagccattgccaagttctcctcctacccctgtttgccgaatgtcataaggtcctggctccagccacgttttatgcaatctgtcagcaagattcctgtcatcaggagcaggtctgcgaagtgatcgcatcttatgcccatttgtgccggactaatggcgtttgtgtggactggcgcactcccgacttctgtgccatgagctgccctccatcattggtgtataaccactgtgagcatggttgtcctcgacactgtgacggcaatgtcagcagctgcggcgatcacccctctgaaggttgcttttgcccaccagataaggtgatgctggaaggaagttgcgtgccagaggaggcctgtacccaatgcataggggaagacggggtgcagcatcagtttttggaggcttgggtccccgatcatcagccttgtcagatttgcacgtgtctgtctggccggaaggtcaattgcacaacccaaccttgtcctaccgccaaggccccgacatgcggcctttgcgaagtggcacgcttgcgccagaatgccgaccagtgttgcccagagtacgaatgtgtgtgcgaccctgtttcctgcgacctccctccggtaccccattgcgaacggggactgcagcccactttaactaacccaggagaatgccggcccaactttacatgcgcctgtaggaaagaggaatgtaagcgcgtctcccctcccagctgtccaccacacaggctgcccaccctgcgaaagacccagtgttgtgacgaatacgagtgcgcttgtaactgcgtgaacagtacagtgtcatgccccctgggatatcttgcctctaccgccactaatgattgtggatgtactactacgacatgcctgcccgacaaggtctgcgttcataggagcaccatctatcccgtcggccagttttgggaagagggatgcgacgtttgcacctgtacagacatggaggacgctgtgatgggtctcagggtggcgcaatgtagtcaaaagccctgtgaagatagttgcaggagtggctttacatacgtgcttcacgaaggcgagtgctgtggcaggtgtttgccgtctgcctgcgaagtcgtcacaggctcaccccggggagacagccagtctagctggaaatctgtcggaagtcagtgggcctcacccgagaatccatgcctcatcaatgagtgcgtaagagtcaaggaggaagtgttcattcagcagaggaatgtgtcatgccctcagttagaggtgcctgtttgcccttccgggttccagctatcctgcaagacatctgcgtgttgtccgtcctgtcgctgcgagcggatggaagcttgtatgcttaatgggaccgtgattggtcccggaaagacagttatgattgacgtgtgcacgacatgccgctgtatggtgcaagtaggggtgattagcggattcaaattagagtgtcggaagaccacatgtaacccttgcccactcggatacaaggaagaaaacaacaccggggagtgctgcggacggtgtctgccaaccgcgtgtaccatacaactccggggcgggcaaattatgaccctgaagcgcgatgagaccttgcaggatggttgcgacacccacttttgtaaggtgaacgaaaggggtgagtacttttgggagaaaagggtgacaggatgtcctccatttgacgaacacaagtgtctagccgaggggggcaaaatcatgaaaatacccggtacctgctgcgacacttgcgaggaaccagaatgcaacgatataacagccaggttgcaatacgtgaaggtaggatcctgtaagtctgaggtggaggtcgacatccattattgtcagggtaagtgtgcctccaaagcaatgtattctatagatattaacgatgtgcaagatcagtgttcctgttgctcaccaaccaggacagaacctatgcaggtggccctgcattgcacaaacggaagcgtcgtgtatcacgaggttctcaacgctatggagtgcaagtgttctcctcgcaagtgttccaag

SEQ ID NO: 21394 - DNA, 8439 bp, Artificial Sequence
  Description of Artificial Sequence: Synthetic coding sequence
atgattcctgcaaggtttgcaggagtgctcctggcgcttgccctcattctcccaggcacattatgtgcagaaggtacacgcggacgttcttcaacagcacgctgttctcttttcggatcagattttgtgaatactttcgacggcagcatgtatagtttcgctgggtactgctcttacctgctggctgggggttgtcagaaaagatccttctccatcataggggacttccaaaatggtaagagggtttccctatctgtgtacctcggagagttcttcgatatccatctctttgttaacggaaccgtgacccaaggcgaccagcgtgtatccatgccctacgccagcaagggtctataccttgaaaccgaggcagggtactataaactgagcggggaggcgtacggcttcgttgccaggatcgatggttctggcaatttccaggtgctcctgtctgaccgctacttcaataagacgtgcggtctctgtgggaattttaatattttcgctgaggacgattttatgactcaggagggtacattgacctctgatccctacgactttgcgaactcctgggctttatcttctggagaacagtggtgtgagagagcatcgcccccatctagctcatgtaacatcagctcaggggagatgcagaaaggattgtgggagcagtgccagcttctgaagtcaacctcagtgttcgccagatgtcaccccctggtcgacccagagccttttgtggccctgtgtgaaaagacactgtgtgaatgcgctggcggactcgagtgtgcctgtcccgcgctgctcgagtacgcacgaacctgtgctcaggaaggaatggtcctatatgggtggacagatcattccgcttgttctcccgtgtgtccagctgggatggaataccggcagtgtgtaagcccgtgtgccaggacatgtcagagtctccacatcaacgaaatgtgccaggagcggtgcgttgatggatgtagctgtccggagggtcagctgctggacgaaggtctgtgtgtcgaatccacggagtgcccgtgtgtgcattccgggaagcgatatcctcccggtacgtcactgtcccgggattgtaacacctgcatatgccgcaattcccagtggatttgtagcaacgaagaatgtccaggagagtgtttggtcacaggtcagagccatttcaaaagcttcgataaccgatacttcaccttttccggaatatgccagtacctccttgcgagggactgccaagaccatagtttttccattgtgatcgaaaccgttcagtgcgccgacgaccgggacgccgtttgcacacggtccgttactgtcaggctgcctgggctgcacaacagtctagtcaagctcaagcacggcgccggggtggccatggacggtcaagatgtgcagctgccactcctcaagggtgacctccgaatccaacatacggtgactgcttccgtacggctgagctacggtgaagacctgcagatggactgggatgggcgcggacgcctgctggtcaaactgtccccagtgtacgccgggaagacttgcggcctttgcgggaactataacggcaatcagggggatgattttctgactccaagtggtctggcggaaccacgggtggaagactttggaaacgcgtggaaattgcacggcgattgccaggatctacaaaaacagcacagtgacccttgcgccttgaatccccgcatgactcggtttagtgaggaagcatgtgcagttctgaccagtccaactttcgaggcctgccacagagcggtgtctcctttgccctacctcagaaattgccggtatgacgtctgcagttgctcggatggaagagagtgcctgtgcggcgcgcttgcaagttacgcagctgcttgtgctggaagaggtgtgagagtggcctggcgagaacccgggaggtgtgaattaaactgtcctaaaggacaggtgtacctccagtgtggtactccttgcaacctgacttgtcgctccctcagttacccggacgaggagtgcaacgaggcctgcttggagggttgcttttgcccacccggactgtacatggacgagcgcggagactgcgtgcccaaggcgcagtgtccctgctactacgacggggagatctttcagcccgaagacattttcagtgaccatcatacgatgtgttactgcgaagatggctttatgcattgcactatgagtggagttccggggagtctgttaccggatgctgtgttgtcatctccattgtcccaccgctcaaagcggtctctcagttgcagacctcccatggtgaagctggtctgtcctgctgataaccttcgcgcggagggtcttgagtgcaccaaaacttgccagaattatgatcttgagtgcatgagcatgggatgtgtgtctgggtgtttgtgcccgccgggcatggtacggcacgaaaaccgctgcgtcgcattggaaaggtgcccatgcttccatcaggggaaggagtatgcacctggggaaacggttaaaatcggctgcaacacctgcgtgtgtcaggacaggaaatggaactgcaccgatcacgtttgtgatgctacgtgttcaaccatcggcatggcccactatcttacctttgacgggctgaaatatctcttccccggagagtgtcagtacgtcctggtccaggactactgtggaagtaacccaggcacgtttcggattctagtgggcaataaaggctgctcacacccctcagtgaaatgcaagaagcgtgtgaccattctggtggagggaggagaaatcgagttgtttgatggggaggttaatgttaagcggcctatgaaggatgagacacatttcgaagtggtggagtccggacgctacattatcctgcttctgggtaaagcccttagcgtcgtgtgggaccggcacctatctatatcggtggtgcttaagcagacgtatcaggagaaggtgtgcggtctttgcggaaactttgatggtatacaaaacaacgacttaacgtccagcaacttgcaggtcgaggaagatcctgtcgacttcggaaattcttggaaagtgagctctcagtgtgcagacacaaggaaagtacccctggactcttcacctgctacctgtcataataatataatgaaacagacgatggtcgattcctcctgcaggatactcactagtgacgtctttcaagactgcaacaaactcgtcgaccctgaaccctacctggatgtgtgtatctatgatacatgctcctgtgaaagtattggcgactgcgcttgcttttgtgatacaatagctgcgtacgcgcacgtgtgtgctcagcacggaaaggtcgttacctggcgtaccgcaacactgtgtcctcagtcatgtgaagaaagaaaccttcgcgagaatggctatgagtgtgaatggagatataattcttgtgcccccgcatgccaggtgacttgccagcatccagagccgctggcttgtcccgtgcagtgcgtggaggggtgtcacgcacattgcccgcctgggaaaatcctcgacgagctactccagacatgcgttgatccagaagattgtcccgtttgcgaggtggctgggagacgattcgcatcaggaaagaaggtgacgctcaatccttcagatcctgagcactgccagatctgtcactgtgacgtagtaaatctgacatgtgaagcatgtcaggagccgggtggcctcgtggttcccccaactgacgcccccgtgagtcctaccaccctgtacgttgaggatatatcggagcccccactacacgatttctactgcagccgcctgctggacctcgtttttttgctggacggaagctcccgcctcagtgaagcagaattcgaagtgctcaaagcctttgtggttgacatgatggaaagactgagaatttcccagaagtgggtccgggtggctgttgtcgaataccacgatgggagccacgcatacatcggcctcaaagataggaagaggccgagtgagctgcgacgaatagcctctcaagtgaaatatgcaggcagtcaggtggcttctacatcagaggtgctaaagtacaccttatttcagatcttctctaaaatcgacaggcctgaagcttcccgcattaccttactattgatggcatcacaggagccccagagaatgtccaggaacttcgttagatacgttcaggggctcaaaaaaaagaaggtaatcgtcatccctgtgggcatcgggccacacgctaacctgaaacagatccgccttatcgagaaacaggcgcctgagaataaggcttttgtgctctcatctgtggatgagttagaacagcagagggatgaaatcgtatcttatctgtgcgatttggcacctgaagcaccccctcccacactgccgcccgatatggcacaagtgaccgttggacccggactgctcggagtttccactctgggcccgaaaagaaactcgatggttttagacgtagcatttgtgctcgagggctcagacaaaattggtgaggccgacttcaacaggtctaaggagttcatggaggaagttatccagcgaatggatgtcggacaggattctatccatgtaactgtactgcaatacagctacatggtaaccgtggaatatccattctcagaggcccagagcaaaggcgacattcttcagagggtgcgagagatccgataccaaggcgggaatagaaccaataccggcctcgctcttcggtatcttagcgaccatagcttcctcgtcagtcaaggcgaccgggaacaggctccaaacttagtttatatggtgacaggaaatccagccagcgacgagattaagagactcccgggggacatccaggtggtgcctatcggcgtgggacccaacgcgaacgtccaggagctggagcggataggatggcccaacgcccctatcctgatccaggatttcgaaaccttaccgagagaagcccctgacctggtgctgcaacgctgctgctcgggagagggcttacaaattccaacccttagccctgcccctgattgcagccagcctttggatgttatactgctcctggatggaagtagcagtttcccagcttcttacttcgatgagatgaagtcatttgctaaggctttcatttcaaaggctaacataggtccacggctcactcaagtctcggtgttgcagtacggatctatcaccacaattgatgtgccttggaatgtggtgcccgagaaagctcacctgttgtctctggtagacgtgatgcagcgcgagggggggccaagtcagatcggggatgcgctggggtttgcagtccggtacctgactagcgagatgcacggggcacgacccggcgcgagcaaagccgtggtcatactcgtgaccgatgtgtctgttgactctgtcgacgcggctgcagatgcagctcgaagcaatagggtgacagtgtttcctatcggaattggtgatcggtacgatgcagcgcagctgagaattttggccggccccgccggcgacagcaatgtagtcaaactccaacggatcgaggatctgcccaccatggtgactctgggtaactcatttttacacaagctttgctcaggctttgtcaggatatgcatggacgaggacggaaacgagaagagacctggagacgtatggacactgccggaccagtgtcatacagtgacgtgtcaaccggatgggcagactctgctgaagagtcacagagttaactgcgacagggggctccgacccagttgtccgaatagtcagtctcccgtgaaagtcgaggaaacatgtggctgtagatggacctgtccttgtgtctgtaccgggagttccacccggcatatcgtgacctttgacggccagaatttcaagctaactggatcgtgcagctatgtgctgttccagaacaaggaacaagacttggaggtgatcctacataatggggcttgcagccccggtgccaggcagggatgtatgaagagcatcgaggtgaaacacagtgccttgagtgtagaattgcatagcgacatggaagtgactgtaaacggtaggctggtgtctgtgccatacgtcggaggcaacatggaggtaaatgtgtacggcgctatcatgcacgaggtccgatttaatcatctcgggcacatctttacgttcaccccacaaaacaacgagtttcagctacagctgagtccaaagacctttgcgtctaaaacttacggcctatgcggcatttgcgacgagaacggagccaatgactttatgctgcgcgacggtacagttacaactgactggaaaacattagtccaggaatggactgttcaacgccctggccagacctgccagcctattctcgaggaacagtgtttggtaccggacagcagccactgtcaggtgctgctcctgcctctctttgctgagtgccacaaggtcctggcccctgcaaccttttatgctatttgtcagcaagacagctgtcatcaggaacaggtctgtgaggttatcgcgtcgtatgcccacctgtgtcggaccaacggagtgtgtgtggactggagaactccagatttttgcgcaatgtcatgtccaccatcactggtatataaccattgcgaacacggctgtcccaggcactgcgatgggaacgtaagctcctgtggtgatcatccgagtgaaggatgcttctgcccaccggacaaagtcatgctagagggttcgtgcgtcccggaagaggcttgcacacagtgcattggagaggatggagtacagcatcaatttttggaggcctgggtgcccgaccaccaaccatgtcaaatttgcacttgcctgagcggaaggaaagtgaactgcactacccagccatgtcctactgccaaggcacccacttgtgggttatgtgaagtggctaggctgcgacagaatgccgaccagtgttgcccagaatatgagtgcgtttgcgacccagttagctgcgacctgccaccagtgccccattgcgagcgcggcctccagcctactctgaccaaccctggggagtgcagacccaacttcacatgcgcttgcaggaaagaggagtgtaaacgcgtatcccccccctcttgtccaccccatagactcccaaccctgcggaaaacccagtgctgcgacgagtatgagtgcgcctgcaactgtgtgaatagcaccgtgtcctgtcccctgggatatcttgcatcaacagcgactaatgactgcggctgcaccaccacaacctgtctaccggataaggtttgcgtgcatagatctacaatctatcctgtgggacaattctgggaggaagggtgtgatgtctgtacgtgcacggatatggaggacgcagtgatggggctgagagtggctcagtgctcacaaaaaccatgcgaggactcatgtcggtccggtttcacctatgtgctgcatgaaggcgaatgttgtggaaggtgtctgccatccgcatgcgaagtggtgacaggctccccgcgcggagatagccaatcttcctggaaatctgtgggatcacagtgggcttctcctgaaaacccctgcctcattaacgagtgtgtacgagtgaaggaggaagtgtttatacagcaacggaatgtcagctgcccccagctagaggtgcccgtgtgtccgtcagggttccagttaagttgtaagacatctgcttgctgtccctcatgtaggtgtgagaggatggaggcttgtatgctgaacggtactgtcattggccctggcaaaactgttatgattgatgtgtgtacgacctgcagatgtatggtgcaggttggagtgattagcggcttcaaacttgagtgtcggaagactacatgtaacccctgcccccttggttacaaggaggaaaacaacaccggtgaatgttgtgggaggtgtctgcccacggcatgcaccattcagcttcggggtgggcagattatgaccctgaagcgggacgaaacactgcaggacggctgcgatacgcacttctgcaaagtcaatgaacgaggtgagtatttctgggagaagagagtaaccggttgccccccttttgatgagcacaagtgtctggctgagggcggcaagatcatgaagatacccggtacttgttgtgatacttgtgaggagcctgagtgtaacgacatcacggccaggctgcagtacgtcaaagtggggtcttgtaagtctgaagtggaagtcgatattcattactgccagggcaaatgtgccagcaaggcgatgtacagtatcgatattaacgacgtccaggaccagtgcagctgctgttctccaactcgaaccgaacctatgcaggtcgcattacactgcactaatgggtctgtggtataccacgaggtgctgaacgcaatggagtgtaagtgttcaccaagaaagtgttctaaa

SEQ ID NO: 21395 - DNA, 8439 bp, Artificial Sequence
  Description of Artificial Sequence: Synthetic coding sequence
atgattccggcaagattcgcgggcgttctcctggctctggcgctgattctgcctggcacactgtgtgcggaaggtacaagaggccgcagttctaccgcccgttgctcgttatttggcagcgactttgtgaatacgtttgatggatcaatgtactcattcgccggttattgctcttacctcttggcagggggctgccagaagcgttctttttccatcatcggcgactttcagaacggaaaaagagtcagccttagcgtttacttgggggagttttttgacatccatttgtttgtaaatggaacggtaacgcaaggcgaccaaagggtgagcatgccttacgcgagcaaaggcctttacctcgaaacagaagctggctattataaacttagtggcgaagcatatggatttgtggcgcgtatcgacgggtcaggaaatttccaagtgttactgtcggatcggtactttaataaaacatgcggtctttgcgggaattttaacattttcgcggaagacgattttatgacgcaggagggtacactgacgtcggatccttatgattttgcaaatagctgggccctgagttccggagaacagtggtgtgaacgcgcgagccctccgtcgagctcgtgcaacattagctcgggcgagatgcagaaaggactttgggagcagtgtcagcttttaaaatcaacaagcgtcttcgcccgttgccatccgctggttgatccagaaccctttgtcgcactttgtgagaaaacgctttgcgagtgcgcaggcggtttggaatgtgcatgcccggcgttgctggagtatgcaagaacatgcgcacaggaaggaatggtactttacggatggacggatcactcagcatgttcacctgtctgtcctgctggtatggagtaccgacagtgtgtaagcccttgcgctagaacatgccaatcactgcatattaatgaaatgtgccaggaaaggtgcgttgacggctgctcttgccctgaaggccaactgcttgatgaaggtttatgtgtagaatcaacagaatgtccatgtgttcattctggaaaacgttatccacctggcacctcactcagtcgtgattgcaatacatgtatctgtagaaactctcagtggatttgctcaaacgaagaatgccctggcgaatgtcttgtcacgggccagtcacattttaaatcctttgacaaccggtatttcacatttagtggcatttgccagtatttactggccagggactgtcaggaccattcatttagtatcgtgattgagaccgtgcaatgtgctgatgatagagatgccgtttgcacgagatccgtaaccgttcgtttgccgggcttacataacagtttggtgaaattgaaacatggagctggggtcgcaatggacggccaggatgtgcaacttcccttgttgaagggcgatctccgcatacagcacactgtaacagcatctgtgagactttcatacggcgaggacttacagatggattgggacggccgggggcgtttgctggtcaaactgtccccggtttatgcgggtaaaacttgcgggctctgcggcaattataatggtaaccagggagatgattttctgacgccgagcggcctggccgaaccacgggtggaggacttcggcaacgcgtggaaattacacggtgattgccaggatctgcagaagcaacatagcgatccgtgcgctctgaatccaaggatgacaagattcagcgaagaagcctgcgctgtgttgacaagcccgacttttgaggcgtgtcatcgggcagtgtccccgcttccctatttgcgcaattgccgctatgatgtttgttcatgctctgatggtagggagtgtctttgtggtgctcttgcgtcatatgcggcagcttgtgcgggtagaggcgttcgggtagcatggagagaaccgggaagatgtgaattaaattgcccaaaaggccaagtttacctgcaatgcggcacgccgtgcaatctcacctgtcgcagcctgtcctatccggacgaagaatgcaacgaagcgtgcctggaaggatgtttttgtccaccggggctgtacatggatgaacgtggcgactgcgttccgaaagctcaatgcccttgttattatgatggcgaaatatttcaaccggaggacattttctcagaccatcatacaatgtgttattgtgaagatggattcatgcattgtaccatgagcggcgttccgggatctttattgcctgatgctgttctttctagccccttaagtcatcgctccaagaggagcttgagctgtaggccgccaatggttaaacttgtctgccccgccgataatctgcgggcggaggggttagagtgtaccaaaacttgccaaaattacgacttagaatgcatgtcaatgggatgtgttagcggttgcttgtgcccgccggggatggtacgccacgaaaacagatgtgtagctttagaacgttgtccgtgttttcaccaggggaaggagtacgcaccgggagagacggtgaaaattggttgtaatacatgcgtatgccaagatagaaaatggaattgtacagatcatgtatgtgatgccacgtgttcaacaattggcatggcacattacctgacttttgatggattaaagtacctattccctggcgaatgtcagtacgtactggtccaggattattgcggctctaaccctggaacctttagaatcctcgtcggaaataaagggtgttcgcacccgtcagtgaaatgtaagaaaagagtcacaatcctggttgaggggggcgaaattgaactgttcgatggggaggttaatgttaaaagaccaatgaaagacgagacacatttcgaagtggtagaaagtgggcgctacatcatattgttgctcggcaaagctttaagcgttgtatgggaccgccacctcagcatttcagtcgtacttaaacagacatatcaagaaaaagtctgtggtttgtgtggcaacttcgatggcattcagaacaacgatttaacaagctctaatctgcaagttgaggaagaccctgtagattttggaaattcatggaaagtgtcttctcaatgtgctgatactcgcaaggtcccattggattcatcaccggcaacatgtcacaacaatataatgaaacagacaatggtagattcttcttgcagaatcttgactagcgacgtgtttcaagattgcaacaaacttgtcgatcccgagccgtatcttgacgtatgtatttatgacacatgcagttgcgagtcaattggcgattgtgcttgcttttgcgatacaattgctgcgtatgcacatgtatgtgctcaacacggtaaagtcgtaacctggagaacagcaacgttatgcccgcagagctgtgaagagcgcaacctacgagaaaacggatatgaatgcgaatggcgctacaactcttgcgcacctgcgtgtcaggttacatgtcaacacccggaacctctggcgtgcccggtgcagtgtgtcgaaggatgccatgcacattgcccccctggcaagatcttagatgaactgctccaaacatgcgttgatccggaagattgtccagtttgtgaagttgccggacgtcgattcgctagcggcaagaaagtaactctgaatccgtcagatcctgaacattgccagatctgccattgcgatgtggtcaacttgacttgcgaggcttgtcaggaaccgggcggtcttgtggtaccgccgacagatgcgccggtctcccccacgacattatatgtggaagatatctctgaaccgccgttacatgatttctactgttctagacttctagatctggtatttctgcttgatggcagttctcgtcttagcgaagcagagttcgaagttctgaaagctttcgtcgtcgacatgatggaacgcctgagaatttcacagaaatgggtccgagtagccgttgttgaatatcatgacggctctcatgcgtatatcggcttgaaggaccgaaagcgaccgtccgagcttagaagaattgccagccaggtaaaatatgcagggtcacaggtggcctcaacgtccgaagttctgaaatatacgctttttcaaattttttccaaaattgataggcctgaagccagtcgcatcacgctcctattgatggccagccaggagccacagagaatgagtaggaacttcgttcgttacgtacagggacttaagaaaaaaaaagtgatagtaattccggtaggcattgggccgcatgccaaccttaaacagatacgtctaattgaaaagcaagcacccgaaaataaggcctttgtattatctagtgtagatgagcttgagcagcagcgcgatgaaatcgtatcttatctttgtgaccttgccccggaagcccctccgcctacgttgccacccgatatggcccaggtgaccgtggggccggggcttctgggcgtgtctactctaggcccaaaacgcaacagcatggttctcgacgtagctttcgtcttagaagggagtgataaaatcggagaagcagattttaacagatctaaagagtttatggaagaagtgattcaacgaatggatgtagggcaggattcgattcatgtcactgtgctgcagtattcatatatggttacagttgagtacccgtttagcgaagctcaaagcaaaggagacatccttcagcgcgttcgtgaaatcagatatcaggggggtaatcggacgaacaccggcctagctttacggtatctttctgatcactcttttctggtaagccaaggagatcgtgaacaggcgccgaacctggtgtatatggtgacaggtaaccctgcgtcagacgaaattaaacgccttcctggagatattcaggtcgtaccgattggcgtcggacctaacgcaaatgtgcaagaattggaacgtatcggatggccgaatgcaccgattctcatccaagatttcgagacgttgccgcgcgaagcacctgatttggttctgcagagatgctgcagcggcgagggccttcagattccgaccctttctccggcgccggactgtagtcaaccgctcgatgtaatcctccttctggatggaagcagctcgttcccggcatcttatttcgacgaaatgaaatctttcgcaaaagcatttatttctaaggcaaatatcggcccgcgcctgactcaggtttcagtattgcaatacggctcaattacgacaattgatgtcccgtggaatgtggtacccgagaaggcccatttgctttctcttgtagatgtgatgcaacgagaaggaggtcccagtcaaattggcgacgccttgggcttcgcagttcgctatttgacctccgagatgcatggagcaagaccaggagcaagtaaagccgtggtcattcttgttacagatgtgtccgttgatagcgtcgatgccgccgcagatgcggcaagaagcaatagagtcacagtctttccgattggtattggtgatcgctatgatgcggcacagcttcgtattttagccggccctgcgggggattcaaacgtcgtcaagctgcagcgtatcgaggatctcccaacaatggtaacacttggcaatagcttccttcataaactgtgcagcggttttgtaagaatctgcatggatgaagatggtaatgaaaaacggccaggggatgtatggacgcttccggatcagtgccatacagtgacgtgtcagccggatggacagactctccttaaatctcatcgggtcaactgcgatcggggccttcgcccctcatgccctaatagccaaagcccggtcaaagttgaagaaacatgcgggtgtcgatggacatgtccgtgcgtgtgcaccgggtcttccacacgccatattgttacatttgacggccagaattttaaattgacaggctcttgcagctatgtgctcttccaaaacaaagaacaggatctggaagtgatactgcacaacggtgcgtgcagtcctggggctcgccaaggttgcatgaaatcgatagaagtgaaacatagcgcgttgagcgtcgaacttcattctgatatggaagtaacagttaatgggcgtcttgtttccgttccatatgtcgggggtaatatggaagtgaatgtctatggcgcgataatgcacgaagtccgcttcaatcatctaggacatatcttcacattcacgccgcagaataatgaatttcaactgcagctgagccctaaaacctttgcatccaagacgtatggcctgtgtggaatttgtgacgaaaatggggccaatgatttcatgttaagagatggcacagtcacgacggattggaaaaccttggtacaggaatggacagtgcagcggccaggccagacctgccaacctatcctggaagagcagtgtttagttccggattcttcacattgccaagttctccttctgccgttatttgccgaatgccataaggtgctggcccctgccacgttctacgctatttgccagcaagattcgtgtcaccaagaacaggtctgcgaggtgattgcctcttatgcacacttatgccggacgaatggagtttgtgtcgattggcgtacccctgacttttgtgcgatgtcatgcccgccttccctagtctataaccattgcgaacatggctgtcccaggcattgcgatgggaatgtgtcaagttgtggcgaccatccgtcggagggttgcttttgtcctccggacaaagtcatgttagagggctcttgcgtgccagaagaggcttgtacacaatgtattggcgaagatggagtgcagcaccaattcctcgaagcctgggtgccagatcatcagccttgccaaatttgtacgtgcttatcaggccgtaaagtgaattgtacgacacaaccgtgtcctaccgcaaaggcgcccacctgcggcttatgcgaagtcgctcgattgcggcagaatgccgaccaatgctgcccggagtatgaatgtgtctgcgatcccgtcagctgtgatcttccgccggttccacattgtgagcgagggcttcaaccgacattaaccaatccgggcgaatgtagaccgaactttacatgtgcctgtagaaaggaagagtgcaaaagggtatccccaccgagctgtcccccacataggctaccgacgttaagaaaaacccagtgttgtgatgagtatgagtgtgcttgcaattgcgtgaatagcactgtcagctgtccgcttggttatcttgcttcaactgctacgaacgattgcggttgcacaacaacgacttgtctccctgacaaggtttgcgtccatcgcagtactatctatcccgttggtcaattttgggaagaagggtgtgatgtctgtacatgtactgacatggaggacgctgtcatggggttgagagtcgctcagtgctcccagaagccttgtgaagattcgtgcagatccggatttacttatgtgctccacgagggcgaatgctgcggacggtgtttacctagtgcatgtgaggtggtgacaggctcaccgaggggtgacagccagagttcttggaaatctgttggttcccaatgggcttcaccggagaacccatgtcttataaacgaatgcgtacgcgtgaaggaggaggtcttcattcaacaacgcaatgtcagctgtccgcagcttgaagtgccggtatgccctagcggttttcaactgtcctgtaagacctccgcttgctgtccaagttgtagatgcgaaagaatggaggcttgcatgctgaatggcacagtaattggccctggcaaaacggttatgatcgatgtctgcacgacgtgcagatgcatggtgcaggtgggcgtaattagtggatttaagctggaatgtagaaaaacaacatgtaacccgtgcccgttaggttacaaggaagaaaataacaccggtgagtgctgtggacgttgccttcctacagcatgcaccatccaactgagaggcggacagatcatgaccttgaaaagagatgagacactgcaagatggatgtgacacacatttctgtaaagtcaacgaacgtggagaatacttttgggaaaaaagagttaccggttgtcccccctttgatgaacataaatgtcttgcggagggaggtaaaatcatgaagatcccaggcacatgttgtgacacatgtgaagagcctgagtgtaacgatatcacagcccggctgcaatacgttaaagtcggatcttgcaaaagcgaggtcgaagtcgacattcattattgtcaagggaaatgcgcatcaaaagctatgtattcgatcgacattaacgacgttcaggatcaatgttcttgttgcagcccgacccgtacagagccgatgcaggtagcattgcattgtaccaacggttcagttgtttaccatgaagtcctaaatgccatggaatgtaaatgtagcccacgtaaatgctcaaaa

SEQ ID NO: 21396 - DNA, 8439 bp, Artificial Sequence
  Description of Artificial Sequence: Synthetic coding sequence
atgatccccgctagatttgccggggtactgctggcccttgccttgatccttcctggcaccctctgtgctgagggcacccgaggacgcagttctaccgctaggtgttccttatttggttctgattttgtaaacacatttgacggcagcatgtatagtttcgctggatattgctcatacctgctcgcgggtggatgccagaaacgatcattctctatcattggggacttccaaaacggaaaaagggtgagtttatcagtctacttgggcgaatttttcgatatccacctgtttgtgaacggaactgtaacccagggagaccagagggtgtctatgccttatgcttctaagggactgtacctagaaacggaggctggctactacaaactatcaggggaagcctatggctttgtcgcacggatcgacggctctgggaacttccaggtgctgctgtccgaccgttacttcaacaagacctgcggcctctgcggaaactttaacatattcgccgaggacgacttcatgactcaggaaggcacactgacaagtgacccttacgatttcgcgaactcgtgggcactctcctccggagaacagtggtgtgaaagggcttccccgccctcctccagctgtaacatctcaagcggtgagatgcagaagggactgtgggaacagtgccagctgctgaagtctacctccgtgtttgccaggtgtcatcccttagtggacccggaaccctttgtggcactatgtgagaagacgttgtgtgagtgtgcaggtggcctggaatgtgcatgtccggccctgcttgaatatgcacgaacatgcgcgcaggaggggatggttctgtacggctggaccgatcatagtgcttgcagcccagtatgccctgcaggcatggaatacagacagtgcgtctcaccctgcgcacgaacttgccaatccctgcacatcaatgaaatgtgccaagagagatgtgtcgatgggtgcagctgcccagagggccagctgctagatgaggggttgtgtgtggaatctacagaatgcccttgtgtgcactcaggaaagagatacccccccggtacatctctgagcagggactgcaatacttgcatctgtagaaactctcagtggatatgctcaaatgaggaatgtccgggagaatgcctggtgacagggcagtcccacttcaaaagcttcgataaccggtacttcacctttagtgggatttgccagtacctccttgcacgtgactgtcaagaccactctttttctatagtcattgagaccgtacagtgtgccgacgatcgtgacgcagtttgcacacgatcggtgactgtgagacttccaggcctgcacaatagcttggtgaagctgaagcacggcgctggagttgccatggatgggcaagatgtgcagctccctttactgaagggggacctccgtatacagcacacagtgaccgctagtgtgagactcagctacggcgaagatctgcagatggattgggacgggcgcgggcggctgctcgtcaagcttagcccagtctacgcaggcaagacatgcggcttatgcggaaactacaatggaaaccagggtgacgactttctgacaccctccggcctggccgaaccacgagtcgaggatttcggcaatgcctggaaactgcacggggactgccaagatctgcagaaacagcattccgacccatgcgccctgaatccaaggatgactcgcttcagcgaggaggcctgcgcagttctaacctctccaacattcgaggcatgtcatcgcgccgtgtccccgctcccatacctgcgtaattgcagatacgacgtgtgttcatgtagcgacggcagagaatgcctgtgcggcgcactggcttcttatgcagccgcttgcgcaggccggggggttcgggtggcttggagggagcccggccgatgcgagctaaactgtcctaaggggcaggtctacctacaatgcggtaccccttgtaacctgacctgtcgatctctgagctaccctgatgaggaatgcaatgaggcttgtctcgaaggatgcttctgcccccccggcctgtatatggatgagcgcggggattgtgtgcccaaggctcaatgtccctgctactacgatggtgagatctttcagccagaagatatcttcagtgatcatcacactatgtgctactgcgaggatggtttcatgcattgcactatgagtggtgtgccagggagtttgctccccgatgcggtgctctcgagcccactctcccatcgaagcaaacgttcactctcgtgcaggccacctatggtgaaactagtgtgccctgctgataatctgagagccgaaggattagaatgtacgaaaacatgccaaaactatgacctggaatgtatgagcatgggatgtgtaagcggctgtctttgtcccccggggatggttcgacacgaaaacagatgtgtagccctcgaacgatgtccttgcttccatcagggcaaggagtatgctcccggtgagaccgtaaaaattggatgcaatacgtgcgtgtgtcaggatagaaagtggaactgtaccgatcacgtttgcgatgcaacctgcagcacaatcgggatggcccactatctaacctttgatggccttaagtatttatttccaggagaatgccagtatgtcctcgttcaggactactgcggctcaaatcctggaacttttcgtatactggttggaaacaaaggctgttcccacccatctgtgaagtgtaagaaacgggttacaattttggtggaagggggcgaaatagagctcttcgacggcgaggtgaacgtgaagagacccatgaaagacgaaactcattttgaagtggtagaatccgggcgatatatcattttgctgctgggcaaggctctttccgtcgtttgggatagacacctgtctatttccgtggtgcttaagcaaacgtatcaggaaaaggtgtgtggcctgtgcggtaacttcgatgggattcagaacaacgacttgacctcaagtaacctgcaggttgaggaggaccctgtggatttcggtaactcctggaaagtgagctctcaatgcgctgatactcgaaaagtgcccttggatagctctccagcaacctgtcacaacaatatcatgaaacaaaccatggtggacagttcctgcaggatcctaacctccgatgttttccaggattgtaacaagttggtcgacccagaaccatatctggatgtttgcatctacgatacgtgttcatgtgaatccattggggattgcgcctgtttctgtgatacaatagccgcatacgctcacgtgtgcgctcagcacggcaaggtcgtaacatggcgcacggctacactgtgtcctcagagttgtgaagagcgtaatctgagggagaacggctacgaatgcgaatggcggtacaactcctgtgcacctgcctgccaggtgacctgtcagcacccagagcccttggcgtgccccgtgcagtgcgtcgaagggtgtcacgcgcactgtccaccggggaaaattctggatgagctgctccagacttgcgtcgaccccgaggactgcccggtgtgtgaggtggcagggaggaggttcgctagcggcaagaaggtgacattgaaccctagcgatccggagcattgccagatctgccattgtgacgtcgtaaacctgacctgtgaggcctgccaagagcccgggggactcgtggtcccacctacagatgcgccggtatcgccaaccacactctacgtggaagacatcagcgaaccccccctgcacgacttctattgctctcgtctgctagacttagtgtttttgctcgacggaagttcacggcttagcgaggctgagttcgaggtgctgaaggcctttgtagtcgacatgatggaaagactgcgtatctcccagaagtgggttcgggtggccgtagttgaatatcacgacgggagtcacgcatacattggcctgaaggacagaaagcgacccagtgagctgaggagaattgcaagccaagttaaatatgcaggctcgcaggttgccagcacttccgaggtgctgaagtacactctgttccagattttctcgaaaattgacagacctgaggcatctagaatcactctgctactcatggcatctcaggagcctcagaggatgagtaggaacttcgtcagatatgtccagggactgaagaagaagaaggtcattgtcatccctgtcggaatcggcccccatgccaacttgaaacagattagactgattgagaagcaagccccagaaaacaaggcttttgtgctaagttcggtggatgagctggagcagcagcgggatgaaatcgtgtcatacctatgtgatctggctccggaagctcccccaccaaccctaccccctgacatggctcaggtgacagtggggccagggttactgggtgtatccaccttgggacctaagaggaactccatggtgctggatgtagcgttcgtcctggaaggaagcgacaagatcggggaggctgacttcaatcgatctaaggagtttatggaagaagtgatacaacgaatggacgttgggcaggattcaatccacgttacagtgctgcagtactcttatatggtgaccgtcgaatacccattcagtgaagcccaaagcaagggagatatcttacagagagtaagagaaataaggtatcagggagggaaccgaaccaacacgggattggcactgcgatatctgtccgatcattctttcctggtgagccaaggagatcgagaacaggcgcccaaccttgtttatatggtgacgggcaatccggctagcgacgaaatcaaacgattgcccggagatattcaggtcgttcccatcggtgtgggccccaacgcaaacgtacaggagctggagaggatcgggtggccaaatgcgcctatcctgatacaagacttcgaaacactgcctcgagaggcacccgatctggtgctgcagcgttgctgcagtggggaaggactgcagataccgaccctgagccccgcccccgactgttctcaaccgctcgacgtgattttactgctggacgggagttccagctttcccgcgtcctatttcgacgaaatgaaatccttcgctaaagcgttcatctccaaggctaacatcggacccaggttaacccaggtcagtgtgctgcagtatggctccatcacaactatcgatgttccatggaacgtggtcccggagaaagctcacttgctttcgttggtggacgtgatgcagagggaaggcggaccatcgcaaattggcgatgccttgggtttcgcagtgcgttacctcactagcgagatgcacggcgctcgacctggtgccagcaaagcagtcgtgatcctggtaaccgacgtctccgttgattctgtggatgccgccgctgacgccgcccgatccaacagagtcaccgtatttcctattgggatcggggatcgttacgatgccgctcagttgcggatcctggccggaccggctggggattctaacgtcgtcaagctccagagaattgaggacctgcccaccatggtgacactgggaaattctttcctgcacaagctgtgctccgggtttgtcaggatatgcatggatgaggacggcaacgagaagagacccggcgacgtctggacccttccggatcagtgccacaccgtcacttgccagccagacgggcagaccttactgaagtcccatagagtgaactgcgatagaggactcagaccttcttgtcctaattcccagtccccggtgaaagtggaagaaacctgtgggtgcaggtggacatgcccctgcgtgtgtacgggctcctccactcgtcatattgtgacattcgatggccaaaactttaaacttacggggtcttgcagttatgtcctctttcagaacaaggaacaggatctggaggtgatcctgcataacggcgcctgctcccccggtgccaggcaaggctgtatgaagagcattgaagttaaacattccgcgttgtccgttgagctgcatagcgacatggaggtcacagtcaatggccgactggtgtcagtcccctatgtcggaggaaacatggaggtgaatgtttatggggctatcatgcacgaagtaagatttaaccacttaggacacatattcacttttaccccacagaacaatgagttccaacttcagctgtcacccaagaccttcgctagcaagacttatggtctgtgcggtatctgtgatgaaaacggtgccaatgactttatgctgcgcgacgggaccgtgaccacggattggaaaaccctggttcaggagtggacagttcagcgacctggtcagacgtgtcagccaatcttagaagaacagtgtctggtgcctgactcaagccattgtcaggtgctcctgttgcctttattcgctgaatgccacaaggtgctcgcccccgcgaccttttacgcaatttgccagcaggatagttgtcaccaagaacaagtgtgcgaggtaatagccagctacgctcacctgtgccgaactaacggggtctgtgtcgactggcgaacacctgatttctgcgctatgagctgtccgccttcactagtttataatcattgtgagcacggctgccccagacattgcgatgggaatgtgagctcttgtggggaccatccctccgagggatgcttttgccccccggataaggtgatgctagagggatcttgcgtaccagaagaggcgtgcacgcagtgtataggcgaggacggagtgcagcatcagtttttggaggcctgggtgccagaccatcagccatgtcagatctgcacttgcctcagcgggaggaaggtgaactgtaccactcagccctgtccgaccgctaaagctcccacctgtgggttatgtgaagtcgcacgacttcgccagaacgcagatcagtgctgcccagaatatgaatgcgtctgtgacccggtgtcctgtgatctgcctcccgtgcctcactgtgagaggggcttgcagccgaccctcactaatccaggtgagtgcaggccgaattttacctgtgcctgcaggaaagaagaatgcaagagagtctccccacctagctgtcccccccaccgtctccctacgctgcggaaaacccaatgctgcgacgaatacgaatgtgcttgtaactgcgtcaattctaccgtgtcctgtccattaggatacctggcttcaaccgccacaaatgattgtggatgtactaccaccacttgtcttccagacaaggtctgtgttcataggtccacaatctaccctgtgggacagttttgggaagaggggtgtgacgtgtgtacctgcaccgatatggaggacgctgtaatgggcctgagggtagcccagtgctctcagaaaccttgcgaggattcatgtagatctggcttcacctatgtgctgcacgaaggcgaatgctgcggccgatgtttgccaagcgcctgtgaagtggttaccggcagtccacgaggggatagtcaaagctcctggaaatcagtgggaagtcaatgggctagtcctgagaatccatgtttgattaacgagtgcgtgcgcgtgaaggaagaggtctttattcagcagagaaatgtatcttgtccacaactggaagttcctgtgtgtccttcaggttttcagctatcctgtaagaccagcgcttgttgccctagctgtcggtgcgaaagaatggaggcttgcatgctgaacggtacagttatcggacccggaaaaactgtgatgatcgatgtgtgtacaacctgccgctgtatggtgcaagtgggcgtgatcagtggattcaaattggaatgcaggaagactacctgtaacccctgtcccctcggttataaagaggagaataatacaggcgaatgctgcggtcgttgtctgcccaccgcctgtacaatccaactccgaggcgggcagatcatgacactgaagagggatgaaaccttacaggatgggtgcgacactcacttttgcaaggtcaacgagcgaggggaatatttttgggagaagagagtcacaggctgccccccttttgatgaacataaatgcttagcggaagggggaaagatcatgaagatccccggcacatgttgtgacacctgcgaagagccagaatgtaatgacatcacagcacgactgcagtatgtgaaggtgggctcctgcaagagcgaagtggaagtggatatccattattgtcaggggaaatgtgcctctaaagccatgtactctattgacattaacgacgttcaggaccagtgcagctgctgtagtccaacacggaccgagcccatgcaagtcgctttgcactgcacaaacggctccgtggtgtaccatgaagtccttaatgcaatggagtgtaaatgttcccctcgcaagtgttcaaag

SEQ ID NO: 21397 - DNA, 8439 bp, Artificial Sequence
  Description of Artificial Sequence: Synthetic coding sequence
atgatcccagcccggtttgctggcgtacttctcgccttggcgctcatcctgccagggaccttgtgtgctgaaggcactcggggccgatcaagcactgcccggtgctccctttttggtagtgatttcgtcaatacctttgatgggagcatgtacagcttcgccggatattgttcttacctgctcgcagggggatgtcagaaacggagttttagtataatcggcgactttcaaaatggtaaaagagtgtctctgtctgtctatctgggagagttctttgacatacatctgttcgtgaatggaacagtgacccagggggaccagagggtctccatgccctacgccagcaaaggtctgtatcttgagaccgaagcaggttattacaaactctcaggggaggcatatggatttgtggcacgtattgacggaagtggaaacttccaggtgcttctgagcgaccgctactttaataaaacctgcgggctgtgcggtaacttcaacatcttcgctgaagacgatttcatgacacaagaaggtactcttacaagcgatccgtacgactttgcgaacagctgggccctcagtagcggtgagcaatggtgcgagagggcctccccaccctcgtcctcctgtaatatctcctcaggagagatgcagaaaggactgtgggaacagtgccaattactaaagagcacatccgtcttcgcgaggtgtcaccccctggtggacccggagcctttcgtggcactgtgcgaaaaaacgctgtgtgaatgcgcaggaggattagagtgcgcctgtccagcactcctcgagtatgcacgcacctgtgcccaggagggcatggtcttgtacggctggaccgatcactctgcctgcagccctgtttgtcccgcaggaatggagtataggcagtgtgtgtctccatgcgcccgcacttgccaatctctgcatatcaatgagatgtgccaggagagatgcgtggacggatgcagctgtcccgagggacagctgctagacgaggggctgtgcgtcgagagtacagagtgcccctgcgtgcattcaggcaaacgctaccctccagggacctcactctctcgcgattgcaatacttgcatctgccggaactcccagtggatttgtagtaacgaggaatgtcctggcgagtgtttggtgaccggtcagtctcactttaagtcttttgataacagatactttaccttctccggtatatgtcagtaccttctggcaagagattgtcaggatcattctttctctatcgtgatagagactgtgcagtgcgccgacgaccgggacgccgtgtgcaccagatccgtgaccgtccgcctcccagggttgcacaattcactggttaagttgaagcatggagccggggtagcgatggacggccaagatgttcagctgccacttctgaagggcgatctgcgaatccagcacacagtcacggctagcgttcgactctcgtacggcgaagacctacagatggattgggatggccgtggcagactcctggtgaagctttctcctgtctacgctggcaagacatgcgggctctgtgggaattataacggaaatcagggcgatgactttcttaccccatcagggctcgccgagcctagggtggaggattttgggaatgcctggaaactgcacggagactgccaggacctacagaagcaacattctgacccctgcgctctgaacccccgcatgactaggttttcggaagaggcatgcgccgtgcttacatctcctacttttgaagcctgtcacagggctgtgtcccctctgccatacctcagaaattgtagatacgacgtgtgctcctgtagcgacggcagagaatgcctctgcggcgccttggcttcctatgcagccgcttgcgccgggagaggagtgcgggtggcgtggcgcgagcccggtcggtgtgaattaaattgtccaaagggccaagtgtatctgcagtgtgggacaccgtgcaatctgacatgtcggagtctctcatatccagacgaggagtgtaatgaagcgtgcctggagggatgcttttgccctcctggtctctacatggatgaaaggggggattgcgtaccaaaggctcaatgcccttgttattacgacggcgaaatctttcagcctgaggatatcttctccgaccaccataccatgtgctactgtgaagacggattcatgcattgcactatgagcggagttcctggcagtctgctgccggatgcagttctgagctcccctctttctcataggtcaaagagatctcttagttgtcggccgccaatggtcaagctcgtctgccccgccgacaacctgcgggccgagggactggagtgcactaaaacatgtcagaattatgacttggaatgcatgagcatgggatgcgtgagcggatgcctctgtccacccggcatggtgcggcacgagaataggtgcgtcgcactggagaggtgtccctgctttcaccagggcaaggaatatgctcccggggagactgttaaaattggttgtaatacatgtgtctgccaggacaggaaatggaattgtaccgaccacgtctgcgacgctacttgcagtacgattgggatggctcactatctcacgttcgacgggctgaagtatctcttccccggcgagtgccagtatgtgctggtgcaagactactgtggctcgaatccggggactttcaggattctagtgggaaacaagggctgttcacatccatctgttaagtgtaaaaaacgagttacaattttggtggaaggcggagagatcgaactgtttgatggcgaagtgaatgtaaaacgaccaatgaaagacgagacacacttcgaagttgtggaatctgggaggtatatcattttgctgctcggcaaggccctgtccgtggtctgggacaggcacctgtctatcagtgtcgtcctgaagcagacatatcaggaaaaagtgtgcggcctttgtggaaatttcgatggcattcagaacaatgacctgacatcttctaacctgcaggtggaagaggacccagtggatttcggaaacagctggaaggtgagcagtcaatgcgccgacacccgcaaagttcccctggactccagtccggccacctgccataacaatatcatgaagcagacaatggtggactctagctgccggattctaacatccgatgtgttccaggactgcaacaagctggtagatcctgagccatatttggacgtgtgcatttacgatacatgcagctgcgagtctattggagattgtgcctgtttttgtgacacaatcgcggcatatgcccacgtctgtgcccaacacggcaaagtagtgacgtggcgaacagccaccctttgcccccagagctgtgaggaacgcaacctgcgggaaaacggatacgagtgcgagtggcgctataattcatgcgcacctgcttgccaagtcacgtgtcagcacccagagcctctggcatgtccagtccagtgcgttgaggggtgtcacgcacactgcccgcctggtaagattctggatgaattgctgcaaacttgcgttgacccggaagactgtcctgtgtgtgaggtggcagggcggaggtttgcctcaggcaagaaggtcacactcaacccaagtgaccctgaacactgccagatttgtcattgtgatgtggtgaacctgacctgcgaggcctgtcaggagcctggcggtttggtggtcccacctacggacgcaccagtgagcccgacaaccttgtatgtggaggatatctctgagcctcctcttcatgatttctactgctcccggctactggacctggtcttcctgttagatggatcttcccgcctttcagaggcagagttcgaggtgttaaaggccttcgttgtggacatgatggaaagactgaggatctcccagaagtgggtacgcgtggccgtggttgaataccatgacggctcccatgcctacattggactcaaagatagaaagcgaccctccgagctcaggcgcatcgcctcacaggttaaatatgcaggttcccaagttgccagcactagcgaggtactcaagtacaccctgtttcagatcttctctaagatcgatcgtccagaggccagccgcatcactttattactgatggccagtcaggagccacagcgaatgagccggaatttcgtgcgctacgtgcagggcttaaagaagaaaaaagtcatcgttatccccgtggggataggaccacatgctaacttaaagcagataagattgatcgagaagcaggcacctgagaataaagcatttgtcctcagttctgtcgatgagttggaacaacagcgggacgaaatagtgtcttatctctgtgacctggcaccagaagcccccccccctactctgccacccgacatggctcaggtgaccgtggggccaggcctcctaggcgtgtccactctaggcccaaagaggaacagtatggtgctggacgtagcctttgtgttggagggcagcgacaaaatcggggaagctgacttcaatagaagcaaggaatttatggaggaagttatacaaaggatggacgtcgggcaagacagcattcacgtgacggtgcttcagtactcatatatggtgacagtggaataccctttcagtgaggctcagagtaagggcgatatcctgcagagggtgcgagagattcgctaccagggcgggaaccgaactaatacgggactggcactgagatacttatccgaccattcttttttggtaagccaaggtgacagagaacaggcaccaaatctggtctacatggtgaccggtaaccccgcctctgacgagatcaaaagactcccaggcgatatacaggtagtacctatcggagtcggacctaacgccaatgtccaggagttggagagaatcggctggcctaacgcacccattctgattcaggactttgagacccttccgagagaggcgcctgatttggtgctgcaaagatgctgctctggggagggcttgcagattccaaccctctcaccagctcctgattgtagccagccccttgatgtgattcttttgctagacgggtcaagctcatttccagcctcgtatttcgatgagatgaaatcttttgccaaagccttcattagtaaagccaacatcggcccccggcttactcaggtaagtgtgctgcaatatggatcaattacaacgatcgatgtaccatggaatgttgtcccggaaaaagcccacctgctgtctctagtggacgtaatgcaaagagagggcggtccatcacagataggcgatgcgttgggttttgccgtgcggtacctaacctctgaaatgcacggggcgaggccgggagcctctaaggctgtggtaatattggtgaccgacgtctcggtcgacagcgtggacgctgccgcagacgcagcaaggtctaaccgggtaaccgtgtttccgatagggattggcgaccgctatgacgcagcgcaactaaggattctcgccggacccgctggcgattcaaacgtcgtgaaactgcagcgaattgaggatctcccaacaatggtgaccctagggaactcattcctgcacaagctttgctccggcttcgtcagaatctgtatggatgaagatggcaacgaaaagcgacctggggacgtgtggaccctgccagaccagtgccacaccgttacctgccagccagacggacagaccctgctgaaatctcatcgagtgaactgcgatcgcggcctgcgaccctcatgccctaacagccaaagtcctgtgaaagtcgaggaaacctgtggatgtagatggacctgtccctgtgtgtgtactggctcatccactcgccatatagtgacatttgacggccaaaatttcaagctcaccgggagctgtagctatgttctgttccaaaacaaagaacaagacttggaggttattctgcataacggtgcctgcagtcccggcgccaggcagggctgcatgaaaagcatagaggtgaagcactcagctctgtctgtggagctgcactccgacatggaggtcaccgttaacggccgattggtgagcgtgccatacgtcggaggcaacatggaagtgaatgtgtacggagctataatgcacgaagtgagattcaatcacttggggcatatcttcacctttaccccccaaaacaacgaattccagttacagctgtcacccaaaacatttgcttccaaaacttatggtttatgcggcatctgtgacgaaaatggagccaatgactttatgctgcgcgacggaaccgttacaacagattggaaaacgctggttcaggaatggaccgtccaacgccccggacaaacttgccagcctatattggaggagcagtgtttagtcccagattcttcgcactgtcaggtgctcctgcttcccttgtttgccgaatgtcataaggttctcgcaccagcaacgttttacgcaatctgtcaacaggattcttgccaccaggaacaagtgtgtgaggtcattgcatcctacgcccacctatgccggacaaatggtgtctgtgtggattggagaaccccggatttttgtgccatgtcttgccctccatctctcgtgtacaatcattgcgaacacggttgtcccaggcactgcgacggcaatgttagttcctgcggggaccatcccagtgagggctgtttctgtccacctgacaaagtgatgctcgaaggttcatgtgtccctgaggaggcctgtactcaatgtattggggaggacggagtgcagcatcagtttctggaagcatgggtccccgatcatcagccctgccagatctgtacctgtctttccggaaggaaggtcaattgcaccacacagccctgtccaacggcgaaagcccccacttgtggactgtgtgaggtggccagactgcgccaaaacgctgatcagtgttgtcctgaatacgaatgtgtttgtgaccccgtgtcctgtgatctcccccccgtaccgcactgtgaacgaggcctgcagcctactctcactaacccgggggaatgccggccaaattttacatgtgcttgcaggaaagaggaatgcaaacgcgtctctcccccatcctgcccgccacaccggctacccactctgaggaaaactcagtgttgcgatgaatacgaatgcgcgtgtaattgcgtcaatagtaccgtaagctgtcctctcggctatcttgcctccacagcgacaaacgactgcgggtgcactacgacaacatgcctgccagataaggtgtgtgtgcacaggagtactatctatcctgtgggacaattctgggaagaaggctgtgatgtgtgcacctgtactgatatggaagacgccgtgatgggactgcgagttgcacagtgctcccaaaagccgtgcgaggatagctgccgtagcggattcacatatgttctccatgagggcgaatgttgtggcagatgcctgccctccgcatgtgaggtggtgacaggaagtcctcgcggggattcccagtcgagttggaaatcagtgggctcgcagtgggccagcccggagaacccctgcctcataaacgagtgtgtccgcgtgaaggaagaggtcttcatccagcagagaaacgtgagctgcccgcagttggaggtgcctgtgtgtccctccggcttccagctctcttgcaaaacgtctgcatgttgcccttcgtgtagatgcgaacgcatggaggcgtgtatgctgaatggcaccgttatcggcccaggaaagaccgttatgatcgacgtatgcacaacttgccgttgtatggtacaggtgggcgtaatctcaggattcaaactagaatgcaggaagacgacatgtaatccttgtcccctgggatacaaggaggagaataatacaggagaatgctgcggtcgatgcctgccgacagcctgtaccatccaattgcggggcggacaaatcatgaccctgaaacgcgatgaaacactgcaggacggatgtgatacacacttttgcaaagtcaacgaacgcggggagtacttttgggaaaagagagttaccggctgtcctccctttgacgaacataaatgtttggccgaaggtggcaaaatcatgaagatacccgggacgtgctgtgacacatgtgaagaacccgaatgtaacgacatcactgcaaggctccaatacgtcaaagtgggcagctgcaagtctgaggtggaggtcgatatacattattgccaaggcaagtgcgcttccaaagcaatgtatagcatagacatcaatgacgtccaggaccaatgtagctgctgttctcccacacggaccgagccaatgcaggttgccctgcattgcaccaacgggagcgtggtttaccacgaggtcctcaatgccatggagtgtaaatgctcgccgcggaagtgttccaag

SEQ ID NO: 21398 - DNA, 8439 bp, Artificial Sequence
  Description of Artificial Sequence: Synthetic coding sequence
atgatcccagccaggtttgccggggttctacttgccttagccttgatccttcccgggacactttgtgctgaggggacacgcggccggagttctaccgctcgatgtagcctgttcggttctgattttgtgaatacgttcgacgggtctatgtactcatttgccggctattgctcctacctactggctggcgggtgtcaaaagcgcagcttctcaatcataggcgattttcagaacgggaaaagggtgagtctgagtgtttacctcggagagttttttgatatccacttatttgtgaacggcactgtcacacagggcgatcagagggtctcgatgccatacgccagcaaaggtctctatctggagacagaggccggttactataagctgtccggcgaagcctatggcttcgtagctaggattgacggttctggcaacttccaggttctcctgagtgataggtatttcaataagacttgcgggctgtgcggtaactttaacatattcgcagaggacgacttcatgacccaggaagggacactgacctctgacccctatgacttcgcgaacagctgggccctcagttccggcgaacaatggtgcgaaagggccagccctccaagctcaagctgtaatatcagttctggggaaatgcaaaaggggctgtgggaacagtgccagctgctaaaaagtacatctgtctttgccagatgccacccattagtggaccctgagccgttcgtggcgttgtgtgagaaaactctgtgtgagtgtgctggaggactggagtgcgcgtgccccgcccttctggagtacgcgaggacctgcgcccaggaagggatggtgctatatggctggacagaccactccgcctgttcccccgtttgccccgcgggcatggagtatcggcagtgcgtgtcaccctgcgctcgtacatgccagagtttgcatatcaacgagatgtgtcaggagagatgcgtggacgggtgcagctgccccgagggccagctgcttgacgaggggttgtgtgtcgaatccacagaatgcccatgcgtgcattctggcaagcgctaccctccgggaacgtccttgtccagagactgtaatacttgcatttgcaggaacagtcagtggatctgtagtaatgaagagtgccctggagaatgtcttgtgacagggcaatcccactttaaaagctttgacaaccgctattttaccttcagcggcatctgccaatatctgttggcccgggactgtcaggaccactctttttctatcgtcatagaaacggtgcaatgcgctgacgatcgggatgcagtatgcacccggtctgtcacagtgcggctccccggactccacaactcactagtgaaactgaagcacggcgccggtgtcgcgatggatgggcaggacgtccaattacctttactcaagggggatctgagaattcagcacacagtgactgcttcagtgcggttgtcgtatggcgaggatctgcagatggactgggatggccgggggagattgctcgttaaactctctccagtttacgccgggaagacatgtgggctgtgtggcaactacaacggcaatcagggagacgattttctcaccccctctggactggccgagcccagggttgaggactttggaaatgcatggaagcttcatggggactgtcaggacctacagaaacagcattcggacccttgtgccctcaaccctaggatgactcgtttttctgaagaagcttgcgccgtgttgacctcaccgacttttgaagcctgccacagggccgtgagtcctctgccctacctgaggaactgccgatatgacgtgtgttcatgttcagatgggcgcgaatgcctttgcggggccctggcctcatatgccgccgcttgtgcaggacggggagttagagttgcctggagagagccgggccggtgtgagctgaactgcccaaaaggccaagtttatttgcagtgtggtaccccatgtaatcttacttgtcggtcactgtcctaccctgacgaagaatgcaacgaggcatgcctggagggctgcttctgcccccccggactgtacatggacgaacgaggcgactgcgttcctaaagcccagtgcccgtgttattacgacggcgaaatctttcagccagaggacatattcagcgaccatcatacaatgtgttactgcgaggatggattcatgcactgtacgatgtccggcgtgcctgggagtcttctgccggatgctgtactgtcctcccccctctcccatagatcgaagaggagcctgagctgtcgacccccaatggtgaagctcgtgtgccccgccgataatcttcgagccgaggggctcgaatgtacaaagacatgccagaactacgaccttgagtgcatgtctatgggctgcgtgagtggctgcctttgtccacccgggatggtgagacatgagaatcgatgcgtcgctttggagcgctgtccgtgctttcaccagggtaaagaatatgctcctggtgagaccgtcaagatcggctgcaatacctgcgtgtgccaggacagaaagtggaactgcaccgatcatgtgtgtgatgccacctgctcgaccattggaatggcccattatctgacgtttgatggactgaaatacctgttcccgggggaatgtcagtatgtgctcgtgcaggactattgtggttccaatcctgggactttcaggattcttgttggaaataagggctgcagccacccaagtgtgaagtgtaaaaagcgcgtgactatccttgtggagggaggcgagatcgaactctttgatggcgaagtgaacgtcaagaggcccatgaaggatgagacgcacttcgaggttgtcgagagcggacgctacataatcctgctgctggggaaagcccttagtgtggtgtgggatcgccacctcagtatttctgttgtactcaaacaaacgtaccaggaaaaggtctgcgggttgtgtggtaacttcgacgggattcagaataatgatttgacaagttctaaccttcaggtagaggaggacccagtagactttggaaatagttggaaagtaagctctcagtgcgctgacacaagaaaggtgcctttggattccagcccagctacatgccataacaatatcatgaagcaaaccatggtggattcttcctgtcgaatcctaacgagtgatgtcttccaggattgcaataagctggttgatccagagccttacctggacgtgtgcatctacgacacatgttcttgcgagagtataggcgattgtgcctgtttctgcgatacaattgccgcttatgcccacgtgtgcgcccagcacggtaaggtggtgacttggcgaacagccaccttgtgtccacagtcttgtgaggagaggaatctccgcgaaaatggctatgagtgcgagtggcgatacaattcttgtgcgccggcctgccaggtgacttgccagcacccagagcccttggcatgtcccgtgcagtgcgtagagggttgccatgcccactgtccccccggcaaaatactggatgagttgcttcagacatgtgtagatccagaggattgtccagtgtgcgaagtggctggcaggcgatttgcctcaggaaaaaaggtgacattgaatccctccgatcctgagcattgccagatctgccactgcgatgttgtcaacttgacctgcgaggcatgtcaagagcccggcggcctagtggtccctcccactgatgccccagtctctccaacgaccctgtatgtggaggatatatcagagccccctcttcacgacttttattgctctaggctgctcgacctcgtgtttctgcttgacggatcaagccggctgagcgaagccgagtttgaggttttgaaagccttcgtcgtagacatgatggagcgtctgcgaatcagccagaaatgggttcgtgtagcagtcgtggagtaccacgacggcagccacgcatacattggcctgaaggatcggaaacggccatcagaactgcggaggatagcatctcaagtgaaatacgctgggtcacaagtggcaagtacatccgaggtgcttaaatataccctgttccaaatcttttcaaaaattgatcggcccgaagcctctcgcattaccctcctcctgatggcttcacaggagccccaaagaatgtctaggaattttgttagatacgtgcaaggcctgaaaaagaagaaggtcatagtcatacccgtcggcatcggtccccacgcgaacttaaagcagatccggctgattgaaaagcaggcccctgaaaataaggcgttcgttctgtccagtgtcgacgagttggaacaacagcgagacgaaatagtgagctacctatgcgatctggccccagaagccccgccaccaactctcccaccagacatggcgcaagttactgttggccccggcttgctgggcgtgtctaccctggggcctaagaggaattctatggtccttgatgttgcctttgttcttgaagggtctgacaagatcggggaggccgattttaaccgatctaaggaattcatggaagaggtgatccagcgaatggacgtggggcaggactcaatccacgtcaccgtgctgcaatacagctacatggttaccgtggaatatcccttttctgaggcccagtctaagggtgatattctccagcgggttcgagagattcgctaccaagggggtaaccgcacaaacacaggcttggccttgagatatctgtcagatcattcgttcctggtatcccagggagacagagaacaggccccaaatctggtgtacatggttacgggcaacccggccagcgatgaaataaagcgattacctggtgacatccaggtcgtcccaattggcgtgggtccaaatgcaaacgtgcaggaacttgagcggataggatggccgaacgcgcccatacttatccaggatttcgaaaccctgcctcgggaagcacccgatctggtcttacagcggtgctgctctggagagggcctgcagattccaacactttcccctgcaccagattgtagtcagccgctcgatgtaattcttctgctcgatggatcatcaagtttcccagcatcgtactttgacgaaatgaaaagcttcgccaaggcatttatttccaaggcaaacatcggccctaggctcacgcaggtgtccgtgctccagtatgggtctatcaccactatcgacgttccttggaacgtagtgccagaaaaagcccatctgctgagcctggttgacgtcatgcagcgggagggaggcccctctcagatcggggatgccctggggttcgcagtgagatacttgacgtccgagatgcatggcgccaggccaggggctagtaaagctgtggtcatcttagtgactgacgtgtctgtagattccgtggatgccgctgccgacgcagcgagatccaatagggtgaccgtttttcccatcggtataggtgatcgctatgacgcggcccagctccgcatcttggccgggcccgccggggactccaatgtggttaaactgcagcgaattgaggacctgccaacgatggtgaccttaggtaactcttttctgcataaactatgctctgggtttgttaggatatgtatggatgaagatggaaatgagaagagaccaggcgacgtttggaccctgccagaccagtgtcacacagtcacatgccagccagatgggcagacactactgaagtcccacagagtgaattgcgacagaggtctgcggccgagctgcccaaactcccaatcccccgtcaaagtggaagagacatgtggttgtagatggacctgtccatgcgtttgtactggatcttctacacgccatatcgtgacgtttgatgggcagaatttcaagcttaccggtagctgctcttatgttctgttccagaacaaggaacaggacctggaagtaatactccacaatggagcctgtagtcccggcgcacggcagggatgtatgaaatccatcgaggttaaacattctgctctttcagtggaattacactctgatatggaggtcaccgtgaacgggaggctggtttccgtcccttatgtcggcggaaatatggaggtgaacgtctacggtgctatcatgcacgaggtacggtttaatcacctgggccacatatttaccttcaccccacagaataacgagttccagctgcagctctccccaaaaacgttcgcaagcaagacttacggactctgcggcatctgcgacgagaacggcgcaaatgacttcatgttgcgtgacggcactgtgactaccgattggaaaactctcgtccaggaatggaccgttcagcgacctgggcagacttgccagccgatcctggaggagcagtgcttggtcccggattcttctcactgccaggtgctgctgctgcctctgtttgcagagtgccacaaggttcttgcccctgccactttctatgcgatatgccagcaggactcatgccaccaggaacaggtgtgcgaggtcattgcaagctacgctcatctgtgcagaacgaatggcgtatgcgtcgattggcggactcctgatttctgtgcgatgagctgtcccccttctctggtgtataaccactgtgagcacggatgtccaagacactgcgatggcaacgtttctagttgcggcgatcacccctctgaagggtgcttctgtcctccagataaggtcatgttggagggatcctgtgtacccgaagaggcctgcactcagtgtattggggaagacggggtccagcatcagtttctcgaagcttgggtccccgatcaccagccttgccagatatgtacttgtctgtctggtcggaaggtgaattgtacaactcagccatgccctacggccaaagcaccaacctgtgggctttgcgaggtagcaaggttgcgtcaaaacgctgatcagtgttgtccagaatacgaatgcgtttgcgacccggtttcctgcgacctgccgccggtgccacactgcgagcggggcctgcagcctactcttactaaccctggtgaatgccggcctaactttacctgtgcatgtaggaaagaagaatgcaagcgcgtgtcgcctccatcatgcccaccacatcggttgccaaccctacgcaaaacccagtgctgcgatgagtacgaatgcgcatgtaattgtgtcaacagcaccgttagttgtccactaggatacctcgccagcaccgctaccaatgattgtggatgtacgacgaccacctgtctgccagataaagtctgcgttcaccggtcaaccatttatcccgttggacaattttgggaggagggatgtgatgtatgcacatgcacggatatggaagatgccgtaatgggcctacgggtggcacagtgctctcagaagccatgtgaggatagctgccgctcgggattcacctacgttctgcacgaaggtgaatgctgtggtcgctgcttgccatcggcatgtgaggtggtgaccggatccccccgtggtgatagccagagtagctggaaaagtgtgggcagccagtgggcgagtccagaaaacccatgtctcatcaacgaatgtgttcgcgtaaaagaggaggtcttcattcagcaacgaaacgtgtcctgccctcagctggaagtgcctgtctgtccgtctggctttcagcttagctgtaaaacatccgcctgctgtcctagctgtcgctgtgagagaatggaggcttgcatgctgaacggcaccgtcattggacccggcaagactgtgatgatcgacgtatgtactacctgtcgctgcatggtgcaagtaggggtaatctctgggttcaaactggaatgcagaaagacgacttgtaacccctgtcctctgggctacaaggaggagaataatacaggtgagtgttgcggcaggtgtttacccaccgcttgtacaatccagctacgtgggggccaaatcatgaccctcaagcgggatgagacccttcaggatgggtgcgatacccacttttgtaaggtcaacgaacggggcgagtatttctgggagaagagagttactggatgtccacccttcgacgaacataagtgcctggccgaaggcggcaagattatgaagattcctgggacatgctgcgatacatgtgaggaacccgaatgtaacgacatcacagcaagactgcagtatgtgaaagtggggagctgtaagagtgaggtggaggtggatattcattactgccagggcaaatgcgccagcaaagccatgtacagtatcgatataaacgatgtgcaggatcagtgcagctgctgttctcctacaagaaccgagccaatgcaggttgcgctacattgcactaacggcagtgttgtctatcacgaagtgctgaacgcaatggagtgtaaatgttctcctaggaaatgtagtaag

SEQ ID NO: 21399 - DNA, 8439 bp, Artificial Sequence
  Description of Artificial Sequence: Synthetic coding sequence
atgatcccggctcggttcgcaggggtgcttctcgctctggcactgatcctccccggcactctgtgcgctgagggaacgcggggcagaagttcgacggctcgctgctcgttgtttggctcggactttgtgaacacttttgatggaagcatgtattccttcgccggatactgctcgtacctcctcgcgggaggatgccaaaagcgctccttttcaatcatcggcgacttccagaatggaaaacgcgtctcgctcagcgtctacctcggagagttcttcgatatccacctcttcgtgaacggcacggtcacccaaggtgaccaacgcgtgagcatgccgtacgcctcaaagggcctttacttggagactgaggctggatactacaaactgtccggcgaggcttacggattcgtggcccgaattgacggctctggtaatttccaggtgctgctctctgaccggtacttcaataagacctgcggtctttgcggaaacttcaacatctttgccgaagatgacttcatgactcaggaaggcaccctcaccagcgacccttacgatttcgccaacagctgggccctttcctccggcgaacaatggtgcgagagggcctcacctccatcctcatcatgcaatatctcctccggtgagatgcaaaaaggcctgtgggagcagtgtcagctgcttaagtcgacctcggtctttgcgcgatgccacccgctggtggacccagagccgttcgtggcactgtgcgaaaagactctctgtgaatgtgcgggcggattggaatgtgcctgcccggccctgctggaatacgcgcgcacttgcgctcaggagggaatggtgctctacggatggaccgaccattcagcgtgctcaccagtgtgcccggcgggaatggagtacagacagtgcgttagcccatgcgcccgcacctgccaaagccttcacatcaatgagatgtgccaggagagatgcgtcgacgggtgcagctgtccggaaggacagctcctggacgaaggactctgcgtggagagcaccgaatgcccttgcgtgcattccggaaagcggtaccctcctgggactagcttgtctcgcgattgcaacacttgcatctgccgcaactcgcagtggatctgctccaacgaagagtgcccaggagagtgcctggtgactggacagtcacatttcaaatcgttcgacaatagatactttaccttttccggcatctgccagtacctcctcgcccgggactgtcaggaccactccttctctatcgtgattgaaactgtgcaatgtgccgacgaccgagacgcggtctgtacccgcagcgtgactgttcgcctgccaggcctgcacaacagcctggtgaaactgaagcacggtgcaggtgtggctatggatgggcaggatgtgcaactccccctcctcaagggagatttgagaatccagcatactgtgacggcatcggtgagactgagctacggcgaggacttgcagatggactgggacgggcgcggccgactgctggtgaagctctcgccagtgtacgcaggaaaaacttgtggcctgtgcggaaactacaacggcaaccagggggacgacttcctcaccccgtcaggactggcagagccccgcgttgaggacttcgggaatgcgtggaagctgcacggcgattgccaggatttgcagaaacagcactcagacccctgcgctctcaaccccaggatgactcggttttcagaagaagcgtgcgccgtcctcacttcgcccaccttcgaagcatgccatagggccgtgtcgccactcccatacctgcgcaattgccgctacgatgtgtgtagctgctcagacggaagagagtgtctgtgcggcgcccttgcgtcatacgctgcagcctgcgcaggacggggagtgagagtcgcctggagagaacctggcagatgtgaactgaattgtccaaagggccaagtctacctccagtgcggaaccccgtgcaatctgacttgcaggagcttgtcctacccggacgaggagtgcaacgaagcatgcctggagggatgcttttgtcccccggggctgtacatggatgaacgcggagactgcgtgccgaaggcccagtgcccgtgttactacgacggagagatattccaaccagaggacattttctcggaccaccataccatgtgctactgcgaggacggcttcatgcattgtaccatgagcggagtcccgggctcgctcttgccagacgccgtgctgtcctccccactgtcccacaggtcgaagcggtcgctgtcgtgtcgcccgccgatggtcaaactggtgtgcccggctgataacctgcgggcggaaggcctggagtgcactaaaacgtgtcaaaattacgatctggaatgtatgtcgatgggatgcgtctcgggatgcctgtgcccgccgggaatggtgcgacacgagaaccgctgcgtggcgttggaacgctgcccttgtttccaccaaggcaaggaatacgcaccaggagaaaccgtcaaaatcggatgtaacacttgtgtctgccaggatcgcaagtggaactgcaccgaccacgtctgcgacgccacgtgctcgactatcggaatggcccactacctcaccttcgacggactcaagtatctgttcccgggggagtgtcagtacgtgctggtgcaagactattgtggatccaaccctggaactttccggatcctggtcggcaacaaaggatgttcacacccatcggttaaatgcaagaaacgggtgacgatcctggtggagggcggagaaatcgaactgttcgatggtgaggtcaatgtgaagcggccgatgaaagatgaaacccattttgaagtcgtggagtcgggacggtacatcatcctgctgcttggcaaggcattgagcgtggtatgggacagacacctctcaatcagcgtggtgctgaagcagacctaccaggagaaggtgtgtggcctgtgcggcaactttgatggtatccagaacaacgatctgactagttcgaatcttcaggtggaggaagatcctgtcgattttggtaactcgtggaaagtgtcatcacaatgcgccgacactcgcaaggtgcctctggattcgtccccggccacttgccataataacattatgaagcaaactatggtggacagtagctgcaggatactcacctccgatgtctttcaggattgcaacaagctggtcgatcccgaaccgtacctcgatgtgtgtatctacgacacctgctcctgcgagtccattggggactgtgcatgtttctgcgataccattgctgcttacgcacatgtctgcgctcagcacgggaaggtggtcacttggcgcaccgccactctgtgcccacagagctgcgaggaacgcaacctgcgggaaaacggatacgaatgcgaatggcgctataacagctgcgctccggcctgccaggtgacttgccaacaccctgaaccactggcgtgcccggtgcaatgcgtggagggatgtcatgcccattgccccccgggtaagatccttgacgaactgctccagacctgcgttgacccggaagattgccccgtttgcgaagtggcagggcggagattcgcctccggtaagaaggtgactctgaacccgtcagacccagaacactgccagatttgtcattgcgatgtggtcaatctgacctgcgaagcgtgccaggaaccaggcgggctcgtggtcccacctaccgatgccccggtgtccccgaccaccctgtatgtggaggacatctctgagcctccgctccacgatttctactgctcaagactgctggatcttgtgttcctgttggacggatcatcccgcctgtcggaggcggagttcgaggtgttgaaggcttttgtcgtcgatatgatggaaaggctgagaatttcccaaaagtgggtgcgcgtggcagtggtcgaataccacgacggatcgcacgcgtatatcggactcaaggatagaaagaggccgtccgagctgcggcgtattgcctcccaggtgaagtacgccggatctcaggtggcctccacctcggaagtcctgaagtacaccttgtttcaaatcttcagcaagattgacagacctgaggcatcccggatcaccctgctgctcatggcttcacaggaaccgcaacggatgtcgcggaacttcgtgcggtacgtgcaaggactgaagaagaagaaggtgattgtaattccagtgggaattgggcctcatgcaaatctcaagcaaattcgcttgatcgagaagcaggcaccagagaacaaagcgttcgtgctctcgtcggttgacgagctggaacagcagcgcgatgaaatcgtgtcctacctctgtgacttggccccggaggccccgcccccgactctcccgccggatatggctcaggtcaccgtgggccctggccttctgggagtttcaactctgggacctaagcggaacagcatggtgctcgacgtggcctttgtgctggaggggtcagataagatcggagaagcggatttcaaccggtctaaggaattcatggaagaagtgatccagcggatggacgtcgggcaagactcgatccacgtgactgtgctccagtactcctacatggtcaccgtggagtaccccttctcagaagcacagtcgaagggagacatcctccagcgcgtgcgcgaaatcagataccagggaggcaatcggaccaacactggactggcactccggtacctgtccgaccactcattcctggtgtcccagggcgaccgcgaacaggcgcccaacctggtctacatggtgacgggaaaccctgcctccgatgaaatcaagcgactgccgggagatatccaagtggtcccgatcggcgttgggcctaacgccaacgtgcaggagctggagcgcatcggttggcctaatgccccgatcttgatccaggacttcgaaacgctcccgcgcgaagctcctgatctggtgctgcaacggtgttgctcaggggagggcctgcagatcccaacgctgtccccggcaccagactgctcccagcctctggatgttatcttgctgctggacggttcctccagcttcccagcgagctacttcgacgaaatgaagagcttcgccaaagcattcatctccaaggcgaacatcggacctcggcttacgcaagtgtcagtgctccagtacggttccatcaccaccatcgatgtcccgtggaacgtggtcccggagaaagctcatctgttgtcacttgtggatgtcatgcagcgggagggaggtcccagccagattggtgacgcccttggatttgccgtcagatacctgaccagcgagatgcatggagccaggccgggggccagcaaggctgttgtcatcctggtgactgacgtatccgtcgactccgtggacgccgccgccgacgccgctcggagcaatagggtgaccgtgttccccatcggtatcggtgacagatacgatgcagcccagctgagaattctcgctgggccggccggagactctaacgtagtgaagctccaacgaatcgaggatctgcccacgatggtcaccctcggaaattcatttctccataagctctgctcaggattcgtcagaatctgcatggacgaagatggaaacgagaaaagacccggagatgtctggactctcccagaccaatgtcacactgttacttgtcaaccggatggacagaccctgcttaaatcacatcgggtgaactgtgatcgggggctgaggccaagctgcccgaatagccagtcgccggtcaaggtggaagagacttgcggatgccgttggacctgcccttgcgtgtgcacgggcagctcaacccgccatatcgtcacgttcgacggccaaaacttcaaactcactggctcgtgctcctatgtgcttttccaaaataaagaacaagacctggaggtgattctgcataatggagcctgctcaccaggagcaaggcaaggatgtatgaagtccatcgaggtcaagcattcggccctgagcgtcgagttgcattcggatatggaggtgactgtgaacggacgcctcgtgtccgtgccatacgtcggcggaaacatggaggtgaacgtgtacggcgcgatcatgcacgaagtcaggtttaatcacctgggtcatatcttcaccttcacccctcaaaacaatgagttccaactccagttgagccctaagacttttgcctccaaaacctacgggctctgcgggatctgcgacgaaaatggagcgaatgactttatgttgcgcgacggaaccgtgaccaccgactggaaaaccctggtccaagaatggactgtgcaacgcccgggacagacctgccaaccaatccttgaagaacaatgcctggtgcccgacagctcgcactgccaggtgttgctgcttcccctgtttgcggaatgtcacaaggtcctggcgcccgccacgttctacgcaatctgccagcaggactcgtgtcaccaagaacaggtgtgtgaggtgatcgcgtcgtacgcccacttgtgccgcaccaacggggtgtgtgtggactggcgtactccagacttttgcgctatgtcgtgcccgccgagcctggtctacaaccactgcgaacacggctgcccgcggcactgcgacggaaatgtgagctcgtgcggggatcacccgtcagaagggtgcttctgcccgccggacaaggtcatgctggaaggatcctgcgttccagaggaggcttgtacgcaatgcatcggagaagatggagtgcagcaccagttcctcgaagcatgggtgccggatcatcagccatgtcagatctgcacgtgtcttagcggacgcaaggtgaactgcaccactcaaccttgcccgactgcgaaggccccaacttgcggactgtgcgaagttgcgcggttgagacagaacgcggaccaatgttgccccgaatacgagtgcgtgtgcgacccagtctcgtgtgacctgccgccagtgccacactgtgaacgcggacttcagccgactcttactaaccccggtgaatgcagaccaaatttcacctgcgcgtgccggaaggaggaatgcaaacgcgtgagtccgccgagctgcccaccacatcgcctccctaccctccgcaagacccagtgctgtgatgagtacgaatgcgcatgtaattgcgtgaacagcaccgtctcctgcccgctggggtacctggcgtcgaccgcgactaacgattgcggatgcactactactacgtgcctcccggataaggtctgcgtgcacagatcgactatctaccctgtgggacaattctgggaggaaggatgcgacgtgtgtacctgcaccgacatggaggacgcggtcatgggcctgagggtggcgcaatgctcccaaaaaccgtgcgaggacagctgccgctcaggatttacttacgtgctgcacgaaggagagtgttgcggacgttgccttccttccgcctgtgaagtggtcaccggttcaccgaggggcgacagccaatcgtcttggaaatcggtggggtcccagtgggcgtccccggaaaacccttgcctgatcaatgaatgcgtcagggtcaaggaagaagtgttcatccaacagcggaatgtctcgtgcccacagctggaagtcccagtctgcccgtcaggattccagctgtcctgtaagactagcgcctgctgtccatcgtgcagatgcgaacggatggaagcctgcatgctcaatggtaccgtcatcggacctggaaagaccgtgatgatcgatgtctgcaccacctgtcggtgcatggtgcaggtgggcgttattagcgggttcaagctcgagtgccggaaaaccacttgcaacccatgccctctgggttacaaggaagagaacaatactggggaatgttgtggaagatgtctgccgactgcctgtaccattcagctccggggtggacagatcatgactctcaagagggacgaaaccctccaggatggctgcgatacccacttctgcaaggttaacgaacgcggcgagtatttctgggagaaacgggtgaccggctgcccgccgttcgatgaacacaaatgcctggcagaagggggaaagatcatgaagatcccgggcacctgttgcgatacttgcgaagagcctgaatgtaatgacatcactgcacgcctgcagtacgtgaaggtgggtagctgtaaatccgaagtggaggtggacatccattattgccagggtaaatgtgcctcgaaggccatgtactcgatcgacatcaatgatgtgcaggaccaatgctcgtgttgttcgccaacccgcactgagcccatgcaggtcgctctgcactgtaccaatggatcggtggtgtaccatgaagtgctgaacgcgatggaatgcaaatgctcgccgagaaaatgctcaaag

SEQ ID NO: 21400 - DNA, 8439 bp, Artificial Sequence
  Description of Artificial Sequence: Synthetic coding sequence
atgatcccggccaggttcgccggggtgctgcttgcacttgccctgatattaccggggacgctttgcgcagaagggacccgcggacgatcatctactgccagatgctctctgttcggcagtgacttcgttaacacattcgacgggagcatgtactcctttgccgggtattgttcctatcttctggctgggggatgccaaaagcgcagctttagcattattggtgattttcaaaatggaaagcgcgtcagcctgagtgtctacctgggcgaattcttcgacatacatctgtttgtcaacgggacagtcacccaaggtgatcagcgcgtcagcatgccatacgccagcaaggggctgtaccttgaaactgaagcgggatactacaaactgagtggtgaggcttatggatttgtggcccggattgacggctccggaaattttcaggtactgttatcggaccggtactttaataagacttgcggcttgtgtggcaatttcaacattttcgctgaggacgacttcatgacacaagaggggactctgacttcagacccctacgacttcgccaattcttgggccctttcctccggtgagcagtggtgcgagagggccagtccaccctccagctcctgcaatatcagctccggcgagatgcaaaaagggctttgggagcagtgtcaactactaaagagtacctccgtgttcgctaggtgccatcccctggtggatccagaaccatttgttgcactgtgtgaaaaaaccctgtgtgagtgcgctggaggattggagtgtgcctgtccagccctgctggagtatgcccgtacctgcgctcaggaagggatggtgttgtacggctggacagatcacagtgcctgcagtcccgtgtgcccagccggtatggagtaccgacagtgtgtgagcccctgcgcacgaacctgccagtcactacatattaatgagatgtgccaggagaggtgcgtggacggctgtagctgcccagagggccaactgctggatgaaggactttgcgtagagagcaccgagtgtccttgcgtgcactcaggtaaaagataccctccaggcactagtttgtcacgagactgtaatacatgcatatgtcgtaattctcagtggatttgttccaatgaggagtgccccggcgagtgcctggtcaccggccagtctcactttaagtccttcgataatcgttacttcacttttagcggaatctgccagtaccttctggctcgcgattgtcaggatcacagcttttcaattgtgattgagactgttcagtgcgctgacgatagggacgctgtgtgcacacggagtgttacagtacgattgcctggactccacaatagtctggtcaaacttaagcacggggcaggagttgctatggacggacaggacgtgcagttgcccttactcaaaggggatctaaggatccaacacacggtgactgcctctgtgcggctttcctatggtgaagacctccagatggattgggacggacgggggcgtctcctggtaaaactgagccccgtttatgccggcaaaacttgcggcttgtgcggaaattacaatggtaaccagggcgacgacttcttgacaccttctggtcttgccgagccccgcgtggaggactttggcaatgcatggaagttgcacggcgattgccaggatttacaaaagcagcactcagatccatgcgcactgaaccccaggatgacaaggttcagcgaggaagcctgcgccgtgcttacctctcctacttttgaggcctgtcaccgcgcagtctccccacttccttacctcagaaactgccggtacgatgtttgctcctgctcagatggtcgggagtgtctgtgcggtgctctggccagctacgcagcagcatgtgccggccgcggagtgagggtagcatggcgggaacccggcaggtgcgaacttaattgtccaaaggggcaggtgtacttgcaatgtggcacaccttgcaacttaacctgtcggtcactgtcatatccagacgaggagtgcaacgaggcatgtcttgaagggtgcttttgcccccctgggctctatatggatgagcggggggactgtgtccccaaggctcagtgcccatgttattacgatggagagatatttcagccagaggatattttttccgatcatcacacaatgtgttactgtgaggatggctttatgcactgcacaatgtccggcgtgccgggctccctgctccccgatgccgtgctgtcctcgcctcttagccaccgtagcaagcggtcactgtcgtgtcggcctcccatggttaaactggtttgtcctgcagacaatttgcgggccgagggtttggagtgcactaaaacttgccagaattacgatttggaatgtatgtccatgggctgcgtaagcggctgtctttgcccgcctggaatggtcagacatgagaaccgatgcgttgcactggaacgatgtccgtgcttccaccagggcaaggagtatgctcccggcgagaccgtcaagataggctgcaatacatgtgtgtgccaggaccgaaaatggaattgcactgaccatgtgtgcgacgccacatgttctaccataggaatggctcactacctgacattcgacggcttaaaatacctttttcctggcgaatgtcagtacgtcctggtgcaggactattgcggctccaaccccgggacgttcagaatcctagtgggcaacaagggatgtagccatccaagtgtgaagtgcaaaaaacgagtgacaatactcgtggagggtggtgagatagagctgtttgacggcgaggtgaatgtgaagcgcccaatgaaagacgagacacatttcgaggtggtcgaaagtggtcggtatataattttgcttttaggcaaggctttatcagttgtttgggacaggcacctctctatctccgtggtgcttaagcagacataccaggagaaagtttgtgggctatgcggtaattttgacgggattcaaaacaacgacttgacctcctccaaccttcaggtggaagaggatcccgtcgatttcggcaatagttggaaagtgtcatcacagtgcgcggacacccgtaaggtgccattggacagtagtcctgctacatgtcacaataatattatgaagcagaccatggtggattctagctgcaggatcctgacctcggacgtatttcaagactgtaacaaactggtagatcctgagccttatctcgacgtgtgtatatacgacacctgcagctgtgagtctatcggtgactgtgcatgcttctgtgatacaatcgccgcctacgcccatgtatgcgcccagcatggcaaagtcgtcacttggcggaccgcgactctgtgtcctcagtcctgcgaggagcggaacctgagggagaacgggtatgaatgtgagtggaggtacaattcatgcgctcctgcatgccaagtcacctgccaacatccagagcccctcgcctgtcccgtccaatgtgtggagggttgccatgctcattgccctcccggcaaaatcctcgatgagctgcttcagacctgcgtagacccggaagactgtcccgtgtgtgaagtggctggtagaagatttgcatctggaaaaaaggtgaccttaaaccctagcgacccggaacactgccaaatttgccactgcgatgttgtaaacttgacgtgtgaagcctgccaggaaccgggaggcttggttgtcccccccacagatgctcctgtgtctccaactaccttgtatgtagaagacatctccgagcctccactgcacgacttttactgttcgcgccttctggatctggtctttctgctcgatggcagctcccggctctccgaggctgagtttgaggtgctgaaggcatttgtggtcgacatgatggaaaggctgcggatcagccaaaagtgggtgagggtagcggtcgtagagtatcacgacggatcacacgcctatattggtctgaaggatcgtaaaaggccctctgagctgcgtcgcattgcctctcaggtgaagtacgccggatcgcaggtcgccagcacctctgaggtcctgaagtatacgctctttcagatcttctccaagattgacagacccgaggccagtcgtataactctattgctcatggcatcccaagagccacagagaatgagccggaactttgttagatacgtgcaggggctcaaaaagaagaaggtgatagtaattccagtgggaatcggcccccacgccaatctgaagcagatcagactgatcgagaagcaggcgccagaaaacaaagctttcgtcctgagctctgtggacgaactggagcagcagcgcgatgagatcgtgagttacctgtgtgatttggccccagaggcccctccccctacactgcctcctgatatggcccaggtaactgtgggccccggactgttgggtgtgtccaccctgggccccaagcggaatagtatggtgctagacgtggcttttgtgctggaaggatccgacaaaatcggagaagccgatttcaaccgctctaaagaatttatggaagaggtgattcagcgaatggatgttggccaagacagtattcatgtcaccgtcctgcagtacagttacatggtgaccgtggaatacccattttctgaggcacagtcgaaaggcgatattctgcagcgggttcgcgagatccgatatcagggcggaaatcgcactaataccggactagccctcaggtacctgagtgaccacagcttcctagttagccaaggcgacagagaacaggctcctaatctagtctacatggtgacaggcaacccagcatctgatgagatcaaacgcctgcccggggatatccaggtggtgcctatcggagtgggacccaatgctaatgttcaagagctggagcgtatcggatggccgaacgcgccaatcctgattcaggattttgaaactttgcccagggaagccccagatttagttctccaacgctgttgctctggggagggcttgcagatccccactctgtctccggcccctgattgctcacagccactggacgtaatactcttgctcgacggaagctccagcttccctgcttcctattttgacgagatgaagtcgttcgctaaagcctttatttcaaaggccaacattggcccaagactgactcaggtctctgtgctgcagtatggctccattactactattgacgtgccctggaatgtcgtccccgagaaggctcatcttttgtcgctggtggacgttatgcaaagggaggggggacccagccagataggggacgccctgggctttgccgtcagatacttgacaagcgaaatgcacggggcacggcccggagcatctaaagccgtagtgatcttggtcacagacgtatcagtggactctgttgacgctgcagcagatgcagcacggtcaaatagagtgacagtcttcccaattggcataggcgaccgatacgatgccgcgcagcttcggatcctggccggaccagccggcgatagcaatgttgttaagctgcaaaggatcgaagaccttcccactatggtcaccttaggcaattcgttcctgcacaaactgtgcagcggctttgtgcggatttgcatggacgaagatggcaatgaaaaacggcctggcgatgtctggactttgccagatcagtgtcacacagtgacatgccagccggacggacaaacactgctgaaaagccaccgcgtaaattgtgacagaggactgcggcccagttgccctaactcccagtccccggtcaaggtggaagaaacatgcggatgtcgctggacatgcccctgtgtgtgcactggcagttccacaagacacattgtgacattcgacgggcagaattttaagcttacgggtagctgctcatacgtcctctttcagaacaaggagcaggacctcgaggtgatacttcataacggggcatgttctcccggtgccagacagggatgtatgaagtccatcgaggtgaaacactctgctttgtccgttgagctgcacagcgatatggaagtgacagtgaatggcagactggttagcgtcccgtatgtcggggggaacatggaggtaaatgtgtatggcgccattatgcacgaggttaggtttaatcacctgggccatatattcacattcaccccgcagaacaatgagttccagctccagctcagccccaagaccttcgcttctaagacatacggtctatgtggtatttgtgacgagaatggagcaaacgacttcatgttgcgggatggaaccgtcaccactgattggaagacattggtacaagaatggaccgttcagcggccaggccagacatgtcagcccatcctagaggaacaatgcctagttcccgattctagtcactgtcaggtccttttgctaccacttttcgccgaatgtcacaaagtgttagcccctgctaccttttatgccatatgtcagcaggattcctgccaccaagagcaggtgtgtgaagtgattgcttcctatgcccatctatgtcgcacaaatggagtgtgcgtcgactggcgaacccccgatttttgcgctatgtcttgtccaccatcgctcgtatataatcattgtgagcatggatgccctcgacactgcgacgggaacgtcagctcatgcggcgatcaccctagtgaggggtgcttctgccccccagacaaggtaatgctggaggggtcttgtgtgcccgaggaagcttgtacgcaatgtataggggaggatggcgtccagcaccagtttctcgaagcatgggttcccgatcatcagccttgccagatatgcacgtgcttgtctggccgaaaggttaactgtactacacaaccctgccctacagcaaaggctcccacatgtgggctctgcgaagttgctcgattacggcagaatgctgaccagtgctgcccagagtatgagtgcgtgtgtgacccggtgtcatgtgatttaccccccgtgcctcattgtgaacgaggtcttcagcctaccctgaccaaccccggtgagtgtagacccaacttcacctgcgcatgtagaaaagaagagtgtaagcgggtgtccccccctagttgccctcctcaccgcctgccaacactgcgcaagacacaatgttgcgacgaatacgaatgcgcctgcaactgtgtaaattctacagtcagctgcccgctgggctacctggcgtccactgcaacaaacgactgcggctgcaccactacaacgtgtttgcctgacaaagtgtgcgttcacagatccaccatctatcctgttggtcagttttgggaggagggttgtgacgtgtgtacctgtacagacatggaggacgctgtgatgggcttgcgagtggctcaatgcagtcaaaaaccttgtgaggacagctgtcgctccggattcacctacgtgctgcacgagggcgagtgttgcggccgctgcctcccctcagcatgtgaagtagtcactggctcaccaaggggcgacagccagtcttcttggaagagtgttggctcacagtgggcatcgcctgagaacccctgtctcattaacgaatgcgttagagtcaaggaggaagtcttcattcagcagaggaatgtgtcttgtccccaactggaagtccctgtgtgcccaagtggttttcagttgagctgtaagacctcagcctgctgtccttcttgtcgctgcgaacgcatggaagcctgtatgctcaatggcaccgtgataggcccaggcaagaccgtcatgattgatgtgtgtaccacctgtagatgtatggtccaggtgggagtcatctcaggcttcaagttagaatgcaggaaaactacctgtaacccctgtcccctaggttataaggaagaaaacaacacgggagaatgctgcggccgttgtctccctacagcatgtacgatacagctgagggggggccagatcatgacactaaagcgcgacgagacgctacaggacggctgtgacacgcatttttgtaaggtgaacgagcgcggggaatatttttgggaaaaacgagtgacaggttgtcctcctttcgacgaacataagtgcctggcggagggcggaaaaataatgaaaattccggggacctgctgtgatacctgcgaagaaccagagtgcaacgatataactgcccgcctccagtatgtaaaggtgggctcttgcaagtccgaggttgaagtcgacatccactactgccaaggaaagtgcgcatccaaagccatgtacagtatcgatattaacgacgtccaggaccagtgcagctgttgctctccgacccgcaccgagcccatgcaagtcgctctccactgtacaaatggcagcgtggtgtaccacgaagtgctcaatgccatggagtgtaaatgctcccccagaaaatgttccaaa

SEQ ID NO: 21401 - DNA, 8439 bp, Artificial Sequence
  Description of Artificial Sequence: Synthetic coding sequence
atgatccccgcaagattcgccggggtccttctcgcactcgcgctcattctgcccggcactctatgcgccgaggggacccgaggtcggtcgtcaaccgcccgttgttcgctctttggctccgattttgtaaatacgttcgacggcagcatgtattcctttgcaggctactgttcttaccttctcgctggcggctgccagaagcgtagtttcagtatcataggagatttccagaatgggaagcgcgtctccctttccgtgtatctcggcgaattcttcgacatccacctgtttgtaaacggtacagtgacccagggcgaccagcgagtttctatgccttatgcaagtaaagggttgtacttagagaccgaagccgggtactacaagctttccggggaggcttacggatttgtagccaggatcgatggctccggcaatttccaggttctactgagcgacaggtacttcaacaagacttgtgggttgtgtgggaattttaacatattcgccgaggatgacttcatgactcaggaggggaccctgacaagtgacccttatgacttcgcaaattcctgggcactgtcatccggagagcaatggtgtgagagagcatctccccctagctcatcttgtaatatatcgagtggggagatgcagaaaggattgtgggagcaatgccaactgctgaaatctaccagcgtgtttgccagatgccacccgctcgtagaccctgagccattcgtggccctgtgtgagaagactctctgcgaatgtgcaggcgggctcgagtgcgcctgccccgctttgctcgaatatgcacggacctgcgcccaggaaggcatggtgctgtacggctggacagaccactcggcctgttccccagtgtgcccagccggcatggagtacaggcagtgtgtaagtccttgcgcaaggacttgccaaagcctgcacattaacgagatgtgccaggagagatgtgtcgatggatgctcatgccccgagggtcaactgttggacgagggactctgtgttgaatctacggagtgtccatgcgtacacagcggaaaaaggtatccccccggcacttctctgagtagggattgtaatacttgcatctgccgaaattcccaatggatatgctctaacgaggaatgccctggtgagtgcctggttacgggccagagtcactttaaatctttcgataaccgttattttaccttctcggggatctgtcagtatctattagcacgagattgtcaggatcactccttcagtatagtaattgagacagtgcagtgcgctgacgatcgtgacgctgtatgtacccggtctgtcactgtcagactccctggccttcataatagcttagtgaagctcaagcacggcgccggggtagccatggacggccaagatgtgcagttgccccttctgaagggcgaccttcggatccagcacaccgtgactgccagcgtgcgtctgtcatatggagaagacttacagatggactgggacggacgtgggagactgctcgttaaattgtctcccgtctacgcaggaaagacatgcggcctctgtgggaactataatggaaatcagggcgacgactttttgacacctagcggcctggccgagccacgagttgaggactttgggaatgcctggaagctgcacggtgactgccaggatttgcaaaaacagcactctgatccctgcgctctgaatcctcggatgaccaggttctccgaagaggcatgtgctgtcctcacttcaccgacctttgaggcttgtcatagagctgtgtctccactcccttatctgaggaattgcagatatgacgtttgcagttgcagcgatggacgggagtgcctctgcggggccctggcttcctacgctgctgcctgcgccgggagaggcgtccgcgtggcgtggagagagccaggccgttgcgaactgaactgccctaaaggccaggtctaccttcaatgcgggacgccgtgcaacctgacttgtagatccctgtcttatcccgatgaggaatgcaatgaagcttgcttggaaggatgtttctgtcctcctggactgtatatggatgaaaggggcgattgtgtaccaaaggcccaatgcccttgttactacgacggagaaatttttcagccagaggatatcttctctgatcatcatactatgtgctattgtgaggacggattcatgcactgtacaatgtcaggagtgcctgggtccctgctgccagatgccgtcttatccagtcctctgtctcaccgtagcaaacgctccctatcctgcaggcctcccatggtaaagttggtctgtcccgcagataaccttcgagcagaaggtctcgagtgcacaaagacatgtcaaaactatgatttggaatgtatgagtatgggctgtgtaagtggctgtctctgcccacctggcatggtgagacacgagaaccgatgtgttgcattagagcggtgcccctgctttcaccagggcaaagagtatgcgccgggcgaaactgtgaagattggctgcaatacatgcgtatgccaggacaggaaatggaattgcacggatcatgtttgcgatgctacatgctcaactattggtatggcccattatttaaccttcgacggcttgaagtacttattcccgggggaatgtcagtacgttctggtgcaagattactgtggcagcaatccaggcacctttagaatccttgtggggaacaaaggatgcagtcatccatctgtgaaatgtaagaagcgcgtcacaatcctcgtcgagggtggcgaaatcgaacttttcgatggggaggtgaatgtcaagcgtccgatgaaagacgagacccacttcgaagtcgttgaatctggcagatacatcatccttctgctggggaaggctctatcagttgtgtgggatcgtcacctgtcaatctcagtggttctgaaacagacttaccaggagaaggtctgcggactgtgcggtaatttcgatggcatccagaacaacgatctcaccagcagtaatctccaagtggaggaggatcctgttgacttcggaaacagttggaaggtgagttctcagtgtgcagacactagaaaggtgcccctggattcttcccccgctacctgccacaacaatatcatgaagcaaaccatggtggacagctcttgtcggatcttaacttccgacgtgtttcaggattgtaataagctcgttgaccctgaaccttatctggacgtctgcatctatgatacctgcagctgcgaatctatcggggactgtgcttgtttttgtgacaccattgcggcctacgctcacgtatgcgctcagcacggcaaggtggtgacttggcgaactgctaccctatgtccacagagttgcgaggagcggaatctgagggaaaatgggtacgagtgtgaatggcggtacaattcttgtgcccctgcttgccaagtcacatgccagcatcccgagcctctggcctgccccgtgcagtgtgtcgagggctgccacgctcactgcccacccggtaagattcttgatgagctgctgcagacttgcgtcgaccctgaagactgtcctgtctgtgaagtcgcagggcgacggttcgcttccggaaaaaaagtgacacttaacccaagcgatcccgagcactgccaaatatgtcactgtgatgttgttaatctcacctgcgaggcctgtcaggaacctggtggactcgtggttccacccactgatgctcccgtatctcccacgactctgtacgtggaagacatcagcgagccgcccctccacgacttctattgctctagactgttagacctagtgtttctcctggacgggtcatcgcgactgtcagaggctgaatttgaggtgctgaaagcctttgtcgttgacatgatggagcggctgcgaatcagccagaaatgggtgcgggttgctgtggtggagtatcacgacggatctcatgcctatatcggcctcaaagatagaaaacggccgtcagagctgagaagaatcgctagtcaggtcaaatatgctgggagccaggtggcctctacctccgaggtgttgaaatacactctatttcagatcttcagcaaaatcgataggccagaggcgtcccgcattacactgttattgatggcttctcaggagccccagagaatgtccagaaatttcgttcgatatgtgcagggtctcaagaagaaaaaagtgatcgtgatccccgtgggcataggtccacacgcaaatcttaagcagattcgcctcattgagaaacaggctccggaaaataaagccttcgtcttgtccagcgtggacgagctggaacagcagagggatgagattgtgagctacttgtgcgacttggccccggaagcgcccccaccaaccctgccgccggacatggcacaggtgacggtgggtccgggattactgggcgtgtctaccttaggtcctaaaagaaactctatggtcctggacgttgccttcgtcttggagggatcggataaaattggggaggctgactttaatcgcagcaaggagttcatggaggaagtgatccagcgaatggatgtgggccaagactccatacacgtcaccgtgttgcaatacagctacatggtaaccgtggagtaccccttctcagaggctcaatccaaaggcgatattctgcaacgcgtgcgggagatcaggtaccagggtgggaaccgaacaaataccggacttgctctgagatacctgtctgaccatagctttctcgtttcccaaggcgatcgggaacaggctcctaacctggtgtacatggttacaggcaacccagccagcgatgagattaaacgcctccccggggatatccaggtggtgcccattggggttggccccaacgctaacgtccaggagttggagaggatagggtggcccaatgccccaattctgatccaggatttcgagaccttgccccgggaggctccggacctggtcctacagaggtgttgctccggcgagggactgcagatccccacactgtcccctgcaccagattgcagccagccattggacgtgatcctcctgctggacggtagttccagctttccggcctcttacttcgacgagatgaagtcttttgccaaggcctttatctcgaaagcaaacatcggtcctcggcttacgcaggtgtctgtgctgcaatatggctcaattaccactatcgatgtgccctggaacgtcgtgcccgagaaggcacatctgctatccctggtcgatgtcatgcagcgagaaggcggaccttcccagattggcgacgcgttaggcttcgcagtgcggtacttgacctctgaaatgcacggagctaggcccggggcgtcaaaggccgtcgtaatactggttactgacgtgagtgtcgacagcgtggatgccgctgcggatgctgcaaggtccaacagggtcactgtgtttcctatcgggatcggcgatcgctacgacgctgcgcagctgcggatcctggccgggccggccggcgatagcaatgttgttaaacttcaaagaatagaggacctcccgaccatggttaccctgggtaactcttttctgcataagctttgtagtggatttgtccgcatctgtatggacgaggacggcaacgaaaagcgtccaggtgacgtatggaccctaccagaccaatgccacactgtgacctgtcagcctgatgggcaaactctgttgaaatcccaccgggtcaactgcgaccggggccttagaccctcctgccctaattcgcaatcacccgtcaaggtggaagagacctgtggttgtagatggacatgcccctgtgtttgcaccggctcctcaactaggcatatcgtcacgtttgatggacagaattttaagctgaccggctcatgttcctacgtcttgttccagaacaaagagcaggacctggaagtaattctgcacaacggagcctgctctccaggggcgagacaaggatgtatgaaatccatcgaggtgaagcactccgccctgtccgtggagctgcactccgacatggaggttactgtcaatgggaggctcgtgagcgtgccctatgttggaggcaacatggaagtgaacgtttatggcgcaatcatgcacgaggtacgattcaaccatctgggccacattttcacttttacgcctcagaataacgagttccaactgcagctcagtcccaaaacatttgcgagcaagacttacggactgtgcggcatttgtgatgagaatggagcgaatgactttatgttgcgggatggcactgtgaccactgactggaaaacactggttcaggagtggaccgtccagcgccccggccaaacctgtcagcccatcctagaagagcagtgcttagtccccgattcatctcactgtcaggttctgctcctgccactgttcgcagagtgccacaaggtgctggcaccagcaacattttacgctatctgccagcaggatagctgtcaccaggaacaggtttgtgaagtgatcgcatcgtatgctcacctctgcaggacaaacggagtctgcgtagattggagaacaccagacttttgcgctatgtcctgcccacctagcctggtttacaaccactgtgagcatggctgcccaaggcactgcgatggcaacgtgagctcatgcggagatcaccctagcgaagggtgtttctgcccaccagataaggtgatgcttgagggtagctgcgtgcccgaggaggcatgtacacagtgtattggcgaggacggagttcagcatcagtttttggaagcgtgggtaccagaccaccagccctgccagatatgtacatgtttgtcaggaagaaaagtgaactgtactacacagccctgtcctacagccaaggcgccaacttgtgggttgtgcgaagtggcgcgcctgcgccagaatgcagaccaatgttgcccggagtatgagtgcgtttgcgatcctgtttcttgcgacttacctccagtaccacactgtgagaggggactccagcccaccctgactaacccaggcgaatgtagacctaattttacatgtgcgtgtcgtaaagaggaatgcaaaagagtgtctcctccctcatgccccccacaccgcctgccgactctgagaaagacacagtgttgtgatgagtacgagtgcgcttgcaattgtgtcaactctacagtctcttgccccctaggctacctcgctagtactgctacaaacgattgcggctgtacgactaccacatgcctgcccgataaggtgtgtgttcacagatcaacgatttatccagtggggcagttttgggaagaagggtgcgacgtctgcacgtgcaccgacatggaagacgccgtcatgggactgcgtgtggctcaatgtagccaaaagccctgcgaggattcttgtcggagcgggtttacatatgtgctgcacgaaggtgaatgttgcgggaggtgtttgccgtccgcttgcgaagttgtaacaggatcacctagaggggattcgcagtcctcttggaaatccgttggctcccagtgggcctcacccgagaatccgtgccttattaacgaatgcgtgcgcgtcaaggaggaggtgtttatccagcagcggaacgtgagttgcccacagctcgaggtccctgtgtgccctagcggttttcagttgtcttgtaaaaccagtgcatgttgcccatcgtgtaggtgcgaacggatggaggcatgtatgttgaatggtaccgttataggacccggaaagactgtgatgatagacgtgtgcacaacctgcagatgtatggtgcaagtgggagtaatcagtggatttaagctcgaatgcagaaaaactacctgtaacccctgtccgctgggctacaaggaagagaataacactggcgagtgttgtggaaggtgcctgccaaccgcttgcaccatacagctgaggggtggccaaatcatgacactcaaaagggacgaaactttacaggatggatgcgacacccatttctgtaaagtcaatgaacgcggagagtacttttgggagaagcgcgtaaccgggtgtcccccgttcgatgaacacaaatgcctggcagaaggcggtaagatcatgaaaatccctggtacatgttgtgatacatgtgaagaacctgaatgtaacgacattactgctcgactgcagtatgtaaaagtcggatcatgcaaaagcgaagtagaggtggatattcattactgtcaagggaagtgcgcatccaaggccatgtacagtatcgatattaacgatgtgcaggaccagtgctcttgctgctcacccacccgcacagaacccatgcaggtggctttgcactgcactaacggaagtgttgtataccacgaagttcttaacgccatggaatgtaagtgctcaccacgaaaatgttccaaa

SEQ ID NO: 21402 - DNA, 8439 bp, Artificial Sequence
  Description of Artificial Sequence: Synthetic coding sequence
atgattcctgccaggttcgccggggtgctacttgctctcgcgctgatcctacccggtacactatgtgccgaaggcactcgcggtcgttcgagtaccgctaggtgtagtctgtttgggtcagattttgtaaatacctttgacggaagcatgtacagcttcgcagggtactgttcctatttattggccggaggatgccagaagcggagcttctccatcataggagatttccagaacgggaagcgcgtgagcttaagcgtgtatctaggcgagttttttgatatccacctcttcgtgaatggaacggtgacgcagggggatcagcgtgtatcaatgccatatgcctcgaagggtctgtaccttgagacagaagccggttattacaaactgtccggcgaggcctacggcttcgttgcgcggatcgacggatcgggcaactttcaggtgttgctcagcgataggtatttcaacaaaacctgtggcctgtgtggcaacttcaatatcttcgcagaagacgacttcatgacccaggaaggaacattgaccagcgatccctacgattttgccaactcctgggctttgtcatccggagaacagtggtgcgagcgcgcctcaccaccaagttcatcctgtaacatctcatctggcgaaatgcaaaaaggtctgtgggaacagtgccaactgttaaaaagcaccagcgtgtttgctcgctgccaccctttggtggacccagaaccctttgtggccctgtgtgagaagacgctttgtgagtgtgcaggcgggctggagtgtgcctgccctgcgttgctggaatatgcccgcacgtgcgctcaagagggaatggtcctgtacggttggacagaccacagtgcctgttctccagtgtgtcctgcaggaatggagtatcggcagtgcgtgagcccttgcgcccggacttgccaaagcttgcatattaatgagatgtgtcaagaacggtgtgtcgatggatgttcctgccccgaggggcagttgttggatgagggcttatgcgtggagagtactgagtgtccgtgtgtgcactccggtaagaggtatcctcccgggacatcattgtcacgagactgtaacacctgtatttgtagaaactcccagtggatttgcagcaacgaggagtgcccaggcgagtgcctggtaaccggccagtctcactttaaaagcttcgacaatcgctactttacattttctggaatatgccagtacctgttggccagagactgccaggaccatagttttagcatcgtgatagagacggtgcagtgtgcagatgatcgggatgccgtgtgcacccgctctgtgacggtcaggttgcctgggctgcataactctcttgtgaaattgaagcacggagctggagttgcaatggatggtcaggacgttcagctgcctcttctcaagggtgatctgaggattcagcacacagtgaccgcctctgtcagactgtcatacggcgaagatctccagatggattgggacgggcgcgggaggctgttagtcaaactcagtcctgtgtacgctggcaaaacttgcggcttatgcggaaattacaatggcaaccagggagatgatttcctgacaccctcaggcctagccgaaccccgcgtggaggattttggcaatgcttggaagctccacggggactgccaggatctgcaaaaacaacattcggacccgtgcgccctcaatcctcgcatgacgagattctccgaggaggcctgcgccgtgctaacctccccaacttttgaagcttgccatagggccgtttccccactgccatacctgcgcaactgccggtacgacgtgtgctcttgtagcgatggcagggagtgtctgtgtggagccctggcaagctacgctgccgcttgtgcaggtcgcggggtgcgggtggcttggagagagccagggcggtgtgagctgaactgccctaaagggcaggtctatcttcaatgcggtaccccatgtaacttaacctgtaggtcgctgagttatccggatgaggagtgtaacgaagcttgtctggagggttgcttctgtccgccagggctgtacatggacgagcggggggattgtgttcctaaagctcaatgtccctgctattacgacggagagattttccagcctgaggatatcttctctgatcaccacaccatgtgttattgcgaagacggctttatgcactgtacgatgtctggggtgcctggatccttactgcccgatgccgtcctttccagccctctatcacatagaagcaaacggtccctgagctgccggccaccaatggtgaaattggtctgcccagctgataatctgcgggcggaaggactggagtgcacgaagacatgccagaattacgacctggagtgtatgagtatgggctgtgtgagcgggtgtctctgtcctcccggcatggtgcgacacgaaaatcgatgtgttgcactggagagatgtccctgctttcatcagggcaaggaatatgcccctggggaaactgttaagatagggtgtaatacatgcgtgtgtcaagaccgcaaatggaactgtacagatcacgtatgcgacgcaacctgttccactatcgggatggcgcactatctgacgttcgacggtctgaaatatcttttcccgggggaatgccagtacgtgctggttcaggactactgtggaagtaacccagggacattcagaattctggtgggcaacaaaggttgctcccacccatccgtgaagtgcaagaaacgggtgacgattctggtggaggggggggagattgagcttttcgatggagaggtgaatgtgaagcggcctatgaaagacgagacccactttgaagtggttgaatctgggaggtatattatcctgcttctgggaaaagccctctcagtcgtatgggaccgccatctgagtattagtgttgtcctcaagcagacttaccaggagaaggtctgcgggttatgcgggaacttcgacggaatacagaataacgacttgacaagcagtaatcttcaagtcgaggaggatcccgtggacttcggtaattcttggaaggtcagtagccagtgcgccgatacacgcaaagtgcctctggatagctctcccgccacatgtcacaataacatcatgaagcaaaccatggtggatagcagctgtcgtatcttaacctccgatgtgttccaggactgtaataaactggtggatccagagccatacctcgacgtgtgcatctacgatacctgctcatgcgagtctatcggcgactgtgcatgtttttgtgacaccattgcagcctatgcccacgtttgtgcacagcacggtaaggtcgtaacttggcgcactgcgacactgtgtcctcagtcctgcgaagaacgtaacctgagagagaacgggtacgagtgcgagtggcgctacaactcatgcgcaccggcttgtcaggtcacctgtcagcacccggagccgctggcttgcccggttcaatgtgtggagggctgccatgcacattgcccccccggtaaaatactggacgaattgctacagacttgcgtcgaccctgaagactgtccagtgtgtgaggttgccggtaggcggttcgcgagtggaaagaaggtcactctgaaccctagcgacccggagcactgccagatctgtcattgtgatgtagtgaatctaacatgcgaggcctgtcaggaacctggcggcctcgtcgtcccacccactgacgcaccagtcagtccaacaactttgtacgtcgaggatattagcgagccgccattgcacgatttttactgttcccggctcctggatttggtgtttctgctggacggttcctctcgcttgtccgaagctgagtttgaggtcctgaaggcctttgtcgtcgacatgatggaacgcttgcgcatctcacagaagtgggtgagggtggccgtggttgagtatcacgatgggtcacatgcctatatcggtctgaaggataggaagcgtccatcagagctgaggaggattgcttcacaggtgaaatacgcaggcagtcaggtggcgtctactagtgaagttctgaaatacacattattccaaatcttttctaagatcgatcggcctgaagcctcccggataacactgctcctaatggcatcacaggagcctcagaggatgtctcggaactttgttcgatatgttcaaggcctaaagaagaaaaaggttatcgtgattcctgtcggtataggcccacatgcaaacctcaagcaaatccgcctaattgagaaacaagctccagagaacaaagccttcgtcctctctagtgtggatgagctggaacaacaacgagacgagatagtaagctacctatgcgatctagccccagaagctccccctccaaccctaccaccagatatggcacaggtgaccgttggaccaggtctgctgggagtgtccacgcttggtcccaagcggaactccatggtcttggacgtggcgtttgtgcttgaaggttctgataaaattggggaagccgatttcaatcgatcaaaggagtttatggaggaggttattcagagaatggatgttgggcaggattccatccacgtaacagttcttcagtactcctatatggtgacagtcgagtacccattcagcgaggcacaaagcaagggtgatatcttacaacgggtcagggaaattcgataccagggagggaatcgaaccaacaccggactggccctgagatatttatctgatcattccttcctggtgtctcagggcgaccgggagcaggcgccaaacctggtgtacatggtgacgggtaaccccgcatctgatgagataaaaagactgcccggcgacatccaagtggtgcccataggggtggggccaaacgccaacgtccaggagctggagcgtatcggctggccaaacgcacctatcctgatccaggattttgaaaccctgccacgtgaagctccggacctggtgttacagcggtgttgcagtggtgaaggcctgcagattcctacgctctcacctgccccagactgctcacagcccctcgatgtcattctgctgcttgatggctctagttccttccctgccagctattttgatgaaatgaagtcatttgccaaagcgtttattagtaaggctaatatcgggcctaggttgacccaggtgtccgtgcttcagtatggttcaatcaccactatcgacgtgccctggaatgtggtgcccgaaaaggcccatcttttatcactggtcgacgtgatgcaacgagaagggggtccttctcagatcggcgacgcgctgggtttcgctgttcgatacctgacctccgaaatgcatggagcacgtccaggcgcaagcaaagcagtggtcatcctggtgaccgacgtgtctgtggacagtgtcgacgcagccgctgatgccgcccggtccaatcgggttactgttttcccaatcggcattggggaccgctacgatgctgcgcagttgcggatcctggccggaccagcaggggattctaacgttgtaaagctgcaaagaatcgaagacctgcccaccatggtgacgcttggcaacagctttctccataaactatgttcaggtttcgtgcgaatctgtatggacgaagacggtaatgagaagcgaccaggcgacgtgtggaccctgcccgaccagtgccacactgtgacgtgccagcctgacggacagacacttctcaaaagtcacagggtgaactgcgacagagggctacgtccttcatgccccaactctcagtctcccgtgaaggtggaggagacgtgcggatgcaggtggacatgcccatgtgtctgtacaggctcctcaacacggcacatcgtgacttttgatgggcagaactttaaattgactgggtcctgctcatatgttctgttccagaacaaggagcaggatctggaagtcattctccacaacggggcatgttctcccggcgcccgccagggatgcatgaagagtattgaggtcaagcatagcgcgctctccgtcgaactccacagtgatatggaagtgacagttaacggccggctcgtgtccgtcccatacgtcgggggaaacatggaggtgaacgtatatggcgccatcatgcacgaagtccggtttaaccacctgggtcacatttttacttttacgcctcagaacaacgagttccagctgcagctgtcaccaaagacttttgcatcaaaaacatacggtctctgcggtatatgcgatgagaacggcgctaacgatttcatgttgcgggacggaacagtcaccacggattggaagaccctggtgcaggagtggacagtccagcggcccggacagacatgtcagcccatactggaggagcagtgcctcgtacccgatagtagccattgccaggtgctgttgctgcctctgttcgcagaatgtcataaagtccttgcgccggccacattttatgctatatgtcaacaggattcttgtcaccaggagcaggtatgtgaggttatagcaagttacgcccacctctgcaggaccaatggagtatgcgttgactggaggacgcctgatttctgcgccatgtcctgtccgccaagtctcgtttataatcactgtgagcacggttgcccacgtcactgcgacgggaatgtttcatcttgcggggatcaccctagcgagggttgcttctgcccccccgataaagtcatgcttgaaggctcgtgtgtccctgaagaagcatgcacccagtgcatcggggaggatggcgtgcagcatcaattcctggaagcatgggtgcccgaccaccagccctgccagatatgtacatgcctgtcaggaaggaaggtgaattgcaccacccagccctgcccaacggccaaagcgcccacgtgtggtctctgcgaagttgcacgcctacggcaaaacgccgatcagtgctgccccgagtatgagtgtgtatgtgatccagtgtcatgcgacctccccccagtgccgcattgtgagcggggtctgcaacccacgctcaccaaccctggagagtgcaggcccaattttacatgtgcttgtcggaaagaggagtgtaagagagtgtcaccacctagctgcccaccacacaggctcccaacactgcggaaaacccaatgctgcgacgaatatgaatgtgcatgcaactgtgtcaactccaccgtcagctgtcccttaggataccttgccagtaccgcaaccaacgactgtgggtgcaccaccactacatgtctgccagataaagtatgtgtgcatcggagtaccatttatccggtcggacagttctgggaggagggttgcgacgtatgcacatgtaccgatatggaagacgcagtaatgggcctgcgagtggcccagtgctctcagaaaccctgtgaggatagctgcaggtcaggcttcacctatgttcttcacgaaggggagtgctgcgggcgctgccttcccagtgcatgcgaagtcgtcactggatctccaagaggggactcacaaagctcttggaagtccgttgggtcccaatgggcctccccggagaacccctgtctcatcaacgagtgtgtgcgggtaaaggaagaggtgttcatccaacagcgcaacgtgagctgtccgcagctggaggttcctgtctgtccaagcggcttccagctgtcttgtaagacttccgcgtgctgtccatcctgcaggtgtgaacgcatggaggcatgcatgttaaacggcaccgtgataggccctggaaaaaccgtgatgatcgacgtgtgcacaacttgtaggtgcatggtacaggtgggtgtcatcagcggctttaaactggagtgtcggaagacaacttgtaacccttgtcccctgggttacaaggaagagaacaacaccggtgaatgctgcgggagatgcctgcccacagcgtgtaccatccaactgcgaggaggtcagatcatgacactgaaacgggatgagacgctccaggacgggtgtgatacacatttttgcaaagttaatgagaggggagaatacttctgggaaaagagggtcaccggctgccctcctttcgacgaacataaatgcttggccgagggcggcaagatcatgaagattccaggaacgtgttgtgatacctgtgaggaacctgaatgtaacgacatcacagcacgactgcagtacgttaaagtcggttcttgcaaatccgaggtggaagtagacatccattactgccagggaaagtgtgcaagcaaagccatgtactccatcgatatcaacgacgtgcaggatcaatgctcatgttgcagtcccacgcggactgagccaatgcaagttgcactgcactgtaccaacggaagcgtagtgtatcacgaggttctgaacgctatggagtgtaagtgttccccccgcaaatgtagcaag

SEQ ID NO: 21403 - DNA, 8439 bp, Artificial Sequence
  Description of Artificial Sequence: Synthetic coding sequence
atgatccccgcacgattcgcgggcgtcctgctggctctggcattaatcctgccaggaaccctgtgcgccgagggcacaagaggtcggtcctcaaccgcacgctgttcactgtttggaagtgattttgtgaacactttcgacgggtcaatgtatagcttcgctggttattgctcctatctgctggctggagggtgtcagaagagatctttctccattatcggagattttcagaacggcaaacgtgttagtttgtcggtatatctgggggagttctttgatattcacttgttcgtgaacggaaccgttactcagggcgaccagcgggttagcatgccctatgccagtaaaggcttgtatctcgaaaccgaggctggatactataaattgtccggagaagcgtatggcttcgttgcaaggatcgacgggagtggcaattttcaggtcctgctgagtgaccgctactttaataagacatgcggactctgcggtaactttaacatcttcgccgaagacgacttcatgacccaagagggcaccctgaccagcgacccttacgattttgcaaactcctgggccctgtcttccggagagcagtggtgtgaacgggcaagcccgccgtcaagttcctgcaacatatcctctggagagatgcaaaagggactttgggaacagtgccagctactgaaaagcactagcgtgtttgcaagatgtcatccacttgtggatcccgagccttttgtagccctgtgcgaaaagacactttgtgaatgcgcggggggtctggagtgcgcctgcccggccctcctcgaatacgccaggacatgcgctcaggaggggatggtgctctatggttggaccgatcatagcgcttgtagtcccgtctgccccgcaggcatggagtatagacagtgcgtgtctccatgtgcccggacatgccagtcactgcatataaatgagatgtgccaggagcgttgtgttgatggttgttcatgtcccgagggccagctgctggacgaggggttgtgtgtggaatccacagagtgtccatgcgtccacagcggaaagagatacccccctggaacttccctgtcacgggactgcaatacgtgtatctgccgcaactcacagtggatctgcagtaacgaagagtgccccggagaatgtctggtcacaggccaatctcattttaagtcattcgataaccggtatttcacgtttagtggaatctgtcaatacttattggcccgagactgtcaggaccacagcttctcaatcgtaatcgagactgtgcagtgcgcggatgatagggacgcggtatgtaccaggagtgttacagttagacttccggggctgcacaactctctggtgaagctgaaacatggagctggggtcgccatggacggacaagacgttcagctacccctcctaaagggggaccttagaatccagcatacagttaccgcaagtgtccgcctttcttatggggaggatttgcaaatggattgggatggaaggggaaggctgctcgtgaaactgagccccgtgtacgcggggaaaacatgcggtctatgcggcaactataatgggaaccaaggtgacgattttctcacgccaagcgggctggctgaaccgcgcgtcgaggattttggcaacgcttggaaactgcacggcgattgtcaggatctccagaagcaacattccgacccatgtgctttgaatccgcgtatgaccaggttctcagaagaagcctgtgccgtccttacgtctcctaccttcgaggcatgtcatcgggcggtgtccccactcccgtacctacgcaactgccgttacgatgtgtgctcttgctcagatggaagagaatgcctgtgcggagccctggctagttatgccgccgcatgcgctggacggggcgtgagggtggcgtggcgggagccggggaggtgtgaactgaattgccctaaaggccaagtttatctgcagtgcgggacgccttgcaacctcacctgtcgaagcctgagctaccccgacgaagagtgtaacgaagcctgtctggaaggctgcttctgcccacctggtctgtacatggatgaacgcggggattgtgttccaaaggctcagtgcccttgctactatgacggtgagatattccagcctgaggatattttttctgaccatcacacaatgtgctattgcgaagacggttttatgcattgtacgatgtctggcgtgccagggagtttacttccagacgctgtactctccagtccgctttcccacagatctaagcgtagcctgagttgtcgccctcctatggtaaaactggtgtgtcctgctgataacctgagggcagaagggcttgagtgcaccaaaacatgccaaaattatgatcttgagtgtatgtctatgggctgtgtgtcgggatgtctatgtccaccgggaatggtgcgtcacgagaacagatgcgtcgctctggaacgctgcccttgttttcaccagggaaaagaatatgctccgggagagacagtcaaaattggctgcaatacttgtgtgtgccaggaccgaaaatggaattgtacggatcatgtctgcgatgccacctgtagtactatcggcatggcccattatttgacttttgatggattgaaatacctgtttcccggcgaatgccaatatgtcctcgtgcaggattactgtgggagtaacccaggcacgtttagaattctagtggggaataagggctgttctcacccctccgttaagtgcaaaaaaagggtgacaattttggtcgagggaggcgagatcgagttatttgatggagaggtaaatgtgaaacgacctatgaaggatgaaactcactttgaggtggtcgagagcgggagatatataatcctattactcgggaaagccctgagtgtggtgtgggaccgccatctgtcaatatcggtggttttgaagcaaacttaccaggaaaaagtgtgtggcctctgcggcaacttcgatgggattcagaataatgacctgacttcttccaacctgcaggttgaagaggatccggtggatttcgggaacagctggaaggtgtcatctcagtgcgccgacacccggaaggtgcccttggactcttcaccagccacatgtcataacaatatcatgaagcaaactatggtagacagttcttgccggatattaacctccgacgtctttcaggactgcaataagcttgtagacccagagccgtacctcgacgtttgcatctacgacacttgttcttgtgaaagcattggtgactgcgcctgcttctgcgacaccatcgcagcgtacgcacacgtctgcgcacagcacggaaaggtggtaacttggcgcactgcaactttgtgcccccagtcctgcgaggagaggaatctgcgagagaacggctacgaatgcgagtggcggtataactcttgtgcccctgcttgtcaggtaacttgccagcaccctgagcctttggcctgtcccgtgcagtgtgtggagggttgccatgcccattgtccaccaggcaaaatcctggatgagctgcttcagacttgcgtcgaccctgaggactgcccagtgtgtgaagttgccggacggagatttgcgtctggtaagaaggtcacgcttaaccctagcgaccccgagcactgccagatttgtcattgcgacgttgtgaacctcacttgtgaggcgtgtcaagaacccgggggactcgtcgttccaccaacagacgctcccgtgtcacctaccacgctgtacgtcgaggatatcagtgaaccgcctcttcatgacttctattgctcccgtctcctggacttggtgttcctcctggacggctcatccaggctttccgaagccgagtttgaagtgctaaaggctttcgtagttgacatgatggagcgcctacgcatctcacagaagtgggtgcgcgttgccgtagtggagtaccatgacgggagtcacgcctacattggattgaaggaccgtaagagacccagcgagctacgccggattgcctctcaggttaaatatgcagggtcacaggtcgcgagcacttctgaggtgctcaaatacaccttgtttcagattttctctaaaattgatcgccctgaagcttcacgaataactctcctactcatggcaagtcaggagccacagaggatgagtcgcaactttgtaaggtacgtacaggggttaaagaaaaaaaaagtcattgtgatccccgtggggattggtccacacgcgaatttaaaacagattcgccttattgagaaacaggcccccgaaaataaagcctttgtgctgtcctctgtggatgaattggagcagcaacgggacgaaatcgtctcatacctgtgtgacctggctcctgaggcccccccccccactcttccacctgacatggcccaggtcaccgtcggcccaggactcctgggagtatccacactgggccccaagcgaaactctatggttctggatgttgcgtttgttctcgaagggagtgacaagataggagaggccgactttaaccgaagcaaggaatttatggaggaagtgatccagcgcatggatgtcggccaggactcaatacacgtaacagtgcttcagtacagctatatggttacagtggaataccctttctcagaagctcaatctaagggtgacattctccagcgggtcagagagatccgctatcagggtggtaacagaacgaacaccggacttgccctcaggtacctttcggaccatagttttctagtttctcagggcgaccgcgaacaagctcctaatctcgtctacatggtgaccggaaatcctgcatctgatgagatcaaaagacttcctggcgacattcaggttgtacccattggggtcggcccaaatgcaaatgtgcaggagttggaacgaataggttggcccaatgccccgatcctgatacaagacttcgaaaccttgccaagggaggcacctgatttggtcttacagcggtgctgctctggggaaggcctccagattcccaccctctcccctgcacctgactgttcacagccactcgatgtgatcttgctgctcgacggctcaagtagtttcccggcgagctactttgatgagatgaagagcttcgccaaagcctttatcagcaaggccaacattggaccgcgcctgacgcaggtaagtgtgctgcagtacgggtcaattaccactatcgacgtgccctggaacgtggtcccagagaaagctcatctgctgagtctagtggatgtaatgcaacgggaagggggtcctagccaaattggcgacgcacttggcttcgccgtacgatacttgacctccgagatgcatggggcacgaccaggggcgagtaaagccgtcgtgattctggtgacggacgtaagtgtcgatagtgtggacgcagcagctgatgctgcaagatctaatagggtcaccgtctttccaattgggatcggagatcgctatgacgcggcccagttaaggatcctggcgggccctgccggggattccaacgttgtcaagttacagagaatagaagaccttcctaccatggtgacgctcggcaactctttccttcataagctgtgctcaggttttgtacgtatttgtatggacgaagacgggaacgaaaagaggccgggggatgtgtggacgctgcccgaccagtgtcatactgtaacctgtcaaccagacgggcagacattactaaagtcccaccgggtaaattgtgatcgaggacttagaccaagttgtcctaatagccaatcacccgtgaaagtcgaagagacctgtggatgcaggtggacttgtccctgtgtttgtaccggctcctcaacacgccatattgtgacattcgacggtcaaaattttaagctgacaggttcttgttcatacgttttatttcagaacaaagagcaggacctggaggtgattttacacaacggcgcttgtagtccgggcgccaggcaaggctgtatgaaatcaatcgaggtgaaacacagcgcactgtccgtggagctgcatagcgacatggaggtaactgttaacggaagactggtctccgtgccgtacgttggcggaaatatggaggtcaatgtgtatggcgccattatgcatgaggtgcgattcaaccatctcggccacatattcacatttacaccgcaaaataatgaatttcagctgcaactttcccccaagacttttgcatctaagacatatggcctgtgcgggatatgcgatgagaacggagcgaatgatttcatgctccgagacggaaccgtcaccacagattggaagaccctagtgcaggaatggacagtccagagacccgggcagacctgccagccaatcttggaggagcaatgtctggtccccgacagttctcactgtcaggtccttctgttgcctctcttcgcagagtgccataaggtactggccccagcaacattctacgccatttgccagcaggactcgtgtcaccaagagcaggtgtgtgaggttatcgcctcttacgctcacctatgccgcacaaacggagtctgtgtggactggagaacacccgatttttgcgcaatgtcttgcccaccttcactcgtttataatcactgtgagcacggttgcccccggcattgcgacggaaatgtgtctagctgtggagaccacccctctgaggggtgtttttgcccgcctgataaggttatgctggaaggcagttgcgtgccggaagaggcctgcacccagtgcatcggcgaggatggggttcaacaccagttcctcgaagcatgggtgccagaccatcaaccatgccaaatctgtacatgtctgtccggcaggaaagtcaattgcactacccagccatgccccactgctaaagctcccacttgcgggctgtgcgaagtcgcacggctgagacagaacgccgatcagtgctgtccggagtatgagtgtgtctgtgatcccgtctcctgtgacctcccgcccgtgccccactgtgagcgcggtttgcagccaaccctgacaaaccctggcgaatgtagacctaactttacatgcgcgtgcagaaaagaagaatgcaaacgcgtcagccctccgtcttgtccacctcatcggctgcccacgttgcggaagacacagtgctgcgatgagtatgaatgcgcgtgcaattgtgtcaatagcaccgtttcgtgcccactgggatatttggcctcaaccgctacgaacgattgtggctgtacaaccactacttgcctgccagacaaggtttgcgtgcataggagcaccatatatcccgtgggacagttctgggaagagggttgcgacgtatgcacctgcactgacatggaggatgctgtgatgggcctgcgtgtcgctcagtgcagccagaagccctgcgaggactcatgtaggtccggatttacgtacgttctccacgagggagagtgttgtggtaggtgccttccttccgcctgcgaggtggtcacaggttcgccgcgcggggactctcagtcttcttggaaaagcgtgggcagtcagtgggctagccctgagaatccttgtcttattaatgagtgtgtgcgggttaaggaagaagtattcatacaacagagaaatgtgtcctgcccccagctggaagtgcctgtttgcccctcaggcttccagttgtcatgcaaaacctcagcctgctgccctagttgccgatgcgagcggatggaggcgtgtatgcttaatggtacagtgatcggccctggtaaaactgtgatgattgacgtgtgtacaacgtgtagatgcatggtccaagtgggcgtgatatcaggctttaagctggaatgtaggaagaccacttgtaatccctgtccccttggctataaggaggaaaataacaccggcgagtgctgcggaaggtgtctgccaacggcgtgtactattcaacttaggggggggcagatcatgaccttgaagagggacgaaacactccaggacggctgtgacacccacttttgcaaggtgaacgagcggggcgagtacttttgggaaaagcgagtgactggttgtcctccctttgatgagcacaaatgtctggcagagggtggcaagatcatgaaaatcccaggcacatgctgcgacacctgcgaagagccagaatgcaacgacattactgcacggctgcagtatgtcaaagttggaagttgtaagagcgaggttgaagtggacatccactactgtcagggcaaatgcgcatccaaggccatgtactctattgacatcaacgacgtgcaggatcagtgttcttgttgcagccccacgcgtacagagcccatgcaggttgctctgcactgtaccaacggttcagtcgtctaccacgaggtgttgaatgccatggagtgcaagtgctcgcccagaaaatgctccaag

SEQ ID NO: 21404 - DNA, 8439 bp, Artificial Sequence
  Description of Artificial Sequence: Synthetic coding sequence
atgattccagcaaggtttgccggcgtactgctcgcactagctctgatcctaccgggcacactgtgtgccgagggaactcgagggcggtcaagcaccgccagatgctcactgttcggaagtgacttcgtgaacacatttgacgggagcatgtacagtttcgcaggctattgctcctatctgttggccggtgggtgccagaagaggtcattctcaatcataggagacttccagaacgggaagcgggtatctttatcagtatacctgggcgaattttttgacatccatctgttcgtgaatgggaccgtcacccagggggatcagagggtgtcgatgccttatgcgtcgaagggcctgtaccttgaaaccgaagctggatactacaagctgtccggagaagcttacggattcgtggcacggatcgacggtagtggtaatttccaggtgctgctgagcgaccggtattttaataagacctgtggcctctgtggcaactttaacatattcgctgaggacgatttcatgacccaggagggaacgttaacctcggatccttatgatttcgccaactcctgggccctgagcagtggagagcagtggtgtgaaagggcttctccaccgagctcgtcatgcaacatctctagcggcgagatgcagaaggggctgtgggagcagtgccagcttctgaagagcacgtcagtgttcgcacgatgccatcccctggtggacccagagccgtttgtcgcgctgtgcgagaaaacgctgtgcgagtgtgccggaggcttggaatgcgcctgccccgctttacttgagtatgctagaacctgcgcccaggaggggatggtgctgtacgggtggacggatcattctgcctgctcacctgtgtgccctgcgggcatggaatatcggcagtgcgtttcaccatgtgcaaggacttgtcagtccctgcacataaacgagatgtgtcaagaaagatgtgtagatggttgttcatgtccagagggccagcttctcgacgaggggttgtgtgtggagtctactgagtgtccttgcgtacactccgggaaacgttaccctcccggaactagcctcagcagagactgtaatacctgtatttgtaggaacagccagtggatttgctcaaatgaagaatgcccgggagagtgccttgttacaggacaaagtcatttcaaatcctttgataaccggtactttactttcagtgggatctgtcagtatttgctcgctcgtgactgccaggaccactccttttctatagtgattgaaaccgttcaatgtgctgacgatcgagacgctgtgtgtaccagatccgtaaccgtgaggctgcctggactccacaactctctggtgaaactaaagcacggcgccggcgttgctatggacggtcaggatgttcagctcccattgcttaaaggggatctgcgaatacagcacacagtgacagcctcggtacgcctgagttatggcgaggacttacagatggactgggacggccgggggaggctgttggtgaagttgtcgcccgtatacgccggaaaaacctgcggcctgtgtgggaactacaacggcaaccagggagatgatttcctgacaccctcaggactggcagaacccagggtcgaagatttcggcaacgcatggaaactgcacggcgactgtcaggatctccagaagcagcacagtgatccatgcgctctgaacccccgcatgacaaggtttagcgaagaagcctgcgcagtgctgacttcacctacctttgaggcttgccacagagcagtttcccccctgccctaccttcgaaattgccgttatgacgtgtgctcatgttccgatgggcgcgaatgcttatgcggagccttggcaagctatgcagccgcatgtgcaggaagaggtgtgcgcgtggcatggcgcgaacccggaaggtgcgaactaaactgtccaaaggggcaggtttacttgcaatgcggcactccctgcaacctgacatgcagatctcttagctaccctgacgaggagtgcaatgaggcctgtttggaggggtgcttctgcccgccaggtctctacatggacgaacgcggggattgcgtcccgaaggctcagtgcccctgttactatgatggagaaatctttcagcccgaggacatttttagcgatcaccacaccatgtgctattgtgaggatggcttcatgcattgtacgatgtcgggagtgccagggtcactgttgcccgatgctgtgttaagctctcctttatctcaccggtcgaaacgatccctaagttgtcgccccccaatggtgaaactcgtctgccccgccgataaccttcgagcggaaggccttgagtgcacgaagacgtgccaaaactatgacctggaatgtatgagtatggggtgcgtttcaggctgtttatgcccgcccggcatggttcgccatgagaacagatgcgtggcactagagcgctgcccctgcttccaccaggggaaggaatacgcccccggagaaaccgtaaaaattggctgcaatacctgcgtttgtcaggacagaaagtggaattgtactgatcacgtctgcgacgccacctgtagcactatcggcatggctcattacctgaccttcgacgggctcaagtatttattccccggagaatgtcagtatgtgctagtgcaggattattgcggttccaatccaggtaccttcagaatcctggtcggcaacaaaggatgcagccatccatccgttaagtgcaagaagcgggttaccatcttggtggagggtggcgagatagaactgtttgacggcgaggtgaatgtgaaacggccaatgaaggacgaaacacatttcgaggtggtggaaagcggccggtatataatattgctgctggggaaagctctgagtgtcgtatgggacagacacctgtccataagtgtggttctcaagcagacctatcaggagaaggtgtgcggtttatgcggtaattttgacgggattcaaaacaatgatttgacaagcagcaaccttcaggtggaggaagaccctgtcgatttcgggaatagctggaaagtcagcagccaatgtgccgatacgcgtaaggtgcctcttgattcaagtcccgccacctgtcataataacatcatgaaacagaccatggtcgattcatcatgcaggattctcacaagtgatgtgttccaggattgtaataagctggtagaccccgaaccgtatctagatgtgtgcatttacgatacctgcagttgtgagtctattggggactgcgcttgcttttgcgatactattgctgcgtacgctcacgtgtgtgcgcaacatggtaaagtagtaacttggcgcactgcgaccctgtgccctcagagctgcgaggaacggaacctacgagagaatgggtatgagtgtgaatggagatacaactcatgcgcccctgcttgtcaggtgacatgtcagcatccggaacccttagcatgccccgttcagtgtgtggagggctgtcatgcacattgcccacctggtaagatcttagacgagctgctgcagacttgtgtggacccggaggattgtccggtctgtgaagtagctggacgcaggtttgcgagtgggaagaaggtcaccctgaacccttctgatcccgagcattgtcaaatctgtcactgcgacgtagttaacttgacatgcgaagcatgtcaggaacctggagggctggtggtcccccctactgatgccccagtgtcacctaccaccctttacgtagaagacattagcgaaccccccctgcatgacttttattgttcccggttactagacctcgttttcctacttgacggctcgagtcggctgagcgaagccgagtttgaagtgctgaaggccttcgtggtcgatatgatggaaagacttagaatttcacagaagtgggtccgcgtcgcagttgtcgagtaccacgacggctcccacgcctatatcgggttaaaggatcggaaacgccctagcgagctgcgtcgcattgcatctcaggtgaagtatgctgggagtcaggtcgcaagcacgtcagaggtcttgaagtacactctcttccagattttcagtaagatcgatagaccagaggcgtctcggatcaccctattgctgatggcgtcccaggagccacagagaatgagcagaaatttcgtcagatatgtccaggggctaaagaaaaagaaggttattgtaataccagtggggatcgggccccacgccaatctgaagcaaatccgcctgatcgaaaaacaagccccagaaaacaaggcattcgtcctaagttctgtggatgaacttgaacagcagcgggacgagatcgtgagctacctgtgtgatctggctcccgaggccccgccccctactctaccacccgatatggctcaggtaacggtcgggcccggcctactcggagtgtccacactaggacccaaacgaaacagcatggttttggacgtagcctttgtgctggaaggaagcgataagattggagaggctgacttcaaccgcagcaaggaatttatggaagaggtgattcaaaggatggacgtgggtcaggattctatccatgtgaccgtcctgcagtatagctacatggttaccgttgaatacccattctcagaagcccagtctaagggtgacatcctccagagagtgcgagaaattaggtatcagggcggcaacagaacaaataccggcctggcactgcggtatttatctgatcacagtttcttagtgagtcagggggatcgggaacaggcgcctaatctggtgtacatggtgaccggcaaccccgcctccgacgaaataaagagactgcccggtgacatccaggtggtacctatcggggtgggtcctaacgcaaacgtgcaggagttggagagaatcggttggcccaatgcccctattcttatccaggactttgaaacactgccgagggaagccccagatctcgtgcttcagcggtgttgttcgggtgaaggactacagattcccacactgtcacccgcccccgattgctctcagcccctggacgttatcctgctgcttgatggctcttcctcctttcccgcatcatactttgatgaaatgaagagcttcgcaaaagcttttatatctaaagcgaacattggacctaggctcacgcaagtgagtgtgctacagtacggctcaatcacaaccatcgatgtgccttggaacgtcgtgccagagaaggctcacctgctctcgctcgttgatgtaatgcagagagaagggggaccatcccagatcggtgacgctctgggctttgctgttcgttacctaacgtctgaaatgcacggagctaggccaggcgcgtccaaggccgtggtgatcctcgtcacagacgtgtccgtcgatagtgttgacgctgccgctgatgccgctcgatccaaccgcgtcacagttttccccattgggattggtgatcggtacgacgccgcccagctccgcatactcgccggccctgcaggcgacagtaatgtggtcaagctccagcggattgaagatctgccgacgatggtgacattgggcaacagctttttgcacaagttgtgcagtgggtttgtgaggatctgcatggatgaggacgggaacgaaaagcggcccggcgacgtgtggaccttgcctgaccaatgtcataccgtgacttgccagcccgacgggcaaactctgctcaaaagccatcgtgtgaattgtgatcggggtctgcgaccgagctgcccaaattcgcagtcacccgttaaggtggaggagacatgtgggtgtaggtggacctgcccttgtgtctgcactgggtcatccacacggcacattgttacatttgatgggcagaatttcaagcttactgggagctgctcttatgttctgttccagaataaagaacaggacctggaggtgattttgcataatggcgcatgttccccaggcgcgaggcaggggtgcatgaaaagcatagaggtaaaacactccgccttgtcggttgaactgcatagtgacatggaggtcacggttaacggtcgtctggtgagcgtcccctatgtcggaggaaacatggaagttaatgtctatggcgcgataatgcatgaggtgcgctttaaccatctggggcatatcttcactttcacccctcaaaataatgagttccagctacagttgtcccctaagacctttgcatctaagacctatgggctgtgtggtatctgcgatgagaacggagccaatgatttcatgctgcgcgatggcactgtgaccaccgactggaaaactctggtgcaggagtggacagtacagcggccaggtcagacctgccagccaattctcgaggaacagtgtctggttccggattcgagtcactgtcaggtcctgcttctccccctttttgccgaatgtcataaagtgctggccccagcgacattttacgccatatgccagcaggattcgtgccaccaagagcaggtgtgtgaagtcatagcctcctacgcacacttgtgtcgcacaaacggagtttgcgtggactggagaacgccagacttctgcgcaatgagctgccctccttccctggtctataaccattgtgaacatggctgtcctaggcactgcgacggtaacgtgagtagctgcggcgatcacccatcagaaggatgcttctgcccacccgacaaggtaatgcttgaggggtcatgcgtcccagaagaagcctgcacacaatgtatcggcgaggacggggtgcaacatcagtttctggaggcgtgggtgcccgaccatcagccttgtcagatctgcacgtgcctgagcgggaggaaggtaaattgtaccacccagccttgtcctacagcaaaggcccccacatgtggcttgtgtgaagtggcaagactgcgtcagaatgcggaccagtgttgcccagagtacgagtgtgtttgcgatccggtgtcttgtgacctgccacccgtgcctcattgtgagcgggggctgcaaccaacattaaccaaccctggagaatgcaggccaaatttcacctgcgcttgtagaaaggaagagtgcaagcgggtttcaccaccaagttgcccaccccatcgtctgcccacactgagaaagactcaatgctgcgatgagtatgagtgcgcatgtaactgtgtgaattctactgtgtcatgcccattgggttatctcgcctctaccgctaccaatgattgcggctgcactactaccacctgcctcccagataaggtgtgcgtgcatcggagcaccatttatcctgtaggccagttttgggaggaagggtgcgacgtctgcacgtgtacagatatggaagatgctgtgatgggcctgcgagtcgctcagtgttctcagaaaccctgcgaagatagttgcaggtctgggtttacatacgtgctacatgaaggggaatgctgcggacggtgtcttccgtctgcctgtgaagtggtcactggctcgccgcgcggggatagccagagttcttggaaatccgtcgggtcccagtgggcctctccagaaaatccatgtcttattaacgaatgcgtgcgtgttaaggaggaggtatttatccaacagaggaacgtctcgtgcccacagctagaagtgcccgtgtgtcccagcggctttcagttgtcctgtaaaacatctgcttgttgtccatcgtgcaggtgtgagaggatggaagcctgcatgttgaatggcactgtgattggccccggcaagaccgtgatgattgacgtgtgcaccacctgccgctgtatggtccaagtgggcgtgatcagcggttttaagctggagtgccgaaaaaccacctgtaacccttgtccactgggctataaagaagagaacaacactggagagtgttgtggtcggtgtctgccaaccgcatgtaccatacaactccgcgggggacagattatgactctgaagcgggacgagacgcttcaggacgggtgcgatacccatttttgtaaagtgaacgagaggggcgaatacttctgggagaagcgcgtcaccggctgcccacccttcgacgaacacaaatgcctggctgaaggaggcaagatcatgaaaatacccggtacctgttgtgatacatgcgaggagcccgagtgtaatgatatcaccgcccgactgcagtacgtaaaagtgggttcatgtaaatccgaagtcgaggtggacattcactactgccagggcaaatgtgctagcaaggcgatgtacagcatcgatattaacgatgtacaggaccagtgttcctgttgctcccccacacgcaccgagcccatgcaggtcgcactccactgtacgaacggatcagtggtttatcatgaagtgctcaacgcaatggagtgcaaatgctcccccaggaagtgcagcaag

SEQ ID NO: 21405 - DNA, 8439 bp, Artificial Sequence
  Description of Artificial Sequence: Synthetic coding sequence
atgattccagcacgattcgcaggtgtgctgttagcgctcgcgctaatcttgccgggcaccctctgtgctgagggtacgcgtggccgttccagcactgctcgatgttccctcttcggctccgatttcgtcaatacattcgatggctccatgtattcttttgcgggatactgctcatacctattagcgggcggctgccaaaaacgctcgttctcaataattggtgatttccagaacgggaaaagggtctccttgtcagtttacttgggtgaatttttcgacatacacttattcgttaatgggaccgttacccaaggtgatcagagggtgtcgatgccctacgccagcaaagggctttacttggagaccgaggcggggtattacaagctgtctggcgaggcatacggatttgtggctcggattgatggttccgggaacttccaggtgcttctttccgatcgctacttcaataaaacctgtggcttatgcggcaattttaatatcttcgccgaagacgattttatgactcaggaggggacgcttaccagcgatccgtacgattttgctaactcgtgggccctttccagtggggagcagtggtgcgagcgcgcctccccaccgtcatcttcctgtaacatttcatccggcgagatgcagaaaggcttatgggaacaatgccagctactcaagagcactagtgtatttgctcgctgtcatccactggtggatccagagccgtttgtagccctttgtgaaaagactctgtgtgagtgtgcaggcggactcgagtgcgcttgccccgcactattggagtatgcgcgcacctgtgcgcaagagggcatggtcctttatggttggacggaccactccgcgtgtagcccggtctgccccgcaggtatggaatatcgacaatgtgtttcgccatgcgcgcgcacttgccagtcactacatattaatgaaatgtgccaggagcggtgcgtggatggctgcagctgccccgagggtcaactgcttgatgagggactctgcgttgaaagtacagagtgcccgtgtgtccacagcgggaaaagatatcccccaggaacgtcattgagtcgagattgcaacacctgtatctgccgaaacagccagtggatctgttcaaatgaggaatgtccgggagagtgtcttgtcaccggtcagtcacactttaagtctttcgacaatcggtatttcaccttctccggaatttgccagtaccttttggcgagggattgccaagatcattcttttagcatcgtcatagagaccgttcagtgcgcggacgatcgggacgcggtttgcactcgtagcgtaactgtgaggttaccaggcttgcacaactctttggttaagcttaaacatggagccggtgttgcaatggacggacaggatgtacagcttcccctcctgaagggggacttacgaatacagcacacggtgacggcgagtgtgcggctttcctatggcgaggatctgcagatggactgggacggacgcggtaggctgctggtgaaactgagtcctgtatatgcgggtaagacgtgtggactttgcggtaattataatggtaaccagggtgatgattttctaacaccctccggtttggcggagccccgtgtggaagatttcggaaatgcatggaaactacacggtgactgtcaggacctccagaagcaacactcagacccttgcgccctcaaccctagaatgacgcgcttttccgaggaagcgtgcgctgtcctgacttcaccaactttcgaggcttgccatcgagcggtcagtccattgccatatcttcggaactgcagatacgacgtctgtagttgctccgacggccgagaatgcctctgcggggccttggcctcatatgcggcggcgtgcgccgggcgcggagtacgcgtagcctggagggaacccggccgatgtgagcttaactgtcctaagggacaggtctacttgcaatgcggcactccctgtaacctaacctgtcgctcactgtcctaccctgacgaggaatgtaacgaagcatgcttggaaggttgcttttgtcctcccgggctttacatggatgagcggggtgactgtgtgcctaaggctcagtgcccctgttattatgatggggagatctttcagccggaggacatcttctcggatcatcacaccatgtgttactgcgaggacggctttatgcactgtaccatgtctggcgtgcctggatccctgcttcctgacgctgttctgtcatcccccttgagccatcgttctaagcggtcgttaagctgccgtccgcccatggtgaagctggtttgtcccgcagataacctcagggcagagggtctcgaatgcacgaagacttgccaaaattacgatttagagtgcatgagcatgggttgcgtgtctggctgcctatgtcccccgggtatggtgaggcatgaaaatcgatgcgtggcattggaacggtgtccttgttttcatcaaggcaaggaatatgccccgggagagactgtgaaaatcggttgtaatacgtgtgtgtgccaggaccgaaaatggaactgtaccgaccatgtctgtgatgcaacttgctcgaccattggaatggcgcactacttgacgttcgatggcttgaagtacctgttccccggtgagtgtcaatacgtcttagtccaagattattgtgggtccaaccctggtaccttccgaattttggtgggcaacaaggggtgttcgcatccttcagtgaagtgcaagaagcgcgtgaccattttggtggagggtggggagatcgaactcttcgatggtgaggtcaacgtcaaacggcctatgaaggacgaaacacacttcgaggtcgtagaaagtgggaggtacatcattctcctgctcgggaaagctctttctgttgtatgggacaggcatctttccataagcgtggtgctgaagcagacatatcaggagaaagtgtgcggtctgtgcgggaactttgacggaattcagaataatgacttgacttcgtcgaacctccaggttgaggaggatccagtcgattttggcaactcttggaaggtgtctagccaatgtgcggatacccggaaggtacctttggattcatcgcctgctacatgtcacaacaatattatgaagcagacaatggttgactcgagttgcagaatccttaccagcgacgtgttccaggactgcaataagctcgtcgaccccgaaccgtatctggatgtatgcatctatgacacatgtagctgtgagtctataggtgactgcgcgtgcttttgcgataccatcgctgcctacgcgcatgtttgtgcccagcacggaaaggtggtcacctggcggactgccactctatgtccgcagagctgcgaggagcgtaaccttcgggagaacggttatgaatgtgaatggaggtataactcttgcgctcccgcctgccaggtgacctgccagcatcctgagcccctagcctgtcctgttcagtgcgtggagggctgccatgcgcactgtccacccgggaagatcttagatgaactcttacagacgtgtgttgatccggaggactgtccagtgtgcgaagtggccggccgtcgctttgcttctggtaaaaaagttactctgaatccctcagaccccgaacattgtcagatttgccactgtgacgtcgtcaaccttacctgcgaagcctgccaagaacccggtggactggtggtccctccaacggacgctccggtatcgccgactactctttacgtcgaggatatctcggagcccccgctccatgatttctactgctctcggttgttggacctggtctttctcttggacggttctagccggctcagcgaggcggaattcgaggttctgaaggcatttgtcgtcgacatgatggagcgtttgaggatctctcagaagtgggttagggtcgcggtggtagagtatcacgatggctctcacgcctacataggcctgaaggatcgaaagcggcctagcgagcttcgaaggatcgcttcacaagtcaagtatgctggatcccaggtggcttcaaccagcgaagtgcttaaatatacgctgttccagattttctctaagattgatcgaccagaggcttcacgaattacattgctgctcatggcatcgcaagagcctcagcgtatgtctcgcaattttgtccgttatgtccagggcctcaagaaaaaaaaggtgatcgtcattcccgtcggtatcgggccccatgccaacctaaagcagattagactcatcgagaagcaggcaccagaaaataaggctttcgttctgagctcagtcgacgagttggaacaacagcgtgacgagatagtctcgtacctatgcgatcttgctcctgaagctcctccgcccaccctacccccagacatggcacaagtgacggtagggcctggattactgggagtctccacattaggccccaagcgaaacagtatggtcttggatgtggcattcgtgctggagggctccgacaaaattggcgaagcagattttaaccgatccaaggagtttatggaagaggtcatccagcgaatggatgtgggccaggactcaattcacgttactgtgctgcagtactcctatatggttacggttgagtaccctttttccgaggcacaatctaagggagatatcttgcaacgtgtgcgagagatacgttatcaaggtgggaatcgcactaatacgggtcttgcactccggtacctctccgatcactcattcttagtgtcgcagggggatcgcgagcaagccccaaatcttgtctacatggtcacggggaatccagcatctgatgagatcaaacggctccccggcgacatccaggtcgtccctattggcgtggggcctaacgctaacgtccaggagttagaacgcattggttggcctaacgccccgatcctgattcaggatttcgagacgctaccccgagaggcgccggatttagtcctgcaacggtgttgttccggcgagggcctgcaaattcctacactgagcccagccccagactgctcgcaacccctggatgtgatcctccttctggatggctctagctctttccccgcttcctactttgatgagatgaagtcctttgcgaaggccttcatttcaaaagcaaacatcggccctcggctgacccaggtaagcgtcttacagtatggttcaataactactatcgatgtcccctggaatgttgtccctgagaaagcgcatctgctctctttggtggacgttatgcaacgcgaaggtggcccttcccagattggagatgcccttggtttcgcagtacggtacttaacgtcagaaatgcacggggctcgaccaggtgcatccaaggccgtcgtaattttagtaaccgatgttagtgttgacagtgtcgacgctgctgctgacgcagccagaagtaacagggtcactgtttttcctatcggtatcggggatcggtatgacgcggctcaactccgcattctggcgggtccagctggcgactccaatgtcgttaagctccaacgtatcgaggacctgcctaccatggtgaccttgggcaattctttcctacataagctgtgttcgggatttgttcgaatctgtatggatgaagatggcaatgagaagaggccgggcgacgtctggaccctcccggatcaatgtcacactgtcacgtgccaacccgacgggcaaacgcttctaaagtcacaccgcgtcaactgcgaccgtggcctccggccgagttgcccaaattcgcagtctccggtcaaagtcgaagaaacctgcggatgccgttggacgtgtccctgcgtctgcaccgggtcttccacccgtcacattgtgacttttgatgggcagaacttcaagttgactggatcttgctcgtatgttctgttccagaacaaggagcaagatctcgaggtcatcttgcataacggcgcttgttcccctggtgctcggcagggctgtatgaaatcgatcgaagtcaaacacagcgctctgagcgtcgagttacactccgacatggaggtaacggtcaatggacgacttgtctctgttccatacgttggtgggaatatggaggtaaatgtgtacggcgccatcatgcatgaggtgcgtttcaaccatctcggtcatatcttcacttttacgccccaaaacaatgaatttcagttacaactttcccccaagaccttcgcctcaaagacgtacggcttgtgcggcatctgtgacgaaaatggcgctaacgatttcatgctccgggacggtactgtcacgaccgattggaagacgctggttcaggagtggacagtccagcggcctggccagacgtgccaacctattctggaggaacagtgcttggtacctgactcgtcgcactgccaagtccttctccttcctctcttcgcggaatgccacaaggtcctcgcccctgctacattttacgcaatctgccagcaggactcgtgtcaccaggagcaagtttgcgaggttatcgcctcatatgcccatctatgtagaaccaacggtgtgtgcgttgactggcgcacaccagatttttgcgctatgtcatgcccgccatcgctggtgtacaaccactgtgagcacggatgcccacggcattgtgacggtaatgtatcctcgtgtggggatcaccctagtgagggctgtttttgtcccccggacaaggtgatgctggagggatcatgtgttcccgaagaggcttgtacacagtgcataggagaagacggagtgcagcatcaattcttagaggcttgggtacctgatcatcagccttgtcaaatatgcacttgtctgagtgggagaaaagtaaattgtacgacgcagccgtgccctactgcaaaggcccccacttgtggcctgtgcgaggtcgcgcgactacgacaaaatgctgaccaatgttgccccgagtatgaatgcgtgtgtgatccggtgtcctgtgacctgccgcccgttccacattgcgaaagaggactgcagccaactctcactaatccaggagagtgtcgtcccaacttcacttgtgcctgccgcaaagaggagtgtaagcgggtatccccaccctcttgccctccgcacagacttccaacgcttcggaagactcagtgctgcgatgagtacgagtgtgcttgcaattgcgtcaactcgaccgtaagttgtcctctcggttatcttgcaagcacagctacaaacgactgtggatgcaccacgacgacgtgcctgcccgacaaggtgtgcgtgcatcgctcgactatttatcctgtcggccaattttgggaagaaggttgtgacgtgtgtacttgtactgacatggaagacgctgtgatgggccttagggtggcccagtgttcgcagaagccctgcgaggactcgtgtcgaagcggtttcacgtatgtgctccacgaaggagagtgttgtggcagatgcctgccaagtgcctgtgaggtcgtgacgggctcaccaagaggtgattcacagtcgtcatggaagagcgtcggttcccaatgggcgtccccggagaatccctgccttattaacgagtgtgttagggtgaaggaggaagtctttatacagcaaaggaacgtttcatgtccgcagcttgaagtgcccgtctgcccatcaggatttcaactcagctgcaaaacttcggcctgttgcccctcctgccgctgcgagcggatggaggcgtgcatgctaaatgggactgtaatcggacctgggaaaactgtgatgatcgatgtgtgtacaacttgtcgctgcatggtacaagtcggtgttatatccggattcaaactggagtgccgcaagactacatgcaacccttgcccccttggttataaagaggagaataataccggagaatgttgcggccggtgcctccccacagcttgcacaatccagctccgcggtggacagattatgacgctgaagcgtgacgagacgctccaggacggatgcgacacgcatttctgcaaggttaacgagcgcggcgaatacttttgggagaagagagttactggttgtccgccgttcgacgaacacaaatgtttagcagaaggagggaaaatcatgaagattcccggcacctgttgtgatacctgtgaggaacctgaatgtaacgacatcactgcgcgattgcagtatgttaaagttggaagctgcaagtctgaggtggaagtggacattcactattgccaaggaaaatgtgcaagcaaggctatgtactccatcgacattaacgatgtgcaagatcaatgttcgtgttgcagccctacccgcactgaaccgatgcaggtagcgttgcactgcactaatggatcggttgtgtaccatgaggtgcttaacgccatggagtgtaaatgttccccgcgtaagtgcagcaag

SEQ ID NO: 21406 - DNA, 8439 bp, Artificial Sequence
  Description of Artificial Sequence: Synthetic coding sequence
atgattcctgccagatttgccggggttttgctcgctttagccttaattctaccggggacactgtgtgcggagggaactcggggcagaagctcaacagctcggtgttcactctttggctccgactttgttaatacgttcgacggatccatgtacagcttcgcgggctattgttcctatctgctcgcaggaggctgccaaaagagatccttttccatcattggtgacttccagaacggcaagcgtgtgtctcttagcgtctatctgggagaattttttgatattcatctgtttgtgaacgggactgtgactcaaggagatcagcgggtcagcatgccttacgctagtaagggcttataccttgagacggaagccggctactacaagcttagtggtgaagcttacggattcgtcgctcggattgacggctcaggtaatttccaggtgctgctgtcagaccgctacttcaacaaaacttgcggtctgtgcggcaacttcaatattttcgccgaggatgactttatgactcaggaggggaccctgacctccgacccctacgactttgccaacagctgggccctgagttccggagaacagtggtgtgaaagagcctccccacccagttcctcttgtaatatttcctctggtgagatgcaaaagggactgtgggagcagtgtcagttgctcaaatcaacctctgtgttcgctagatgccacccactagttgatcccgagcccttcgtggcactgtgcgagaagactctgtgtgaatgcgcaggtggccttgagtgcgcctgccctgccttgctcgagtacgcacgaacttgcgcacaggaaggcatggtgttgtatggttggaccgatcacagtgcttgttctcccgtgtgtccagcaggcatggagtatagacagtgtgtgagtccctgcgccaggacctgtcagtccctgcacatcaatgaaatgtgccaggaacggtgcgtcgacgggtgttcgtgtccagagggccagctgctggacgagggcctgtgtgtggagagtactgagtgcccgtgtgtgcactccgggaagagatatcccccaggaacttccctcagtagagactgcaatacatgtatatgtcgcaactcacagtggatttgttctaatgaagaatgccccggcgaatgtctggtaacagggcagtcacacttcaaatcttttgataataggtactttaccttctctggcatctgtcaatatctgctggcccgtgattgtcaagaccacagcttcagtatcgtaatcgaaaccgtgcagtgtgctgacgatcgagacgctgtgtgcacccgctccgtcaccgtgaggctcccgggattacacaattctctagtcaaactgaaacatggcgcgggcgttgctatggatgggcaggacgtccaactcccgcttctcaaaggggacctccggatacaacatacagtgacggctagtgtgcgcctgtcctacggggaggatctgcagatggactgggacggcaggggccgattgttggtgaagttgagtcctgtgtacgccggaaagacctgtggactgtgtggcaactacaatgggaatcagggggacgacttcctgactccctccggactagccgaacctcgcgtggaggatttcgggaacgcctggaagctacatggtgactgccaagacttgcagaagcaacatagtgacccttgcgcactcaaccctcgtatgacacgatttagcgaagaagcctgtgcagtcctgacatcgccaacttttgaggcttgccatcgcgccgtcagcccactgccctatcttagaaactgccggtacgatgtctgcagctgcagcgacggccgggaatgcctatgtggcgcactggcatcatacgcagctgcatgcgccggccggggcgtcagagtggcctggcgcgagcccggacggtgtgagctaaattgcccaaaagggcaggtgtatcttcaatgtggcacaccgtgcaatttgacctgtaggtctctctcatatcccgacgaagaatgtaacgaggcctgccttgagggctgtttctgtccgcccggactctatatggacgagaggggtgattgtgtgcctaaggctcagtgtccctgctactatgacggcgagatcttccagcccgaggatatattttctgaccatcataccatgtgttactgtgaggatggtttcatgcactgcacaatgtccggcgtgccaggatccttactaccggacgccgttctctcatccccgctttcgcacaggtcaaaaagatcgctcagctgtcgaccgcctatggtgaagctcgtgtgtccagccgacaacctgagggccgaggggctggagtgcactaagacctgccaaaattacgatctggaatgtatgtccatgggatgtgtgtccggatgcttatgtccaccagggatggtgcgtcacgagaatcgatgcgtcgccctggagaggtgcccttgctttcatcagggaaaagagtatgcccccggtgagaccgttaagatcggctgcaacacttgcgtatgtcaggatcgaaagtggaactgcaccgaccacgtgtgtgatgctacctgcagtacaatcgggatggctcactacctcacattcgatggcctgaagtacctctttcccggcgagtgtcagtatgtgcttgtccaggattattgtgggtcgaatccaggtacatttagaattctggtgggcaataagggatgcagccacccgtccgtgaaatgtaagaagcgcgtcactattttggtagagggtggtgagatcgagctgtttgatggagaagtcaacgtcaagcgcccaatgaaggacgaaacgcattttgaggtggtggaatccgggaggtatatcatcctgcttctgggaaaggccctgagcgtggtatgggaccggcatttaagcatctccgtcgtactgaagcaaacctatcaggaaaaagtttgtggcctttgcgggaacttcgacggcatccaaaacaacgatctaacatccagcaacctgcaagtggaggaggacccagtggatttcgggaatagttggaaagtgtcatcacagtgtgccgacacaaggaaagttcctttggattcatcgcctgcgacttgccataataacattatgaaacaaacaatggtcgatagcagttgccgaattcttacgtcagatgtcttccaggactgtaataagttggttgaccctgagccctaccttgacgtctgcatctacgacacatgtagttgtgagagcatcggtgactgcgcttgcttctgtgatactattgccgcttatgctcatgtgtgtgcccagcacggaaaagtggtgacgtggcgaacggccaccttatgtccgcagtcctgtgaggaacgcaacttgagagagaacgggtacgaatgtgaatggcggtataattcatgtgccccagcatgtcaggtgacttgccagcatcccgagcctctcgcctgtcctgtgcaatgcgtggagggctgccacgcccattgcccccctgggaaaatactcgacgagctgctgcagacctgcgttgaccctgaagattgtccggtctgtgaagtggcgggtcggaggtttgcctctggaaagaaagtgacactgaacccgtccgatcctgaacactgccagatctgccactgtgacgtcgtgaacctcacatgtgaagcttgtcaggagccagggggcttggtcgtcccccctaccgatgccccagtcagtccaactaccctctatgtggaagacatcagtgagcccccactccatgacttctattgctcaaggttgttggatctggtgtttcttcttgacggctcttctaggctgagcgaggccgagttcgaagtgctaaaggcctttgtggtggatatgatggaaagactcaggataagtcagaagtgggttcgtgtcgcggtcgtagagtatcacgatgggtctcacgcttacataggcctgaaagacaggaagcggccttcagaattacgccgcatcgctagccaagtgaagtatgccggctctcaggttgcttcaacatccgaagtgcttaagtatactctattccagatctttagcaagatcgacaggcctgaggccagtagaataaccctcctgcttatggcctcccaggaaccgcagcgtatgtcacgaaatttcgtccgttatgtacaggggctaaaaaagaaaaaggtgatcgtgattcctgttgggatcgggcctcatgcaaatcttaaacagattagactgatcgagaagcaggcccctgaaaataaggcctttgtgttgtcctccgtcgatgagctggagcagcaacgggatgagatcgtgtcctacttgtgcgacctggcccccgaggctccgcctcctacactgcctccagacatggcccaggttaccgtgggtcctggactgcttggagtttccacactcggccccaagagaaattcaatggtgttggacgtcgcttttgtgttggaagggagtgacaagataggagaagccgacttcaatagatctaaagagtttatggaggaagtaatccagaggatggacgtcggacaggacagcatccatgtcactgtactgcagtacagttacatggtgaccgtcgaatatcccttttctgaggcccagtcaaaaggagatatcctgcagagggtgcgggagattaggtaccagggcggaaaccggaccaacaccggcctggcgttgcgttatctctccgaccattctttcctggtgagtcagggtgaccgtgagcaggcccccaacctggtgtatatggtgactgggaatccggcttctgatgaaattaagcggcttcctggcgatattcaggtggttcccatcggagtgggcccaaatgcaaacgtgcaagaacttgaaaggattggatggcccaatgcacctattctgattcaggactttgaaactctcccccgtgaggcccctgatctggtgctccaaagatgctgctccggcgaaggcctgcaaattccaaccttatcaccggcgcctgattgcagccagcctctcgatgtcatcctgttgctggatggctcatcctcgtttccggcatcttacttcgacgagatgaagagctttgcgaaagccttcatctcaaaggctaacatcggtccccgcttgacccaggtctccgttttgcagtatggtagcatcaccactatcgatgtgccctggaacgtagttccggagaaggcgcatctgctctccctcgtggatgtgatgcagcgggaaggaggacccagccagataggagacgccctgggattcgccgtcaggtacctaactagtgagatgcatggggctaggccaggcgcgtcaaaggcagtggtaatccttgttacagacgtctctgttgattctgtggacgcggctgcagatgccgctcgttcaaatcgggtgactgtgttccctataggcatcggcgatcggtacgatgccgcccaactgcgaatcctggcaggtccggctggagacagcaatgttgtcaaattgcagcgcatcgaagacctgcctacaatggtgacccttggcaatagctttcttcacaaactttgttccgggttcgtgcggatctgcatggacgaagacggcaacgagaaaagacccggagatgtatggacccttccggatcaatgccataccgtaacttgccagcctgacggacagacactgctcaagtcccatagggtcaactgtgaccgagggctgcggccctcatgtcctaactcccagagtccagtgaaagttgaggagacttgtgggtgccgttggacctgtccttgcgtgtgtacggggagctctacacgccacatcgtgactttcgatgggcagaacttcaaattgaccggatcgtgctcctacgtcctgtttcagaataaggagcaggacctggaggttatcctgcacaatggggcatgttcgcccggggcccggcagggctgcatgaaatccatcgaagttaaacacagtgctctgtcagttgaactgcactctgatatggaggtcactgtaaatgggcggctcgtctcggtcccatatgttggcggcaatatggaagtgaatgtttacggagccattatgcatgaggtgcggtttaaccacctcggccacatattcacctttacaccgcagaataacgaatttcagttacagctgtcccctaagactttcgctagcaagacatatggcctttgtgggatatgtgacgaaaacggcgcgaatgacttcatgttgcgagacggaaccgtgaccactgactggaagactctggtgcaagagtggaccgtgcagagacccgggcaaacgtgccaacccatcctggaagaacagtgtctggtgccggattcatcacattgccaggttctgttactaccgctctttgcggaatgccataaggtcctcgccccagcaaccttttacgcaatttgtcagcaggattcttgtcatcaggagcaggtgtgtgaggttatcgccagttacgcccatttgtgtcgcactaatggtgtgtgcgtcgattggagaacaccagacttctgcgccatgagttgccctccttccttggtgtataaccactgcgaacacggctgtccaagacactgcgatggcaacgtatcttcttgcggggatcatccaagtgagggatgcttctgcccacctgataaggtgatgctggagggcagctgcgtgccagaagaggcctgcacgcaatgcatcggcgaggacggcgttcagcaccagttcctggaggcatgggtgccggaccaccagccctgccagatttgcacatgtctgtcaggcaggaaggtcaactgtaccacacagccctgtcccacggccaaagcacccacgtgcgggctgtgtgaggtggcaagactacgccagaacgctgatcagtgctgtcctgagtatgagtgtgtctgtgacccggtatcttgtgatttgcctcccgttccccactgcgagagggggctgcagccgaccctgacgaatcccggggagtgtaggccaaatttcacgtgcgcatgtcgaaaggaagaatgtaagagagtctccccaccgagctgcccccctcaccgcctgcccacccttcggaagacacagtgttgtgacgagtatgagtgtgcttgcaattgtgtaaatagtactgtgtcttgccctctgggatatcttgctagtaccgccacaaatgactgcggatgcaccactacaacctgtctccccgataaagtctgcgtccacaggagcactatctaccccgtcgggcagttctgggaggagggctgtgacgtgtgtacctgcaccgatatggaagatgccgtcatgggtttgagggtggcccagtgttcacagaagccctgtgaggacagttgtcgaagtggcttcacttatgttctgcacgaaggggagtgctgcggccgttgcttgccgtcagcatgtgaggtggtgacagggagtccccgtggagattctcaatcaagctggaaaagcgtgggcagccagtgggcttcgcctgaaaatccatgcctcatcaacgagtgtgtgcgcgtgaaggaggaggtgttcatccagcaacgcaacgtctcttgtccccagctcgaggtgccagtgtgccccagcggcttccagctgtcttgcaagacttcagcctgttgtccatcctgtaggtgtgagagaatggaggcctgcatgttgaacgggactgtcattggccccggcaagacagtgatgatcgatgtttgtactacgtgccgttgcatggtgcaggtgggcgtcatctccggatttaaattggaatgtcggaagactacctgcaatccgtgtcctctgggctacaaggaggagaacaataccggcgagtgttgtggaagatgcctgcctactgcctgcacaattcagctgcggggtggacagatcatgaccctgaagcgcgatgagactctccaggacggatgtgacactcacttctgtaaggtgaatgaacgaggggagtacttttgggagaagcgagtgacgggctgtcccccattcgacgaacataagtgtctcgcagagggcggcaaaatcatgaaaatacctggaacttgttgcgacacttgtgaagagcctgaatgtaacgatataaccgcgcggctccaatacgtcaaggtgggaagttgcaagtccgaagtagaggtagacattcattattgtcaggggaaatgcgcaagtaaagcaatgtattccatcgatattaacgacgtgcaggatcagtgttcctgctgctccccgacccgaaccgaacctatgcaggtcgctctgcactgcactaacggaagcgtggtgtaccatgaagtcttgaatgctatggagtgcaagtgctccccacggaaatgcagcaaa

SEQ ID NO: 21407 - DNA, 8439 bp, Artificial Sequence
  Description of Artificial Sequence: Synthetic coding sequence
atgatcccagcaagattcgctggtgtccttctagctcttgctctcatccttcctggaaccttgtgtgcagaggggaccaggggaaggagttcaacagcgagatgctcgctcttcggatcggacttcgtgaatacattcgacggaagcatgtatagcttcgccggatactgcagctacctgctggccgggggctgtcagaagagaagcttctctataatcggcgacttccaaaacggaaagcgggtcagcctgtcggtctatttgggggaattttttgatatacatctctttgtcaatggaaccgttacacagggagatcagcgggtgagcatgccctatgcctcaaagggtttgtacctcgaaactgaggctggatactacaaactttcgggggaagcttatgggttcgtggccaggattgatggtagcggcaattttcaagttctgctgagcgaccgatactttaataagacttgcggactgtgcggaaacttcaatatattcgccgaggacgattttatgacccaggaaggcaccctgacctccgacccttacgacttcgcgaacagttgggctctgtcaagcggagagcaatggtgcgaacgcgcctcaccaccgtcctcgagttgtaacatctctagtggcgaaatgcagaagggtttgtgggagcaatgtcaacttctcaagagcacgagcgtgtttgcccggtgtcacccactcgtcgacccagaaccatttgtggctctgtgtgaaaagactctgtgcgagtgtgccggagggttggaatgcgcctgtcccgccctgttggaatacgcccgaacatgcgcccaagaaggaatggttttgtacggttggacagaccacagcgcttgttcacctgtctgccctgccggaatggagtacagacagtgcgtgagtccctgcgctcggacctgccagagcctgcatattaacgagatgtgtcaggagagatgtgtcgatggttgctcttgccctgagggccagctgctggacgaaggtctatgcgtggagagcaccgagtgcccgtgcgtgcactccgggaagaggtacccgcccggaacaagcctgtcaagggactgcaacacatgtatctgtagaaatagccagtggatctgcagcaatgaagagtgtccgggtgagtgtcttgttacaggccagtcacactttaagtcttttgacaatagatacttcacattctctggcatctgccagtaccttctggcaagagattgccaggaccactccttctcgattgttatcgagactgtccagtgcgctgatgaccgcgatgctgtttgtactcggtcagtgaccgtgcgtttgcccggtttgcataattccttagtgaagctaaaacatggcgccggcgtggcgatggatggccaggacgtgcagctgccactgctgaaaggcgatttgagaatacagcataccgtcacagcgagcgtccgccttagctatggagaagatctgcagatggattgggatggtcggggaaggctccttgtgaagttatcacccgtgtatgcaggcaaaacctgcggcctgtgtgggaactacaatgggaaccagggagatgacttcctgacaccttcaggcctagccgagcctcgggttgaggacttcggtaatgcatggaagctccatggagattgccaggacttgcagaagcagcactctgatccctgtgccctgaaccctcggatgacgaggttctcagaagaagcttgtgctgttctgaccagccctacgtttgaagcctgccatcgggctgtgtccccacttccatatttacggaactgtagatacgacgtctgctcgtgttcggacggccgagagtgcctctgcggcgccttggccagttacgcagcagcatgcgcagggaggggcgtgcgggtggcctggagagagcccggtcgttgcgaacttaactgtcccaaaggccaggtgtacctacagtgcggtacaccctgcaacctgacatgccgctctctcagctacccagacgaagaatgcaacgaggcatgtctggagggatgcttctgtccccctgggctgtatatggacgagaggggagattgcgttccaaaagcacagtgcccttgctattatgacggcgagatctttcaacctgaggacattttctcagaccaccatacaatgtgctattgcgaagacggttttatgcattgcactatgagtggcgtgcctggaagcctgctcccagatgcggtgcttagctccccactatcccatcgctcgaagaggtccctgagttgtcggcctccgatggttaagttggtctgccccgccgacaacctgagggccgaaggtctggaatgtactaagacatgccagaattacgacctggaatgcatgagtatgggttgcgtaagcggatgtctctgccctccagggatggtgaggcatgagaatagatgtgtggcacttgaacggtgcccttgctttcatcaggggaaagaatacgcgccaggtgagaccgtcaaaataggctgtaacacgtgcgtctgtcaagaccgcaaatggaattgtactgatcacgtgtgtgacgctacatgtagcacaatcggcatggcacattaccttactttcgacggtctgaaatatcttttccctggcgaatgccagtatgtactggtacaggactattgcggctccaatccaggcacatttcggattctcgtggggaacaagggttgctctcatccctccgtgaagtgtaaaaagagagtcacaatcctcgtcgagggaggcgaaattgagcttttcgatggtgaggtaaacgtcaaacgcccaatgaaggacgagacccactttgaagtggttgaatcagggcgttatataattctgttgctggggaaggccctctctgtggtgtgggatcggcatctctcaatcagcgtggtactgaagcagacttatcaagaaaaggtatgcggactgtgtgggaacttcgacgggatacaaaacaatgatttgacttctagcaatcttcaggtcgaagaggaccctgtggatttcggcaattcatggaaggtgagtagccagtgcgcggacacccgcaaggttcctctagactcttcgcctgccacgtgccacaataatatcatgaaacagactatggtggattcatcctgtaggatcctaacatccgacgtgtttcaggattgtaacaagctggtagatccggagccatacctagacgtgtgcatatacgacacatgtagctgtgagtctatcggagactgtgcatgcttttgcgatactatcgcggcgtatgcacacgtgtgcgcgcagcatgggaaggtagtgacatggagaactgccacactgtgccctcaatcttgcgaggagcggaacctccgagaaaatggctatgagtgtgagtggaggtacaattcgtgtgcacccgcctgtcaggtgacctgccagcaccccgagccactggcctgccccgtgcagtgcgtggaaggctgccacgctcattgcccccccgggaaaatactggatgagctgttacaaacctgcgtagatccggaagactgccccgtgtgtgaagttgccggaaggaggttcgcttccggaaaaaaagtcacactcaatccttctgaccctgaacattgccagatctgccattgcgatgtcgtaaatctgacctgcgaggcctgtcaggagcccggaggattggtcgtccctcctacagatgctcctgtatctcccactaccctctatgtggaagacattagtgagcctccactgcatgacttttattgctcccgactactagatctcgtttttctgctcgatggatctagccggctaagtgaagctgagtttgaagtgctgaaagcattcgttgtggatatgatggagcgcctcagaattagccagaaatgggtgcgggtagcagtggtggaataccacgacggcagtcacgcatatatcggcctcaaagatagaaagaggccatcggagctcaggcggattgcttcccaggtcaagtacgctggcagtcaagtggcgtccactagtgaggtcctgaaatataccctgttccagatattttcgaaaatcgataggccggaggcgagtcggattacgcttctgttaatggcttcccaggagccccaacgtatgagtagaaacttcgttagatatgtgcagggtctgaagaagaaaaaagtaattgttattcccgtaggcattgggcctcacgcaaatctcaagcagatcaggctcattgaaaagcaagcacctgaaaacaaggccttcgtgctcagcagtgtggatgagctcgagcaacagcgggacgagatcgtgtcttatctttgtgacctggcccctgaggcaccgccccccactctgccacccgatatggcccaggtgactgttggcccaggtttgttgggcgtgtccaccctaggacccaagaggaacagtatggtgttagatgtggccttcgtgctggagggatcagataaaatcggagaggcagatttcaaccggtctaaggagtttatggaggaagttatccagaggatggatgtgggacaagattcaattcacgtaaccgtgctgcagtactcgtacatggtgacagtggagtatcccttttctgaagctcagagtaaaggagacatcctgcagcgcgtgcgcgaaatccgctaccagggcgggaatcgaaccaacacgggtttagcactgcgatacttatcagatcactcgttcttggtgtctcagggggatagggagcaggccccgaacctggtgtacatggtgactggaaacccagctagcgatgagatcaaacggctccccggggacatccaggtcgttccaataggggtcggtcccaatgcaaacgtccaggagctggaaagaattggttggccaaatgcaccaatccttatccaggacttcgagaccctgcctagggaggcgcctgatctggttctgcagaggtgttgttccggagaaggattacagattcctacattgagcccggcccctgactgttctcaacctctggacgtaatcctgcttctcgacgggtctagctcattcccagcctcctacttcgacgagatgaagagcttcgccaaggcattcattagcaaagcaaacataggccctcgcctgactcaggtctctgtccttcagtatgggtcaattaccaccatcgacgtaccctggaatgtggtgcccgagaaggcccacttgctgtccctcgtcgatgttatgcaacgtgagggcggcccgtcgcagataggcgatgccttggggtttgccgtgcgctaccttacatccgagatgcatggtgcacggccgggtgcctccaaagctgtggtgatacttgtgactgatgtttcagttgatagtgtcgatgcggccgcggacgcagcgcgcagcaacagggtgacagtgttcccaatcggcataggggatcgctatgacgctgcccagctccgtattctggcaggccccgccggggattcaaatgttgtgaagctgcagcggattgaggacttacctactatggttacccttggcaattcgttcctgcacaagctgtgctccgggttcgtaaggatctgcatggatgaggatggaaatgagaaaaggccgggtgacgtttggaccctgcctgatcagtgtcataccgttacttgccaaccagacgggcaaaccctgctgaaatcccaccgcgtcaattgcgatcgcgggctgcgaccgtcctgccctaactctcagagccccgtgaaggtcgaggagacatgtgggtgccgatggacatgcccctgcgtctgcacaggcagttccacccggcatatcgtcactttcgatggacagaacttcaaactcactggtagttgtagctatgtgcttttccagaacaaagagcaagatctcgaagtcatcctgcataacggggcgtgcagcccgggagcgagacagggttgcatgaagagtatcgaagtaaaacacagcgctctgtcggtggaattacatagtgacatggaggtgaccgttaacggccggctagtgtcagtaccctacgtgggcggaaatatggaggttaatgtgtacggagccatcatgcatgaggtgaggtttaaccatttggggcacatctttacattcactccacagaataatgagtttcagctgcagctgtctcctaagacctttgcgtcaaagacgtatggcttgtgtggtatctgtgatgagaacggtgccaacgatttcatgcttagggatgggaccgtcacaactgattggaaaacactcgtacaggaatggactgtacagaggcctgggcagacttgccagcctatccttgaggaacagtgcctggtgccggatagcagccactgtcaggtcctgttactgcctctttttgccgagtgccataaggtgctggcccccgccaccttttatgcgatatgtcagcaggattcctgccaccaggaacaggtttgtgaggtaattgcttcctacgctcacctgtgccgaaccaacggggtctgtgtagactggaggacgccagatttctgcgctatgagctgccccccttccctggtttataaccattgtgaacacggatgccctcgccattgtgatggaaatgtcagctcttgcggcgaccacccatctgagggttgtttctgtccgcctgataaggtaatgctcgagggctcctgcgtacctgaggaagcatgcacccaatgcatcggggaagacggcgtccagcatcagttcttggaggcctgggtccccgaccatcagccctgtcagatatgtacctgcctctccggaaggaaggtcaattgtactacccaaccttgtccgacggcaaaggcccccacgtgcggcctgtgtgaagtggcaagactgcggcagaacgcagaccagtgttgtcctgagtatgagtgtgtgtgcgatccagtcagctgcgatctaccccctgtgccccattgtgagagggggcttcagcctaccctcactaacccaggcgagtgcagacctaattttacctgcgcgtgccggaaggaggaatgcaaacgggtgagtcccccgagctgcccacctcaccggctgcccactctgcgtaagacccaatgttgtgatgaatacgaatgtgcttgtaattgtgtcaactccactgtgagctgccccttaggatacttagcctcaaccgcaaccaatgactgtggatgtacgacaacaacatgcctgccagataaggtgtgtgtgcatcggtccaccatatatcctgtcggtcagttctgggaggaagggtgcgatgtctgtacttgtacagacatggaggacgcagtgatgggattgagagtggcacaatgctcgcaaaagccctgcgaagactcatgtcggtccggctttacatacgtgctccatgagggggagtgttgcggcaggtgcctccccagtgcctgtgaggtcgtcaccggatccccacggggagactcacagtcttcctggaagtccgtcggctctcagtgggcttcccccgagaatccgtgcctgatcaacgaatgcgtccgggttaaagaggaagtgtttatccaacagcgtaacgtttcctgtccccaactggaggtcccagtatgcccttcggggtttcagctgtcatgtaagacctctgcttgctgtcctagttgccggtgcgaacgaatggaagcctgcatgctcaatggcactgtcatcgggccgggcaaaactgtcatgatcgacgtctgcaccacctgtcgctgtatggtacaggtcggtgtcatatccgggtttaagctggaatgccggaagactacttgcaacccgtgtccactgggttataaagaagagaataacacaggggagtgttgcggacgctgcctgcccactgcttgtaccatacaactcaggggcggacagattatgacactaaagagggatgagacgctgcaagacgggtgcgatacccacttctgtaaggtaaatgaacgcggagagtatttctgggagaaaagagtaacaggctgcccacctttcgatgagcacaagtgtctggctgaaggcggtaaaatcatgaagatccctggaacttgctgtgacacgtgcgaggaaccagagtgcaacgatatcacagcgcgattgcagtatgttaaggtcgggtcctgtaaatctgaggttgaggtggacattcactactgtcagggtaagtgcgcaagtaaagctatgtattccatcgatataaacgacgtgcaggatcaatgctcctgctgcagtcccactagaactgagcctatgcaggtggcccttcattgcacgaacgggtcggttgtgtatcacgaggtactgaacgcaatggaatgtaagtgttccccgaggaaatgttccaaa

SEQ ID NO: 21408 - DNA, 8439 bp, Artificial Sequence
  Description of Artificial Sequence: Synthetic coding sequence
atgattccagcccggtttgcgggcgttcttctggctctggctctaatattaccaggtaccctatgcgccgagggcacaagggggcgaagtagcactgccaggtgctcactgttcggctctgatttcgtaaatacattcgatggatccatgtactccttcgctgggtattgttcttatttgctcgccgggggatgccagaagaggtctttcagcatcattggcgattttcagaatggcaagagagtgtcactgtctgtctatctcggtgagttcttcgatattcacttattcgtcaacggcaccgtcacccagggggatcagagggtatccatgccgtacgccagtaagggcctgtatctggagactgaggccgggtactataaacttagcggtgaagcgtacggtttcgtcgcgcgcatcgatggaagcggcaacttccaggtcctcttgagcgaccggtattttaacaaaacgtgcgggttatgtgggaatttcaatatattcgcggaagatgacttcatgactcaggaggggaccctgaccagcgacccctatgatttcgcgaacagctgggccctgagctctggagagcagtggtgtgaacgggcatcccccccatcctcatcctgtaatatctccagcggcgaaatgcagaagggcctgtgggagcagtgccagttgctgaagtcgacttccgtctttgcccggtgtcaccccctcgtggacccagaaccttttgtagctctgtgcgaaaaaaccctttgcgaatgcgctggaggcctggaatgtgcctgtccagctctgctggagtacgcccgcacatgtgcccaggagggtatggtcctttatggatggacagaccattctgcatgcagtcccgtctgtccagctggcatggagtacagacaatgtgtgtccccttgcgcccgtacttgccagtcccttcacataaacgagatgtgtcaggagcgttgtgtggacggttgtagctgtccagaaggtcaacttttggacgaggggctatgcgtcgagtccacagaatgcccttgtgtgcacagcggaaaacggtatcctccaggtacatcactgtcccgcgattgcaatacatgtatttgcaggaacagccagtggatttgcagcaatgaggagtgcccgggggagtgtttggtgactggtcagtcccactttaaatctttcgataataggtactttactttctcaggtatatgccagtacctcctcgcccgggactgtcaagatcattccttctctatcgtgattgagaccgttcagtgcgccgatgaccgagacgctgtgtgcaccagatccgtgactgtgcgactccctggactgcacaatagtcttgtcaaattgaaacacggtgctggagtggcaatggatggccaggacgtccagctgcccctgctgaaaggtgatcttcgcattcaacataccgtaacagcctcagtgcgactgtcatacggcgaagatctacagatggattgggacggccgtggcagacttctggtgaaattatctccagtgtacgctggaaaaacatgtggcctctgcgggaattataatggcaaccaaggggatgactttctcaccccgtctggacttgccgaaccccgcgtcgaggattttgggaacgcttggaaacttcacggggactgtcaagatcttcagaaacagcactccgatccttgcgccttaaatccccggatgacccggttctcagaggaagcctgtgccgtacttacatctcccacattcgaagcttgccatagagccgtatctccactcccatatctaagaaactgccgatacgatgtttgtagctgcagtgacggacgcgaatgcctctgtggcgctttggcttcttacgccgccgcctgtgcgggcagaggtgtccgggtggcctggagggaaccagggcgttgtgagctgaactgtccgaaggggcaggtgtacctacagtgcgggaccccctgtaaccttacatgtcgcagcctatcttacccagatgaggagtgcaatgaagcctgcctagaggggtgtttctgtccacctggattgtacatggacgagcgaggagactgtgtcccgaaggcacagtgcccatgctattacgatggcgaaatcttccagcctgaagatattttcagtgatcaccacaccatgtgctactgtgaagatggctttatgcattgtactatgtcgggagtccctggatccctccttcccgacgccgtgctgagctctccactatctcaccgaagcaagcgatcactatcctgcaggccccctatggtcaagttggtttgcccagccgataatctgcgggctgagggcctggagtgcactaaaacctgtcaaaactatgacctcgaatgtatgtccatggggtgcgtgtccgggtgcctatgtccacctggcatggtgagacacgaaaatcggtgcgttgccctcgagcggtgcccctgctttcaccaaggtaaagaatacgccccaggggagaccgtgaagattggctgcaacacctgcgtttgccaggaccggaaatggaactgcaccgaccacgtgtgcgacgccacctgctctacaataggcatggcccattacttgacattcgatgggcttaagtacctatttcccggggagtgccagtatgtgctcgtccaagattattgcggatctaaccctgggacattcaggatcttagtgggaaacaaggggtgtagccatccatcggttaagtgcaagaagcgggtgaccatcctcgtcgaaggcggggagatcgaactgttcgatggcgaggtgaacgtcaagcgccctatgaaggacgaaacccacttcgaagtagtggaaagcggccgctatatcattcttctccttggcaaggcgttatccgtcgtgtgggatcgtcacctgtctatctcggtcgtactgaaacagacataccaggaaaaggtgtgcggactctgcggcaactttgatggcatccagaacaatgacttgacatcctctaatctgcaggtggaggaggacccggtcgacttcggtaactcctggaaagttagttcacagtgtgccgatacccgcaaagttcccctggactcttcgcccgcaacatgtcataataatattatgaaacagactatggttgattcctcttgtcgtatattgactagtgacgtctttcaggactgtaataaactggtggatccagaaccatatctggacgtctgtatctatgatacatgcagctgtgagagcataggcgattgtgcttgcttctgcgatacgatcgctgcctatgcacacgtgtgtgcccagcacggaaaggtggtaacctggaggacagctactttatgcccccagagttgtgaagagcgtaatttaagagaaaatggatacgagtgcgagtggcggtataattcctgcgcccccgcctgtcaggtaacctgccagcaccctgagcctctggcctgccctgtgcaatgcgtcgaagggtgccacgcgcattgcccccctggtaagatcctggatgaattactgcagacctgcgtggacccagaggactgccccgtttgcgaggtcgcaggtaggcgttttgctagtggtaagaaggtgacgttgaatcctagcgacccagagcactgtcaaatctgtcactgcgacgtagtgaatcttacctgcgaggcatgccaagagcccggaggcttagtagtcccacccacagatgccccagtcagccccaccaccctgtatgttgaggatatctccgagcctcccctccatgatttttattgtagccgcctgttggatctcgtgtttctgcttgacgggtcatcccgtttatccgaagcggagttcgaagtgctcaaagccttcgttgtggacatgatggaacggttgcgcatctcacaaaagtgggtgcgcgtggccgtcgtagaataccacgatggaagccacgcttacataggcttaaaggaccgcaaacgtccctcagagttacgccggattgcgtcccaggtaaagtatgcgggatctcaggtggcttccacatctgaagtactgaagtatacactgttccagatctttagtaaaatcgacagacccgaagcttctcggattacccttctgctcatggcaagtcaagaacctcaaaggatgtcacgcaactttgtgagatatgttcaggggctgaagaagaaaaaagtcattgtaatcccagtgggaatcgggccacacgcgaacctgaagcagatacgattaattgaaaagcaagcacctgagaataaggctttcgtgcttagttctgttgacgaactggagcagcaacgagacgagatcgtaagttacctgtgcgatctggctccagaagcccctcctcctactctgcctccagatatggctcaagttacagtaggtccggggttactaggcgtttcgaccttaggaccaaagcgcaatagcatggtgcttgacgttgctttcgtgttggagggcagcgataagatcggagaagcggacttcaataggtccaaggagttcatggaggaggttattcagaggatggacgtcggtcaggattcgatccatgtgaccgtgctgcaatatagttacatggtaacggtcgagtacccgtttagtgaggcccaaagcaagggcgatatactacagcgcgtgcgggagatcagatatcaggggggaaaccggacaaacacaggactggccctcaggtacctttcagatcatagcttcctggtgagtcagggcgatcgagagcaggcccccaatctggtgtacatggtaacaggtaatccagcgtcggatgaaattaaaagactgcccggcgacatccaggtggttcctattggggtcgggcccaatgccaatgtgcaggaattggagagaatcggctggccaaatgcccctatcctgattcaggacttcgagacacttccaagagaagcccctgacttagtcctgcagcgctgttgtagcggggagggtctgcagataccaacactgtcccccgctcccgattgtagccagcccttggatgtaatactgctcctggacggtagcagtagcttccccgcctcctatttcgacgaaatgaaatccttcgctaaggcattcatttccaaggctaatataggtccacgtttgactcaggtgtccgtgctgcagtacggctccattactaccattgacgtaccgtggaatgtagttcctgagaaggcccatctcctgtccttggttgatgtgatgcaacgtgaggggggccccagtcagattggagacgctctgggctttgcagtgagatatctcacatctgagatgcatggagctcgaccaggagctagtaaagccgttgtgatcttggtcaccgacgtgtcagtcgactctgttgatgctgctgcagacgcagcaagatccaatagagtgacagtgttccctatcggcatcggcgaccgctacgacgccgcccaactgcgcatcctggctggacccgctggcgattcaaatgttgtgaagctccagagaatcgaggatctgcctaccatggtgacactgggcaacagtttcctccacaagctgtgtagtggctttgtgcggatttgcatggacgaagatggcaatgagaagcggccgggagatgtgtggactctgcctgatcagtgccacaccgttacttgccaacccgatggtcagactctgctaaagagccaccgcgtgaactgcgatcgcggtctcaggccttcatgcccaaactctcagtccccagtgaaggtggaagagacatgcggctgtcggtggacctgtccttgcgtttgcactggatccagcactagacatatagttaccttcgacgggcagaattttaagttaactggtagctgttcctacgtgctattccagaacaaagagcaggatctcgaggtgattctgcacaatggtgcgtgctccccaggagctcgtcagggatgtatgaagtcaattgaggtgaaacatagtgccctcagtgtagaactccatagcgatatggaggtcaccgtcaatgggcgactcgtcagtgtcccatatgtgggtggtaacatggaggttaacgtctatggagcgattatgcatgaagttagattcaaccacctgggccacattttcactttcacgcctcagaataacgaatttcaactgcaactgtcacccaaaacattcgccagcaagacctacggcctgtgtggcatctgcgatgaaaatggagccaatgattttatgttaagagatggcaccgtgacaactgactggaagactctcgtccaagagtggaccgtacaacgccccggtcaaacttgtcagcccattttagaggagcagtgcctcgttccagattctagccattgtcaagttttgctactgcccctgtttgccgaatgtcataaagtgttggctccagccacgttctacgctatatgccaacaggactcttgtcatcaggagcaggtatgtgaggtgatcgctagctatgctcatctctgtagaacaaatggagtgtgcgtcgattggcgaacacccgacttttgtgcaatgtcgtgccccccaagtcttgtgtacaaccattgcgagcatggttgcccgcgtcattgtgatggtaatgtgtctagctgcggcgaccacccatcagagggctgtttttgccccccagacaaggtaatgctagaaggttcatgtgtgccagaagaggcctgtactcaatgtatcggagaggatggtgtccagcaccagtttcttgaagcctgggtgcctgaccaccagccgtgccagatttgcacatgcttatcggggcgcaaagtgaattgtactactcagccatgcccaaccgctaaagctccgacgtgcggtctctgtgaggtagcccggttacgccaaaacgctgaccagtgctgtcccgagtacgagtgcgtgtgcgatcccgtttcatgcgacctgccacctgtcccacactgcgagagaggcttacagccaacactgaccaaccccggagagtgccggccaaatttcacgtgtgcctgcaggaaggaggaatgtaaacgagttagcccgcctagctgtcccccccaccgtctgccgaccctgaggaagacgcagtgctgtgacgagtacgaatgcgcatgtaactgcgtaaactctactgtctcttgcccccttggttacctagcttctactgccacaaacgactgtgggtgtacgaccaccacttgcttgccagacaaggtgtgtgtgcacaggtccaccatctaccccgtgggccagttttgggaggagggctgcgatgtgtgcacctgcaccgacatggaagatgccgtcatggggctgagggtcgctcaatgcagccagaaaccttgtgaggatagttgcaggagtggttttacctacgtgctgcacgagggggaatgctgtggcagatgcctgccgagcgcttgtgaagttgtgacaggatctcctagaggcgatagccagtcatcctggaagtccgtcggatcccagtgggccagtccagagaatccttgtttgatcaatgagtgcgttcgggtgaaggaagaagtgttcattcagcagagaaatgtttcatgccctcaattagaggtgcccgtctgtccatcgggtttccagctctcttgtaagacatcagcgtgttgcccctcatgccgttgtgaaagaatggaagcttgcatgctcaacggcactgttatcggccccgggaaaactgtgatgattgacgtgtgtaccacctgtagatgtatggtgcaagtaggcgtgatcagtgggttcaaactcgagtgcaggaaaaccacctgcaacccatgcccgctgggctataaggaagaaaacaatacgggtgagtgttgtggccggtgcctgcctaccgcatgcaccatccagctgcgcggaggacagatcatgaccctgaaacgagatgaaacactgcaagatggatgcgacacacatttttgcaaggtcaacgaaagaggcgagtacttctgggaaaagagggtcactggttgtccgccctttgacgaacataagtgtctggccgaaggcggaaaaatcatgaaaattcccggtacctgctgcgacacctgtgaggaacccgagtgcaatgacattaccgctagactgcaatatgtgaaggttggcagttgtaaaagtgaggtggaggttgacatccactattgccaaggcaaatgcgccagcaaggcaatgtactctattgatattaacgatgtccaggaccagtgttcctgctgctcgcctacgcggaccgaaccgatgcaggtggctctccattgcactaatggaagcgttgtatatcacgaagtgcttaacgccatggagtgtaagtgctcaccccgcaaatgctctaaa

SEQ ID NO: 21409 - DNA, 8439 bp, Artificial Sequence
  Description of Artificial Sequence: Synthetic coding sequence
atgatcccagcccgattcgctggagttctcctcgcactggcccttatcttgcccggcacactgtgtgctgagggcacccggggaagatcttccacggccagatgcagtctgttcggctcagatttcgttaacactttcgatgggagcatgtatagtttcgcaggatactgttcttatctcctggccgggggctgtcagaagagatctttctcaattattggcgactttcagaatggaaaacgagtgtctctctctgtgtacctgggagagtttttcgacatacacttgttcgtgaacggaactgtgacacaaggagaccagcgggtgtccatgccttatgcctccaagggcctgtacctggagacagaggcaggctactataagctctctggcgaagcttacggatttgtggcacgaatcgatgggtcagggaatttccaggtcctcctcagtgatcggtatttcaataagacttgcggattgtgtggcaattttaacatattcgctgaggacgacttcatgactcaggagggaacactgacaagcgatccttatgattttgctaacagttgggccctgtcatccggcgagcagtggtgcgaacgagcgtctcctccctcttcttcctgcaacatatcttcaggtgaaatgcaaaagggcctgtgggagcagtgccaattgctgaagagtacttcagtttttgcacgatgccacccacttgtggatcccgagcctttcgtggctctgtgcgaaaaaactctgtgtgagtgtgcaggcggcctggaatgcgcttgccctgctctgttggagtatgctcgaacctgtgcacaggagggaatggtcctttacggatggactgaccatagtgcctgctcccccgtatgccctgcgggaatggagtacagacagtgtgtgagcccctgtgcccgaacatgccagtccctgcatatcaatgagatgtgtcaagaacgatgtgtggacggatgtagctgtccagagggtcagctgctggacgaggggctttgcgtggagtccactgagtgtccatgcgtgcactcagggaaacgctatccccctggtacctcactgagtagggactgtaacacgtgtatctgtagaaacagccaatggatctgtagcaacgaggagtgcccaggggagtgcctggtgactggccaatctcacttcaagtcctttgacaaccgatatttcacattttcaggaatttgccagtacctcctcgctcgggactgccaggatcattccttcagtatcgtgatcgagactgtgcagtgcgctgatgaccgcgatgccgtctgtacacggtctgtgaccgtgcggctgccagggctccacaactctctggtgaagctgaaacacggtgcaggggtggcaatggacggccaggatgtgcagcttcctctgctgaagggcgacctcagaatccaacataccgttacagcttcagtaagactcagttacggagaagaccttcagatggactgggacgggcgcggaaggctgctcgtcaaattgtcccctgtatacgctggcaaaacatgcgggctgtgcggaaattataatggcaatcagggcgatgactttctgactccatctgggctggccgagcctcgggtggaggactttggtaacgcatggaagctgcacggagactgtcaggacctgcagaagcagcactctgacccttgcgctttgaatccccgaatgactcgattttcagaagaggcctgcgctgtactgacttctcctactttcgaagcgtgtcatagagccgtgagcccactgccctaccttcgcaattgtcggtatgacgtatgttcttgctccgacgggagagagtgcctctgcggtgcgctggcctcctatgccgccgcctgcgcggggagaggggtgagagtggcatggagagagcccgggagatgtgaattgaactgtcccaagggccaagtatatctgcagtgcggcacaccatgcaaccttacctgtaggagcttgagctaccccgatgaagaatgcaacgaagcttgtctggaggggtgcttctgccccccaggcctgtacatggatgagcgaggggattgcgtcccaaaagctcagtgcccttgctactacgacggcgagatttttcagcccgaggacatctttagtgatcatcacaccatgtgttactgcgaggatggcttcatgcattgtactatgtctggcgtgccaggcagcttgcttcctgatgcagtgctgagctctcctctgtctcaccgctctaagcggagcctgtcctgccggccccctatggtaaaactggtgtgccccgccgacaatctgagggcagaaggtctggagtgtaccaagacttgccagaactacgacctcgagtgcatgtccatgggatgcgtctccgggtgcctctgccctccaggtatggtgcgccacgaaaacagatgcgtcgccctggagcggtgcccttgcttccaccaggggaaagagtacgcacccggtgagactgtgaaaatcggatgcaatacctgtgtatgtcaggataggaagtggaattgtacagaccacgtgtgtgacgccacatgtagcaccattggcatggctcattatctgacgtttgacggcctgaagtacctcttccccggagagtgtcaatacgtactggtccaggattactgtggaagtaaccctgggaccttcaggattctggtgggcaataaggggtgtagccatcccagtgttaagtgcaagaaacgcgtgacgatactggtggaaggcggcgagattgagctgttcgacggtgaggttaacgttaagcggcccatgaaggatgagacccatttcgaagtagtcgaatccgggagatacatcatcctgctgcttggcaaggcactgagtgttgtgtgggatcggcacctgtccatctccgttgtgctgaaacagacataccaggaaaaggtgtgtggactttgcgggaattttgatggaatccaaaacaacgacctgaccagtagtaacttgcaggtggaggaagacccggtggactttgggaatagttggaaagtgagctcccagtgtgctgataccagaaaagtaccccttgattcatctccagccacatgccacaataacataatgaagcagaccatggtggatagtagctgtaggattctgacttctgatgtgttccaggattgcaacaagctggttgatccggagccttatctggatgtgtgcatctacgatacttgctcctgtgagagtataggagactgcgcatgtttttgtgataccattgcagcctacgcgcacgtttgcgcacagcacggcaaagtggtcacatggagaactgccacattgtgtccgcagagctgcgaggagagaaatctcagagagaacggatatgagtgcgagtggcgatacaactcttgtgctccggcctgccaggtgacttgtcagcacccagaaccgttggcatgtccggtacagtgcgtggaaggttgtcacgcccactgcccccctggaaagattctggacgaactcctgcagacttgtgtggaccccgaggactgtccggtgtgcgaagtggccggtcgcagattcgcgagtggaaaaaaggtgaccctcaacccctccgaccccgagcactgtcagatctgccactgtgacgtcgttaatctcacctgcgaggcctgccaggaacctggggggctggtagtgcctcctactgacgcaccagtcagtccaactaccttgtacgtcgaggacattagtgaaccgcccctgcatgacttctattgctctcgactcttggatctggtttttctcctggatggcagttcacgcctgtctgaggcagagttcgaagtcctgaaggctttcgtggtagatatgatggagagactcaggattagtcagaaatgggtcagagtcgctgtcgtggagtaccacgacggctctcatgcttatattggactcaaggaccggaaaaggccttcagagttgagaaggatcgcgtctcaggttaagtatgctggttcacaagtggcatccactagcgaggtacttaaatatactcttttccaaattttctccaagatagatagacccgaggcttctaggatcacgctgctgctgatggccagccaggagccacagcggatgtctagaaattttgtgcggtacgtgcagggccttaagaaaaaaaaggtcatcgtcattcccgtaggcattggtcctcacgctaatctgaagcagattcgcctgatcgaaaagcaagcaccagagaacaaagcatttgtcctcagcagcgtggacgagctggagcagcaaagggatgagatcgtgagttatctttgcgatctcgccccggaagctccgccccctacgctcccccccgacatggctcaagttactgtggggcctggtctgctcggtgtgagtaccctgggccccaaaagaaactcaatggtgctcgacgtcgcctttgtcctggaagggagcgacaaaatcggagaggccgacttcaacagatccaaggaattcatggaggaagttatccagaggatggatgttggtcaggattccatacatgtgactgtgctccagtactcctacatggttaccgtagagtatccattctctgaagcacagtctaagggtgatattctccaaagagtccgagagatccgctatcaggggggcaatcgcaccaacactgggttggccctccgctacctgagtgaccatagtttccttgtatcacagggagaccgcgagcaagctcctaacttggtttatatggtgacaggcaaccccgccagcgatgagatcaagcgcctcccaggcgatatccaggtggtgccaattggagtaggccctaatgccaacgtgcaggagctggagaggatcgggtggcccaacgcccccatactcattcaggattttgaaacgcttcctcgagaggcaccagacctggtcctgcagaggtgctgttccggtgaaggactgcaaatacccaccctgtctcccgcccctgattgcagtcagcctctggacgttatcctcctgttggatggatccagtagctttcccgcttcttacttcgacgagatgaaatcattcgcgaaagcgttcatctccaaggccaacataggccccagactgacgcaggtctctgttttgcagtacggctcaatcaccaccattgacgtgccctggaacgtggtgcctgaaaaggcacatttgttgagcctggtggatgtcatgcaaagggaagggggcccttcccagataggggacgcactcggatttgcggtgcgatacctgacgtccgagatgcatggggcccgaccaggcgccagtaaagccgtagtgatactggtgacagacgtctcagtggactctgttgatgctgccgcagatgcagcccgctctaatcgggtcactgtcttccctattggcataggtgaccggtacgatgcggctcagctcagaatactggccggaccggccggtgattccaacgttgtgaaattgcagagaatcgaggacttgccaaccatggtgacacttggaaattcttttcttcataagctctgcagtggatttgtgcggatttgcatggacgaagacggaaacgaaaagaggcctggggacgtgtggactttgcctgaccaatgtcacacagtgacctgccaacccgacggccagactttgctcaagagccaccgcgtgaattgtgacaggggcctgaggccaagttgccccaatagccagtccccagtgaaggttgaggaaacatgcggatgtagatggacatgtccctgtgtgtgtaccggaagctctactagacacatcgtgacttttgacgggcagaacttcaaactgacaggcagctgttcttacgtgctgttccagaacaaagaacaggaccttgaagtgatccttcacaacggagcttgctctccgggcgctagacagggttgcatgaaatcaatcgaggtgaagcattccgctttgtctgtcgagttgcactccgacatggaggtaaccgtgaatgggcgcttggtaagtgtgccttatgtcggagggaatatggaggtgaacgtgtatggggccatcatgcatgaggttagattcaatcatctgggacacattttcacattcacaccacagaacaacgagtttcaactccagcttagcccgaaaactttcgcttcaaagacctatgggctctgcggcatctgtgacgagaacggggccaacgatttcatgctccgcgacggtactgtaactaccgattggaagactctcgtgcaggagtggaccgttcaacggcccggacagacctgtcagccgatactcgaggagcaatgcttggttcctgactccagtcactgtcaggtcctgcttttgcctctcttcgccgagtgtcacaaagtgctcgcccctgctacattctatgctatttgccaacaggacagttgccatcaggaacaggtgtgtgaggtaattgcaagctacgcacatctgtgtagaacaaatggcgtgtgtgtcgattggcggacgcctgacttctgtgctatgagttgcccaccatcactcgtgtacaaccattgtgagcacggctgtccaaggcattgcgacggcaacgtcagttcttgtggggatcacccaagtgagggatgcttttgtccgcctgacaaagtcatgctggaaggcagctgcgtcccagaggaggcttgcacccagtgtatcggggaggatggcgtccagcaccagttcctggaggcctgggtgcctgatcatcagccatgtcagatttgcacctgtctctctggccgaaaggtgaactgcacaactcagccctgcccaactgctaaagcccctacgtgtggcctctgtgaagtggcaagactgcggcagaacgccgaccaatgttgccctgagtatgaatgtgtttgcgaccctgtttcttgcgacctgccccctgtcccccactgtgagcgcggtctgcagccaaccttgacaaatcccggggaatgtcggcctaatttcacatgtgcttgccgcaaagaagagtgcaagcgggtaagcccaccctcttgtccaccccataggcttccaacacttaggaaaactcagtgttgcgacgaatacgaatgcgcttgcaactgcgtaaatagcaccgtgtcctgtccattggggtacctggcaagtaccgctaccaacgattgcggctgcacaactaccacttgcttgcccgacaaggtctgcgttcaccggtccacaatctatcctgtaggccagttttgggaagagggttgtgatgtgtgcacttgcaccgacatggaggatgccgtgatgggcctcagggtcgcccagtgcagtcaaaaaccatgcgaagattcctgtcgatcagggtttacttatgtcctgcatgaaggcgagtgttgtggccggtgccttccttctgcttgtgaggtcgtgactggctcaccacgcggagattcccaaagtagctggaagagtgtgggaagtcaatgggcctcacccgagaatccttgcctgatcaacgagtgcgttcgcgtgaaagaggaggtctttatccaacaaagaaacgtgtcctgtcctcaactggaggtgcccgtgtgcccctctggctttcaactgtcctgcaagacaagcgcatgttgccccagttgtcgatgcgagagaatggaagcttgtatgctgaatggcactgtcataggccctgggaaaacagtgatgattgacgtgtgcaccacctgccgctgcatggttcaggtcggtgttatctctggcttcaagttggagtgtcggaagaccacctgcaacccttgtccactgggatataaggaggaaaataacactggagagtgttgtgggagatgtctgcccacagcctgcactattcagctgcgaggaggccagattatgacactcaaacgggacgagacacttcaggatgggtgcgacacacacttctgcaaagtgaacgagcggggagaatatttttgggagaagagagttacaggatgccctccatttgacgagcataaatgtttggccgaagggggcaaaataatgaaaattccaggtacctgttgcgacacatgtgaggagcccgaatgtaatgacattaccgcgcggctgcagtatgtgaaggtaggtagctgcaagagcgaagttgaggtagatatccattactgtcagggaaaatgcgcatccaaagccatgtacagcatcgatatcaatgacgtgcaggaccaatgctcctgttgctctcccacacgcaccgaaccaatgcaggtggccttgcactgcactaatggcagtgtcgtctaccacgaagtgttgaatgcgatggagtgcaagtgctccccaaggaagtgtagtaaa

SEQ ID NO: 21410 - DNA, 8439 bp, Artificial Sequence
  Description of Artificial Sequence: Synthetic coding sequence
atgatccctgctcgatttgccggggtacttcttgccctggccttgatcctccccggaaccctttgcgccgaagggaccagggggcgctcctctacagcacggtgttcgctcttcggatctgatttcgtcaacaccttcgatggtagcatgtacagctttgcaggatattgctcatacctgcttgctggggggtgtcagaaacggagtttcagcatcatcggagactttcagaacgggaagcgagtgagcctatccgtctatctaggagaattttttgacattcatctatttgtgaatgggaccgtaacgcagggtgaccagagagtgagtatgccttacgcttctaagggcctttaccttgagaccgaggcagggtattataaactcagtggagaagcatatggtttcgtagctcggattgatggctcaggaaatttccaagtgttgttgtcagacaggtactttaataagacctgtgggctctgcggaaactttaatatatttgccgaggacgactttatgacgcaggagggcaccctgacctccgacccatatgactttgcaaactcctgggccctgtcctctggagaacagtggtgtgagcgagcgtcaccaccctcttcaagctgcaacattagttcaggggagatgcagaaggggctgtgggagcagtgtcagctattgaagtccacatcagttttcgctagatgtcatccactggtggacccagagccctttgttgccctgtgcgaaaagaccttgtgcgaatgcgccggcggactcgagtgtgcatgtcccgcgcttctcgagtacgcaaggacttgcgcccaggagggaatggtgctctacggatggaccgaccactctgcgtgcagtcccgtgtgtcctgccggcatggagtatcgccagtgtgtaagtccttgtgccagaacttgtcaatcactccatatcaacgagatgtgtcaagagcggtgcgtggatgggtgctcttgcccagagggccagctcctggacgaagggttatgtgtggagtccacagaatgcccttgtgtgcactctggcaaacggtacccaccagggacgagtctgagccgcgactgcaatacttgtatttgccggaattcccagtggatttgctcaaacgaggagtgccctggtgagtgtttggtgacagggcagtctcacttcaaatccttcgacaatcgttacttcactttctccgggatatgccagtatctattggcccgggattgtcaggatcattcgttcagtatcgttattgagacggtccaatgcgccgatgaccgtgatgctgtttgtacacgcagcgtgaccgtgaggttaccaggacttcacaatagcctggtcaaactgaagcacggcgctggcgtagcgatggacggacaggacgtgcagcttcccctgctgaagggcgatctgaggatccagcacaccgtaactgcttctgtccgtttaagctatggtgaagacctacagatggactgggatggacggggacggttactcgtcaaactctccccagtatacgccggaaaaacatgtggcctttgtgggaactataacggcaaccagggagacgacttcctgacccccagcggtcttgcagagccaagggtggaggatttcggaaacgcctggaaacttcacggagattgccaagacctacagaagcagcactccgacccctgtgcactgaaccctcggatgacccgattctctgaggaggcctgcgcagtactcacgagcccgacttttgaggcctgccaccgcgccgtgtcccctctgccttacctaagaaattgccgctacgatgtatgtagttgctctgatggtcgtgaatgtctgtgtggggctctggcaagctacgccgcagcgtgtgcaggtcgaggggtccgtgtcgcttggcgagagccagggcggtgcgaattgaattgccccaaaggacaggtgtatctgcaatgcggtacaccctgcaacttaacttgcagaagcctctcgtatcctgacgaagaatgcaatgaggcatgtctggagggctgcttctgccctcccggtctgtacatggacgagaggggggattgtgtccccaaggctcagtgcccatgttattacgacggggaaatcttccaacctgaggacatttttagtgaccaccataccatgtgctactgtgaggatggttttatgcactgcacgatgtccggtgtgccaggttccttgcttcctgatgcagttctaagcagtcccctaagccatcggtctaagcggagtctgagttgccgcccccccatggtgaagctcgtctgcccagcggacaacctgagggccgaaggcctggagtgcacaaaaacctgtcagaactatgatctggaatgcatgtccatgggatgcgtttccggctgcttgtgccctccaggaatggtccgccatgagaacaggtgtgtagccctggagagatgcccatgttttcaccagggcaaagaatacgctcccggcgagacagtcaaaatagggtgcaatacctgtgtctgccaggatcggaagtggaattgcacagaccacgtctgtgacgccacatgtagcaccattggcatggctcactatctaacattcgacggcctgaagtatctatttcccggggaatgccagtacgtactggtccaggattactgcggctctaatccagggacatttcgaattctagtgggaaacaaagggtgcagtcatccttctgtcaagtgcaagaaaagggttaccatcctggtggagggtggcgagatcgagctctttgatggtgaagttaacgttaagagacccatgaaggacgaaacccatttcgaagtggtagagtcaggacgctacattatacttctgttgggcaaggccctatcagtcgtgtgggaccgccacctgtctatatctgtggttttgaagcagacgtatcaggagaaagtctgcgggctatgcgggaacttcgatggcattcagaataatgatctgacctccagcaatctgcaggttgaggaggaccccgtcgacttcgggaactcctggaaggtctccagccagtgcgcagacacccggaaagttcctctggatagcagtccggcaacctgtcataataatataatgaaacaaactatggtggacagctcctgcagaattctcacttccgacgtgtttcaggattgcaacaagctggtagacccggagccatatctggatgtgtgtatttacgatacctgctcctgcgaatctattggtgactgcgcatgcttttgcgacaccatcgccgcttacgcccacgtctgtgcacagcatggcaaagtcgtgacctggcgcacggctacattatgcccccagtcttgcgaagaacggaacctgcgggagaatggctatgagtgtgaatggagatacaattcctgcgctccggcttgccaggtaacatgccagcatcctgagcctctagcctgtcctgtgcagtgtgtggagggctgccacgctcactgccctccaggtaagattttggacgaactcctgcaaacttgtgttgacccagaggactgtccggtctgtgaggtcgctggtcggaggttcgctagcgggaaaaaagtcactctgaacccaagcgacccagagcattgccagatctgccattgtgatgtggtgaatttgacatgcgaagcctgccaggaaccaggcgggttggtcgtccccccgactgatgccccagtcagcccaacaactttgtacgttgaggatatttcagagccacctctgcacgacttctattgttcgcgactgctggacctggtgtttctgctggacgggtctagccgtctcagtgaggctgaattcgaggtacttaaagcctttgtggttgatatgatggagcgcctgcgaatcagtcagaagtgggtaagagttgccgttgtggaataccatgatgggtctcacgcgtacatcgggctaaaggacagaaagaggccctccgagctgagacgcattgcctcacaggtgaagtacgccgggtcgcaggtcgcgagcacctccgaggtcttgaagtacactttgttccagattttttctaaaatcgatcgtcccgaggcctcgagaattacattgctactcatggcgtctcaagagccacaacgcatgagcagaaacttcgtgaggtacgttcagggactgaagaagaagaaagtgatcgtgatccctgtgggtattggcccacacgctaatctcaagcaaatcagactgatcgagaagcaggccccagagaacaaggcatttgtccttagttcggtcgacgagctcgaacagcagcgcgatgagatcgtcagttacctctgcgatctggctcccgaagcaccccctccgaccctccctcccgacatggcccaggtcacagtcggtcccggcttattgggcgtgtcgacactgggccccaagaggaactctatggtattggatgtggccttcgtattggaaggatctgacaaaattggggaagccgatttcaatcgttctaaggagttcatggaggaagttatccagaggatggacgtaggtcaggatagtattcacgtcaccgtgctgcagtactcttatatggtgactgtggagtaccccttctccgaggcccagtcgaagggagatatcctccagagggttcgcgaaattcggtatcaggggggcaatcggaccaacaccggccttgcactacgttacctgagtgaccatagctttcttgtgtctcagggagacagggagcaagctccgaatctggtgtacatggtcactggcaatcccgcaagtgacgaaataaaaaggttgcccggggatattcaagtggtgccgatcggggtcgggcccaatgctaacgttcaggaactcgaaaggattggctggcctaatgctccgatcctaatacaggattttgaaacactaccacgggaggcgcccgatctggtgctccagcggtgttgctctggagagggacttcagattcctactctcagccctgcccccgactgctcccaacccctcgacgtgattctgcttttggacggctcttcctctttccccgctagctacttcgacgaaatgaagtcattcgcaaaagcctttattagcaaggccaatatagggccaagattaactcaagtgagcgtgcttcagtatggatctatcactactatagacgtgccttggaacgtggtgcccgagaaggcgcatttactctctttggtagacgttatgcaacgtgaagggggaccttcccagattggcgacgctctcgggtttgccgtgcggtatttgacctcggagatgcatggagctagacccggagcttctaaggcagtcgttatcctcgtgacggatgtctcagtggactcagttgatgccgccgctgacgccgctcggtctaaccgggtaacagttttcccaatcgggatcggcgaccgctacgacgccgcccaacttcgcatccttgccggacctgccggggactccaatgtcgtgaagctgcagcgtatcgaggatttacccaccatggtgacactgggtaactcatttctgcacaagctctgcagcggatttgtgcgaatctgcatggatgaggacgggaatgagaaaaggcccggtgacgtttggactctccctgaccaatgtcataccgtcacctgtcaaccggatgggcaaactctgttgaagtcacacagggtgaactgcgacagaggcctgcggcctagttgccccaacagccagtcacccgtgaaggtcgaagagacttgcggctgtcgatggacctgcccctgcgtctgtacaggcagctcgacccgacacattgtgacttttgacgggcagaatttcaagctgaccggaagctgctcatatgtacttttccagaacaaggagcaggacctcgaagtgattttgcacaacggtgcctgctcacccggcgctaggcagggttgtatgaagtcaatcgaggtgaaacactcagcactttccgtggaactccatagtgacatggaagtgactgtaaatgggcgtctcgtgtctgtgccctacgtcggcgggaacatggaggtgaatgtgtatggggcaattatgcacgaagtaagatttaatcatctcggccacatcttcacctttacccctcagaacaatgaatttcagcttcaattgtcaccgaagaccttcgcctctaaaacttacgggctatgcgggatctgcgacgagaatggggccaacgatttcatgctgagagacggcacggtgacgactgattggaaaaccctggttcaggaatggactgtgcagcggcccggacaaacatgccagccaattctggaggaacagtgcctggtgccagattcatcacactgtcaagttctgctgttgccgctcttcgccgagtgtcacaaggtccttgctcctgccacgttttatgccatctgccagcaggactcttgccaccaggagcaggtgtgcgaggttatagccagctacgcacatctgtgccgaaccaatggggtatgcgtggattggaggacaccagatttttgtgcgatgagttgtccgccttctttggtgtacaaccactgtgaacacggttgcccacggcactgcgatggcaacgtaagtagctgcggtgaccacccgtctgaagggtgtttctgcccccctgataaagtcatgcttgagggaagctgtgtccccgaggaggcttgcacccagtgtatcggcgaagatggggtgcagcaccagttcctggaagcttgggtgcctgatcaccagccttgtcagatctgtacctgcctgagcgggagaaaggttaattgtaccacacagccctgccctactgctaaggctccaacatgcgggctctgcgaggttgcacgcttgaggcagaatgctgaccagtgttgtccagaatatgaatgtgtgtgtgatccagtgtcctgcgacctgccacccgtgccacattgcgaacgaggcctgcaacccaccttgacaaaccctggcgagtgcaggccaaacttcacttgcgcctgtcggaaagaggaatgtaagcgtgtatcgccgccaagctgcccaccacaccggctcccaaccttaaggaagacacagtgttgcgatgagtacgagtgcgcttgcaactgtgtgaatagcaccgtgtcctgcccactcggatacctcgcgagtacagccacaaacgattgcggttgcactaccaccacttgtctcccagacaaagtctgtgtgcatcgctcaacaatatatcccgtcgggcagttctgggaggaagggtgtgacgtttgtacatgtacagacatggaagacgcagttatgggtctgcgagtcgcccagtgctcacagaagccatgtgaggatagctgccgctcaggttttacctacgtcctacacgaaggagagtgctgtggcaggtgcttaccttcagcctgtgaagtcgttaccggcagccctcgtggggactcgcagtcaagctggaagtcagttggtagtcagtgggccagcccagaaaacccctgcttgattaatgagtgcgtgcgggtgaaagaagaagtattcattcagcagcgtaatgtgagttgcccgcagctggaggtccccgtctgcccaagtggatttcaattgtcatgcaagacttccgcatgttgtccatcttgtaggtgtgagcgtatggaagcatgcatgctgaacggaacagtcataggcccaggcaagaccgtcatgatcgacgtttgcactacatgtcggtgcatggtgcaagtgggtgtgatttcagggttcaagctggagtgtcggaagaccacctgtaacccttgtccacttggatacaaagaggaaaacaacaccggcgaatgctgcggtaggtgtctacccaccgcctgcacaatccagctgcgaggtgggcaaatcatgaccctaaagagggatgagacactccaagatgggtgtgacacccacttttgtaaggtgaatgaaagaggggaatatttctgggagaagagagtgaccggttgccctccttttgacgagcacaagtgtctcgcggagggaggtaaaattatgaaaatcccaggtacttgctgtgatacatgcgaagagcctgagtgcaatgatatcacggcgcgtttacagtatgtgaaagtgggttcttgtaagtccgaagtggaagtagatatccactattgccagggtaagtgcgcctctaaggcgatgtactctattgacattaacgacgtgcaggaccagtgtagctgttgctctcctacccggacagagcctatgcaggtggctcttcactgcaccaacggcagtgttgtgtaccacgaagtgctgaacgccatggaatgtaagtgctccccgagaaagtgtagcaag

SEQ ID NO: 21411 - DNA, 8439 bp, Artificial Sequence
  Description of Artificial Sequence: Synthetic coding sequence
atgatacccgcaagattcgcgggagtgctgcttgctctggcactgatcttgcctgggactctatgtgctgaggggacacggggccgcagctccaccgcaagatgctcactgtttgggtctgattttgtgaacaccttcgatggctccatgtattcgttcgctggatactgctcctacctcctcgcagggggctgccaaaaacgctcgttctcaatcattggggacttccaaaatggaaaaagagtctccctgagcgtctacctgggcgagtttttcgatattcatctctttgtgaacgggactgtaacccagggcgaccagcgcgtgtcaatgccttatgcctcgaagggcctttatctggagactgaggccgggtactataaactgtcaggggaagcttacggcttcgtggcccgcattgatggatccgggaattttcaagtcctgctgtcagatagatatttcaacaaaacctgcggcttgtgtggcaacttcaacatatttgcagaggacgacttcatgactcaggagggaacccttacttcggacccttacgatttcgcaaacagctgggctctttcgagtggagagcagtggtgtgagcgagcctcccccccatccagctcgtgcaatatatctagcggcgagatgcagaagggtctttgggagcagtgccaactcttgaaatcaacctctgtatttgccagatgtcatcccttggtggatccagagccgttcgttgcgttgtgtgaaaaaaccctgtgcgagtgcgcaggcggcctggagtgtgcctgtccagccctcctcgagtatgctaggacctgtgcccaggagggcatggtgctttacggatggaccgatcactcagcttgcagtccagtgtgtccagcggggatggagtatcgacagtgcgtttccccatgcgctaggacctgccagagtttgcatattaacgagatgtgccaggaaagatgcgttgatggatgcagctgtcccgagggacagcttcttgacgaaggactttgcgtggaatctacggagtgtccttgcgtgcactctggtaagcgttacccaccaggcaccagcctttcgagggactgtaacacttgtatctgtcggaatagccagtggatttgtagtaacgaagagtgcccgggtgaatgtctggtgactggccagtcccattttaaatcttttgataacagatacttcaccttctctggaatctgccagtacctcctcgcccgcgattgccaggaccactcgttctccatcgtcatcgagactgtgcagtgtgccgacgatcgagatgctgtgtgcactcggtcagtcaccgtgaggttgcctggcttgcacaactccctagtgaagctaaagcacggcgctggcgtagcaatggatggccaggacgttcagttgcccttactgaagggcgacctcaggattcaacatacggtcactgcctcggttaggctctcatatggtgaagatctccagatggattgggacggacgggggcgactgctagtgaagctgagccctgtttacgcagggaagacttgtggtctgtgcggcaactataacggaaaccagggggacgacttcctgaccccttccggcctcgccgagcctcgcgtggaagatttcggcaacgcctggaagttgcacggagactgtcaagaccttcagaaacagcacagcgacccctgcgctctcaaccccaggatgacccggttctctgaggaggcctgcgcggtccttacctcccccaccttcgaagcctgccaccgcgccgtatccccattgccgtaccttcgcaattgtcgatatgacgtgtgtagctgtagcgatgggcgggaatgcttatgcggggccctggcctcttatgcagctgcctgcgcgggtaggggtgtgcgggtggcatggagagaaccgggtcgctgcgaactgaattgtccaaagggccaggtgtacctccagtgcggcactccatgcaacttaacctgtcggagtttgtcttatcctgacgaagaatgtaatgaggcatgcctcgaaggatgtttctgcccgcctggactatatatggacgaacgaggagattgtgttccgaaagctcagtgtccgtgctattacgacggtgaaatattccagcctgaggatattttctccgatcaccatacgatgtgttactgcgaagatgggtttatgcattgcactatgagtggggttcctggctcgctgctgcctgacgcagtgctgtccagtccactatcgcatcggtccaagaggagcttgtcttgccggccccccatggtgaaactcgtgtgccccgctgataatctacgtgcggaaggcctcgagtgcaccaagacatgccagaactacgatctggagtgtatgagcatggggtgtgtgtcaggctgtctgtgtccccccggtatggtcagacacgagaataggtgtgttgcactggagagatgcccctgcttccatcagggcaaagaatatgccccgggggagaccgttaagattggttgcaacacttgtgtctgtcaagaccgcaaatggaactgcaccgaccacgtctgtgacgcgacttgtagcaccattgggatggcgcactacctaacattcgacgggcttaaatatctgttccctggggagtgtcagtacgtcctagtccaagattactgcgggtctaacccgggaacatttcggatactcgtgggcaataaggggtgcagccacccttcggttaaatgtaaaaagcgggtgactatccttgtcgaaggcggtgaaatcgaactgttcgatggtgaggtgaatgtcaagaggcctatgaaggatgaaacccacttcgaggtggtcgaatcggggaggtacattatactcctgctggggaaggcactgtctgtcgtttgggacagacacttgtccatctccgttgtgcttaaacagacttatcaggagaaggtctgcgggctctgcggcaactttgacggaattcagaacaatgacttgacttcatcgaatctgcaggttgaggaggacccagtcgatttcgggaatagttggaaggtgagctcgcagtgcgcagacacacggaaagtgcctctagacagtagcccagctacatgtcacaacaatatcatgaagcagacaatggtggattccagttgccggattcttacctctgacgtgtttcaggactgcaacaaactcgtagaccctgaaccctatctggatgtctgcatatatgacacctgttcttgcgaaagcattggagattgcgcctgtttctgcgatacaattgccgcatatgcccatgtctgtgctcagcacgggaaggtagttacatggaggacagccaccttgtgcccccagagctgtgaggagaggaatctacgcgaaaacggatacgagtgtgaatggagatataattcatgtgcccccgcctgtcaggtaacctgtcaacatcctgaacccctggcgtgccctgtgcagtgtgtcgagggttgccacgcccattgcccgcccgggaagatactggatgagctgctacagacatgtgtggatcctgaagactgtccagtatgtgaggtggctggtcggcggtttgcgagcggaaaaaaggttaccttaaacccatcagatccagaacattgccagatctgccattgtgatgtggttaatctgacctgcgaggcatgccaagagcctggtggcctcgtggtcccacctaccgacgctcccgtttctcccactactttgtacgtagaggatatatcagagccacctctacatgacttttattgcagccggttgctcgacctcgtttttctccttgacggatcttctcggttatccgaggccgaatttgaagtcctcaaagcatttgtggtggatatgatggagcgtttacgcatctctcagaagtgggtgcgtgtggcggtcgtggagtaccacgacggtagtcatgcctatattggcttgaaggatcggaaacgccccagtgagctcaggcgtatcgccagccaggtgaaatacgctggaagccaagtggcctcaacctctgaggtgctcaagtatacattgtttcagattttcagtaagatcgaccgacccgaggcctcccgcatcacactgctgttgatggcatcacaagagccgcagaggatgagtcgaaacttcgtgagatatgtgcaggggctgaaaaagaaaaaggtgatcgtgattccagtcggtatcggacctcacgctaatctaaagcagatccgtctcattgaaaaacaggctccagagaacaaggcctttgtgctttcctcggtcgatgaactggagcagcaacgcgatgaaattgtaagctatctctgtgacctggccccggaagcgccaccccccaccctgccaccagacatggcacaggtaacagtcgggccaggcttacttggtgtgtccactcttggacctaagcgcaactctatggtattagatgtcgccttcgtgctggagggaagtgacaaaatcggtgaagccgattttaatcgctctaaggagtttatggaagaggtcatccagagaatggatgtcgggcaggatagcatccatgtcactgttctgcaatatagttacatggtgactgtcgaatatcctttctccgaagcccagtccaagggcgacattttgcagagggtgcgcgaaattcggtaccaggggggtaatcgcactaatacaggcctggcactcaggtatctgagcgaccatagcttcctggtgagtcagggggaccgcgagcaggcaccaaacctggtctatatggtgactggtaaccccgcgtccgacgaaattaaacggctgcctggcgatatacaagtcgtgcccattggcgtgggacctaatgccaacgtgcaagaactggaaagaataggttggcccaacgcccccatactgatccaggacttcgagacgttgcccagggaagcccccgatcttgtcctgcagaggtgctgctcaggcgagggtcttcagatccccactttaagtcccgcccccgactgtagccaacctctggacgtgattctgcttcttgatggatcgagctcattccctgctagctatttcgacgagatgaaatcattcgctaaggctttcatctccaaagccaatatagggcccaggctgacacaggtaagcgtgttgcagtacgggtcaattaccacaattgacgtgccttggaatgtggtgccggaaaaagcccacctgctaagcttagtggatgtcatgcaacgcgagggcggcccctcgcaaattggggatgccctaggatttgctgtgcgttacctcaccagcgagatgcacggcgcccgacccggtgcgagtaaggctgtggtgattctggttacagacgtcagcgtggactccgtggacgcagcggctgacgcggctaggtcaaaccgagtcaccgtgttcccaataggtattggcgaccgctatgacgccgctcagcttagaatcttggccggcccggccggggattctaacgtcgtcaaactgcagcgcatagaggatcttcctaccatggtgactttgggtaactcctttttacacaaactgtgttctgggtttgtgagaatttgcatggatgaagatggtaacgagaaacgtccaggtgacgtatggacacttccagatcagtgccacaccgtgacgtgccaacctgacggtcagactcttctgaagtcgcaccgcgttaactgcgaccggggcttgcgaccctcatgcccaaactcccagagcccggtgaaagtggaagaaacctgtggctgtcgatggacttgcccctgtgtgtgtactgggagctccacccggcacatcgtgacatttgacggccagaacttcaaactgactgggagttgtagctacgtgttgttccagaataaagaacaggatctcgaagttatcctacataatggggcgtgcagccctggggcacggcagggctgtatgaaatcgattgaagtgaagcactcagcgctgtcagtagaactacatagtgacatggaggtcactgtgaatggcagactggtctctgtgccgtacgtgggagggaacatggaagttaacgtttatggggccattatgcatgaagtgagattcaatcacctgggccatattttcactttcaccccacagaacaacgaatttcagctgcagctttcacccaagacgtttgcctctaaaacgtatggcctgtgtggtatttgcgatgagaacggcgctaacgacttcatgttacgggacgggaccgtgaccaccgactggaagacgttagtgcaagaatggacagttcagcgtccaggccaaacctgccaaccaattctggaagaacagtgtcttgtgccagatagttctcactgccaggtactgctcctgcccctgttcgccgagtgccacaaggtcctggctccggcaaccttttatgccatatgccaacaggacagctgccatcaagagcaagtctgcgaggtcatcgcttcctatgctcatttatgtaggactaatggcgtgtgcgtcgactggagaacgccagatttttgtgctatgagctgcccacccagtctggtgtataaccactgcgagcacgggtgccccagacattgcgacggcaacgtcagtagctgcggcgaccacccttcagaaggctgtttctgccccccagacaaagtgatgctcgaaggaagctgtgttcccgaggaggcctgtacacaatgtataggtgaggacggggtccagcatcagttcctagaagcgtgggtgcctgaccaccagccatgccagatatgcacatgtttgagcggtcgcaaagtgaactgcaccacacagccgtgccctaccgcgaaggctcctacctgtggcctctgtgaggtagcccggctgaggcaaaacgccgaccagtgctgccccgaatatgagtgtgtgtgcgatccggtgtcatgcgacctgcctccagtgcctcactgtgaaagggggttacaacccacattaacgaatcctggcgaatgtagaccgaacttcacatgcgcttgtaggaaggaggagtgcaaacgcgtctcgcccccttcttgtcctcctcacaggttacccactctcagaaagactcagtgttgtgatgagtatgaatgcgcatgtaactgtgttaactctactgtttcctgtcccctgggttatttggcctcaaccgcaacaaacgactgtggctgcaccactaccacgtgcctgcctgataaagtgtgcgtgcataggagcaccatttacccagtggggcagttctgggaggaaggctgcgacgtgtgtacctgtaccgatatggaggacgccgttatggggctccgtgtcgcccagtgctcccagaaaccctgcgaggacagctgccgttctggctttacatacgtgctacatgagggcgagtgctgcggaaggtgtcttccatcggcttgcgaagttgttaccggctcccctcggggggactcccagtcttcctggaagtccgttggatcacagtgggccagtcctgaaaacccgtgcctcattaacgaatgtgtgcgcgtgaaagaggaagtcttcattcagcagcgcaacgttagttgtcctcagctggaggtgcctgtgtgcccaagcggcttccagctgtcttgcaagaccagtgcctgttgcccctcttgtcggtgcgagcggatggaggcctgtatgctcaatggcacagtgattgggcccggaaagactgtcatgattgatgtgtgcactacatgtaggtgtatggtccaggttggcgtaatctctggcttcaagctggagtgccggaaaacgacatgtaacccatgccctcttggatataaagaggaaaacaatacaggagagtgctgtgggcgctgtctgcccaccgcctgcaccatccagcttagaggcggtcagatcatgacacttaagcgggacgagaccttacaggatggttgcgacacccatttctgcaaggtgaacgaacgcggcgaatacttttgggagaagcgagttaccggctgtcccccttttgatgagcataagtgcttagctgaaggtgggaaaattatgaaaattcctggtacctgttgcgacacctgcgaggaaccggaatgtaacgacatcactgcacggttgcagtatgtaaaagtcggctcgtgcaagtcagaggtggaagtcgacattcattactgccagggaaagtgcgcgtcaaaagccatgtattcaatcgacatcaacgatgtgcaggatcagtgtagctgctgtagtcccaccaggacagagcccatgcaggtggccctgcactgtacaaatggcagcgtggtgtaccatgaagtgcttaacgccatggagtgcaaatgctcacccaggaaatgctcaaaa

SEQ ID NO: 21412 - DNA, 8439 bp, Artificial Sequence; identical to SEQ ID NO: 21386
  Description of Artificial Sequence: Synthetic coding sequence

SEQ ID NO: 21413 - DNA, 8439 bp, Artificial Sequence
  Description of Artificial Sequence: Synthetic coding sequence
atgattcctgcccgctttgccggcgtattgctcgccctggctctgatcctgcctgggacactctgcgcagagggaacacgaggcaggtcaagcaccgcccggtgttcactcttcgggtccgactttgttaatacattcgacggcagcatgtattccttcgctggctactgcagctacctgctggccggtggatgccagaagaggtctttcagcattatcggcgactttcagaatgggaaaagagtgagcctgtcagtctacctaggggaatttttcgatatccatctgtttgtgaatggcaccgtgacccagggggatcagagggttagtatgccctacgcaagcaaaggattatacctagagaccgaggccggttattataaattgtctggcgaggcctacggcttcgtggctaggatagatgggtctgggaatttccaggtactgctttctgaccgctattttaacaaaacctgtggtctctgcggcaattttaatatcttcgccgaagatgacttcatgacccaggagggtacactgacaagtgacccatatgacttcgcaaactcttgggcactaagcagtggcgagcagtggtgtgaaagggccagtccaccctcgtcctcatgtaatatcagtagtggggaaatgcaaaaagggctttgggaacagtgtcagctcctcaagtccacctccgttttcgctaggtgtcatcctctagtggatcccgaaccttttgtggcgttgtgcgaaaaaactctgtgcgaatgtgccggagggctcgagtgcgcttgccctgctctcctagaatatgctcggacttgtgcgcaggaagggatggtgttgtacgggtggacggatcacagcgcatgcagtcccgtctgccccgctggcatggagtatcggcagtgtgtgtccccgtgtgcccgcacctgtcaaagccttcacatcaacgaaatgtgtcaggaaaggtgcgtcgatggttgctcatgtccggaaggacagttgctagatgaaggactctgcgtggagagcactgagtgcccatgcgtccactccgggaagcgatatccacccggaacctctcttagcagggactgcaatacttgcatctgccgaaattcccagtggatctgcagtaatgaggaatgcccgggagaatgtctggtgaccgggcagtctcattttaaaagttttgacaacagatactttactttctctggcatctgtcagtacctgctcgctcgcgactgtcaggatcactcgttctcaattgtgatcgagaccgtccaatgcgccgacgaccgtgacgccgtttgcacgcgttctgtgaccgtcagactgcctggtctgcacaactccttggttaaactgaaacatggcgcgggagtggccatggacgggcaggatgttcaattgccactgttgaagggagacttgagaatccaacacaccgtaacagccagcgtgcgtttatcttacggggaggatctgcagatggactgggacggcagaggccgacttctggtgaagctgtcacctgtttacgcaggtaagacttgtgggctatgtggaaactacaatggcaaccaaggtgatgactttctcactccgtcaggcctcgctgagccacgtgtcgaggattttggcaatgcgtggaagctgcacggcgattgccaggatctgcagaagcagcacagcgatccttgcgccctgaatccccggatgacacgcttctctgaagaggcttgcgcagtgctgacgtctcccaccttcgaagcctgccaccgagctgtctcgcctcttccctacctgcgaaattgcaggtacgacgtgtgtagctgctcagatggaagagagtgtttatgtggcgcgttagcttcatacgcagctgcctgcgcaggacgcggggttcgggtggcctggcgcgagcccggccgctgcgaactgaattgtccaaagggtcaggtctatctgcagtgtggaactccctgtaatctcacatgcagaagcctgagctaccccgatgaggaatgcaacgaggcatgcctcgagggctgcttctgcccgcccggactgtacatggacgagcgcggcgactgtgttcctaaggcacagtgcccttgctattatgacggagaaatctttcaaccagaagacatcttctccgaccaccatactatgtgttattgtgaggacgggttcatgcactgcacaatgtccggcgtgcctggttctctactgcccgacgccgtactgagctcgcctttgtctcatagatctaagcggtccctaagctgccgaccaccgatggtcaaactggtgtgtcctgccgataacttgagggctgaagggctcgagtgtacaaagacatgtcagaattacgacttagagtgtatgtccatgggctgcgtctctggttgcctatgcccacctggcatggtacgacatgaaaatcggtgtgtggccctggaaagatgcccctgcttccaccaaggtaaagaatatgcccctggggagactgtgaagattggctgcaacacctgcgtgtgccaggaccggaagtggaactgcaccgatcacgtctgtgatgcaacttgctctacgatcggcatggcccactacctaacattcgacggtctgaaatatctgtttccaggagagtgtcagtacgtgctggttcaggattattgtgggtccaacccagggacctttcgtatactggtgggtaacaagggctgcagtcatccctcggtcaagtgcaaaaaacgggtcacgatccttgtagaaggcggggagatagagctctttgacggtgaggtaaacgttaagaggccaatgaaggatgaaacccattttgaggtggtggaaagtggcaggtatatcatcttgctcctgggtaaagctctttccgtcgtgtgggatcggcacctctcgatcagtgtcgtgctgaagcagacctaccaggaaaaggtctgcggtctctgcggaaacttcgacgggattcaaaataacgatctcacgagcagcaatctgcaggtggaagaggatcccgtggactttgggaatagctggaaggtttcaagccagtgtgctgatacgcgaaaggtaccccttgattcctcgcccgctacctgccataataacattatgaaacaaacaatggtcgactccagctgtcgcatcttaacatcagatgtgtttcaggactgcaataagctcgtggacccggagccttatctcgatgtgtgcatctatgatacatgctcttgcgagtcaatcggggattgtgcatgcttttgcgatacgatcgccgcatacgcccacgtatgcgcacagcacgggaaagtcgtcacttggagaactgctacactttgcccccagagctgcgaagagcgcaatctgagggagaacggttacgagtgcgaatggcgttataactcctgcgcgccagcctgccaggtgacatgtcaacatcctgaacccctcgcatgccccgtgcagtgcgtggagggctgtcatgcccactgccctcctgggaagatacttgacgaactcctgcagacatgcgtcgatcccgaggattgtcccgtttgcgaagtcgcgggccgaagatttgccagtggcaagaaggtcactctcaatccatccgacccagagcactgtcagatctgccactgcgatgtggtgaacctgacttgtgaggcctgtcaggaacccggcgggttggtggtaccaccaaccgatgcccctgtgtctcccacaacactgtatgtcgaggacatcagcgagccgcctctccacgacttctactgctcccgcctgttagatttggtgtttctgcttgacggttctagcaggctgagcgaggccgagtttgaggttttaaaagcctttgtcgtggacatgatggagaggttgcggatcagccaaaagtgggtgagagtcgccgtggtggaataccatgacggaagccacgcctatattggcctaaaggaccgaaaaagacccagtgaactgcgtcgcatcgcaagtcaggtcaagtacgcgggcagtcaagtggccagcaccagcgaggtgctaaagtacaccctcttccaaatattcagtaaaattgaccggcccgaagcaagtaggataactctcctgctgatggcaagccaggaaccccaacggatgagtaggaacttcgtgcgttacgtgcagggccttaagaagaaaaaggttatcgtcatccctgtgggtatcggtccccatgcaaatctgaaacagattagactcattgagaagcaggccccggaaaataaggctttcgtgctgtcctctgtcgacgagctggagcagcagcgggacgaaattgtatcctatctatgtgatctcgcgcccgaggcccccccgcctactctgcctcccgacatggcccaggttaccgtggggccaggtctgttgggcgtcagcacactgggtcctaagagaaattccatggtccttgacgttgcgttcgtcctggaaggtagtgataaaatcggcgaggccgacttcaatagatcaaaagaatttatggaggaagtaatccagagaatggatgtgggccaggacagtattcacgtgaccgtgcttcagtatagctatatggtcacagtggagtatccattctccgaggctcagtctaagggcgatatcttgcagagggtcagagaaattcgctatcagggcggtaataggacaaataccggcctggctttgcgatatctgtctgatcattccttcctggtgagccagggcgatagggagcaggcgcctaatctggtctacatggttaccgggaatcctgccagtgatgaaatcaagcgattgccgggagatattcaggtggtgcccatcggcgttggcccaaacgccaatgttcaggagctggaaagaatcggatggccaaatgcacccatcttgatccaggactttgaaacactcccccgggaggcccccgacctggtgcttcaaaggtgttgctctggagaggggttacagatccctacgctcagccctgcacccgactgctcacagccacttgatgtgattcttctgctcgacgggagctcttcattcccagcctcctacttcgatgagatgaagagcttcgccaaggctttcatttctaaagcaaacataggccctagattaacccaggtgtctgtactccagtacggcagcatcacgacaattgacgtgccctggaacgtcgtgcccgagaaagcacaccttttgagcctcgtcgatgtcatgcagagggaagggggaccgtctcagataggggatgctctgggctttgccgtgaggtacctgacgtctgagatgcatggagccagaccaggggctagcaaagccgttgtcatcctagtcaccgatgtgtccgtagacagtgtggatgcagccgctgatgcggcaagatcaaacagggtcaccgtgtttcctattgggatcggagacagatatgacgcagctcaactcagaatactggccggtcccgcaggagattcaaatgtggtcaaactccagaggatcgaggatctgcccacgatggtgacccttggcaattcatttctccataaactgtgttccggctttgttaggatatgtatggacgaggatgggaatgaaaagcgccccggcgatgtatggacattgcccgatcaatgtcatacggtgacgtgccagcctgacggtcagacactattgaagtctcatcgggtgaattgtgaccggggactaaggccaagttgccctaactctcagtccccagtaaaggtcgaggagacatgcgggtgccggtggacctgcccatgtgtgtgtaccggatcctccacccgacatatagtgacgttcgatgggcagaacttcaagttgacgggtagttgttcatacgtgctctttcaaaataaggagcaagacctggaggtcatactccacaatggcgcgtgctcccccggggcacgtcaaggttgcatgaagagtattgaggtaaagcattcagcactgtccgtagagctgcacagcgatatggaggtgacggtgaacggacgcttggtttcagtgccgtatgtcggtggtaatatggaagtgaacgtttatggcgcaattatgcatgaggtcagattcaatcatttgggacacatattcacttttacccctcagaataatgagtttcagctgcagctatctccaaaaacgttcgcctccaagacatacggactttgtggtatatgtgatgagaacggggccaacgactttatgctgcgcgacggcacggtgacaacagactggaaaacacttgttcaagagtggactgtgcagcgcccgggccaaacctgccagcctattctcgaggaacagtgcctggtgcctgacagtagtcactgccaggtgttactcctgcctctctttgccgagtgccacaaggttctcgctccagctactttctacgcgatctgtcaacaggattcgtgccaccaggagcaggtatgtgaggttattgcaagctacgcccatctgtgtcgtacaaatggagtctgtgtcgattggcggactcccgacttctgtgccatgagttgccctcccagtttagtgtacaaccattgcgaacacgggtgtcctcgacattgtgatgggaatgtttcatcctgcggcgatcatccatcagaaggctgcttttgccctcctgacaaagtaatgctggaagggtcctgtgtgcccgaggaggcatgtacccagtgcatcggggaggatggcgtacagcatcagtttttggaggcctgggtgcccgaccatcagccttgccaaatatgcacatgccttagcggcagaaaggtaaattgtacaacccagccctgccccactgctaaggcaccgacctgcggcctctgcgaggtggcaaggctgcgccagaacgctgaccagtgctgtccagagtacgagtgcgtttgcgaccctgtgtcttgtgacctccctcccgtcccgcactgtgagagaggtctccaacccaccctgaccaaccccggtgaatgtcggcctaatttcacctgcgcatgtagaaaggaggagtgcaagcgtgtgtcgccaccgagctgccctccacatcgcctccccacgctccggaaaactcagtgctgcgacgaatatgagtgtgcatgtaactgcgtgaatagcacagttagctgtcccttgggctacctggccagcaccgctaccaacgattgcggatgtaccaccaccacctgtctacctgataaggtgtgtgtgcaccgctctaccatctatcccgtgggtcagttttgggaagagggttgcgatgtctgcacgtgtactgacatggaggatgccgtgatgggactgagagtagcccagtgctcacaaaaaccatgcgaggacagctgtaggagcggttttacatatgttcttcacgagggagagtgttgcgggcggtgtttgccatcagcatgcgaagtcgtgaccggcagtccacggggggactcccagtccagctggaaatccgtgggctctcaatgggcttcgcctgagaatccctgtctgatcaatgagtgcgtccgtgtaaaagaggaggtatttatccagcagagaaatgtaagttgcccacagctggaggtccctgtatgtccctccggtttccagttgagctgcaagacatctgcatgttgtccctcttgtagatgtgaacgcatggaagcatgcatgctcaacggtacagtgatcggaccaggcaagaccgtgatgatcgacgtatgtacgacgtgccgctgtatggtccaagtcggtgttatttcgggcttcaaactcgaatgcagaaaaactacttgcaacccctgcccacttgggtataaggaagagaataacacgggagaatgttgcgggcggtgtctgccgactgcttgcaccatacaactgaggggaggccagattatgaccttgaagagggatgaaacgctgcaagatgggtgcgatacccacttttgtaaggtcaacgagcgcggggaatatttttgggagaagcgggtgacaggatgtccacccttcgacgagcacaaatgcctggccgaaggcggcaagattatgaaaatacctgggacctgctgcgacacctgcgaggagccggaatgtaatgacataaccgcccggttgcagtacgtgaaagtcggctcttgtaagtctgaagttgaggtggacattcactattgtcaaggtaagtgcgcttctaaagctatgtattccatcgatatcaatgatgtacaggaccagtgctcctgttgttctccaactcggaccgaacccatgcaggtggccctgcattgcaccaatggatcagtggtctaccatgaggtccttaatgctatggaatgcaagtgctcacctaggaagtgcagtaag

SEQ ID NO: 21414 - DNA, 8439 bp, Artificial Sequence
  Description of Artificial Sequence: Synthetic coding sequence
atgatacccgcacgtttcgcaggcgtcctcttggccctggcgctgatcctgcctgggaccctgtgcgcagaaggcacccgcggccgatctagcacggcccgatgcagcctgttcggttctgatttcgttaatacctttgacggcagcatgtacagctttgcggggtactgctcttatttgctggcgggcggctgccagaagaggtctttttccatcattggcgattttcaaaacggtaagcgcgtgtccctgagcgtgtatctcggtgagttttttgatattcacctgttcgtgaatggcacagtgacccagggcgaccagcgcgtgagcatgccgtatgcaagcaagggtctgtacctggaaacggaagcgggttattacaaactgagcggtgaggcttacggatttgtggcccgcattgacggtagcggcaatttccaggtactgctgagcgaccgctactttaataagacctgtgggctgtgcggcaacttcaatatctttgcagaagacgattttatgacccaggagggaacgcttaccagcgacccgtatgactttgccaacagctgggccttgagcagcggtgagcagtggtgcgagcgcgcgtctccgccatcaagctcttgtaacatttcctcaggagaaatgcagaagggtctttgggaacagtgccagctactaaaatccacgagcgttttcgcgcgctgccatccactggttgatccagagccattcgtggccctgtgtgaaaagactctgtgcgagtgcgcgggcggcctggaatgcgcctgccctgcgctgctggagtacgctagaacctgcgcgcaagagggcatggtcctgtatggctggaccgaccacagcgcgtgcagtccagtttgtccagcgggtatggaatatcgccagtgtgtctccccatgtgcgaggacctgccagagcctgcatattaacgagatgtgtcaggagcgctgcgtcgatggttgctcttgccctgagggtcagctgctggatgaaggcttgtgtgtagagtctaccgagtgcccatgtgtccacagcggtaagaggtatcccccggggacctcactgtcgcgcgattgtaacacgtgtatttgccgtaacagccagtggatctgcagcaatgaggaatgtcccggtgaatgcctggtgacgggtcagagccattttaaatcatttgataacagatattttacctttagcggtatttgccagtatctgttggctcgtgactgccaagatcactctttctccattgtcattgaaaccgtccagtgtgctgacgatcgcgatgctgtctgtacccggtctgtgacggttagactgcccggactgcacaattcgctggtgaagttgaaacacggcgcaggtgtggcgatggacggtcaggacgtacaactcccactgttaaagggggacttgcgcattcaacacactgtgaccgcatctgtgcgattgagctacggcgaggacctgcaaatggactgggatggtcgcggacgcctactggtgaaactttctccggtgtacgccggtaaaacgtgtgggctatgcgggaactacaacggtaaccagggggatgatttcctgacgccgagcggattggccgagccacgcgtggaagacttcggcaacgcttggaagctgcatggtgattgtcaagatctgcagaagcaacacagcgatccttgtgctctgaacccaagaatgacgcgtttttccgaggaagcctgtgcagtgctgacgtcaccaacgttcgaggcctgtcacagggctgtctctcctctgccatacctgaggaactgccgctatgatgtttgttcctgttctgacgggcgagaatgcctgtgcggtgcgcttgcgtcgtatgcggcagcgtgcgctggccgcggcgtccgcgtcgcatggcgcgaacctggtcgctgtgaactgaattgccctaaaggtcaggtttatctgcagtgtggtaccccgtgcaatcttacgtgtcgctccctgagctacccggatgaagaatgcaacgaggcatgcctggaaggctgtttttgtcctcctggcctgtacatggatgagcgcggagactgtgttccaaaagcacagtgcccttgctattatgatggcgagatcttccagcccgaggacatcttctctgatcaccacaccatgtgctattgcgaagacggttttatgcattgtacaatgagcggtgtgcctggaagcctgctgccagatgctgtgttgagcagcccgctgtcgcaccgcagtaagcgcagcctgagctgccgccctccgatggtgaaattggtgtgtcctgcggacaatctgcgtgctgagggcctcgagtgtacgaagacctgtcagaattatgatctggagtgtatgagcatgggatgcgtttctggttgtttgtgcccacctgggatggtcaggcatgagaatcgctgcgtcgcactggaacgttgtccgtgctttcatcagggcaaagagtatgcgcctggtgagactgtcaagataggttgcaacacgtgtgtgtgtcaggaccgcaagtggaattgtaccgaccacgtgtgtgacgcaacctgctccacgataggcatggctcactacctcaccttcgacggcctcaaatatctgtttcctggtgagtgtcagtatgtattggtccaggactattgcggaagcaacccgggaacttttcgcattctggtcggtaataaaggttgttcccacccgagcgtcaagtgtaagaagcgtgtaacaattctggttgagggtggtgaaatcgagctgtttgatggcgaagtaaacgtaaagaggccaatgaaggatgagacccattttgaagtggtggagagtggccgatacattattctactattaggtaaggcgctgtctgtggtctgggaccggcatctgagcatctccgtcgttctgaaacagacttatcaagaaaaggtgtgcggcctgtgcggcaactttgatggtatacaaaataatgacttgacctcttctaacctgcaagtagaggaagatccagtggatttcggaaattcctggaaagtttcctcccagtgtgccgacaccaggaaggtgccattggactcctcgccggcgacctgccataacaacattatgaagcagactatggtggatagctcctgtcgcattttgacgagcgatgttttccaggattgcaacaagctggtcgatccggaaccgtacctggacgtgtgtatctatgatacgtgtagctgcgagtctattggtgactgcgcgtgcttttgcgacacaatcgcggcgtacgcgcatgtttgcgctcagcacggtaaggtggtgacttggagaactgcgaccctgtgcccgcagtcatgtgaggagcggaacctgcgcgaaaatgggtatgagtgtgagtggcggtacaactcctgtgctccggcatgccaagttacgtgccagcacccggaaccgctggcgtgcccggtccaatgcgtggagggttgccatgcacactgcccgcccggtaaaatactggacgagctgctgcagacctgcgtggacccggaggactgcccggtctgcgaagttgctgggcgacggttcgccagcggtaagaaggttacgctgaacccgagcgatcccgagcactgccaaatatgtcactgcgacgttgtgaatctgacttgcgaggcctgccaggaaccgggaggtctggtcgtgcctccgactgatgcaccggttagcccaaccaccctctacgtggaggacatttccgagccgccattacatgatttctactgctcccgcctattggacctggttttcttgctcgatgggtcatcccgcctgtcggaagctgaattcgaggtcctgaaggcttttgttgtggatatgatggagcgcctgcgcatcagtcaaaaatgggtgagagttgcggtcgttgagtaccatgacggtagccatgcatacattggtctgaaggatcgcaagcgcccttcggagctccgccgcatcgcaagccaggtgaagtacgctggttcacaagtggcgagtaccagtgaagtgctcaagtatactctgtttcaaatattttctaagatcgaccgccctgaagcatctcgtattaccctgctgctgatggcgtcgcaagaaccgcagcgcatgagccgcaacttcgtccgttacgtccaggggctgaaaaagaaaaaggtgatcgtcattccagtgggtatcggtccccacgcaaacctcaaacagatccgtctgatcgaaaagcaggctccagagaataaagccttcgttctttcatcagtcgatgaactggaacagcaacgagatgaaattgtgagctacctgtgcgacttagctcccgaagcgccacccccgacgttgcctcctgacatggcgcaagtcaccgtgggccctggtctgctgggtgtgtccaccctgggtccaaagcgtaactctatggtgctggatgttgcttttgtgttggaaggtagcgataagattggtgaagcggatttcaaccggagcaaggaatttatggaggaagtgatacagcgaatggacgtcggtcaagatagcattcatgttactgtgctccagtatagctacatggtgaccgtggagtacccattcagcgaagcgcagagcaagggtgacatcttacaacgcgtccgcgaaattcgataccagggtggtaacagaactaacactggactggccctgcggtacctgtcagaccacagcttcttagtgagccagggtgatcgcgagcaggcgccaaatttggtgtatatggtcactggaaacccagccagcgatgagattaagcgcctgcctggtgacatacaggtcgttccgattggtgtgggtcctaatgctaatgtacaggagctggaacgcatcggttggcccaatgcacccattctgatccaggactttgaaaccctcccacgcgaagctcctgacctagttttgcagcggtgctgcagcggtgagggtctgcagattccaaccttgagcccagccccggactgcagccagccgctggacgtgatcctgctgctagacggctcctcctcctttccggcctcatatttcgacgagatgaaaagctttgcgaaggcgttcatctccaaagcaaacattggccctcgcttgacccaggtcagcgtgctgcagtacggctctatcaccactattgatgtcccgtggaacgtcgtgccggaaaaggcacatctgctttctttagtcgatgtgatgcagcgggaaggaggtccgtctcaaattggtgatgcgctgggcttcgccgtgcgctatcttaccagcgagatgcacggtgcacgtccgggcgccagcaaagcagtcgtgatcctggtcacggatgtttcagttgatagcgtggatgccgccgctgatgccgcccgtagcaatcgtgtgactgtcttcccaatcgggattggggataggtacgatgccgcacagctgcgcatcctggcaggtcctgccggcgatagcaatgttgtgaagctgcaacggatcgaggatctgccgaccatggttactttaggtaactcctttctgcacaaactgtgctctggttttgttcgcatttgcatggatgaagatggtaatgagaaacgcccaggcgatgtgtggactctaccggaccagtgtcataccgttacctgccaaccggacggacagacgttgctgaaaagccaccgtgtaaattgcgaccgcggactgcgccctagctgccctaattcccaaagcccggtgaaggttgaggaaacatgcggatgtcgctggacctgtccgtgtgtttgcactggcagctctacgagacacatcgttactttcgatggtcagaatttcaaactaactggcagttgttcctacgtcctgtttcaaaacaaggagcaggatctggaggtgatcttgcacaatggtgcctgtagcccaggcgcgcgccaaggctgcatgaaatcaatcgaggttaaacatagcgcgctgtctgtggagctccattcagacatggaggtcaccgtgaatggccgtctggtctccgttccttacgtgggtggcaatatggaggtcaatgtgtacggtgccattatgcacgaagttcggttcaaccatttgggccacattttcacatttacgcctcagaacaacgaatttcaactgcagctctctcctaaaactttcgcaagcaagacttacggattgtgcggtatctgtgatgaaaatggcgctaatgacttcatgctgagagatggcacggtgaccaccgactggaagacgctggtccaggaatggacggtgcaaagacctggtcagacctgccaacctatcctcgaagagcagtgcttggtgccagacagcagccattgccaggtcctgctgctacctctgtttgctgagtgtcataaggtgctggcgccggcaaccttctacgctatctgtcagcaggacagctgccaccaggaacaggtgtgcgaggtgattgcttcctacgcacacctgtgcaggactaatggtgtctgcgtggattggcggaccccggatttctgcgctatgtcttgtcctccttctctggtgtataaccactgtgagcacggctgtccccgtcactgcgacggaaatgtgtcttcgtgcggcgaccacccatctgagggttgcttttgtcctccagacaaagtcatgctggaagggagctgcgttccggaggaggcatgcacgcaatgcatcggggaagacggtgttcagcatcaatttctggaagcctgggtgccggatcaccaaccgtgtcagatttgcacgtgtctctcaggtcggaaggtgaattgcaccacacagccatgtccaaccgcgaaggccccaacgtgtggtctgtgtgaggttgctcgcttgcgccaaaatgcagatcagtgttgcccggagtatgagtgcgtctgcgacccggtgtcctgtgatctgccgcctgtgccacactgtgagaggggtctgcagcctaccctgactaacccaggggagtgcagaccaaattttacctgcgcatgccgcaaagaggagtgcaaacgcgttagcccaccttcttgccccccacatcgcttgcccacccttagaaagactcagtgttgtgacgaatatgagtgcgcctgcaattgcgtgaactctaccgttagctgtccgctggggtacttggcaagtacggccacgaacgattgtggttgtacgactacaacgtgcctgcctgataaagtgtgtgttcaccgctccaccatttaccctgtcggccagttttgggaagagggttgtgacgtatgcacctgtaccgacatggaagacgcagtgatgggtctgcgtgttgcacagtgctcccagaagccctgcgaggatagttgccggagtggattcacctacgtcctgcatgagggagagtgctgtggccgctgcctgccaagcgcgtgtgaagtcgtgaccggcagcccgcgcggtgacagccagagttcatggaaaagcgttggttctcagtgggcgtctccggagaacccttgtctgattaacgagtgcgtgcgcgtgaaagaggaagtattcatccagcagcggaacgtgtcttgcccccaactggaggtccctgtttgcccttccggcttccagctgagctgtaaaacgtcggcgtgctgtccgagctgccgctgtgagcgcatggaggcgtgcatgctcaatggcaccgtcatcggtcctggcaagacagtcatgattgatgtctgcacaacatgtagatgtatggtccaagtcggggttatcagcgggttcaaactggaatgtcggaagaccacctgcaacccgtgccctctgggctacaaggaggaaaataataccggtgagtgttgtggaagatgcctgcctacggcctgcaccattcagctgcgaggcggccagattatgacgttaaagcgcgacgaaactttgcaggacggctgcgacacccacttttgcaaagttaatgagcgaggtgagtatttttgggagaaacgcgtgaccggctgtccgccatttgacgagcataaatgtctcgctgagggcggcaagatcatgaagatcccaggcacctgttgcgacacctgtgaggaaccggaatgcaatgacatcacggctcgccttcaatatgtgaaggttggctcgtgtaaaagcgaggtggaagttgatatccactattgccaaggcaagtgcgcttccaaagctatgtattccatcgacattaatgatgttcaggatcagtgctcttgttgcagcccgacccgaactgagccaatgcaagttgcgctgcactgcaccaacggaagtgtggtttaccatgaggtgctgaatgccatggaatgtaaatgctcgccgcgcaaatgttcaaag

SEQ ID NO: 21415 - DNA, 8439 bp, Artificial Sequence
  Description of Artificial Sequence: Synthetic coding sequence
atgatcccagctcgcttcgcaggtgtgctgctggctctcgcactgatcctcccgggcacattatgtgcagagggaacccggggaagaagtagcacagctaggtgtagcctgttcggttctgactttgttaatacgttcgatgggagcatgtactcgttcgctggttattgctcctacttgcttgcagggggttgccagaaaaggtctttctccatcattggtgatttccagaatggtaaaagagtgtcgctgtccgtgtatttgggcgagttttttgacattcacttgttcgttaacggcactgttacccaaggcgatcagcgcgtaagtatgccttacgctagcaaaggcttatatctggaaacagaggctgggtattataaactctctggagaagcctacggtttcgtggcccgtatcgacggatccggaaacttccaggtcctgctatcagaccggtacttcaacaagacctgtggtctttgtggaaacttcaacatcttcgcggaggatgacttcatgacgcaggaggggaccttgacctccgatccatacgattttgctaatagctgggcactctccagcggagaacagtggtgcgagcgcgcatctcctccctcttcgagctgtaacatctcctcgggggagatgcagaaaggtctgtgggaacagtgccagctcttgaaaagtaccagtgtttttgcccggtgccacccattggtggacccagagccgttcgtggccctttgcgagaagacgctgtgtgagtgcgccggcggcctggaatgtgcctgtcccgccttattggagtacgcccggacatgtgcacaggaaggcatggtgctttacggctggaccgatcactcagcatgttcacccgtgtgtcctgctggcatggagtacaggcaatgcgtcagcccctgtgcccggacttgtcagtccctccatatcaacgagatgtgccaggagaggtgtgttgatggttgcagctgtcctgaaggtcagctcctcgacgaggggttgtgtgtagaatctaccgagtgtccctgcgttcacagcggaaagcgctatccacctgggactagtctatcacgggattgcaatacatgcatatgccggaattcccagtggatttgttctaacgaggagtgccctggcgaatgtctcgtgaccggtcagagccacttcaaaagcttcgacaatcggtatttcacatttagcggtatctgtcaatatctgttggctagagactgtcaggaccactctttcagcatagtgattgagacagtgcagtgcgctgatgacagggacgcagtgtgtactagaagcgtgaccgtgcgtctccccggtctccacaacagtttggtgaagctgaaacatggagcaggggtcgcgatggatggccaggatgtgcaactgccgttgctcaagggagatctgcggattcagcacacagtcactgccagtgttcgactgagctacggagaggacttgcagatggactgggacggcagggggaggttgttagtcaaactaagcccagtgtatgcgggaaaaacttgtggcctctgtggaaattataatggcaaccagggagatgactttctcacaccctcagggctggctgaacctagggttgaggattttgggaatgcttggaaactgcacggagattgtcaagatttacagaagcaacactcagatccttgcgctctgaacccccgcatgaccagattcagcgaagaggcatgcgccgtccttacatctcccacgttcgaagcctgccacagggcagtcagcccgttgccttatctgagaaattgccgttatgatgtctgcagttgtagtgacggccgagagtgcctgtgcggtgccctagcctcctacgcagccgcttgtgccggaagaggggtccgtgttgcatggcgcgagcccggccggtgtgagctaaattgccccaaaggacaagtctaccttcagtgtggcaccccctgcaatcttacctgccgtagcttatcctatccagacgaggaatgcaacgaggcttgcctagaggggtgtttctgtcctccgggtctttacatggacgagagaggggattgtgtcccaaaagcccagtgtccctgttactacgatggcgagatctttcagcccgaggatattttctccgaccaccatacaatgtgctattgtgaagatgggttcatgcactgtacgatgagtggtgttcccggttccctgctacccgatgcagtattgagcagccccctgagccaccggtctaaacggagtctctcatgccggccgccaatggttaagttagtgtgccccgccgataacttgagagccgaaggactggaatgcaccaaaacgtgtcagaactacgatctggagtgcatgtctatggggtgcgtgagtgggtgtttgtgtcctcctggaatggtcagacacgagaaccggtgcgtcgcactggaacgctgcccgtgctttcaccaaggaaaggagtatgcgcctggcgaaactgtgaaaatcgggtgtaatacctgcgtgtgccaggataggaaatggaattgcaccgaccatgtttgtgatgcaacctgctccacgattggtatggcccattacctgacctttgacggcttgaagtacttgtttcccggggagtgtcaatatgtcctcgtccaggactactgtggatctaaccccggaacatttcgcatcctggtggggaataaaggctgttcgcatccctctgttaagtgcaagaagcgcgttactattctggtggagggtggagaaattgagcttttcgacggtgaggtgaacgttaagagaccaatgaaggacgaaactcactttgaagtcgtagagtctggccgttatataatcctcctgttaggcaaagctctatctgtggtgtgggatcgacatctgagcatctccgttgtactcaagcaaacttatcaggaaaaggtctgcgggctatgcggcaattttgatgggatccagaacaatgacttgacttcctctaacctgcaggtcgaagaagacccggtggactttggtaattcttggaaggtgagttcccaatgcgcagataccagaaaagtgccactcgattcatctcccgccacgtgccataataacattatgaagcagaccatggtagactcttcctgccggatccttacatcagatgtgttccaggattgcaacaagctcgtagatccagagccctaccttgacgtgtgcatctacgatacttgtagctgcgagtcaattggggactgtgcatgtttttgtgatactatagcggcttacgcacatgtgtgcgctcagcatggaaaagtggtcacctggagaacagccaccctatgtccgcagtcctgcgaagagcgcaacctgagagagaatggctatgagtgcgagtggaggtacaactcttgtgcacctgcatgccaagtgacttgccagcatccagagccactcgcatgtccagtacagtgcgtggagggttgtcacgcccactgccctcctggtaagattctagacgagctcttacagacgtgtgtggaccctgaagattgcccggtgtgtgaagtagcaggacggcgattcgcttctggaaaaaaggttaccctgaaccccagtgatcccgagcattgccagatctgccactgtgatgttgtgaacctgacatgcgaggcctgccaggagcctggcggcctggtagtgccccctacggacgccccggtgtcacccaccacactgtacgtcgaggacatctccgagcctcctctgcacgacttctactgttcacgtctgctggatctggtgtttctgctcgacggctcgtcgcgcctgtccgaggctgaatttgaggtgctgaaagcatttgtagtcgacatgatggagcggctccgtatatcacagaaatgggtgcgcgtggccgtggttgagtaccacgacgggagccacgcatacatcggactgaaggatcgaaagaggccaagcgagcttcggcgcatagcttcacaggtaaaatacgcaggaagtcaagtggcgtcaacaagcgaagtgcttaaatacacactgtttcaaattttttccaagatcgaccggcccgaggcctcccgcataaccctgttgctcatggcttctcaggaacctcagcgcatgagccgaaacttcgtcaggtacgttcagggtctcaagaagaagaaggtcattgtcatacccgtcggaatagggccgcatgcgaatctgaagcaaatccggctgatagagaaacaggccccagagaacaaagcctttgttctctcctcagtagacgagctggagcagcagcgcgatgaaattgtaagttatctctgtgatcttgctcccgaagcaccaccccctaccctacctccggatatggcccaggttactgtagggcccggattgctgggcgttagcaccctgggccctaaacgtaattctatggtattggacgtggcctttgtcctggagggatctgataagattggggaggccgattttaaccgcagcaaggagttcatggaggaggtgatccagagaatggacgtgggacaagatagtatccatgtcaccgttcttcagtattcttatatggtaaccgtggaatatccattttcagaagcccaaagtaagggggacatcttacagagggtgcgggaaataaggtatcaaggggggaatcgaactaacaccgggcttgcattgaggtatctatccgatcactccttcctggtcagccaaggggatagggagcaggcacccaatctcgtttatatggtaacgggtaatcctgcatcagacgagatcaagagattgccgggcgatattcaagtggtgcccattggcgtcgggccaaacgcgaatgtgcaggagctggaaaggatcggctggcctaacgcaccaattctgattcaggatttcgagaccttgcctcgggaagctcccgacttagtcctgcaacgatgttgttccggggagggcctgcaaatccctacacttagtcctgccccagattgctcacaacccctagacgtgatcctgttgcttgatggcagtagcagctttccagccagctatttcgacgaaatgaagtcattcgctaaggccttcatttcaaaagccaacattggacccagactaacacaggtgagtgtcctccagtacggttctataaccacgatcgacgtgccctggaacgtggtccctgaaaaagcgcatcttcttagcctggttgatgttatgcaaagagaaggggggccatcacaaataggcgacgcactaggatttgctgtgaggtatctgacatccgagatgcacggagccagaccgggagccagcaaagcagtggtaattctggtgaccgacgtgtctgtcgattcagtggacgccgcggccgacgccgcacgatcgaatagagtgaccgtgtttcccattgggattggggatcggtacgacgccgcccagctgcgcatcctcgctggccctgccggcgactccaatgttgtcaaactgcagaggatcgaggacctcccgactatggtgactctgggcaacagcttcctacacaagctgtgttctggtttcgtccgtatctgcatggatgaggatggtaacgaaaaacggccgggggacgtgtggaccctacccgatcagtgtcataccgtgacctgccaacctgacgggcagacccttttaaagtcacaccgagtaaactgcgatcggggtttacgcccatcttgccctaatagtcagagcccagtaaaggtggaggagacctgtggctgcagatggacctgtccctgtgtttgtaccggatcttcaactagacacatcgtcactttcgatgggcagaacttcaaactaaccgggagttgtagttatgtgctgttccagaataaggagcaggacttggaagtgatcctccataacggagcctgtagtcctggagcgcgccaaggctgcatgaaatccattgaggtgaagcacagtgcgctaagcgttgagttacatagtgacatggaggtgactgttaacgggcgtttagtatcggtgccatacgtgggaggtaatatggaggtcaatgtgtatggcgccataatgcacgaggtgagatttaatcatctggggcatatcttcaccttcacacctcagaataacgagttccagctgcaactaagccccaaaacgtttgcctccaagacttatggtctatgcggtatatgtgacgagaacggcgccaatgactttatgctgcgcgatgggactgtgacaacagattggaaaactctcgtccaggagtggaccgtgcagcggccaggacagacttgccagccaatactagaggaacagtgtcttgtccccgactcttctcactgccaggtgctcctgctgccactgtttgccgagtgtcacaaggtgttagctcctgctacattctatgcaatttgccagcaggactcctgccaccaggaacaggtgtgtgaggttatcgctagttacgcacatctctgtaggacaaacggggtttgcgtggactggaggacacccgacttctgtgctatgtcatgccccccttctctggtgtataaccactgcgaacacggttgccctcggcactgcgatgggaatgtgtcatcttgcggagatcacccaagcgagggctgtttctgcccacctgacaaggtgatgttggaaggctcatgcgtaccagaagaagcatgtactcagtgcattggagaggacggtgtgcagcatcagtttctggaggcttgggtccccgaccaccagccatgccagatctgcacctgcctgtctggaaggaaggtgaactgcaccactcagccctgtccgacagctaaggcccctacctgtggcctttgcgaagtggctaggctcagacagaacgccgaccagtgctgtccagagtatgaatgcgtgtgtgatccagtgtcctgtgacttgcctccagtccctcactgcgaacggggtctccagcctactcttacgaaccccggcgagtgcagacccaacttcacgtgcgcttgtcgcaaagaggagtgcaagcgagtgagcccgccctcttgccctccgcatcgacttccaactttgaggaagacacagtgctgcgacgaatatgagtgcgcctgtaattgtgtaaacagtacagtgagttgcccgcttggttatcttgcttcaacagccaccaacgattgcgggtgtacgacgactacctgtctccctgacaaggtatgtgttcatcgctccactatttacccagtgggacagttttgggaggaaggatgtgacgtctgcacctgcaccgatatggaggacgctgtcatgggacttagagtggcccagtgttctcagaaaccttgtgaggattcttgccggtcggggttcacttatgtgctgcacgagggcgaatgttgtgggcgctgtctacccagcgcatgcgaggttgtgactggtagtcctcggggggattcacagagttcctggaaatccgtgggctcccagtgggcgtcgcccgagaacccatgtttgatcaacgaatgtgttcgcgtcaaagaggaagtgttcattcaacaaagaaatgtaagctgtccccaactggaagtgcctgtgtgcccctccgggtttcagttgtcctgtaaaaccagcgcttgctgtccatcgtgcaggtgtgaacggatggaagcatgtatgcttaatggtacagtgatcggtcccggcaaaacggtgatgatcgacgtctgtacaacctgtcggtgcatggtgcaggtcggcgtcatctcaggatttaagcttgagtgtcgcaaaacgacatgtaacccttgccctctgggttataaggaggagaacaatactggagagtgctgtggacgatgtttgcctaccgcttgtaccatccagctccgaggcggacagatcatgacactaaagcgggatgaaaccctccaggatggttgcgacacacacttttgtaaagtgaatgagcgcggcgagtatttctgggagaagcgcgtgaccgggtgcccaccattcgacgagcataagtgccttgccgaaggagggaagataatgaagatacctggcacctgttgcgatacgtgcgaggaacccgaatgcaacgacataacagctcgtctccagtacgtgaaagtgggcagctgcaaaagcgaggttgaagtagacatacactactgtcagggaaagtgcgccagtaaagcaatgtattccatcgatataaatgacgtgcaggatcagtgttcatgctgctcccccacccggaccgaacctatgcaggttgctcttcattgcaccaacggatctgtggtgtatcacgaagtgctgaacgctatggagtgtaagtgttcgccgcgcaagtgctccaag

SEQ ID NO: 21416 - DNA, 8439 bp, Artificial Sequence
  Description of Artificial Sequence: Synthetic coding sequence
atgatccccgcgaggtttgccggcgtgctcttggcgctcgccctgatcctgcccggcaccctctgcgccgagggcacacgcggccgctcaagcacagctcggtgctccttgtttgggagcgacttcgtgaacactttcgatggctccatgtactcttttgccggatactgcagctacctgctggccggagggtgccagaaaagatctttttcaatcatcggggatttccagaacggtaaacgggtaagcctgtccgtgtacctgggagagtttttcgacatccacttgtttgttaatggaaccgtgactcaaggagaccaaagggtgtctatgccatatgctagtaaaggcctgtacctggagactgaagcgggttactataaactgtctggcgaagcctacggattcgtggctcggatcgacggatcaggcaatttccaggtgctcctttctgacagatatttcaacaaaacctgcgggctgtgcggtaacttcaacatctttgctgaggacgattttatgacacaggagggcactctgacttccgacccttatgattttgccaacagctgggccctgagctctggtgagcagtggtgcgagagagctagcccccctagttcctcttgcaatatatcttcaggtgagatgcagaagggtctgtgggaacaatgtcagttgttgaaaagcacaagcgtgtttgcaagatgtcaccccctggtcgacccagaacccttcgtggcactttgtgagaagaccctgtgtgagtgcgctgggggccttgaatgtgcctgtcccgcattgttggagtacgcaaggacttgtgcccaggaggggatggtcctgtacggctggaccgatcattctgcttgttcaccggtctgtcctgcggggatggagtatagacagtgcgtttcaccgtgtgcccgaacttgtcaaagtctccacattaatgaaatgtgtcaagaacgatgtgtggacgggtgctcttgccctgaggggcagcttcttgatgaaggcctgtgcgtcgagtctacagaatgcccgtgtgttcattctggcaaacgatatcctcctggcacttctttgtctagagattgcaacacctgcatatgtaggaactcccagtggatttgttccaacgaggagtgccccggagaatgtctggtgactgggcagtctcatttcaagtcatttgacaaccggtacttcacattttctggtatctgtcaatacctgttggctcgagactgtcaagatcatagtttcagcattgtcattgaaactgtgcaatgcgcggacgatagagacgccgtgtgtacacggagtgtcactgttagattgccaggcctgcataacagtttggtcaaactcaagcacggcgccggagtggccatggatgggcaggacgtgcagctgccgcttctcaaaggagacctgcgaattcaacacacagtcacagcatcagtccggctgtcctacggcgaagatctccaaatggactgggacggacggggccggctcctggtcaagctcagccctgtgtacgccggtaaaacgtgcggcctgtgcggcaactataatggaaaccaaggcgatgattttctgaccccatcagggcttgctgagccccgggtggaggacttcggcaatgcatggaaactgcatggtgactgtcaggacctgcaaaagcagcacagcgacccttgtgctctgaaccctaggatgacaagattctcagaggaagcttgcgcagtactgacttccccaacatttgaggcctgccatagggccgtgagccccctgccttacctgcggaattgtcgatatgatgtatgcagttgttccgacggcagagagtgcttgtgcggagctctggcctcctacgccgcagcgtgcgccggtaggggcgtaagggtcgcatggcgcgaaccaggccgctgcgagcttaactgcccaaagggtcaggtgtatttgcaatgtggtacgccatgtaacctgacatgtaggagcctgtcttaccctgacgaggagtgcaacgaagcctgtctggaagggtgtttttgccctccgggactgtatatggacgaaaggggagattgtgtgcccaaagcccagtgtccgtgctactatgacggagaaatctttcagccagaagatattttcagcgatcaccacactatgtgttactgtgaggacgggttcatgcactgtacaatgtctggagttcctggaagcctgctgcctgacgctgtgctgagcagtcccctgagtcaccgctccaagagaagtctgagctgcaggcctcccatggtaaaactggtgtgcccagctgataacctccgagccgagggactggagtgtacaaagacttgccagaactatgatctcgagtgtatgtcaatgggatgtgtgagcgggtgtctgtgccctcctggcatggtcaggcatgaaaatcgctgtgtcgcgctcgaacgatgtccctgcttccaccaaggcaaggagtatgctccgggagagaccgttaagataggatgtaacacgtgtgtttgccaggacaggaagtggaactgcactgatcacgtctgtgatgctacctgttcaacaatcgggatggctcactatctcacattcgatgggcttaagtacctgttcccaggggaatgccagtatgttctggtacaggactactgcggcagcaacccaggcacattcagaattctggttggaaacaagggttgctctcatccttctgtgaaatgtaagaagcgagtcaccatcctggtggagggcggagagatcgagctgttcgacggcgaggtaaatgtgaaaaggcctatgaaagatgaaacacactttgaggttgttgaaagtggcaggtatattatccttctgctcgggaaggccctgtctgtagtctgggatcgacatctgtccatcagcgtggttctgaaacaaacataccaggaaaaggtgtgcggtctttgtggaaattttgacggaatccaaaacaacgatttgacaagcagtaacttgcaggttgaagaggacccggtggactttggcaactcttggaaggtatcaagccagtgcgccgacacacgcaaagtcccacttgactcttcccctgctacctgccacaacaatatcatgaaacagacgatggttgactcatcctgcaggattctgacttcagacgtcttccaggactgtaataagcttgtagatccagagccgtacctcgacgtatgtatttacgacacatgtagctgcgagagcattggggattgcgcctgcttctgtgataccattgccgcttatgcgcatgtttgtgcgcaacacgggaaggtggtgacgtggaggaccgccacgctgtgtcctcagtcctgtgaagagcgcaacctgagagagaatggatatgagtgtgaatggcggtacaactcttgcgcccccgcctgccaggttacatgtcagcatcccgagccactggcctgtcccgtgcagtgcgtggagggctgccatgcccattgcccaccaggcaaaatcttggatgaacttcttcaaacatgcgtggatccagaggattgtccagtatgcgaagttgccggaagaagattcgctagtggaaagaaggtgacccttaatccgagtgaccccgaacattgtcagatatgtcactgcgatgtagtaaacctgacttgtgaggcgtgccaggaaccggggggtctggtagtgccacccactgacgccccagtgagcccgaccactctctacgtggaggacattagcgagccaccactccatgatttctactgttcacgcctcctcgatctcgtgttcttgctcgacggctcttccagactgtctgaggctgagttcgaagtgcttaaggcctttgtggtggacatgatggagaggctcaggatcagtcagaagtgggtgagagtagctgtcgtggaataccatgatggctcccacgcttatattggcctcaaagaccggaagcggccgtctgagctgcggagaattgcgtctcaagtcaagtacgcgggctcccaggtcgccagcaccagtgaggtgctcaaatacacactctttcagatcttctccaagatagaccggccagaggcaagcagaatcacattgctgctgatggctagccaggaacctcagaggatgagcaggaattttgtgcgctacgtccagggcctgaagaagaagaaagtgatcgtgatccccgtgggaatcgggccacacgcaaacctcaaacagatccgattgatcgagaagcaggcccccgagaacaaggcctttgtgctgagcagcgtggatgagctggaacagcagagggatgagatcgtgtcctatctctgtgacctggcacctgaggcccctccgcccactttgcccccagacatggcccaggtgacagtgggccctggcctcctgggagtgagtacccttggacccaagcggaactctatggtactggatgttgctttcgtgctggaaggctcagataaaattggagaggcagatttcaatcggtcaaaggagtttatggaagaggtaatccagcggatggacgtcggacaggactccattcatgtgacagtcctccagtactcttacatggtgaccgttgagtacccattttccgaagcccagagcaaaggcgacattcttcagcgggtaagggaaattagatatcagggcggcaacaggaccaacacaggcctggccctgaggtacctgtccgaccactcattcctggtgtctcaaggcgatcgcgaacaagcccccaacctcgtgtatatggtgacaggtaacccggcctcagacgagatcaaacgattgcctggtgatattcaggtcgttcctattggtgtgggaccgaacgccaacgtgcaggagttggagcggatcgggtggcccaatgccccaatcctcattcaggacttcgaaacattgccgagagaagcacctgatctggtgttgcagcgctgctgttctggtgagggtctgcaaatccctactctgagtcccgcacctgactgctctcagccgctcgacgttattttgctgctggatgggtctagcagctttcctgcatcctattttgatgaaatgaagtctttcgcaaaagcctttatcagcaaggccaatataggacccagactcactcaggtcagcgtgctgcagtacggaagcatcaccacaatagatgtgccctggaacgtggtgccagaaaaagcccacctcttgtcccttgtggacgtgatgcagcgggagggcggaccaagtcagataggtgatgccctcggcttcgcagtccggtatttgactagtgagatgcacggcgcacgccccggcgccagcaaggccgtggtaatcctggtcaccgacgtttccgtcgactccgtcgacgccgccgccgacgccgccagatccaacagggtcacagtcttcccaatcggtatcggcgatcgctacgatgctgcacaattgagaatcctcgccggacccgctggtgacagcaacgttgtcaaactccagaggattgaggatttgcctaccatggtgactctcggcaacagtttcctgcataagctttgctctggctttgttcggatctgcatggacgaggacggtaatgaaaagagacctggcgatgtgtggacccttcccgatcagtgtcatactgtaacttgccagcccgacgggcagacactgcttaagagtcatcgggtgaattgtgatcgagggctgcggccgagctgcccaaactcacaatcaccagttaaggttgaggaaacatgcggatgtaggtggacatgcccctgcgtgtgcacaggtagctccactcgccacattgtgacttttgatggtcaaaattttaagttgaccgggagttgctcctatgtcctgttccaaaacaaagagcaggatcttgaagttattctgcataacggagcatgctcccctggcgcccgccaggggtgcatgaaaagcattgaggtgaagcattccgcccttagcgtggaactccattctgacatggaggtgaccgtcaacggcaggctggttagtgtcccttacgtcggagggaatatggaagtcaacgtgtatggcgccatcatgcatgaagtgaggtttaatcaccttggccatatcttcacctttaccccccagaacaacgaattccagttgcaactctcccccaaaactttcgcatcaaaaacctacggcttgtgcggcatatgcgatgaaaatggagctaatgactttatgctcagggatggcaccgttacaactgattggaaaacgctggtgcaggagtggaccgttcagagaccgggtcagacctgccagccaattttggaagagcaatgcctggtgcccgacagtagccactgtcaagttctcctgcttccgctgtttgcagaatgccataaggtattggcacccgccaccttttatgctatctgccagcaggacagctgtcaccaggaacaggtctgcgaggtgattgccagctatgcccatctgtgtcggacgaatggcgtttgcgtggactggaggaccccggatttctgcgcaatgtcctgcccaccgtctttggtgtataaccactgtgaacatggttgtcctcgccactgcgatggtaacgtctccagctgcggagatcatcctagcgaaggctgtttctgcccccccgataaggtgatgctggaaggatcttgtgttcctgaggaagcttgtacacagtgtatcggcgaggatggggtgcagcatcagttcctcgaggcctgggttccagaccatcaaccttgccagatctgcacttgcctttctggtagaaaggtcaattgtaccacacagccttgtcctacagcgaaagcgccgacctgtggcctctgtgaagtggcaaggctgcgccaaaacgccgaccagtgctgccccgaatatgaatgtgtgtgcgaccctgtctcttgtgacctccctcccgtgccccactgcgagagaggtctgcaacccacgttgacgaacccaggcgagtgccggccaaattttacttgcgcgtgtaggaaggaggagtgcaaacgggtgtcacctccatcatgtcctcctcacagactcccaacactgagaaaaacccaatgctgcgatgagtatgagtgtgcgtgtaactgtgtgaactccaccgttagctgtccccttggctatcttgcatcaacagccactaatgactgcgggtgtaccaccaccacctgcctgcctgacaaggtttgcgtgcataggagtacgatctacccagtggggcagttctgggaagaaggctgtgacgtatgcacatgcaccgacatggaagatgcagtaatggggcttcgcgtggcccagtgttcccagaaaccgtgtgaagacagttgccggtctggcttcacttacgtcctgcacgaaggtgaatgctgtgggcgatgcttgcctagcgcgtgcgaggtggttactgggagcccgcggggcgactcccagagctcttggaagtctgtgggatctcagtgggcaagtcccgagaacccttgtctgatcaatgaatgtgtgcgagtgaaggaggaggtcttcatacagcagcgaaacgtgtcttgcccacagctggaggtcccagtgtgcccatccggattccaactgtcttgcaaaaccagtgcatgctgcccatcatgtcgatgtgagagaatggaggcctgtatgctgaatggtacagtgatcggcccaggtaagaccgtgatgatcgatgtatgcacaacctgccggtgcatggtgcaggtaggcgttattagcggctttaaattggagtgtcgaaagactacatgcaacccttgcccccttgggtataaggaggagaacaataccggggagtgttgcggaagatgtctccctaccgcctgtacgattcaactccgaggaggccagatcatgacccttaaacgggatgagaccctgcaagacggttgtgatactcatttttgcaaagttaacgagagaggcgaatacttctgggaaaagagagttacgggttgcccaccgtttgacgagcataagtgtctcgcagagggtggaaaaattatgaaaatccccggaacctgttgcgatacatgcgaggagccggagtgcaacgacattactgccagactgcagtacgtgaaggtaggatcatgtaaatcagaagtggaggtggacatacactattgtcaagggaagtgtgccagtaaagcaatgtatagtattgatattaatgacgtccaggatcagtgttcatgttgtagcccgacccggactgagcctatgcaggtggctttgcactgcactaacggctcagtggtctatcacgaggttctgaacgcaatggaatgtaaatgctctccgaggaagtgctccaag

SEQ ID NO: 21417 - DNA, 8439 bp, Artificial Sequence
  Description of Artificial Sequence: Synthetic coding sequence
atgattcccgcacgtttcgcaggggttctattggcccttgccttgatcttgcccggtacgctgtgcgcagagggcacaagggggcgatctagcactgccaggtgctccctgtttggatcggattttgttaacacgtttgacggatcaatgtacagctttgccggctactgcagctacctattagccggaggctgccagaaacgctccttttcgatcattggtgattttcagaatggcaagcgggtttccctaagcgtctacctgggcgagttctttgacatccatctcttcgtaaacggcaccgttacacaaggcgaccaacgcgtgtctatgccctacgcatctaaaggcctctatcttgagaccgaggccggttactacaagctgtccggtgaggcctatggtttcgtcgctcgtatagatggctccggcaacttccaggtgctactgtcagatcgctattttaacaaaacctgcggtctttgcggcaatttcaacatttttgcagaagatgactttatgacccaggagggaaccttaaccagcgatccctacgactttgcgaattcctgggcgcttagttcgggagaacagtggtgcgagcgggcctctccaccgtccagcagttgtaacatctcctcgggcgaaatgcagaagggcctgtgggagcagtgtcaactcctgaagagcacctcagtgttcgcacgctgccatcccttggtagacccggagccttttgtggcgctgtgtgagaagaccttgtgcgagtgcgctggagggcttgaatgtgcttgccccgccctcttggaatatgccaggacctgcgcgcaagagggcatggtcctctatggctggacagatcactcggcttgctcgccggtctgcccagccggaatggagtatagacagtgtgtcagtccctgtgcgcgcacgtgccagtccctgcacatcaatgagatgtgccaggagcgttgcgtggacggatgttcgtgcccggagggccagctgttggacgagggcctgtgtgtggagtccacggagtgcccctgcgtccactccggtaagcggtatccgcccgggacatcacttagtcgggattgtaatacgtgtatttgccgtaacagtcagtggatatgctcgaatgaggaatgtcccggcgagtgcctggtgaccggacaatcccattttaagagcttcgataaccgctatttcacgttctcgggaatctgccaatatctgctggctcgagactgtcaggatcacagtttctcgattgttatcgaaaccgtccagtgcgccgacgaccgcgatgcggtgtgcacccgcagcgtgaccgtccgcctgccgggtctacacaacagcttagtcaagttgaagcatggtgccggcgtcgccatggatggccaggatgttcaactgccgctgttgaaaggcgacttgcggatccagcacacggtgacagcttcggtcaggctgtcctacggagaggacttgcagatggattgggacggtcgtggccgtctcctcgtcaagctgtcaccggtatacgccggcaagacatgtggtttgtgcggaaattacaacggcaatcagggcgacgactttctcacgccatcgggcctggccgaacccagagtggaggattttggaaacgcatggaagcttcacggagattgccaggatttgcagaagcagcattccgacccttgtgctttgaaccctcggatgactcgcttctccgaggaggcgtgtgccgtgctgacgtctccaaccttcgaagcgtgccatcgcgccgtcagccctctgccgtacttgcgtaactgtaggtacgatgtgtgttcttgcagcgatggccgcgaatgcctctgtggtgctctggcctcgtacgcggctgcctgcgccggtcgcggggttcgcgtggcctggcgagaaccaggaaggtgtgaactgaactgccccaagggtcaggtctacctgcagtgcggcaccccgtgcaaccttacatgccgatctttgtcgtatccagacgaggagtgcaacgaggcctgcctggagggttgcttctgcccgccgggattgtacatggacgagcgcggtgattgcgtcccaaaggcccaatgtccgtgctactatgacggtgagattttccagccagaggatattttctcagatcaccatacaatgtgctactgcgaagatggttttatgcattgcaccatgagcggggttccaggctctctgttgccagacgccgtcctgagcagcccgttgtcccaccgctcgaagcggtctctgagctgcaggccgccgatggtcaagctcgtctgccccgccgataaccttcgcgccgaaggcttagagtgtacgaaaacctgccagaattatgatctggagtgcatgtcgatgggttgtgtatcgggatgtctgtgtccgcctggtatggtgcgtcatgagaatcggtgcgtggccctcgagaggtgcccttgcttccaccaaggtaaggaatacgcccccggagaaactgtcaagataggctgcaacacctgcgtgtgccaggatcgcaaatggaactgcacagaccatgtctgcgatgctacatgctccacgattggcatggcacattacctaacattcgatgggctgaagtacctattccctggcgaatgccagtacgtgctggtacaggattattgcggcagtaaccctggtacgttccgcatcctggtgggcaataagggctgctcccatccgtctgtcaagtgcaaaaaaagagttaccatcctggttgaaggtggcgaaattgagctcttcgatggcgaggtgaatgtgaaacgcccgatgaaggacgagacccacttcgaggtagttgagagcggcagatatatcattttgctgctggggaaggcactgagcgttgtatgggaccgtcatctgtcaatttctgtcgtgctgaagcagacgtaccaagagaaggtgtgtggcctttgtggcaattttgacggaatacagaataacgatctgaccagctccaatttacaggtggaagaggatcctgtagacttcggaaacagttggaaggtgtcatcccaatgcgcagatacgcgaaaagtacccctggatagctcacccgcgacgtgccataataacataatgaagcagacgatggtggattcctcgtgcagaatccttacgtcggacgttttccaggactgcaacaagttagtcgaccccgagccatacctggatgtgtgcatttacgatacctgcagttgtgagtcaataggtgattgcgcgtgcttctgcgacaccatagcagcatatgctcacgtgtgcgcccaacatggtaaggttgtcacgtggcgcactgcgaccctgtgcccacagtcctgcgaagagcgcaatctgcgcgagaatgggtacgagtgcgagtggcgctataacagctgcgccccggcatgccaggtcacctgccagcacccggagccattagcatgcccggtgcagtgcgtggaaggatgccatgcgcactgcccacccgggaaaatcctggatgaactgctgcagacgtgtgtcgatcccgaggattgccccgtttgtgaggtggccggccgccggttcgcttccgggaagaaggtgactttgaaccccagcgaccccgaacactgccaaatttgtcattgcgatgtcgttaacttgacgtgtgaggcatgtcaggaaccaggcggactggtcgttcccccaacagacgcaccagtgagcccgacaaccttgtatgtggaagatatttccgagccgcccctgcatgacttctactgttcgcggctattggacttggtctttctgctggacggaagctcgcgactgtcggaggctgaattcgaggttcttaaggccttcgtggttgatatgatggagaggttgcgcattagccagaaatgggttcgcgtagcagttgtcgagtaccatgatggaagtcacgcctatataggactgaaggatagaaagcgccccagtgagctgcgccggatagcctcgcaagttaagtatgcagggagtcaagtcgcatctacaagtgaggtgctgaagtatacactgttccagattttttctaaaatcgaccgccctgaggcttcccgtattactttgctgcttatggcctcacaagagccgcaacgaatgagccggaacttcgtgcgttatgtgcagggcctgaagaaaaagaaagtgattgttattcccgtgggaattgggccccacgccaacctgaaacagatccgattgatagagaagcaggcacccgaaaataaggcatttgtcctgtcatcagtggatgagttggagcagcaacgtgatgagatcgtatcctacttatgcgatctggccccggaggcacccccccccaccctccccccggatatggcccaggtcacagtcggtccgggattgctgggtgtcagcaccttgggccccaagaggaattccatggtgctggatgtggctttcgtgctggagggctcagataaaatcggcgaagccgattttaaccgtagtaaggagttcatggaagaagtaatccagcgcatggatgtcggccaagactccatccacgtgacggtgctgcagtattcctacatggtaaccgtcgagtaccccttttcagaggcgcaatcgaagggggacattctacaacgcgttcgcgagattcgataccaggggggcaacaggacgaacaccggattagctctgcgctacctgagcgatcactcgtttctggtgtcacagggggatagggagcaggcccccaatctggtgtacatggtaaccggcaaccccgcttcagatgagatcaagcgcctccccggcgacattcaagtcgtcccgattggtgtgggaccgaatgccaacgtgcaggagctggaacgcataggctggccgaacgcgccgatcttgatacaggatttcgagaccctgccgcgcgaagctcccgacctggtcctgcaaaggtgctgctcgggcgaggggcttcagatcccgaccctgagtcccgcgcctgattgctcccagccattggacgtaattctcttgttggatggcagctcgagcttcccagcctcgtacttcgatgagatgaagagttttgcgaaggcctttataagtaaggcaaatataggcccccgactaacccaggtttcagtattgcagtatggctctataacgactattgatgtcccctggaacgtcgtgccagaaaaagcccacctgctatcgctggtagatgtgatgcagcgagagggaggaccctctcaaatcggcgacgccctgggattcgccgttcgatatctcacctcggaaatgcacggagcccgtccgggagcttccaaggctgttgtcattctagtgactgacgtgtccgtggactcagtagatgccgcggcggatgctgcgcgctccaaccgtgtgacggtgtttcccattgggataggcgatcgctacgatgccgcccagcttaggatcctggccggaccggccggtgacagcaacgtcgtcaagctgcaacgtatcgaggatctgcccactatggtgaccctgggaaattcgttcctccataagctttgctcgggattcgtacgaatatgtatggatgaagatggtaatgagaagcgtcccggcgatgtatggacgctgccagatcagtgccacaccgtgacatgccagccggacggtcaaaccctactcaagagtcatcgcgtgaactgcgaccgcggccttcggccgagctgccctaattcgcagtccccagtcaaggtggaggagacctgcggctgcaggtggacgtgtccctgcgtgtgcacgggaagtagtacgcggcatattgttacgtttgatgggcagaacttcaagcttacagggtcgtgctcatacgtccttttccaaaacaaggagcaggatctagaggtcatcttgcataacggcgcttgttcacccggagccaggcagggctgcatgaaatcgatcgaagtgaagcattccgccttgtcggtcgaacttcattctgacatggaagtgactgtgaacggccgcctcgtgagcgttccctatgttggtggtaatatggaggtgaacgtctacggagctataatgcacgaagtccgctttaatcacctaggccatatcttcacattcacaccccagaataatgagtttcaactgcagctctccccgaagacatttgccagtaagacttacggtctgtgcggaatctgcgacgagaatggtgcaaacgactttatgttacgtgacggaaccgtgacaaccgattggaaaaccctggtgcaagaatggacagtgcagagaccgggtcagacctgccagcccatactggaagaacaatgcctggttcccgacagcagtcactgtcaggtgctgcttctgccgctgttcgcggagtgccacaaagtgttggccccggccacattttacgcaatatgccaacaggacagttgccatcaagagcaggtctgcgaggttatagcctcctatgcccacttatgccgtaccaacggcgtctgcgtggattggcggacgcctgatttttgtgcaatgtcatgcccccccagtctcgtgtataaccactgcgagcacggctgtccccgacattgcgacggcaacgttagctcctgcggcgaccacccttccgagggatgtttttgccccccagataaggtgatgctagaaggatcatgcgttccagaagaggcctgcactcagtgcatcggcgaggatggcgtgcagcatcagttcctggaggcctgggtgccggaccatcaaccctgtcagatctgcacctgcctgtccggcaggaaagtcaattgtaccacccagccctgccccacagccaaagccccaacatgcggtttgtgcgaggtggcgaggctccgccagaacgcggaccagtgttgcccagagtacgaatgtgtgtgtgacccagtttcatgcgatctgcccccagttccgcactgcgagcgtggactgcagcccactctcacgaaccccggggagtgccggccgaactttacgtgcgcttgccggaaagaggagtgcaagagggtgagccctccatcctgtccgccccataggctcccgactctgcgaaagactcaatgctgcgatgagtacgagtgcgcgtgcaattgtgtcaatagcactgtatcttgccccttggggtacctagcctctacggccactaacgattgcggttgtaccaccacgacctgcctaccggacaaggtgtgcgtgcatcgatccaccatatatccagtcggccagttttgggaagagggctgcgatgtgtgtacatgcacagatatggaggatgctgtcatgggtctgcgggtggctcaatgctcacagaaaccgtgcgaagatagctgcaggtccgggttcacgtacgttcttcatgagggcgagtgttgcggccggtgcttgccaagtgcgtgtgaggtcgtgacgggatcgccgcgcggtgatagtcaatcgtcgtggaaaagtgtgggcagccaatgggcgtcaccagagaacccgtgtctcatcaatgagtgcgttcgggtgaaggaggaggtgtttatccagcagcgcaatgtctcgtgtccccagttggaggtgccggtgtgcccgtctggtttccaactaagctgtaagacctccgcatgttgtcccagctgccgctgcgagcgaatggaggcttgcatgcttaatgggaccgtgattggacccggcaagacagtgatgatcgatgtgtgcacgacatgtaggtgtatggtgcaagtcggagtaatctctggattcaagttggagtgccgcaagactacctgcaacccgtgccccctgggttataaggaggagaataacaccggtgagtgttgcggacgctgcctgccaacagcgtgcaccatccagctccgaggaggccagataatgacgttgaaacgtgatgagacgctgcaggatggatgcgacacgcacttctgcaaggtgaacgaaagaggtgaatacttctgggagaagagagtgacaggatgtccaccgttcgatgaacacaagtgcctcgcggagggcggtaaaatcatgaaaatacccggcacctgttgcgacacatgcgaggagcccgagtgcaacgacatcaccgcccgccttcagtacgttaaggtcgggtcttgtaagtcggaggtggaggtggatatacactattgtcagggcaaatgtgcctccaaggccatgtactcgatcgacatcaacgatgtacaggatcagtgctcatgctgcagcccgacgcgcactgaacccatgcaggttgctctgcactgcactaatggaagcgtcgtctaccacgaggtgcttaatgccatggaatgcaagtgttcaccacgtaaatgctctaag

SEQ ID NO: 21418 - DNA, 8439 bp, Artificial Sequence
  Description of Artificial Sequence: Synthetic coding sequence
atgataccggcgcgatttgcgggtgttctattagcgttagcgttaatactaccgggtacgttatgtgcggaaggtacgcgaggtcgatcgtcgacggcgcgttgttcgctatttggttcggattttgtaaatacgtttgatggttcgatgtattcgtttgcgggttattgttcgtatctactagcgggtggttgtcaaaaacgttcgttttcgataataggtgattttcaaaatggtaaacgtgtatcgctatcggtttatttaggtgaattttttgatatacatctatttgtaaatggtacggtaacgcaaggtgatcaacgagtttcgatgccgtatgcgtcgaaaggtctatatctagaaacggaagcgggttattataaattatcgggtgaagcgtatggttttgttgcgcgtatagatggttcgggtaattttcaagtattattatcggatcgatattttaataaaacgtgtggtttatgtggtaattttaatatatttgcggaagatgattttatgacgcaagaaggtacgctaacgtcggatccgtatgattttgcgaattcgtgggcgctatcgtcgggtgaacaatggtgtgaacgagcgtcgccgccgtcgtcgtcgtgtaatatatcgtcgggtgaaatgcaaaaaggtttatgggaacaatgtcaattactaaaatcgacgtcggtatttgcgcgttgtcatccgctagtagatccggaaccgtttgttgcgttatgtgaaaaaacgctatgtgaatgtgcgggtggtttagaatgtgcgtgtccggcgctattagaatatgcgcgaacgtgtgcgcaagaaggtatggtactatatggttggacggatcattcggcgtgttcgccggtatgtccggcgggtatggaatatcgacaatgtgtttcgccgtgtgcgcgtacgtgtcaatcgctacatataaatgaaatgtgtcaagaacgatgtgttgatggttgttcgtgtccggaaggtcaattactagatgaaggtttatgtgtagaatcgacggaatgtccgtgtgtacattcgggtaaacgatatccgccgggtacgtcgttatcgcgtgattgtaatacgtgtatatgtcgtaattcgcaatggatatgttcgaatgaagaatgtccgggtgaatgtctagttacgggtcaatcgcattttaaatcgtttgataatcgttattttacgttttcgggtatatgtcaatatctattagcgcgtgattgtcaagatcattcgttttcgatagtaatagaaacggtacaatgtgcggatgatcgagatgcggtatgtacgcgatcggtaacggttcgactaccgggtttacataattcgttagttaaactaaaacatggtgcgggtgtagcgatggatggtcaagatgttcaattaccgctactaaaaggtgatttacgtatacaacatacggttacggcgtcggttcgtctatcgtatggtgaagatttacaaatggattgggatggtcgtggtcgtttattagtaaaactatcgccggtttatgcgggtaaaacgtgtggtttatgtggtaattataatggtaatcaaggtgatgattttctaacgccgtcgggtttagcggaaccgcgtgtagaagattttggtaatgcgtggaaattacatggtgattgtcaagatctacaaaaacaacattcggatccgtgtgcgctaaatccgcgtatgacgcgattttcggaagaagcgtgtgcggtattaacgtcgccgacgtttgaagcgtgtcatcgtgcggtatcgccgttaccgtatctacgtaattgtcgttatgatgtatgttcgtgttcggatggtcgagaatgtttatgtggtgcgttagcgtcgtatgcggcggcgtgtgcgggtcgaggtgtacgtgtagcgtggcgtgaaccgggtcgatgtgaattaaattgtccgaaaggtcaagtatatctacaatgtggtacgccgtgtaatttaacgtgtcgttcgctatcgtatccggatgaagaatgtaatgaagcgtgtctagaaggttgtttttgtccgccgggtttatatatggatgaacgtggtgattgtgtaccgaaagcgcaatgtccgtgttattatgatggtgaaatatttcaaccggaagatatattttcggatcatcatacgatgtgttattgtgaagatggttttatgcattgtacgatgtcgggtgttccgggttcgttattaccggatgcggtactatcgtcgccgctatcgcatcgatcgaaacgttcgctatcgtgtcgaccgccgatggtaaaactagtttgtccggcggataatttacgagcggaaggtttagaatgtacgaaaacgtgtcaaaattatgatttagaatgtatgtcgatgggttgtgtttcgggttgtttatgtccgccgggtatggttcgtcatgaaaatcgatgtgtagcgttagaacgatgtccgtgttttcatcaaggtaaagaatatgcgccgggtgaaacggtaaaaataggttgtaatacgtgtgtttgtcaagatcgaaaatggaattgtacggatcatgtatgtgatgcgacgtgttcgacgataggtatggcgcattatctaacgtttgatggtctaaaatatctatttccgggtgaatgtcaatatgtattagtacaagattattgtggttcgaatccgggtacgtttcgaatactagttggtaataaaggttgttcgcatccgtcggttaaatgtaaaaaacgtgttacgatattagtagaaggtggtgaaatagaattatttgatggtgaagtaaatgtaaaacgaccgatgaaagatgaaacgcattttgaagtagttgaatcgggtcgttatataatattattattaggtaaagcgctatcggtagtatgggatcgacatttatcgatatcggttgttctaaaacaaacgtatcaagaaaaagtatgtggtttatgtggtaattttgatggtatacaaaataatgatttaacgtcgtcgaatttacaagtagaagaagatccggtagattttggtaattcgtggaaagtttcgtcgcaatgtgcggatacgcgaaaagtaccgctagattcgtcgccggcgacgtgtcataataatataatgaaacaaacgatggtagattcgtcgtgtcgtatactaacgtcggatgtttttcaagattgtaataaattagtagatccggaaccgtatctagatgtatgtatatatgatacgtgttcgtgtgaatcgataggtgattgtgcgtgtttttgtgatacgatagcggcgtatgcgcatgtttgtgcgcaacatggtaaagtagttacgtggcgtacggcgacgctatgtccgcaatcgtgtgaagaacgtaatttacgagaaaatggttatgaatgtgaatggcgatataattcgtgtgcgccggcgtgtcaagttacgtgtcaacatccggaaccgttagcgtgtccggttcaatgtgtagaaggttgtcatgcgcattgtccgccgggtaaaatactagatgaactattacaaacgtgtgtagatccggaagattgtccggtatgtgaagttgcgggtcgtcgatttgcgtcgggtaaaaaagttacgttaaatccgtcggatccggaacattgtcaaatatgtcattgtgatgtagtaaatttaacgtgtgaagcgtgtcaagaaccgggtggtctagttgttccgccgacggatgcgccggtatcgccgacgacgctatatgtagaagatatatcggaaccgccgttacatgatttttattgttcgcgactactagatctagtttttttattagatggttcgtcgcgtttatcggaagcggaatttgaagtattaaaagcgtttgttgtagatatgatggaacgtctacgtatatcgcaaaaatgggttcgagttgcggtagttgaatatcatgatggttcgcatgcgtatataggtttaaaagatcgtaaacgaccgtcggaattacgacgaatagcgtcgcaagtaaaatatgcgggttcgcaagttgcgtcgacgtcggaagttttaaaatatacgttatttcaaatattttcgaaaatagatcgtccggaagcgtcgcgtataacgttactactaatggcgtcgcaagaaccgcaacgaatgtcgcgaaattttgtacgatatgtacaaggtttaaaaaaaaaaaaagtaatagtaataccggttggtataggtccgcatgcgaatttaaaacaaatacgtctaatagaaaaacaagcgccggaaaataaagcgtttgtactatcgtcggttgatgaattagaacaacaacgtgatgaaatagtatcgtatctatgtgatctagcgccggaagcgccgccgccgacgttaccgccggatatggcgcaagtaacggtaggtccgggtctattaggtgtatcgacgttaggtccgaaacgaaattcgatggttttagatgtagcgtttgttctagaaggttcggataaaataggtgaagcggattttaatcgttcgaaagaatttatggaagaagtaatacaacgtatggatgttggtcaagattcgatacatgtaacggttctacaatattcgtatatggttacggtagaatatccgttttcggaagcgcaatcgaaaggtgatatattacaacgtgtacgtgaaatacgatatcaaggtggtaatcgtacgaatacgggtctagcgttacgttatttatcggatcattcgtttctagtatcgcaaggtgatcgagaacaagcgccgaatttagtttatatggttacgggtaatccggcgtcggatgaaataaaacgattaccgggtgatatacaagtagtaccgataggtgtaggtccgaatgcgaatgtacaagaattagaacgaataggttggccgaatgcgccgatactaatacaagattttgaaacgctaccgcgagaagcgccggatctagttttacaacgttgttgttcgggtgaaggtctacaaataccgacgctatcgccggcgccggattgttcgcaaccgctagatgttatactattattagatggttcgtcgtcgtttccggcgtcgtattttgatgaaatgaaatcgtttgcgaaagcgtttatatcgaaagcgaatataggtccgcgactaacgcaagtatcggttctacaatatggttcgataacgacgatagatgttccgtggaatgttgtaccggaaaaagcgcatttactatcgttagtagatgtaatgcaacgtgaaggtggtccgtcgcaaataggtgatgcgctaggttttgcggtacgttatttaacgtcggaaatgcatggtgcgcgaccgggtgcgtcgaaagcggtagtaatattagtaacggatgtatcggtagattcggtagatgcggcggcggatgcggcgcgttcgaatcgagtaacggtatttccgataggtataggtgatcgatatgatgcggcgcaactacgtatactagcgggtccggcgggtgattcgaatgtagtaaaactacaacgaatagaagatttaccgacgatggtaacgctaggtaattcgtttttacataaattatgttcgggttttgtacgtatatgtatggatgaagatggtaatgaaaaacgtccgggtgatgtatggacgttaccggatcaatgtcatacggttacgtgtcaaccggatggtcaaacgttattaaaatcgcatcgagtaaattgtgatcgtggtctacgtccgtcgtgtccgaattcgcaatcgccggttaaagtagaagaaacgtgtggttgtcgttggacgtgtccgtgtgtatgtacgggttcgtcgacgcgacatatagttacgtttgatggtcaaaattttaaattaacgggttcgtgttcgtatgtactatttcaaaataaagaacaagatttagaagttatattacataatggtgcgtgttcgccgggtgcgcgtcaaggttgtatgaaatcgatagaagttaaacattcggcgttatcggtagaattacattcggatatggaagtaacggttaatggtcgtttagtatcggttccgtatgttggtggtaatatggaagttaatgtttatggtgcgataatgcatgaagtacgttttaatcatctaggtcatatatttacgtttacgccgcaaaataatgaatttcaactacaattatcgccgaaaacgtttgcgtcgaaaacgtatggtttatgtggtatatgtgatgaaaatggtgcgaatgattttatgttacgagatggtacggttacgacggattggaaaacgttagtacaagaatggacggtacaacgtccgggtcaaacgtgtcaaccgatactagaagaacaatgtctagtaccggattcgtcgcattgtcaagttctattattaccgctatttgcggaatgtcataaagtactagcgccggcgacgttttatgcgatatgtcaacaagattcgtgtcatcaagaacaagtttgtgaagttatagcgtcgtatgcgcatttatgtcgtacgaatggtgtttgtgttgattggcgaacgccggatttttgtgcgatgtcgtgtccgccgtcgttagtatataatcattgtgaacatggttgtccgcgtcattgtgatggtaatgtatcgtcgtgtggtgatcatccgtcggaaggttgtttttgtccgccggataaagtaatgttagaaggttcgtgtgttccggaagaagcgtgtacgcaatgtataggtgaagatggtgtacaacatcaatttttagaagcgtgggtaccggatcatcaaccgtgtcaaatatgtacgtgtctatcgggtcgtaaagtaaattgtacgacgcaaccgtgtccgacggcgaaagcgccgacgtgtggtctatgtgaagttgcgcgtctacgtcaaaatgcggatcaatgttgtccggaatatgaatgtgtatgtgatccggtttcgtgtgatctaccgccggttccgcattgtgaacgtggtttacaaccgacgctaacgaatccgggtgaatgtcgtccgaattttacgtgtgcgtgtcgtaaagaagaatgtaaacgagtatcgccgccgtcgtgtccgccgcatcgtctaccgacgttacgtaaaacgcaatgttgtgatgaatatgaatgtgcgtgtaattgtgttaattcgacggtttcgtgtccgttaggttatctagcgtcgacggcgacgaatgattgtggttgtacgacgacgacgtgtttaccggataaagtatgtgtacatcgatcgacgatatatccggtaggtcaattttgggaagaaggttgtgatgtatgtacgtgtacggatatggaagatgcggttatgggtctacgagttgcgcaatgttcgcaaaaaccgtgtgaagattcgtgtcgttcgggttttacgtatgtattacatgaaggtgaatgttgtggtcgatgtttaccgtcggcgtgtgaagtagtaacgggttcgccgcgtggtgattcgcaatcgtcgtggaaatcggtaggttcgcaatgggcgtcgccggaaaatccgtgtctaataaatgaatgtgttcgtgtaaaagaagaagtatttatacaacaacgtaatgtatcgtgtccgcaattagaagtaccggtttgtccgtcgggttttcaattatcgtgtaaaacgtcggcgtgttgtccgtcgtgtcgatgtgaacgaatggaagcgtgtatgttaaatggtacggtaataggtccgggtaaaacggtaatgatagatgtatgtacgacgtgtcgttgtatggttcaagtaggtgtaatatcgggttttaaactagaatgtcgtaaaacgacgtgtaatccgtgtccgttaggttataaagaagaaaataatacgggtgaatgttgtggtcgatgtttaccgacggcgtgtacgatacaattacgaggtggtcaaataatgacgctaaaacgtgatgaaacgttacaagatggttgtgatacgcatttttgtaaagttaatgaacgaggtgaatatttttgggaaaaacgtgtaacgggttgtccgccgtttgatgaacataaatgtttagcggaaggtggtaaaataatgaaaataccgggtacgtgttgtgatacgtgtgaagaaccggaatgtaatgatataacggcgcgattacaatatgttaaagtaggttcgtgtaaatcggaagtagaagttgatatacattattgtcaaggtaaatgtgcgtcgaaagcgatgtattcgatagatataaatgatgtacaagatcaatgttcgtgttgttcgccgacgcgtacggaaccgatgcaagttgcgttacattgtacgaatggttcggtagtttatcatgaagtattaaatgcgatggaatgtaaatgttcgccgcgtaaatgttcgaaa

SEQ ID NO: 21419 - DNA, 8439 bp, Artificial Sequence
  Description of Artificial Sequence: Synthetic coding sequence
atgattcccgcacgtttcgctggtgttttgctagccctcgctctgattcttcctggcaccctttgcgcagaagggacgagggggcggagcagtacagccaggtgtagcctgtttggatcagatttcgttaacaccttcgacggcagtatgtattcgtttgccggctactgttcgtacctccttgctggtggatgtcagaagcggtcctttagtatcatcggcgactttcaaaatgggaaacgcgtgagtttgtccgtctacttaggcgagttttttgacattcatttgtttgtgaatggtacagtaactcagggggaccaaagggtcagtatgccctatgcatcaaaaggtttgtatctggagacagaggcagggtattacaaattatcaggcgaagcgtacggattcgtcgcacgaattgacggttctggcaattttcaagtgctgctcagcgaccgatactttaacaaaacatgcggcctgtgcggaaatttcaatatctttgccgaggacgatttcatgactcaagagggaacactaaccagtgacccctatgacttcgctaacagctgggccctctcatctggtgaacagtggtgcgagagagcaagtccaccatcttcttcctgtaacatctcctccggagaaatgcagaagggactgtgggaacagtgtcagctccttaaatctaccagcgtctttgcgcggtgtcaccccttggtggatcccgagcccttcgtggcactttgtgagaaaaccctgtgtgaatgtgctggtggactggagtgtgcctgtcccgccctgttagagtatgcgcgcacctgcgcccaggagggcatggtgctgtacgggtggacagatcacagcgcttgcagtccagtatgtccagccgggatggaatataggcaatgcgtgagcccctgtgccaggacctgccagagcctgcacatcaacgagatgtgtcaggagaggtgcgtggatggttgctcatgccctgagggccaacttctcgatgagggattgtgtgtggagagcacagagtgtccatgtgtgcactccggaaaacgctacccccccggaacttcactctctcgcgattgcaatacatgcatctgtaggaactctcagtggatttgttctaacgaagaatgtccaggtgaatgcctggtgaccggacaatcccactttaagagcttcgacaatcgctacttcaccttcagtggaatttgtcagtatctgctagcccgggattgccaggaccactcttttagcatcgtgattgagacagtgcagtgcgcggacgatagggacgcagtatgtaccaggagcgtaactgtccgcctgccagggctgcacaacagtttggttaagttgaaacatggcgcaggcgtcgcaatggacggtcaggacgtgcagttgcctctgttgaagggcgacctgcggatacaacataccgtgactgcgtctgttaggctgagttatggagaagacctgcaaatggattgggacggcaggggaaggttgctcgtcaaattgagtcctgtctatgccggcaagacatgtggtctctgtgggaattataatggtaaccagggggacgacttcctgacgccctcaggcctcgccgagcccagagttgaggactttgggaacgcatggaaactgcatggagattgccaggatcttcagaagcagcatagtgatccttgcgcgttgaatcccagaatgaccaggttctctgaagaagcttgcgcggtgctcacaagcccaactttcgaggcatgtcatcgcgctgtcagtcctctgccttatctgcggaactgcagatacgacgtgtgctcttgtagcgatggcagggagtgcctttgcggtgctctggccagttatgctgcggcatgcgccgggagaggtgtcagagttgcttggcgtgaacctggccggtgcgagctgaattgcccgaaaggacaagtgtatctgcagtgcggtacaccttgtaacctgacatgtcgcagcctttcatatccagatgaggaatgtaacgaggcatgtctcgaaggatgtttctgccctccagggctgtacatggacgagcgcggcgattgcgtgcccaaggcccagtgcccatgctactatgacggcgagatctttcaaccagaggacatattctctgaccatcatacaatgtgctactgcgaggatggcttcatgcactgtactatgtctggcgttcctggctcactgctgccggatgccgttttatcttcccccttatcacacaggagtaagaggagcctctcctgtagaccacctatggtgaaacttgtctgtcctgccgataacctcagggccgaaggcctggagtgtactaaaacatgtcagaactacgacctggaatgcatgtcgatggggtgcgtcagtggatgtctctgtccacctgggatggtgaggcacgaaaataggtgtgtcgctctggagcggtgcccttgtttccatcaggggaaggagtatgctcctggcgagacagtcaagattggctgcaatacttgcgtgtgtcaggataggaagtggaactgcacagatcatgtgtgtgacgctacatgctcgacaattggcatggcgcattatctgacttttgatggtctcaagtatctgttccccggcgagtgccagtacgtgctcgtgcaggattattgtgggtcaaatcctgggacgtttcgcatccttgtggggaacaaaggttgttctcaccctagcgtgaaatgcaaaaagagagtaaccatactcgtggaaggaggcgaaattgagctctttgatggcgaagtaaatgtgaaacgtccgatgaaggacgaaacccacttcgaggtggtcgaatccggaaggtacattattttgttgcttggtaaagctcttagcgtggtgtgggacaggcacctgtcgatcagtgtggtgctcaaacaaacgtatcaggagaaagtgtgtggcctctgcggaaattttgatggtatccagaataatgacctgacctctagcaatctgcaggtcgaggaagaccctgtggactttggtaattcatggaaggtatcttcacagtgtgcagatacacgaaaagtgcctctagatagctctcctgcaacctgccataataatattatgaaacaaacaatggttgatagctcttgcaggattctgactagtgacgtgttccaggattgcaacaaattagtcgacccagagccatatttagatgtctgcatctacgacacctgtagttgtgaaagcatcggggactgtgcctgcttctgcgatactattgcagcatatgcccacgtgtgtgctcagcatgggaaggttgtgacctggcggacggctacactgtgtccccagtcttgtgaagagagaaacctgagggagaacgggtacgagtgcgagtggagatacaattcttgtgcaccggcgtgtcaggtaacctgtcagcatcccgagcccctggcctgccccgtgcagtgtgttgaggggtgtcacgcgcattgcccccccggaaaaattctggacgaacttctccaaacttgcgtagatccggaggattgtcccgtctgtgaggtggcaggccgccgattcgcctctggtaagaaggtcacactgaatccttccgatcccgagcattgtcagatttgccactgtgacgtggttaacctgacctgtgaggcatgtcaagagcctgggggcctggtcgtcccaccaacagacgcccctgtttcacccacgaccctctatgtggaggacatttccgaacctcctctccacgacttctactgctctcgactacttgacctcgtgtttctgctggatggaagtagcaggctcagtgaggccgagttcgaggtcttgaaggccttcgtggtcgacatgatggagcggctgcgaatcagccagaagtgggttcgcgtcgcagttgtagagtatcatgatgggagccacgcatacatcggcctgaaagaccgaaagaggccatcagaactgaggcggatagcctcccaggttaagtatgccggctcacaggtcgcaagtacgtctgaagttctcaagtataccctgttccagattttcagtaaaatcgacaggcctgaggcctctcgaatcaccctgttattgatggcgtctcaggagccccagcgaatgagccgtaacttcgtccggtatgtgcaggggcttaaaaagaagaaggtcatcgtcatccccgttggtatcggcccgcacgcgaacctcaagcaaatccgcttgatcgaaaagcaggccccagagaataaggccttcgtcctatctagtgttgacgagctggagcagcagcgggacgaaatcgtgtcctatctctgtgatctcgcaccagaggcaccccctcccaccctgccacctgatatggcccaggtcaccgtgggcccagggctcttgggggtcagcacactgggacccaagcgcaactcaatggtcttggacgtggctttcgtgctggagggcagtgacaagatcggcgaggcggactttaacaggtccaaggaattcatggaagaagttatacagagaatggacgtagggcaggacagtattcacgtcacagtgctgcaatacagttatatggtgaccgtcgagtacccattttccgaagcacagagcaagggggatattctgcagagagtacgtgagattaggtaccagggcggcaaccgcactaacacaggccttgcactgcgttatttgtcggaccactctttccttgtgtcccagggagacagagagcaggcccctaatctcgtgtatatggtgactgggaaccctgcaagcgatgagataaagcggttgccaggggatatccaagttgtacccattggggtggggcctaatgctaacgttcaggagcttgagcggattggatggcccaatgcacctattctgatacaggattttgagaccttacctagagaggctcctgacctggttctacagcgatgctgtagtggtgagggcctccagattcctacccttagcccggcgccagattgctctcaacctctggatgtcatcttgctcctcgatgggtcctcaagctttcccgcgtcttatttcgatgagatgaagagttttgcaaaagcgtttatatccaaggccaatatcgggcccagactgacgcaggtatctgtcctgcagtacggatccatcactacaatcgacgtgccatggaatgtggtgcccgagaaagctcatctgttgtctctggtcgacgtgatgcagagggagggcggtccaagccagatcggggacgctctgggcttcgcggtccggtacctcacaagcgaaatgcacggcgcccgccccggggctagcaaagccgtggttatcctggttacagacgtgagcgttgactccgtggatgctgcagcagatgccgcccgatccaatcgtgtgaccgtattccctatcggtatcggagatagatacgacgctgcacagctccggatcctggccggacctgctggagacagcaacgttgtgaaattacagcggatcgaagacctcccaaccatggtaactttagggaatagttttttgcataagctgtgcagcggtttcgtcaggatctgtatggatgaggatgggaacgaaaaacggcccggtgatgtctggactctgcccgatcagtgtcatactgtaacttgtcagcccgatggacaaacactcctgaaaagccatagagttaattgcgacagggggctgcggccctcctgccccaatagccagagtccagtgaaagtcgaggaaacttgtggatgcagatggacatgtccctgcgtctgcactggcagttcaactaggcacatcgtcactttcgacggtcaaaattttaagctgactgggtcctgctcctacgtcttatttcagaacaaagaacaggatctggaggtgattctgcacaatggcgcatgcagtcctggggcgaggcagggatgtatgaagtctatcgaggttaagcactccgccctttcggtggagctgcattccgacatggaagtgactgtgaatggaagattggtctccgtcccctatgtgggtggaaacatggaagttaacgtgtacggcgcaattatgcacgaagtacggtttaaccacctgggccacatttttaccttcaccccacagaacaatgagtttcagctgcagctctcccctaagacctttgccagtaagacatacggcttgtgcggtatatgcgacgaaaacggcgcgaacgacttcatgctgagggacggcacggtgaccaccgattggaaaacactggtgcaggaatggacagtccagcggccaggccagacatgtcagcctattcttgaagagcagtgtctggtccccgattcctcccattgccaggtgctgcttctgcctctgttcgcagagtgccacaaagtgcttgccccggccacattctatgccatttgccaacaagattcctgccatcaagagcaggtgtgcgaggtgatagcctcatacgcccacctgtgccggacaaatggggtgtgcgtagattggagaacaccagacttctgtgcgatgtcctgcccgcctagcctggtttacaaccactgcgagcacgggtgcccccgccactgtgacggcaacgtgtctagttgcggagaccacccctcagaaggctgtttctgtccacctgacaaggttatgctggagggttcctgtgtgcctgaagaggcatgtacacagtgcattggagaggatggggtccaacatcagttcctggaggcttgggtgccagaccatcagccatgccaaatatgcacctgtctgtctggccgcaaggttaactgtacgactcagccatgtcccactgccaaagctccaacctgcggattgtgcgaggtagctcggctcagacagaacgcagatcagtgctgtccagaatacgagtgcgtctgtgaccctgtgtcatgtgatttaccacccgtgcctcactgcgaaagggggctgcagccgacccttactaatcccggggagtgccggcctaatttcacgtgtgcatgtagaaaagaagaatgtaaacgcgtctccccgccatcctgtccgccgcaccgtctgcctactcttaggaaaactcagtgttgcgacgagtatgaatgcgcctgtaactgtgtgaacagtactgtatcttgcccattggggtaccttgcatctaccgctaccaacgattgtggatgtaccacgaccacctgcctcccggacaaagtgtgcgtgcaccgaagcactatctatcccgtagggcagttctgggaggagggctgtgacgtctgcacatgcactgacatggaggatgccgtgatggggctacgggtagcgcagtgctcccaaaagccctgcgaggattcttgtcgttccgggtttacatacgtgctgcatgagggggagtgttgtggacgatgcctcccatccgcatgtgaggtggtgacagggagtccgcgtggggatagtcagtcctcgtggaaaagtgttggatcccagtgggcaagcccggagaatccatgcctgatcaacgaatgcgttcgggtcaaggaagaggtcttcatccagcagaggaatgtgtcctgcccccagctcgaagtccctgtgtgtccgtccgggttccagcttagctgtaagacgtccgcctgttgtccaagttgcaggtgcgagcgcatggaagcctgtatgctgaatggaacagtgattggccctggaaagacagtgatgatcgacgtttgcacaacttgtaggtgtatggtccaggtgggcgtaatcagcggcttcaagctggagtgcagaaaaaccacttgtaatccttgtccattagggtacaaagaagagaataataccggcgagtgctgtggtaggtgcctcccaacagcatgtactatccagctgaggggaggacaaatcatgacgcttaaaagagatgagactctccaggacggctgtgatacccatttctgcaaggtaaatgagagaggagagtacttctgggaaaagcgtgtgactgggtgtcctccctttgatgagcacaaatgtttggcggaagggggcaagattatgaagattccgggcacatgctgcgatacctgtgaagagcccgaatgtaacgacattactgctagactccagtacgtgaaagttggcagttgtaagtctgaggtcgaagtggatattcactattgtcagggcaaatgcgcctccaaggctatgtattcgatagacatcaacgacgttcaggaccagtgttcatgttgttctcctacgcgcacagaacctatgcaggtggcgctgcactgcacaaatggttcggtcgtgtatcatgaggtgctcaacgccatggaatgcaagtgttccccacgcaaatgctccaag

SEQ ID NO: 21420 - DNA, 8439 bp, Artificial Sequence
  Description of Artificial Sequence: Synthetic coding sequence
atgatcccagcccgtttcgcgggagttctgttagctctggccctgattctgcctggcaccctgtgtgccgaagggacaagggggcgatcttccacagctagatgtagtctgtttggctccgacttcgtaaacaccttcgacggtagcatgtactcatttgctggctactgttcctatttgctcgcgggaggctgtcaaaaaaggtcattctccattattggtgattttcagaatgggaaaagggtctccttgtcagtttatctgggagaattttttgacatacacttgtttgtgaacggcacagtgacccagggcgaccaacgggtctccatgccatacgctagcaagggcctatatctggagacagaagcagggtattacaagctatctggggaagcatacggcttcgtggcacgcatcgacgggtcaggaaattttcaggtattgctgagtgacagatatttcaataagacctgcggcctctgcggcaattttaatatattcgcagaagatgattttatgacccaggaagggacactcacctcggatccctacgattttgctaattcctgggccttgagctcaggcgagcagtggtgtgaaagggctagccccccctcaagttcatgcaatatttctagcggcgagatgcagaaagggctttgggaacagtgccagctgctgaaaagcacaagcgttttcgctaggtgccatcctctggtggatcctgagccttttgttgctctgtgcgagaagaccctctgcgagtgtgcgggcgggctggagtgtgcttgccctgctctgttggaatacgcgcgcacgtgtgctcaggaaggaatggtcctttatgggtggaccgatcattctgcatgctcccctgtgtgtccggccggtatggagtatcgacaatgcgtttccccgtgtgccagaacgtgtcagagcctgcacatcaacgagatgtgtcaggaaaggtgcgtggacggatgttcttgccccgagggccagcttctcgacgaaggcttgtgtgtagagtctactgaatgtccttgtgtccatagcggtaagcggtacccacctgggaccagcctatccagggactgtaatacctgcatctgcaggaactctcaatggatttgtagcaacgaggaatgccctggtgagtgtctggtgactggccagtcccatttcaaatcattcgacaatcgttatttcaccttctctggcatttgtcagtatctgctagcacgcgactgccaagatcattcgttcagcatcgtgatcgagactgttcaatgtgctgatgatcgcgacgcggtgtgtactcgcagtgtcactgtgagattgcccgggctccacaactccctcgttaagctaaagcacggcgccggcgtggctatggacggacaggatgtacaactcccccttctcaaaggagacttgaggattcagcatacagtgactgctagcgtgcggctaagttacggcgaagatctgcagatggactgggatgggagggggcgactcttagtcaaactttcacctgtgtatgccggcaagacctgtggattgtgtggaaattataatggaaaccagggagatgatttccttactccgtctggactggccgaaccacgcgtcgaggatttcggaaatgcttggaagctgcacggagattgtcaggaccttcagaagcagcattccgatccatgtgcacttaacccaagaatgacaagattctctgaggaggcttgcgccgtgttaacttcacccacctttgaagcctgtcatcgggcagtgtctcctttgccttacttgcgaaattgccggtacgatgtttgttcttgttcagacggccgcgagtgtctctgcggtgcgctggcatcttatgcggctgcatgcgcgggaaggggcgtcagggtggcttggcgtgagccggggagatgcgagctaaactgccctaaaggacaggtgtacctgcagtgtggcaccccctgcaatctgacctgcaggtcattgagttatcccgacgaggagtgtaacgaagcgtgcctggagggatgcttttgccctcccggactgtatatggacgaacgcggcgattgcgtgcccaaagctcagtgtccgtgttactacgatggcgaaatattccagcctgaggacatcttttccgaccatcacacaatgtgctactgtgaagatggtttcatgcactgtacaatgtctggggtgcctgggagcctactgccggacgctgtgctgagtagccccctgagtcacaggtctaagcggagtctgtcatgtaggccaccgatggtcaagctcgtctgtcccgctgataatctgcgcgcggagggccttgagtgtaccaaaacttgccagaattacgacctagagtgcatgtcgatgggatgcgtctcgggttgcctctgcccaccaggcatggtgcgacacgagaaccgatgcgtggctctggaacggtgcccctgtttccatcaaggaaaagaatacgcccccggtgagaccgtgaagataggatgtaacacatgtgtgtgccaggatagaaagtggaactgcacagaccacgtgtgcgacgctacatgttcgacgattggtatggctcactacttgacatttgacgggttaaaatatttgttccctggcgaatgtcagtatgtacttgtgcaagactactgcggaagcaatccaggaacgttccgaatcctagtagggaacaagggatgtagccatcctagcgtgaagtgtaagaagagagtaaccatcttggtggagggaggagaaatcgagctctttgatggagaggtgaacgtgaagcggcctatgaaggatgagacccatttcgaggtggtagaaagcggcagatacatcatcctcttactgggaaaagcattgtccgtcgtttgggataggcacctgagcatcagcgtggttctgaagcagacttaccaggagaaggtctgcggactttgcggcaatttcgacggcatccaaaacaacgatctgacctcttccaatctgcaggtagaggaagatccagtcgactttggcaattcctggaaagtctcctctcagtgcgctgatacgcgcaaggttccacttgactcatctcccgccacctgtcataacaacattatgaagcagaccatggtagattccagctgccgcatcctcacaagcgacgtgtttcaggactgcaataagctagtggatccagaaccctatctggacgtatgcatctacgatacgtgcagttgcgagtccattggcgactgcgcttgcttctgcgatacaatcgctgcctacgcccacgtgtgtgctcagcacgggaaggtagtaacctggcggacagctaccctgtgcccccagtcctgtgaagaacgcaatctgagggagaacggatatgagtgcgaatggagatataattcttgtgcaccggcctgtcaagtcacttgccaacacccagagcccttagcctgccccgtgcagtgcgtggagggctgccatgcacactgcccgcccggcaaaatactggacgagctacttcaaacctgtgtcgatccggaggattgtcccgtttgtgaggttgccggacgaagattcgcttccgggaaaaaggtgaccttgaacccaagcgacccagagcactgccaaatctgccactgtgacgtagtaaaccttacctgcgaagcctgccaggagcctggaggcttggtagtgccgcctacagatgcacctgtatcccccacaaccctctatgtagaagacatatctgagccgcccttgcatgacttctactgttctaggctgctcgaccttgtgtttctactggatggctccagtcgcttaagcgaggctgagtttgaagttctcaaggcattcgtcgtcgacatgatggaacggttgcggataagccagaaatgggtgcgcgtggctgtggtggagtatcacgacggtagccacgcttacataggcctaaaagataggaagaggccaagtgaactccgtcggatcgccagtcaagttaagtacgctggcagtcaggtcgcttctacatctgaagtcctgaaatacaccctgtttcagatcttctccaagattgacaggccggaggcatcgcggattactctcttgctcatggcatctcaagagccccagcgcatgtctcgtaattttgtgaggtatgtgcagggcctaaagaaaaaaaaagtgatagttattcctgtcggaataggtcctcacgccaacctgaagcagattcgattgatcgaaaagcaggctcctgagaataaagcatttgtcctctcgtcagtcgacgagctcgagcagcagagagatgagatcgtgtcatatttgtgtgaccttgcccccgaagctcccccgccaaccctgccccctgacatggcccaggtaacggtgggtccaggactactgggtgtttcgactctgggacccaagagaaactcaatggttctggacgtcgcattcgtgctggagggcagcgataaaatcggagaggcagattttaaccgcagcaaagagttcatggaggaggtcattcagcggatggacgtaggacaggatagcatccatgtaactgttcttcaatactcgtatatggtgaccgttgagtatccttttagcgaggcccaatccaagggggatattttgcagcgggttcgggagattaggtatcaggggggcaataggacaaataccggtctggccttgagatatcttagcgaccatagcttcctggtcagccagggagatcgggagcaagcccccaacctcgtgtatatggtgactggaaacccagcaagcgacgagattaaaagactgcctggggatatccaagtggtgcccatcggagtgggccctaacgctaatgtgcaggagctggaaagaatcggctggcccaacgctcctatactgatccaggattttgagacactgcctcgggaagctccggacctggtgctccagcgctgctgcagcggcgaaggcctacagataccaactctgagcccagccccggattgctctcagccgctggatgtcatactgcttttagacggctcatcctcttttccggcctcttattttgacgagatgaagtcgttcgctaaggcctttataagtaaggctaacattgggcctcggctcacgcaggtgagtgtgctccagtacggtagcatcactactatcgacgttccttggaatgtcgtgccagagaaggctcacctgttgtcccttgtagatgtgatgcagcgcgagggagggcctagccagatcggcgacgccctaggattcgccgttaggtatctgacaagtgagatgcacggagcacggcccggagcaagcaaagccgtggttatcctagtgactgatgtctccgtcgatagtgtcgacgcagctgccgatgccgcccggtcaaaccgcgttacggtgttcccgattgggattggtgacagatacgacgctgcgcagctcaggatcttggccgggcctgccggggactctaacgttgttaagctgcaacggattgaggacctgccaactatggtgactctaggtaattcattcctgcataaactttgttctggcttcgtgcgcatctgtatggatgaggacggaaatgagaagaggcccggcgacgtttggacactaccagaccagtgtcacacggtgacctgccagccagatggtcagaccctattgaagagccatagagtaaactgcgacaggggactgagaccgagctgtccaaacagccaatctccagtgaaggtagaggaaacctgcggatgtcggtggacctgtccatgtgtatgtacgggaagctcaacaaggcatatcgtcactttcgatggccagaacttcaagctcacgggctcttgttcatatgtgctcttccagaataaggagcaggatctggaggtgatactccacaacggggcttgctcgccaggcgcccggcaggggtgtatgaagtctatcgaagtgaaacactctgccctctctgtcgaactacatagtgacatggaggtgaccgtaaacggacgtctcgtgtctgttccttatgtgggcggtaatatggaagtgaatgtgtacggtgccattatgcatgaagtccggtttaaccatctgggacacatatttaccttcacaccgcaaaacaatgagttccagctgcaactctcccccaaaacttttgcgtcgaagacatacgggctatgcgggatttgcgatgagaacggagcgaatgacttcatgttgagggatggcaccgtgacaactgactggaagacactggtgcaggagtggactgtgcagcgccctggccagacctgccagcctatcctggaggagcagtgtttggttccagatagcagccactgtcaagttcttctcctgcctctgttcgccgagtgccataaagtccttgcgcccgccacgttttatgctatttgccaacaggacagttgtcaccaggagcaggtgtgtgaggtgatagcaagttacgcacacctctgtagaactaatggagtgtgcgttgactggaggactcctgacttctgcgccatgtcatgcccaccttcccttgtttacaatcactgtgagcatggttgcccccgccactgtgatgggaacgtctcttcttgtggggatcatcccagtgaggggtgcttctgcccaccagacaaggtgatgctggaggggtcatgtgtgcccgaagaggcttgcacccagtgcattggtgaggacggtgttcagcatcagttcttggaggcgtgggtgccagatcaccagccctgtcagatctgtacatgcctgtccggcaggaaagttaactgcacaacccaaccctgccccaccgccaaagctcctacctgtgggctgtgcgaggtcgctaggttaagacagaacgccgatcaatgctgcccggagtacgaatgtgtatgtgacccagtctcttgcgacctcccccccgtgcctcactgcgaacgggggctgcagcctacactcaccaaccctggcgagtgtcgccctaactttacctgtgcctgccggaaggaagaatgcaaacgggtgtccccaccctcatgtccaccccaccggcttcctactttgcggaagactcagtgttgcgacgaatatgagtgtgcttgcaactgtgtgaatagcactgtgagttgccctcttggataccttgcttcaacagctacgaatgactgcgggtgtactactactacgtgtctacctgataaagtatgcgtccacaggagcacaatctacccagtagggcagttttgggaagaaggctgcgatgtttgcacctgtaccgatatggaggacgctgtgatgggcctcagggttgcccaatgttcgcagaagccatgcgaagattcctgtaggagtggctttacctatgtgctgcatgagggtgagtgctgtggccgctgcctgccgagcgcctgcgaggttgtgaccggctctccaaggggcgattcacagtcttcctggaagagtgtgggatcccaatgggcctccccagagaatccttgcttgataaacgagtgcgtgagagtgaaggaggaagtcttcattcagcagcgcaacgtgtcctgtcctcaactggaagtgcccgtgtgcccaagtgggttccaactgagctgtaagacaagtgcatgctgtccctcatgtagatgtgagcgaatggaagcatgtatgctcaatgggacagtgatcggtccaggcaagactgtgatgattgacgtctgcaccacatgccgatgcatggtccaagtcggcgtgataagtggatttaaactggaatgtcggaagactacatgtaatccctgtccgctggggtacaaagaagaaaacaataccggagagtgctgcggacgctgcttgcctaccgcgtgcacaatccaactcaggggcggacagatcatgacattgaaaagagatgagaccctccaggatggctgtgatacccacttttgtaaggtcaacgagaggggagagtacttctgggagaaacgcgtcacgggctgtcccccatttgacgaacataaatgtctggccgaaggggggaaaatcatgaagattccgggaacctgttgtgatacctgcgaagagccagaatgcaacgatatcaccgctcggctccagtacgtgaaagtgggctcctgtaagtctgaggttgaagtggatatacactattgtcagggcaagtgcgcctctaaggctatgtactctattgatattaacgacgtgcaggaccagtgtagctgttgttcgcccacacgaacggagcccatgcaggtcgccctgcattgtaccaacgggtctgtagtgtaccacgaggtcttgaatgcgatggaatgtaagtgctccccacggaagtgttctaaa

SEQ ID NO: 21421 - DNA, 8439 bp, Artificial Sequence
  Description of Artificial Sequence: Synthetic coding sequence
atgataccagcccgcttcgcaggcgttcttcttgccctggccctgattttgcccggcaccctctgcgccgagggcacaaggggtagatcttcaaccgctagatgctccctgttcggctcagatttcgtaaacaccttcgatggaagtatgtactctttcgccggttactgcagctaccttttggctggcggttgccagaagagaagcttttctataatcggagatttccagaacggaaaaagagtgtctctttcagtgtacctgggagagtttttcgatattcatctgttcgtcaacggtaccgtgacccagggtgaccagcgcgtctccatgccatacgcatctaaaggcctttacctcgagacagaggccggctactacaaattgtctggcgaagcttatggatttgtagctagaattgacggcagcggaaacttccaggtcctgctctctgatagatacttcaacaagacttgcggcctctgcggtaatttcaatatctttgccgaagatgacttcatgacccaggagggtactctgaccagcgacccttatgactttgcaaactcttgggctctttcttcaggtgagcagtggtgcgagcgtgcaagcccaccttcaagctcatgcaatataagcagcggagaaatgcaaaagggactgtgggagcaatgccaactcttgaagtctactagcgtttttgcccgttgccaccctctggtggatccagaacctttcgtcgcactctgtgaaaagacactctgcgagtgcgctggtggtcttgagtgcgcctgcccagccctgctggaatatgcaagaacatgcgctcaggaaggtatggtcctgtacggttggacagatcattcagcatgctcaccagtgtgcccagccggcatggagtatcgccaatgcgtgtcaccttgcgcacgtacatgccagtccttgcacatcaatgagatgtgtcaggagaggtgcgtggatggttgctcctgccccgaaggacagctcctcgatgagggactttgcgtcgagtctacagaatgcccctgtgtacactccggtaaaaggtatccaccaggtacttccttgtcaagagactgcaacacatgcatctgcaggaactcacagtggatatgttccaatgaggaatgtccaggtgagtgcctggtcaccggccaatcccactttaagagtttcgataaccgctacttcacattcagtggtatttgtcaatatctgctcgccagggactgccaagatcattcctttagcatcgtgatcgaaacagtacagtgcgccgacgaccgcgatgcagtatgcacccgctcagtgaccgtgcgtctgcccggtttgcataactctttggttaaactgaaacacggagctggcgtggctatggacggtcaggatgtgcagctgcccttgctgaagggtgaccttaggatccagcataccgtgactgcaagcgttaggctgagctatggagaagacctgcagatggactgggacggtagaggaaggcttttggtaaagctcagtccagtttacgccggcaagacctgcggcctctgcggaaattacaacggcaaccagggagacgacttcctcacccctagtggcctggccgagccaagggtcgaagatttcggaaacgcttggaagcttcacggtgactgccaagatttgcaaaagcaacactcagatccatgcgcactgaacccacgcatgacccgtttttcagaagaggcctgtgccgttctgacctcacccacatttgaggcttgccacagggctgtctcacctctgccatacctcaggaactgtcgttacgatgtctgctcctgcagtgacggccgtgaatgtctctgcggcgccctggcttcttatgctgccgcatgtgctggtaggggcgtccgcgtggcctggagggagcccggcaggtgtgaacttaactgtcctaaaggccaggtgtacctgcagtgtggaactccttgcaatttgacttgtaggagcctgagctatccagatgaagaatgcaacgaagcctgcctggaaggatgcttctgtcctccaggtttgtatatggacgagaggggtgattgcgtgccaaaggctcagtgtccatgctactacgacggagagatcttccaaccagaagatatcttcagtgatcatcacacaatgtgttactgcgaggacggtttcatgcactgtactatgtcaggagtgcccggttcccttctcccagacgcagttcttagcagccccctgtcacataggtccaagcgtagtctgtcttgcagaccaccaatggttaagttggtgtgccctgctgacaaccttagagccgagggattggagtgtacaaaaacatgccaaaattacgacctggaatgcatgtcaatgggatgtgtgagtggttgtctttgtccacccggtatggttaggcacgagaatcgttgcgtggcactggagaggtgtccctgcttccaccaaggtaaagaatatgctccaggagagaccgtgaagatcggttgcaatacttgtgtctgccaggaccgcaagtggaactgcaccgaccacgtttgtgatgctacctgctctaccatcggcatggcccactacctgacctttgacggcctgaagtacctgttccctggagaatgtcagtacgtgctggttcaggattattgcggcagcaacccaggcaccttcaggattcttgttggaaacaagggatgttctcatcctagcgtgaaatgtaagaagcgcgttacaatcttggtcgagggtggtgagatcgagctgttcgatggagaggtgaacgttaaacgtccaatgaaggatgagactcacttcgaggtggtggaatcaggaagatacatcatcctgctgttgggcaaggccttgtctgtagtgtgggaccgccatctcagcatctctgtggttcttaagcagacctatcaggagaaagtctgcggcctctgcggaaacttcgacggcatccagaacaacgatttgacctcttcaaacttgcaggtggaagaggacccagtggattttggtaacagctggaaggtgtcctctcaatgcgccgacactagaaaagtacccctggattcatctcccgcaacatgccataacaacatcatgaagcagacaatggtggatagcagctgcaggatcctgacctctgacgtatttcaggattgcaataagctggtagatccagagccatacctggacgtgtgtatttacgacacctgttcctgcgagtctatcggtgattgcgcttgcttttgcgatacaatcgccgcctacgcccatgtgtgtgcccagcatggtaaggtcgtcacttggagaacagccactctttgcccacagagctgcgaggagcgtaacttgcgcgaaaatggctacgaatgcgaatggaggtataactcttgtgctcccgcctgtcaggttacatgtcaacatccagagcctttggcttgcccagttcaatgtgtggaaggttgccacgctcactgccccccaggtaagatcctcgacgaattgctgcagacttgcgtggaccctgaggattgtccagtgtgcgaagtagctggtagacgcttcgcttccggcaaaaaggttaccctcaacccaagcgaccccgagcactgccagatttgccactgcgacgtggtaaacctgacctgcgaagcctgccaggaacctggtggcttggtggtgccacccactgacgccccagtttctccaactactctttacgtggaggatatttccgagcccccactgcacgacttctactgcagccgtttgctggacctcgtgtttctgctggacggtagcagtagactgagcgaggccgagtttgaggttctgaaggctttcgttgtcgatatgatggaacgtctccgcatttcccaaaaatgggtaagggtcgccgtcgtggaataccacgacggtagccatgcctatattggcctgaaggacaggaagcgccctagcgagctcagaagaatcgctagtcaggtcaagtacgccggttcacaggttgcctctacctctgaggtgttgaagtataccctgttccaaatcttttccaaaatcgaccgtcccgaagcctctcgtatcacactcttgctcatggcctctcaggaacctcagcgtatgagcaggaacttcgtgcgctacgtgcagggcttgaaaaagaagaaggttatcgtgatcccagtgggcattggtccccatgccaatctgaagcagatacgcctcatcgagaaacaggcacccgagaataaggcttttgttcttagctctgttgacgaactggagcagcaaagggacgagatcgtctcctatctctgtgatctcgcacctgaagcacctcctccaactcttccccccgatatggcccaagtcacagtgggacctggactgctgggagtgtcaaccctgggtcccaaacgcaactccatggttctggatgtggcttttgtgctcgagggctctgacaagattggagaggcagacttcaatagatcaaaggaattcatggaggaagtcattcaaagaatggacgtgggtcaggattctattcatgtgacagtgctccaatactcctatatggtcaccgtggagtaccctttctccgaagctcaatccaagggtgacatactccagagagttagagagatccgctaccagggtggcaataggaccaacaccggtttggctctgcgctacctgtccgaccactcatttctcgtgtcccagggagatagagagcaagctcccaatctggtctatatggtgacaggaaaccccgcttctgatgaaattaagagactgccaggcgatatacaggtagtgcctattggcgtaggaccaaacgccaatgttcaggaattggaaagaattggctggcccaacgctccaatcctcattcaggactttgaaacactccctagagaggctcctgaccttgtgcttcagagatgttgctccggagagggactgcagataccaacattgagccctgctcctgattgcagccaacctctggatgttatcctgttgctcgatggctcatcttcatttcctgcttcttattttgatgaaatgaaaagtttcgctaaagcttttatttcaaaagcaaatataggacctcgcctcacacaggtatcagtgttgcaatatggatccatcaccaccatcgacgtgccatggaatgtagtccctgagaaagctcacctgctgtcactggtggacgttatgcagagggaaggaggaccaagccaaatcggtgatgctctgggatttgctgtgcgttaccttacatccgaaatgcatggagccaggcccggcgcctccaaggctgtcgtaattctcgtcacagatgtttccgtggacagtgttgacgctgcagcagatgctgctaggtctaaccgcgtgaccgtattccctattggtataggagatagatatgacgccgctcaactgagaatactcgctggccctgccggcgattcaaacgtcgtcaagttgcagcgcattgaggaccttcccacaatggttaccctcggaaactcattcctgcataaattgtgtagcggatttgtacgcatctgcatggacgaggatggcaatgagaagcgtcctggtgacgtttggacccttcccgatcagtgccatacagtcacctgtcagcccgacggccagacacttttgaagagtcatcgcgttaattgtgaccgtggcctgaggcctagctgccctaactctcaaagcccagtgaaggttgaggagacatgcggttgccgctggacatgcccttgtgtctgcactggatcttctaccagacacattgtgacctttgatggacaaaactttaagcttaccggttcatgctcatacgtcttgttccaaaacaaggagcaagaccttgaagtgatactccataatggagcttgctcccctggtgctagacaaggttgtatgaagtccatcgaagtgaaacattccgccctgtccgtggaattgcactctgatatggaagttactgttaatggcagactggtgtccgtcccttatgtgggtggtaacatggaggtgaatgtctacggagctattatgcatgaggtgagattcaaccacctgggccacatttttactttcacaccacagaacaatgagttccagctccagctgagccctaagaccttcgcctccaagacctatggtttgtgcggtatctgcgatgaaaatggagccaatgactttatgctgcgcgatggtacagtcactaccgactggaagaccctcgtgcaagagtggacagtgcagcgtcccggacagacatgccagcccatactggaagaacagtgcctggtgcccgatagttcccactgtcaagtgctgttgctccctctctttgccgagtgtcacaaagtcctcgctcctgctacattctatgccatctgtcagcaagattcttgccatcaggagcaagtctgcgaggttatcgcctcatatgcacacctttgccgcacaaacggagtttgcgtggactggcgcacccccgacttctgtgctatgtcctgcccacctagcctggtttataaccattgcgaacacggctgccctcgtcactgcgacggtaatgtgtccagctgtggtgatcacccctcagagggttgcttttgcccaccagataaggttatgttggaaggctcttgtgtccctgaggaggcttgcacacagtgcataggcgaggatggtgtacagcatcagttcttggaggcatgggtgcctgaccaccagccttgtcagatttgcacctgcttgtccggcaggaaggtgaactgtactactcagccttgccctaccgctaaggcacccacttgtggcttgtgcgaagtcgcacgtctcagacaaaacgcagatcaatgctgtccagagtacgagtgcgtgtgcgaccctgtttcatgcgatctgccccccgtgccccattgtgagaggggactgcagcctactctgactaaccctggcgagtgccgtccaaactttacctgcgcctgcaggaaggaagagtgcaagcgtgtgtctcccccttcctgtccaccccatcgcttgcctactctgaggaagacccaatgttgcgacgagtatgaatgcgcctgcaactgcgtcaattctaccgtatcttgtcctctcggatacttggcttccactgcaactaatgactgcggctgtaccaccacaacttgtctgcccgacaaggtgtgcgtacatagaagcaccatataccccgtcggccaattctgggaggagggttgcgacgtgtgtacttgcacagatatggaggacgccgtgatgggactgagagtggctcagtgctctcagaagccttgcgaggacagttgccgctctggttttacttacgtgcttcacgaaggcgagtgttgcggcaggtgccttcccagtgcatgcgaagtggtcaccggctcaccccgcggagactctcagtcctcctggaaatccgtgggttcccaatgggccagccccgagaatccctgtctgatcaatgagtgtgtgagagtgaaggaggaggtgttcatccagcagaggaatgtgtcctgcccccagctggaggtgcctgtgtgtccctctggttttcagctctcctgtaaaacttcagcttgctgccctagctgcaggtgtgagcgtatggaagcttgtatgctcaacggtactgtcatcggaccaggaaaaaccgtgatgatcgacgtgtgcaccacttgccgttgtatggtgcaggttggtgtcatttccggctttaagttggagtgtcgcaagaccacatgcaatccctgccccctcggatacaaggaagaaaacaataccggtgagtgttgtggccgctgcctgcccacagcctgtactatacagttgaggggtggccagattatgacacttaagcgcgatgagactcttcaagacggctgcgacacccacttttgtaaagtgaatgagagaggtgaatacttttgggagaaacgcgtaaccggttgccccccattcgacgaacacaagtgtctcgccgaaggcggtaagataatgaaaatccccggtacttgttgcgatacttgcgaggagccagagtgtaatgacatcactgcacgcctccagtatgtcaaggtgggttcttgtaagagtgaggtggaggttgatatccactactgtcagggcaagtgtgccagtaaggctatgtatagcatcgatatcaatgatgtccaggatcagtgctcttgctgctctccaacacgtactgagccaatgcaggtggcactgcactgtaccaacggaagcgtcgtgtatcacgaggtgttgaatgctatggagtgcaaatgctcccctaggaaatgcagcaag

SEQ ID NO: 21422 - DNA, 8439 bp, Artificial Sequence
  Description of Artificial Sequence: Synthetic coding sequence
atgatccccgcacgctttgctggagtgctccttgccctggccttgatccttcccggcacactatgcgctgaaggaacaagaggcagaagctctaccgctaggtgcagcctgttcggctccgacttcgtcaatacgtttgacgggagcatgtatagttttgctggatattgcagttacctgctggctggagggtgtcagaagaggagcttcagcattatcggagacttccaaaacggaaagcgcgtgagcctttctgtttacctgggagaattttttgacatccatctgtttgttaacgggaccgtgacccagggggatcagcgggtgagtatgccttacgcaagtaagggtctctatctggaaacagaggcaggttactacaaactttcaggagaagcttatggatttgtcgctcgcatcgacggaagtggcaacttccaggttctcttaagcgaccgctattttaacaagacctgcggcctgtgcggaaactttaatattttcgccgaagatgacttcatgacccaggagggcaccctaacttccgacccctacgattttgcaaacagctgggctctgagctccggggaacagtggtgcgaaagagcctccccacccagctcctcctgcaacatctcatcaggcgaaatgcagaaagggctctgggagcaatgtcaactcttgaaatccacatctgtattcgctaggtgtcacccccttgtcgaccctgaacccttcgtcgctctctgtgaaaaaaccctgtgtgagtgtgccggggggctcgagtgcgcctgccctgcattgcttgaatatgctagaacgtgcgctcaggagggcatggtactgtatggctggaccgatcactcggcatgtagtccagtttgtcctgcagggatggaataccgccagtgtgtttcaccttgcgcacgcacctgccagagcctgcatattaatgaaatgtgtcaagaaagatgtgtcgatggatgctcatgcccagagggccagttacttgacgaggggctgtgcgttgagtctaccgaatgcccatgcgtgcattcgggcaaaagatacccaccaggcacctccttgtcaagagattgcaacacttgcatatgcagaaactcccagtggatctgctcaaacgaggaatgcccaggagagtgcctcgtcacgggccaatcacactttaagtcattcgacaataggtacttcacattcagcggcatctgtcaatacttgctcgcacgcgattgccaagaccactcgtttagtatcgtgatcgaaacagtccaatgcgccgatgatagggacgccgtttgcactaggtctgtgactgtgcgcctaccaggcctccataatagccttgtcaaactcaagcacggcgcaggcgttgcaatggatggacaggatgttcaactgcccctcctcaaaggcgatctgagaattcagcatacagtcacagcgagcgtgcgtctcagctacggagaggacctgcagatggattgggacggccgcggaagactcctggtgaagctgagccctgtttacgcaggtaagacctgcggactttgcggcaactacaacggcaaccagggagacgatttcctgaccccttccggactcgcggagccaagagtagaagatttcggaaacgcctggaaattgcacggcgactgtcaggatttacaaaaacagcacagcgacccatgcgctcttaaccctcgaatgaccagattctccgaggaagcctgcgccgttctgacatcaccaacatttgaagcttgccatcgcgccgtttcaccgctgccatatctgagaaactgcaggtacgatgtctgttcttgctctgatgggagggagtgtctgtgcggcgccctcgccagctatgccgccgcttgcgctggcaggggcgtgcgagtagcctggcgtgaacccggcagatgtgaactgaactgtcctaaaggccaggtctacctccagtgtggtaccccctgcaacctcacatgtaggagcctgagttatcccgatgaagagtgtaacgaggcttgcctcgaaggctgtttctgtccaccaggcctgtacatggacgagcggggcgattgcgtccccaaagctcaatgtccgtgttactatgatggagaaatcttccaaccagaggatatattctccgaccatcatacaatgtgttattgcgaagacggctttatgcactgcactatgtccggagtccccggctccctgctgcccgacgccgttctaagttctccactcagtcatcgctctaagagaagcctgtcttgtaggcctcccatggtcaagctggtgtgtccagctgacaaccttcgggctgaaggcctagagtgcaccaagacctgtcaaaactacgatttggagtgtatgagcatgggatgcgtatctggttgtttatgcccgccgggcatggtaaggcacgagaatcgatgcgtggctctggaaaggtgtccttgctttcaccagggaaaagagtacgcacccggggaaacagtcaagatcggttgcaatacatgcgtatgtcaagatagaaagtggaactgcacagatcacgtgtgcgacgccacatgttctaccattggaatggcccattatctgacgtttgatggcttgaagtacctcttcccaggggaatgccagtatgtgttggtccaggactactgcggctctaaccctggtacttttaggatcctcgttggcaacaagggttgttctcatccatccgttaaatgcaaaaagagagttacaatcctggtcgagggaggagaaatcgagctgtttgacggagaagtgaacgtgaagagaccgatgaaagatgagacacatttcgaagtcgtggagtctgggcgctatattatactgctgctggggaaggcattgagcgtggtctgggacaggcacctctctatctcggtcgtgcttaaacagacataccaggagaaggtctgcggactctgcggtaacttcgatggaattcaaaataatgatctgacctcaagcaacctgcaggtggaagaggatccagtggactttggaaacagctggaaggtttcttcacagtgcgcagatacacggaaggtccctttggattcaagccctgcaacttgccataacaacatcatgaagcagacaatggtggactccagctgtcgaatcctgacctccgatgtctttcaagactgcaacaaactggtcgatcctgagccctacttagatgtttgcatttacgatacttgtagctgtgaatccatcggggattgtgcttgcttctgcgatacgatcgctgcttacgcacatgtgtgcgctcaacatggtaaagtcgtgacctggaggactgcaacactgtgcccccaatcttgcgaagagcgtaacctgagggagaatggttatgaatgcgaatggagatataactcttgcgcaccagcctgccaggtgacctgtcaacacccagagccattagcctgtcccgtgcaatgcgtggagggatgtcacgctcattgccccccaggaaagatcttggacgagctgctgcagacctgcgtggatcccgaggattgtccggtttgtgaggttgctggcaggcggtttgcaagcggcaagaaagtaaccctcaacccatccgatccggagcactgtcagatttgtcattgcgatgtggtcaacctgacttgcgaggcttgtcaagaacccggcggcttggtagtgcctcctacagacgcaccggtgagtccgaccactctctacgtcgaagacattagcgagcctccactccacgatttctattgtagtcggctgctggacttggtgtttttactcgatggaagcagccgtctatctgaggcagaattcgaggtgctcaaggcctttgtcgtcgacatgatggagcgattgaggatctcgcaaaagtgggtgcgagttgccgtcgtggaataccacgacgggtctcatgcctatatcggcctgaaggacagaaaacgaccatccgagctgcggagaatcgcaagccaagtgaagtacgccggttcccaggtagcctcaaccagtgaagtcctgaagtacacccttttccagatcttctcaaaaattgaccgaccagaggcttccaggattaccctgttgctgatggctagccaagaaccccagagaatgagccgtaattttgttcgttatgtacagggcctgaaaaaaaagaaggtaatcgtgatccctgtcggcatcggaccccatgctaatttgaagcagataagactcatagagaaacaggcaccagagaataaggcctttgttctgtcatcagttgatgaactggaacagcaaagagacgagatcgtgtcatacctttgtgacctggcaccagaggcaccaccacctactctgccaccggacatggctcaagtgaccgtgggtcctggtctcctcggcgtgagcactctcgggccaaagaggaactcaatggtccttgatgtcgcctttgtactggaagggagcgacaagattggagaggccgactttaaccgaagcaaggaattcatggaggaagtgattcagagaatggacgtcggacaggattcaattcatgtgaccgtgcttcagtattcttatatggtaacagttgagtatccattttcagaagcccaatctaagggagacatacttcagagagtgcgcgaaatacgttatcagggagggaatcgcacaaataccggcctggcgttgaggtacctgtcagatcattcttttctggtcagccaaggcgaccgcgagcaagctcctaatctcgtgtacatggtaacaggtaacccagctagtgacgagatcaaaagactgcccggagatattcaggtggtcccaatcggcgttggaccaaatgccaacgtgcaggaactggagcgtatcggctggcctaacgcgccgatattgatccaggacttcgagacactgcctagagaagctccagatctggttttgcaacggtgctgcagtggcgaaggactgcagattcctactctgtcacccgcgcccgactgttcacaaccactggacgtcattctgctgcttgatgggtcatcttcttttcctgcatcttatttcgatgaaatgaagtccttcgccaaagcatttattagtaaagccaatattggtcccagattgactcaggtaagcgtgctgcaatatggaagtattacaacaatcgatgtgccatggaatgtcgttccggaaaaggcccacctgctgagtctggtcgacgtgatgcagcgggaaggcggcccgtcccagattggagacgcattgggttttgctgtccgctaccttaccagtgagatgcatggggcccggccaggagcttcgaaagctgtagtcatcctcgtgactgatgtcagcgtagattccgtcgatgctgctgcagatgcagcaaggtctaacagggtgaccgttttcccaatcggaatcggagatcggtatgacgcagctcaacttaggattctggctggacctgctggcgactctaacgtggtgaagctccagaggattgaggacttaccaactatggtaacgctgggcaacagcttccttcacaaactttgctccggttttgtgcgcatttgtatggacgaggatggcaacgaaaagcggcccggagatgtgtggactttgcccgatcaatgtcatactgtgacttgccagcccgatggtcaaacattgctgaaatcccacagagtgaactgtgataggggcctaaggccctcttgccctaacagccaaagtcccgtcaaagtcgaagagacttgcggatgtagatggacctgtccctgcgtgtgtacaggctctagcacaagacatatcgtgaccttcgacggccagaactttaaacttaccggctcctgctcttacgttctgttccagaacaaagagcaggacctggaggtgattctgcataacggggcatgctcccctggagcaaggcagggttgtatgaaatcaattgaagtgaagcacagcgcactgtctgtggaacttcacagtgatatggaagtcaccgtaaatggcaggctggtctctgtgccatacgtcgggggaaacatggaggttaacgtctatggggccataatgcacgaagtgaggtttaaccatctaggacatatcttcacttttactccacagaataatgagttccagctgcaactgtccccaaagaccttcgcgagcaaaacgtacgggctttgcggcatctgcgatgaaaacggcgccaatgacttcatgttacgggatggaacagtaactactgactggaagacgctagttcaggaatggaccgtccagaggcctggacaaacctgccaaccgatactcgaagaacagtgcctcgtaccagatagcagtcactgccaggtgctccttctgcccctgtttgcagagtgccacaaggtgctcgcgcccgccaccttctacgcaatctgccagcaagattcttgccaccaagaacaggtttgcgaagtcatcgcttcatatgcccacctctgcagaaccaatggcgtgtgcgttgattggcggacccccgacttctgtgccatgagttgcccaccaagcctagtgtataaccattgtgagcatggatgtccaaggcactgcgacggcaacgtttcatcctgtggagatcacccctccgaaggatgtttttgtcctcccgataaagtgatgctggaaggctcctgcgtgcctgaagaggcatgcacccagtgcatcggcgaagacggcgtccagcatcagttcctggaggcttgggtcccagaccaccagccatgccagatctgtacctgcctgtcaggaagaaaggtcaactgcacgactcagccatgccccactgccaaggcccccacctgcggtctctgcgaggtggcaagactgcgccaaaatgcagatcaatgctgccctgaatacgagtgcgtctgcgacccggttagctgcgatcttcctcccgtgccccactgcgagagaggactgcagccaacactaaccaatcctggagaatgccgcccaaatttcacttgcgcctgcagaaaggaagaatgtaaacgcgttagtccacctagttgtcctccgcaccgtctgccaaccctgaggaaaacccagtgttgcgacgagtacgagtgcgcttgcaattgtgtgaacagtacagtgagctgcccgctggggtatcttgcttctacggctactaatgattgcggctgcacaactaccacctgcctcccagataaggtttgtgttcacagatccacaatttaccccgtcggacagttttgggaggagggatgtgatgtctgtacatgtacggacatggaagatgctgtcatgggccttcgcgtggctcaatgctcacagaaaccctgcgaagactcttgcaggagcggatttacttatgtcctgcacgagggcgaatgctgcggcaggtgcctcccaagcgcttgtgaggtggtcaccggaagccccagaggggactcacagtcaagctggaaatcagttggcagtcaatgggcttccccggagaatccgtgtctgatcaacgaatgtgtgcgggtgaaagaggaggtgtttatccagcaacgtaatgtaagttgccctcaactggaagtacccgtgtgccccagcggatttcagctgtcgtgtaagacctcagcatgctgtccttcatgtagatgtgagagaatggaggcttgtatgttaaacggaacagtgataggccctggcaagacagtgatgatcgatgtgtgcacaacttgtagatgcatggtccaagtgggcgttattagcggcttcaagctggagtgtcggaagaccacttgcaatccgtgcccattgggatataaggaggagaataacacaggggagtgttgtgggcgctgcctgccaactgcttgtaccatccaactgaggggagggcaaatcatgactctgaaaagagatgagactttgcaggacgggtgtgacacccacttctgtaaagtcaatgagaggggtgagtacttttgggaaaagagagtgacggggtgcccgccctttgacgaacataagtgccttgcggagggcggcaaaatcatgaaaatcccaggaacatgttgcgacacctgtgaagaaccagagtgcaacgatatcacagcaaggctgcaatacgtcaaagttgggagctgtaagtccgaggtcgaggttgacattcattactgccagggaaagtgtgcttctaaagccatgtattccattgacatcaacgatgtgcaagaccaatgttcctgctgtagccccactcggaccgagcctatgcaagtcgcactgcactgcaccaatggatctgtggtataccacgaggtgcttaatgccatggagtgtaaatgcagcccgaggaagtgctctaag

SEQ ID NO: 21423 - DNA, 8439 bp, Artificial Sequence
  Description of Artificial Sequence: Synthetic coding sequence
atgattcccgcccgtttcgctggtgttctgctggcactggcacttatcctcccaggtaccctctgtgctgagggtactcgtggccgctcaagcaccgctcgctgctctttgtttggctccgactttgtaaacacattcgatggcagcatgtactcgttcgctgggtactgctcttacctcctcgctggcggatgccaaaagcgctccttctcgatcattggtgactttcaaaacggtaagcgtgtctctctttccgtgtacctgggcgagttctttgatatccacttgttcgtgaacggtacggtcactcagggggatcaacgggtctccatgccttatgcctccaagggtctctatctagagacagaggcgggctactataaactgagtggtgaggcctatggcttcgtcgcgagaatcgacggatccggtaacttccaggtgcttctctccgaccgttactttaataaaacgtgtggtctctgtggaaatttcaacatcttcgcagaagatgatttcatgactcaggagggtaccctgaccagcgacccatacgacttcgctaactcttgggccctctcttccggggagcaatggtgtgagcgagcctcgcccccctccagcagctgtaacatttcgagtggagagatgcaaaaaggactctgggagcagtgccagctgctcaagagcacttctgttttcgctcgatgtcatcctctcgtcgacccggagccattcgtcgcgctctgcgagaagaccctctgcgagtgcgcgggcggcttagaatgcgcctgcccagctctgttggaatacgccaggacctgcgcacaggaaggcatggtcctctatggatggaccgaccattcagcctgcagtcccgtctgccccgccgggatggagtaccgtcagtgcgtctcaccttgcgcccgtacctgccagagcctccatataaatgagatgtgtcaagagcgctgtgtggacgggtgttcctgccctgagggtcagctcttggatgagggtttgtgtgtcgagtccactgaatgcccttgtgtccattctggcaagcgttatccccccggcacctccctgtctcgggattgtaacacctgtatctgccgcaattcgcaatggatctgctccaacgaggagtgtcctggtgagtgtctggtaaccggtcagagccacttcaagtctttcgataaccgttacttcaccttcagcgggatctgtcagtacctcctcgccagagactgtcaggaccattccttttcgatcgttattgaaacggttcaatgtgcggacgaccgtgatgccgtgtgcactcgcagcgtcaccgttcgcctgccaggtttgcataacagtttggttaagctgaagcatggcgctggtgttgccatggatggtcaggatgttcagctccccctcttgaagggcgatctacgcatccagcatacggtcaccgctagcgttcgcctttcctacggcgaggaccttcagatggactgggacggtagaggacgactgttggtcaagctttcccccgtgtacgctggaaagacgtgtggcctctgtggtaactacaacggcaaccagggcgacgacttcctcaccccttcgggactggccgaacccagggtcgaggacttcggaaacgcctggaagcttcacggagactgtcaagatctgcagaagcagcactccgatccctgcgctttgaacccacgcatgacacggttctccgaggaagcttgcgccgttctgacctctcccacgttcgaggcctgccaccgcgccgtgtcaccgttaccctacctacgtaactgtaggtacgatgtctgttcgtgctcggatggtcgtgagtgtctgtgcggtgccctcgccagctacgccgccgcttgtgcaggccggggtgttcgagtcgcctggcgcgaacccgggcgttgcgaacttaactgtcccaagggacaggtgtacttgcagtgcggtaccccttgcaaccttacttgccgtagtctctcgtacccagacgaggagtgcaacgaggcgtgcctggaaggctgtttctgtccccccggtttgtacatggatgagcgcggtgactgcgtgcccaaggcccagtgcccgtgctactacgatggtgaaatcttccagcctgaagacatcttcagcgatcaccatacaatgtgttactgtgaggatggattcatgcattgtaccatgtctggagtgcccggcagcctgcttccggacgcggtgctatctagtccgctgtctcataggtccaaacgtagcctctcttgtcggcccccgatggtcaagctcgtttgcccggcagataatctgcgtgcggaaggcctggagtgcaccaagacttgccagaactacgacctcgaatgcatgtcgatggggtgcgtctctggctgcttatgtcctccaggtatggtgcgtcatgaaaaccgttgcgtcgcgctcgagaggtgcccctgtttccaccagggaaaggagtatgcccccggtgagacggtcaagataggttgcaacacgtgcgtgtgccaggaccgcaagtggaactgcacggaccatgtctgcgatgccacgtgcagcacaatcggaatggcacactatcttacgttcgatggtctcaagtatcttttccccggtgagtgccagtacgtcctagttcaggactattgcggctccaacccggggaccttccggatactcgtcgggaacaagggttgttcgcacccctccgtcaagtgcaagaagagagtgaccattcttgtggaggggggtgagatcgagctgttcgatggtgaggtcaacgtcaagagaccaatgaaggacgaaacccactttgaggtcgttgagtccggcaggtacattatccttctgctggggaaggctctgagtgttgtctgggaccgccacctctcgatatctgtggtcctcaagcagacttaccaagagaaagtgtgcggtctctgcggcaactttgacggcatccaaaataatgacctgaccagttctaacctacaagtggaagaggatccggttgatttcggcaatagttggaaggtgagctcccagtgcgctgatacgcgcaaagtgcccctggattcctccccggcgacctgccacaacaatatcatgaagcaaaccatggttgacagctcctgccgaatcctgacttccgatgtgttccaggattgcaacaaattggttgatccggagccctatctggacgtctgcatctatgacacctgttcgtgtgaatcgattggcgactgcgcatgcttctgtgacaccatagctgcctacgcacacgtctgtgcgcagcacggcaaagttgtgacctggaggaccgcaactctgtgcccgcagtcgtgcgaggagcgaaacttgcgtgagaacgggtacgagtgcgagtggcgctacaattcatgcgcccctgcttgccaggttacctgccaacacccggagcctcttgcctgtccggtccagtgcgtcgagggctgccacgctcactgccctccaggaaagatcctcgacgagctgctgcagacctgcgtcgaccccgaggactgtcccgtctgcgaggtcgcaggccgtcgtttcgcgtctgggaaaaaggtgactctcaatccatctgatcccgagcactgccagatttgccactgcgatgtcgtgaacctaacctgtgaggcgtgccaggagcccggtggactagtggtcccccccaccgacgctcccgtctcgcccactacgctctacgtcgaagacatatcagagcccccccttcacgacttctactgcagtcgtctgcttgatctggtcttcctgcttgatggctcgagccgtctgtcggaggctgagttcgaggtcctcaaggccttcgtcgtcgacatgatggagcgccttcgcatatcgcaaaaatgggtccgcgtggctgtggtcgagtaccacgatggctcgcatgcctacattggcctgaaggaccgcaagagaccgtcggagctacggcgtattgcttcgcaagttaaatatgccgggtcgcaagtcgcctcgacctccgaggtccttaagtacacgctgttccagatcttctccaagatcgaccgacccgaggcctcccgcatcacgctgctgctgatggcctcgcaggagccccagcgcatgtcaaggaacttcgtccggtacgtccagggattgaagaagaaaaaggtgatcgtcatccccgttggaatcggcccacacgcaaacctcaaacagattagactgattgagaaacaagcgccggagaacaaagccttcgttttgtcctccgtggacgagcttgaacaacagcgcgacgagatcgtgagttacctgtgcgacctcgcccctgaggcgccgcccccaacgttgccacccgatatggcccaagtcacggttggtcccggtttactcggcgtttctaccctcggacctaaacggaactccatggtcctcgatgtcgcgttcgttctggagggatctgataaaatcggtgaggcggatttcaatcgctccaaggagttcatggaggaagtcatccagcgtatggatgtcggccaggatagcatccacgtcaccgtcctccaatattcctacatggttaccgtcgagtaccctttctccgaggcccagtccaagggtgatatcttgcagcgggtccgcgaaatccgatatcagggagggaatcgaactaacacgggtctggctctccggtatctgtcggaccactctttcctcgtctctcagggggatcgtgaacaggctcctaacttggtgtatatggtcaccggcaaccccgcctccgacgaaatcaagagactccccggtgacatccaggtcgtgcccatcggcgttggcccaaacgccaacgtgcaggagctcgaacgtattggttggcccaacgccccgatcctcatccaggatttcgagactctgcctagagaggcccccgatctggtcttgcagaggtgctgctccggagagggcctccaaatcccgacgctgagtcctgccccagactgctcacaacctcttgacgtgatccttctcttggatggttccagctcgttccccgcgtcgtatttcgacgagatgaagtcattcgcaaaggccttcatctctaaggcaaatatcggcccccgcctgacacaagtgtcagttctgcaatacggcagcatcaccactattgacgtgccgtggaatgtcgtccccgagaaggcccacctgctttcgctggtggatgtcatgcagcgtgaaggaggaccaagccagataggtgacgctctgggcttcgctgtgcgctacctgacctccgaaatgcatggcgccagaccgggcgcgtcgaaggcggtggtaatccttgtcaccgatgtctcggtcgacagcgtcgacgcggccgccgacgcggctcggtccaatagagtgaccgtcttccccatcggaattggtgaccgttatgacgccgcgcagcttcgaatactagcggggcccgctggtgacagtaacgtcgtcaaactacagcgtatcgaggatctgcccaccatggtcacgttgggtaactcgttccttcacaagctttgcagtggcttcgtgcgcatttgtatggatgaggatggaaacgagaagcggcctggagatgtctggacgcttcctgaccagtgtcataccgtcacttgccaaccggacggacagaccctcctgaagtcgcatcgcgttaattgtgaccgtggcttgcggccttcttgcccaaactcccagtctcccgtgaaggttgaggagacctgcggttgtcgctggacttgcccctgcgtgtgtacgggctcttcgacccgccacattgtaaccttcgatggtcagaacttcaagctcacaggttcttgcagctacgtcctgtttcagaacaaggagcaggaccttgaagtcatccttcacaacggcgcctgctcacccggtgcgcgccagggctgtatgaagtctattgaggttaagcacagtgccttgtcggttgagctgcactccgatatggaggttacggtcaacggtagacttgtctccgtcccgtacgtaggaggtaacatggaggtaaacgtatacggtgcgataatgcatgaggttcgcttcaaccacctgggccatattttcaccttcacaccccagaacaacgagtttcagctgcaactcagccccaagaccttcgcttccaaaacgtacggtttgtgcggcatctgtgacgaaaatggagctaacgatttcatgctccgtgatggcacagtgaccacagactggaagaccctggtccaggagtggactgtccaacgccccgggcagacctgtcagccaattcttgaggagcaatgccttgtgcccgactcgtcccactgccaggtgctcctgctgccccttttcgccgagtgccataaggtcctggcgcctgcaacgttctacgctatttgccagcaggactcttgtcatcaggaacaagtttgtgaggttatcgcatcctacgcccatctgtgccggacgaatggcgtctgtgttgattggcgcacccccgacttctgcgctatgtcctgtcccccatccttggtttataaccactgtgagcacggatgccctcgccactgtgatggcaacgtttcgtcctgtggagatcatcccagcgaagggtgcttctgccctccggataaggtcatgctcgagggttcttgcgtccctgaagaggcctgcacccagtgtatcggtgaggacggcgtccaacaccagttcctggaggcctgggtccccgaccaccagccatgccaaatttgcacctgtcttagcgggcggaaggtgaattgcaccacgcagccttgtccgacggctaaggccccgacctgcgggctctgtgaggtcgccagactcaggcagaacgccgatcagtgttgccccgagtatgagtgtgtttgcgacccggtgtcgtgcgacttgccccccgtcccgcattgcgagcggggcctgcagccgaccctgaccaatcccggggagtgcagaccgaacttcacttgtgcctgtcgtaaggaagaatgcaagcgcgtatcgcctcctagctgtcccccgcacaggctccccaccttgaggaagacccagtgctgcgatgaatacgaatgtgcatgcaactgcgtcaactcgaccgtctcttgcccactcggttacctcgcatccaccgccacgaacgattgtggatgcacgactaccacctgcctgcccgataaggtttgcgtccatcgctcaacgatctacccagtcggtcaattctgggaagaaggctgcgatgtctgtacctgcacagacatggaggacgcggtcatgggtctacgcgtcgcgcaatgtagccaaaagccttgcgaggatagctgccggtccggatttacctacgtgctccacgagggcgagtgctgcggccggtgcttaccttctgcctgcgaggtcgtgaccgggtcgccgcgcggtgattcgcagtcctcgtggaagtctgttggttcccagtgggccagtcccgagaacccttgcttgatcaacgagtgtgttcgtgtgaaggaggaagtctttatccagcagcgcaatgtgtcttgccctcaactcgaggtgcccgtgtgccctagcggcttccagctgtcctgtaagacgagtgcctgttgtccttcctgccgttgcgagcgtatggaggcttgtatgctgaacggtaccgttatcggtccaggtaagacagtcatgattgatgtttgcaccacctgtcgttgcatggttcaagtgggcgttatctccggattcaagcttgagtgtcgcaaaactacctgcaatccgtgccccttgggttataaggaggagaataacaccggagaatgctgcggacgttgtctgccaacggcctgtacgattcagttgcgcggtggtcaaattatgacattgaagcgggacgagactctgcaggatggttgtgacacccacttctgcaaggtcaacgagagaggagagtatttttgggagaagcgcgttaccggttgtcctccattcgatgagcacaagtgcctcgcggaaggcggcaagattatgaagatccctggcacctgttgtgacacctgtgaagagcccgagtgtaacgatatcaccgcccggttgcagtacgttaaagtcggcagctgcaaatctgaggtcgaagtcgacatccactactgtcagggaaagtgcgcttccaaggcgatgtacagcatcgatatcaatgatgttcaggatcaatgttcgtgttgcagccctacccggacggagcccatgcaggttgctctccactgcacgaacggaagcgtagtctaccatgaggttctcaacgctatggagtgcaagtgcagcccgcgcaagtgcagcaag

SEQ ID NO: 21424 - protein, 4 aa, Homo sapiens
  MOD_RES (2)..(3): Any amino acid
RXXR

SEQ ID NO: 21425 - protein, 4 aa, Homo sapiens
  MOD_RES (2)..(2): Any amino acid
  MOD_RES (3)..(3): Lys or Arg
RXXR

SEQ ID NO: 21426 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 21427 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 21428 - protein, 6 aa, Homo sapiens
LVPRGS

SEQ ID NO: 21429 - protein, 4 aa, Homo sapiens
LVPR

SEQ ID NO: 21430 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 21431 - protein, 4 aa, Homo sapiens
IEGR

SEQ ID NO: 21432 - protein, 4 aa, Homo sapiens
IDGR

SEQ ID NO: 21433 - protein, 4 aa, Homo sapiens
AEGR

SEQ ID NO: 21434 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 21435 - DNA, 615 bp, Artificial Sequence
  Description of Artificial Sequence: Synthetic transcript sequence
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 21436 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 21437 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 21438 - RNA, 758 nt, Artificial Sequence; identical to SEQ ID NO: 1628
  Description of Artificial Sequence: Synthetic transcript sequence

SEQ ID NO: 21439 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 21440 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 21441 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 21442 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 21443 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 21444 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 21445 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 21446 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 21447 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 21448 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 21449 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 21450 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 21451 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 21452 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag

SEQ ID NO: 21453 - RNA, 947 nt, Artificial Sequence; identical to SEQ ID NO: 1616
  Description of Artificial Sequence: Synthetic transcript sequence

SEQ ID NO: 21454 - RNA, 947 nt, Artificial Sequence; identical to SEQ ID NO: 1615
  Description of Artificial Sequence: Synthetic transcript sequence

SEQ ID NO: 21455 - RNA, 947 nt, Artificial Sequence; identical to SEQ ID NO: 1614
  Description of Artificial Sequence: Synthetic transcript sequence

SEQ ID NO: 21456 - RNA, 2745 nt, Artificial Sequence
  Description of Artificial Sequence: Synthetic transcript sequence
gggaaauaagagagaaaagaagaguaagaagaaauauaagagccaccauguuuucgaugagaauugugugucucgucuugucagucguaggaaccgcguggaccgccgacagcggggaaggugauuucuuggcugagggugguggaguccgcggucccagagugguagaaaggcaucaauccgcauguaaagacagcgauuggccguucugcucggaugaggacuggaacuauaagugcccuuccgggugucggaugaaggggcucaucgacgaggucaaucaggauuucacuaaccgcaucaauaagcucaaaaacucgcuguucgaguaccagaagaacaacaaggauagccacucgcugacuacaaauaucauggaaaucuugcggggagacuucucaagcgcgaauaaucgcgauaauacguacaaccgaguaucagaggacuugaggucgaggauugaaguccuuaagcggaaggucauugagaaaguccaacacauccaguugcugcagaagaacguacgggcgcaguugguggauaugaagaggcuggaaguggacaucgacaucaagauccgauccugucggggaucaugcucacgagccuuggcgagggagguagacuugaaggacuaugaggaccagcagaagcaguuggaacaggugauugccaaggacuugcuuccgucacgggaucggcagcaccucccuuugaucaagaugaaacccgugccggaccucgugcccggaaacuucaagucccagcuucagaagguaccaccggaguggaaagcgcuuacagacaugccgcagaugcggauggaguuggagaggccgggaggaaacgaaauuacgagaggcggcucaacaucguacgggacagguucggaaacagaaucgcccagaaauccaucgucagcaggaucauggaacagcgguagcuccggaccggguucgacgggaaauagaaacccgggaucaucagguaccggugggacugcgacuuggaagcccgguucgucgggaccgggaucgacuggaucguggaauagcggcuccuccgguacuggaucgaccggaaaucagaauccugguucgccucggccuggcuccaccggaacauggaacccgggcagcagcgaaaggggaucggcuggacacuggacgucagagucguccgugucagggucgacggggcaguggcacuccgaaucgggaucguuccggccugauucaccuggcuccggaaacgcaagacccaauaacccggauugggguacguuugaagaggucagcggaaacguaucaccggggacacggagggaguaucauacugagaaauuggugacaucgaagggagauaaagagcucagaacggggaaggagaaggugacgagcggaucaacgacgacuacuaggagguccugcucgaaaacuguaaccaagaccgugauugggcccgacggccauaaagaggucacuaaagaagucgugaccuccgaggauggguccgacugccccgaagccauggaccucgggacgcuuuccggaauugggacguuggacggguuuagacacaggcaccccgacgaagcagcguuuuucgauacggccagcaccggcaaaacguuccccggguucuucucgcccaugcucggagaguuugucucagaaacggagucgcgcgguucggagagcgguaucuuuacaaauacgaaagagucgucgucgcaccaucccggaauugcagaauuucccagcaggggcaaaagcagcucauacuccaaacaguucacaucguccaccucguacaauagaggugacagcacauucgaaagcaagagcuacaaaauggccgacgaggcggguagcgaggcugaucaugaagguacacauucaacaaaacgcggacacgcuaagucgcgaccggugcgggauugcgacgauguccuccagacccaccccucggggacacaaucggguauuuucaauaucaaacuucccggguccucgaagaucuuuucgguauauugugaucaagaaacguccuugggaggguggcuccuuauccaacaacgcauggacgggucacugaacuuuaaucgaacguggcaggauuacaaacggggauucgggucguugaaugacgagggagaaggggaguuuuggcucggaaacgacuaccuccaucugcucacacagagagguagcguguugaggguggaacuugaagauugggcgggaaaugaggcguaugcggaguaucacuuucgcgucgggucagaagcagagggauacgcacuucaggugucgucguaugaaggaacggcuggggacgcccugauugaggggagcguagaggaaggggcagaguauacgucgcacaacaacaugcaauuuuccacauucgacagagaugccgaucagugggaggaaaacugugcggagguguacggcgguggguggugguauaacaauugccaggcggccaacuugaaugggaucuacuaucccggaggcucguacgauccacgcaauaacucgccauaugaaauugaaaauggaguggucugggugucguuccgaggagcagauuacucguugagagcggucaggaugaagaucagacccuugguaacccaaugauaagcugccuucugcggggcuugccuucuggccaugcccuucuucucucccuugcaccuguaccucuuggucuuugaauaaagccugaguaggaagg

SEQ ID NO: 21457 - RNA, 2576 nt, Artificial Sequence
  Description of Artificial Sequence: Synthetic transcript sequence
gggaaauaagagagaaaagaagaguaagaagaaauauaagagccaccauggaacacaaagaggucguccucuugcugcuccuguuucucaaaucgggccagggagagcccuuggacgauuacgugaacacacagggcgcgagccuguucucgguaacgaaaaagcaguugggagcuggcucaauugaagaaugugcggcgaaaugcgaagaagaugaagaguucacgugucgggcauuucaguaucacucgaaagagcaacagugcgugaucauggcagagaaccgaaaaucgucgaucaucaucagaaugcgggacgucgugcuguucgaaaagaaaguguaccugucagaguguaagacggguaaugggaaaaacuauaggggcacaaugucaaagacuaagaaugggauuacaugucagaaauggucguccacguccccucacagaccaagauucucgccugcuacgcauccguccgagggcuuggaggagaacuauugucgcaacccagauaacgauccccaagggccuuggugcuacaccacagaccccgagaagcgguaugauuacugcgauauucuugaaugcgaggaggaguguaugcacugcuccggagagaacuacgauggaaagaucuccaagacaauguccggacuggaaugucaggccugggacucacagucgccccaugcacacgguuacauuccuagcaaauucccgaauaagaaccuuaagaagaauuacugccggaacccggaccgagagcuucgcccuugguguuucacaaccgaccccaacaagagaugggagcugugugacauuccgagauguacaacaccaccgccgucaucggguccaaccuaucaaugucugaagggaacgggugagaacuaucggggaaacgucgcggucacagugagcgggcacacgugccagcacuggucggcgcagacaccccacacacauaaucggacgccagaaaacuucccuuguaagaaucuggaugagaacuacugcagaaacccagacgguaaaagagccccguggugccauacuacgaacagccaagugcgaugggaauauuguaagaucccgucgugcgacucaucgccaguaagcacugaacaacuugcaccgacggcuccucccgaguugacgccuguggugcaagauuguuaccauggcgaugggcagucauacaggggaacuagcagcaccaccacgacgggcaaaaagugucagucgugguccuccaugacaccacaccggcaccaaaagacuccggagaauuacccaaaugcgggucugaccaugaauuacuguaggaacccugacgcggacaaagguccauggugcuuuaccaccgaucccuccguacgcugggaauacuguaacuugaagaaaugcucggggacagaagccuccgugguagccccuccgccagucgugcugcuucccgacguggagacaccguccgaagaggacuguauguuugguaacggaaagggauauagagggaaaagggcgacgacggugacugggacgcccugucaggacugggcagcgcaagagccgcaccgccacagcaucuuuacucccgaaaccaauccaagggccggacuugaaaagaacuauugccggaauccggauggggacgucggagguccgugguguuauacuacaaacccuagaaaacucuacgauuauugcgauguaccgcaaugugccgcucccuccuucgacugcggaaagccucaagucgagccuaagaagugucccgggagaguggugggcgggugcguagcccacccgcauucguggcccuggcagguaucguugagaacgagauuugggaugcacuuuuguggcgguacgcuuaucuccccugagugggucuugacagcugcgcauugcuuggagaaguccccucggccguccucauacaaggucaucuugggagcccaucaggaggugaaucuggagccccauguccaagaaauugagguaucgagguuguuucucgaaccgacacgcaaggacaucgcacugcugaaacuuagcuccccugccgucaucacagacaaagucaucccagcgugccuccccagccccaauuacguaguggcggauagaaccgagugcuucaucacgggauggggcgagacacaggggacguucggagcuggccuccuuaaagaggcccagcuucccguaaucgaaaacaaaguaugcaaccgcuaugaguuucucaauggacgcgugcagagcacagagcuuugcgccggacaccucgcgggagggaccgauagcugccagggugacagcggagggccguugguguguuucgaaaaagacaaguauaucuugcaaggugugaccagcuggggacuugggugcgcgaggcccaauaagccgggagucuaugugagagucucacgcuucgucacauggauugagggagugaugaggaacaacugauaagcugccuucugcggggcuugccuucuggccaugcccuucuucucucccuugcaccuguaccucuuggucuuugaauaaagccugaguaggaag

SEQ ID NO: 21458 - RNA, 1283 nt, Artificial Sequence
  Description of Artificial Sequence: Synthetic transcript sequence
gggaaauaagagagaaaagaagaguaagaagaaauauaagagccaccaugucgcggucggguaccgauccccagcagaggcagcaggccuccgaagcagaugcggcugccgcgacguucagggccaacgaccaccaacacauucgguacaacccauugcaagacgagugggucuuggugucggcccaccgcaugaaacggcccuggcagggucagguggagccgcaacugcuuaagacggugccccgacaugauccguugaacccacucuguccaggggcgaucagagcuaauggagaagugaauccgcaguaugacagcacauuuuuguuugacaaugauuuucccgcguugcagcccgaugcaccuagccccggaccuucggaucauccgcuguuucaggcaaagagcgcucggggcgugugcaaggucaugugcuuccacccguggucggacgucacauugccucuuaugucggucccugagauuagggccgugguggaugcaugggccuccgucacggaggagcucggagcgcaauaucccugggugcagauuuucgagaacaaaggggccaugaugggguguucaaauccacacccucauugccaggucugggcguccucauuccugcccgacaucgcacagagagaggagaggagccagcaggcguacaaaucacagcacggggagccucugcuuauggaauacucacggcaggaacuccuucgcaaggagagacucguacugacaucagaacauuggcuuguacugguacccuucugggcaacguggcccuaccagacucucuugcuuccccgacgccacguccgaagguugccggaguugacuccggcggagcgcgacgacuuggccucgaucaugaaaaagcuccuuacgaaauaugauaaucucuuugagacuuccuucccguacuccauggguuggcauggagcgcccaccggaucggaagcaggggcgaacuggaaccauuggcagcuccacgcgcacuauuauccgccgcuucuccggucggcuacagucagaaaguucauggugggcuacgaaaugcuggcccaggcgcaaagggaccucacacccgaacaagcagcugaacgacugagagcgcugccugagguacacuaccaucucggacaaaaggaucgcgaaaccgccacgaucgcaugauaagcugccuucugcggggcuugccuucuggccaugcccuucuucucucccuugcaccuguaccucuuggucuuugaauaaagccugaguaggaag

SEQ ID NO: 21459 - RNA, 1538 nt, Artificial Sequence
  Description of Artificial Sequence: Synthetic transcript sequence
gggaaauaagagagaaaagaagaguaagaagaaauauaagagccaccauggcgucggagagcgguaaacuuugggguggacgauucgucggggcaguagaccccaucauggagaaguuuaacgcgucgauugccuaugacagacaucucugggaaguagacgugcaaggauccaaagccuauucacgcgggcuggaaaaggccggacuguugacgaaggcagagauggaccagauccuucauggguuggauaaagucgcugaagagugggcccagggaaccuucaagcucaauucgaaugacgaagauauccacaccgccaacgagcgcagacuuaaagaacugauuggagcgacagccgguaaacugcacaccggaaggucacggaacgaccagguggucacugaucuuaggcuguggaugaggcagacgugcagcacgcugucgggguugcuuugggaguugauccggacgauggucgaucgagcugaggcagagagagauguacuuuuccccggguauacacauuugcaacgcgcccagcccauccgguggucccacuggaucuugucccacgcgguggcucugacacgcgauagcgaacggcuccuugaaguccgcaagagaaucaauguccucccuuugggauccggugcgauugccggaaauccacugggaguggaccgggaacucuugagggcagagcucaacuuuggcgcaauuaccuugaacucaauggacgcaaccucggagagggacuucguagcggaguuucucuuuugggcgucccuuugcaugacucauuugucacgcauggcggaggaucugaucuuguacuguacaaaagaguuuuccuucguccagcucucagacgcguacucgacgggaucgagccugaugccgcagaagaaaaacccagacucauuggagcucauccggucgaaggccgggaggguguucgggagaugcgcagggcuccuuaugacgcuuaagggacuuccgucaacuuacaauaaggaucuccaagaagauaaagaagccguguuugaagucagcgacacuaugagcgcaguguugcaaguagccacgggcgugaucucgacgcugcagauccaucaggagaauaugggacaggcgcuguccccggauaugcucgcgacagauuuggcuuauuaccucguccggaaggggaugcccuucagacaggcgcacgaggcgucgggaaaggcgguauucauggccgaaacaaaaggcguggcguugaaccagcugucgcugcaagaauugcagacgaucucgccucucuuuuccggugaugugauuuguguaugggacuaugggcacucgguggagcaguacggggcauugggcgguacagcgaggucaucaguggacuggcagauuagacaggugcgcgcucuccuucaagcgcaacaggccugauaagcugccuucugcggggcuugccuucuggccaugcccuucuucucucccuugcaccuguaccucuuggucuuugaauaaagccugaguaggaag

SEQ ID NO: 21460 - RNA, 1508 nt, Artificial Sequence
  Description of Artificial Sequence: Synthetic transcript sequence
gggaaauaagagagaaaagaagaguaagaagaaauauaagagccaccauggaccccuacaugauucagauguccagcaagggaaaccuucccucgauccucgauguccacgugaaugucggaggacgcucauccguacccgggaagaugaagggccggaaggcccgcuggagcgucagaccuuccgacauggccaaaaagacguuuaauccgaucagggcgauuguggacaauaugaaggucaaaccgaacccaaacaaaacgaugauuagccuguccaucggggacccgacaguguuugggaaucuccccacugauccagaagugacacaggcgaugaaggaugcguuggauuccggaaaguacaacgguuaugcgccgagcauuggguuccugucaagccgggaggagauugcaagcuauuaucacugccccgaagcgccgcuggaggccaaagacgugauuuugacgucggguugcagccaagcgauugaccucugccuugcgguacuggccaauccuggucagaacaucuuggugcccagaccggguuuuucgcucuacaaaacacuggccgaaucgauggguaucgaggucaaacucuacaaccuguugcccgagaagucaugggaaauugaucugaaacagcuugaauaucuuaucgaugaaaagacagccugucuuauuguaaacaauccgucgaauccuugugggucgguauucucgaaaaggcaccuccaaaagauccuugcggucgcagcgaggcaaugcgugccuauccuggcggaugagaucuacggagacaugguauucuccgacugcaaauaugagccgcuggcuacguugucgacggaugugccaauccucucgugugguggauuggcgaagcgguggcucgugccgggguggcgacucggauggauucuuauccacgaccgcagagauaucuuuggaaacgagauccgagauggccuggucaaacugucgcagaggaucuuggggccuuguacgauuguacagggugcauugaaguccaucuugugccgcacucccggagaguucuaucauaauacccucucauucuugaaaucaaacgcggaucucugcuauggcgcacuugcugcgauccccggauugaggcccgucagaccgagcggagcgauguacuugaugguagggaucgaaauggaacauuuucccgaauuugagaaugacgucgaguucaccgagcggcuuguggccgaacagucagugcauugucugccggccaccuguuucgaauaccccaacuucauccggguggucaucacugugccugaggucaugauguuggaggcaugcucgcgcauccaagaguuuugcgagcagcauuaccacugcgcugagggaagccaggaagagugugacaagugauaagcugccuucugcggggcuugccuucuggccaugcccuucuucucucccuugcaccuguaccucuuggucuuugaauaaagccugaguaggaag

SEQ ID NO: 21461 - RNA, 2252 nt, Artificial Sequence
  Description of Artificial Sequence: Synthetic transcript sequence
gggaaauaagagagaaaagaagaguaagaagaaauauaagagccaccauggcugcgcccaugacucccgcagcaagaccggaggacuacgaggcagcauugaaugccgcccucgcagacgugcccgagcuugcaagguugcuggaaauugaucccuaucucaagcccuacgccgucgauuuucagcgccgguacaagcaguucucccaaauucucaagaacauuggcgagaacgaaggagguaucgacaaguuuucacgggguuaugagucguucgggguccaccggugcgccgacggagggcuguauuguaaggagugggcgccuggggcggaagggguguuucuuacgggagauuucaauggauggaaucccuucucauacccguacaagaaauuggacuacggaaagugggaguuguauauuccaccgaagcagaacaaaucagugcuugugccucauggauccaaacuuaaagucgugauuacaucgaaaagcggggagauccucuaccgcaucucaccgugggcgaaauauguagucagggaaggggauaacgucaacuacgauuggauccacugggaccccgagcauucauacgaauucaaacacucaaggccgaagaagccccgaucgcuccggaucuacgaaagccacgugggaauuuccucacaugaaggaaagguggccucguacaaacacuuuacgugcaauguccuuccucgaaucaaaggucugggauacaauugcauccagcuuauggcgauuauggagcaugccuauuaugcguccuuuggcuaccagaucaccucguucuucgcggcgagcucacgauauggaacuccagaggaguugcaagaauugguagacaccgcccacucaauggguaucauuguccuucuugacguggugcacagccaugccagcaagaacucggcggauggccucaacauguucgacgggacagacucaugcuacuuccacagcgggccuagggguacucaugaucucugggacucgcgccuuuuugcguacucgagcugggaaauccuccgcuuucugcugucgaauaucaggugguggcuggaggaguaucgguucgaugguuuccgcuuugauggagucacgagcaugcuuuaccaucaucacggggugggccagggauucucgggcgacuauucggaauacuucgggcuucaaguagacgaggaugcguugaccuaccucaugcucgccaaucacuugguccacacguuguguccugauucgaucacaaucgccgaggacgugucggggaugccagcgcucuguuccccgaucucgcaagguggaggcggguucgauuaucgccuggcgauggcaauucccgacaaguggauucaacuucucaaagaguuuaaggaugaggauuggaauaugggagacauuguguacacgcugacgaaucgccgguaucuugagaaaugcaucgcguaugcugagucgcacgaccaggcguuggucggggauaagucccucgcauuuuggcucauggacgcagaaauguauacaaauaugucgguauugacucccuucacacccgugaucgaucgagggauucagcuccacaaaaugaucagauugauuacgcacgguuugggcggagagggguauuugaacuucaugggaaacgaauuuggucauccagaguggcucgacuucccgcgcaaaggaaauaacgaguccuaccacuacgcaaggaggcaguuucaucuuacggaugaugaccuucugagauauaaguuucuuaacaacuuugacagggacaugaaccgccucgaagagagauacgguugguuggcugcuccucaagcauacguauccgaaaagcacgaagggaauaagaucaucgcauucgaacgggcaggacuccuguuuaucuucaacuuucacccgucgaaaucauauacggacuaucgagucggaacagcgcugccgggcaaauucaagauuguacuggauucagaugcggcugaguacggaggccaucagagacuugaccacuccaccgacuucuucucggaagcguucgagcacaacggaaggccguacucacuucuggucuauauccccucgcggguagcacucaucuugcaaaauguagaucucccgaauugauaagcugccuucugcggggcuugccuucuggccaugcccuucuucucucccuugcaccuguaccucuuggucuuugaauaaagccugaguaggaag

SEQ ID NO: 21462 - RNA, 2012 nt, Artificial Sequence
  Description of Artificial Sequence: Synthetic transcript sequence
gggaaauaagagagaaaagaagaguaagaagaaauauaagagccaccauggcgcauguacgcgggcuucaacugccuggcugccuggcgcuugcggcauuguguucgcugguccauucgcagcacguauuccucgccccucagcaagcacgcucccuucuucaaagaguacggcgagcaaacacauucuuggaggaggucaggaaaggcaauuuggaacgggaaugugucgaggagacuugcucauaugaagaggcuuuugaagcgcuggagucgagcacagccacagauguguuuugggccaaguacaccgcaugcgaaacagcgcggacgccgagggacaaauuggcggccugccucgaagggaacugugccgagggguugggaacaaacuauagaggacaugugaauaucacgcgcagcgggaucgagugucaguuguggcgcucgcgguacccgcacaaaccggagauuaacucgaccacccaccccggagcggaucuccaagagaacuuuugucgcaaucccgacuccuccacgacagguccaugguguuacacgaccgacccuacuguaaggcggcaggaaugcucaauccccgugugcgggcaggaucagguaacagucgcgaugacuccaagauccgaaggguccucagugaaccuuagcccaccucuggagcagugcgucccggaccgaggacagcaguaccagggaagauuggcugugacaacgcacggacugccgugucucgcaugggcaucggcgcaggcgaaagcccuuuccaagcaucaggauuucaauuccgcgguccaguugguagaaaacuucugucggaaccccgauggugaugaggaggguguguggugcuauguggcggggaaacccggcgauuuuggauacugcgaccucaauuacugcgaggaagcgguggaagaggaaacgggugacggacuggaugaggacucagacagggcgaucgaagggaggacggcaaccucagaauaucagacguuuuucaacccgcggacguucgguucgggagaggccgacuguggacugcggccucucuucgaaaagaaaagccuugaagauaagaccgaaagggaauugcucgaauccuacauugaugggagaaucguggaggggucggacgcagagaucggaaugucgccguggcaagucaugcucuuucgcaagucgccccaagagcuccucugcggugcgucccucauuucagauagguggguccucacugcugcgcacugccugcucuauccgccgugggauaagaauuucacugaaaacgacuugcuugucagaauuggaaagcacucaaggacgcgguacgaacggaauauugagaaaaucagcauguuggagaagaucuacauccaccccagauacaacuggcgagagaauuuggacagggauaucgcgcucaugaagcucaagaaacccguagcauuuuccgacuauauccauccugucuguuugccggacagagagacugcagcgucauugcuucaggcgggguauaagggaagagucacgggguggggaaaucuuaaggagacauggacagccaauguagggaaaggacagcccucgguauugcaaguggugaaucuccccaucguggaacggccagugugcaaggauagcacacgcauccgcauuacggacaacauguuuugugccggguauaaaccggaugaaggaaaaaggggagaugcaugcgaaggagacagcggagggccguucgugaugaaaagccccuucaacaauaggugguaccagauggguaucgugucguggggugagggaugugacagagaugggaaguacgguuucuauacgcacguguuucggcugaagaaguggauucagaaggugauugaccaguucggagagugauaagcugccuucugcggggcuugccuucuggccaugcccuucuucucucccuugcaccuguaccucuuggucuuugaauaaagccugaguaggaag

SEQ ID NO: 21463 - RNA, 2726 nt, Artificial Sequence
  Description of Artificial Sequence: Synthetic transcript sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaucucaaaauuggguaugagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaagcugccuucugcggggcuugccuucuggccaugcccuucuucucucccuugcaccuguaccucuuggucuuugaauaaagccugaguaggaag

SEQ ID NO: 21464 - RNA, 1805 nt, Artificial Sequence
  Description of Artificial Sequence: Synthetic transcript sequence
gggaaauaagagagaaaagaagaguaagaagaaauauaagagccaccauggcggucgagucgcaagguggacggccucuugugcuugguuugcuccuuuguguacucggcccugucgugucacacgccgggaagauuuuguugauccccguggacggaucacauuggcuuucgaugcucggagccauccagcaguugcagcaaagggggcaugagauugugguccuggcuccggacgcgucgcucuacauucgcgauggugcauucuauacucuuaagacauauccagugcccuuccagcgcgaagaugucaaagagucauuugucucacugggacacaacguauucgagaacgacuccuucuugcagagagucaucaagacguacaagaaaaucaaaaaggauagcgccaugcuguugucagggugcucgcacuugcuucacaacaaggagcugauggcgucacuggcggagucgagcuuugaugucauguugacggacccguuuuugccguguagcccgaucguggcgcaauacuugucccuucccaccguauucuuccuccacgcgcuucccuguagccuggaguuugaggcgacccagugucccaaucccuuuucauacgugccucgaccguugucaucacauucggaccacaugacguuccuccagcgggugaagaauaugcucaucgccuuuucccaaaacuuccucugcgacgucgucuacuccccuuacgccacgcuggcauccgaguuucugcagcgagaggugacugugcaagaccuucucucgucggcaucaguaugguuguuccgaucagauuucguaaaggacuacccaagacccaucaugcccaacaugguguucguagggggaaucaauugccuccaccagaauccgcugagccaggaguuugaagcguauaucaacgcgucgggggaacacggaauugucguguuuagccuggggucgaugguaucggagauucccgaaaagaaggcgauggcaaucgcagacgcacucggaaagaucccccagacaguccuuuggcgguauacagggacgaggccgagcaauuuggcaaacaauacgauccuugugaaaugguugccgcagaaugaucuucucggucaucccaugacaagagccuucaucacgcacgccgguucgcaugggguauaugaaucgauuugcaauggcgugccuauggugaugaugccgcucuuuggugaccagauggacaaugcgaaaaggauggaaaccaagggagcaggagucacccugaaugugcuggaaaugacauccgaggaucucgaaaacgcgcuuaaagcggucauuaacgacaaaucguauaaggaaaacaucaugagguugagcucccuucacaaagauagaccugucgagccauuggaccuggccguguuuugggucgaguucgugaugcggcacaagggagcgccacacuugaggccagcugcgcaugaucugacgugguaucaguaccacucccucgaugugauuggcuuccugcuggcagucguguugacuguggcguuuaucacauucaaauguugcgcuuacggcuaccggaagugcuugggaaagaaaggacgcgugaaaaaggcccauaagucgaaaacacauugauaagcugccuucugcggggcuugccuucuggccaugcccuucuucucucccuugcaccuguaccucucaaacaccauugucacaaacaccauugucacaaacaccauugucacaaacaccauugucauggucuuugaauaaagccugaguaggaag

SEQ ID NO: 21465 - RNA, 476 nt, Artificial Sequence
  Description of Artificial Sequence: Synthetic transcript sequence
gggaaauaagagagaaaagaagaguaagaagaaauauaagagccaccauggcgcucuggaugcgauugcuuccucuccuggcuuugcuugcacugugggguccagacccggcagccgcguucgugaaucagcauuugugcggaagccaccuugucgaagcguuguaucuggucugcggggagaggggguucuuuuacacacccaagacccgcagagaggccgaggauuugcaaguaggccagguggaacucggugggggacccggagccggaucgcuccaaccgcucgcgcuggaagggucacugcagaaacggggaaucguggagcaguguuguacguccauuugcucgcuuuaccagcuugagaacuauuguggcugauaagcugccuucugcggggcuugccuucuggccaugcccuucuucucucccuugcaccuguaccucuuggucuuugaauaaagccugaguaggaag

SEQ ID NO: 21466 - RNA, 1031 nt, Artificial Sequence
  Description of Artificial Sequence: Synthetic transcript sequence
gggaaauaagagagaaaagaagaguaagaagaaauauaagagccaccauggaaacacccgcguggcccaggguaccuaggccggagacagcaguagcgagaacgcuucuccucggauggguauucgcccaaguggcgggagcguccggcacuaccaacacugucgcggcauauaacuugacguggaaaucaacaaacuucaaaacuauccuugagugggagccgaagcccgucaaucaagucuauacaguccaaaucuccacgaagucaggcgauuggaagagcaagugcuucuacaccacagauacagagugcgaccugacugacgaaaucgucaaggauguaaagcagacguauuuggcuagaguauucucguacccagcgggaaacgucgagagcaccgguucagccggagaaccgcuguacgaaaauucgccggaguuuacucccuaucuugagacaaauuuggggcagcccaccauccagucguuugaacagguggguacgaaggugaacgucaccguggaagaugagaggacauugguccgccggaacaauacuuuucuuucccucagagauguauuugggaaagaccuuaucuacacauuguacuauuggaagucgucgucguccgguaaaaagacggcuaaaacgaacacgaacgaguuccucaucgacguggacaaaggcgagaauuacugcuuuucaguccaggccgugauccccucgcgaacggugaaucggaaauccacggacucgccaguggaguguaugggacaggagaaaggagaauuucgggaaaucuucuacauuauuggggccgucguauucguggugaucauucuggugauuauucucgcgauuagccugcacaagugucgcaaagcagggguggggcagucauggaaggaaaauagcccucugaacgugucgugauaagcugccuucugcggggcuugccuucuggccaugcccuucuucucucccuugcaccuguaccucuuggucuuugaauaaagccugaguaggaag

SEQ ID NO: 21467 - RNA, 470 nt, Artificial Sequence
  Description of Artificial Sequence: Synthetic transcript sequence
gggaaauaagagagaaaagaagaguaagaagaaauauaagagccaccauggcccuuuggaugagauugcuuccucuucucgcgcuccucgcgcugugggguccagaccccgcagcugccuuugugaaucagcaucugugcggaagccacuuggucgaagcccuguacuugguaugcggggagcggggguucuucuacaccgacaaaacagaagcggaagauuugcaagucggacagguggaguugggugggggucccggagcaggcucgcuucaaccgcuggcgcucgagggaucacuucagaagagggggaucguggagcaguguugcacguccauuuguucgcuguaucagcucgagaacuauuguaacugauaagcugccuucugcggggcuugccuucuggccaugcccuucuucucucccuugcaccuguaccucuuggucuuugaauaaagccugaguaggaag

SEQ ID NO: 21468 - RNA, 470 nt, Artificial Sequence
  Description of Artificial Sequence: Synthetic transcript sequence
gggaaauaagagagaaaagaagaguaagaagaaauauaagagccaccauggcccucuggaugagacuguugccgcuccuggcacuucuugcgcucugggggccugaccccgcagcggccuucgugaaucagcauuuguguggaucgcaccugguagaagcgcuuuacuuggucugcggugagcggggguuuuucuauaccaagccgacagaggccgaagauuugcaagugggccaggucgagcucggugggggucccggagcuggaucgcuccagccacuggcgcuugagggaucacugcagaaaagggggauuguggagcaguguugcacgagcaucugcucccuuuaucaauuggaaaacuacuguaacugauaagcugccuucugcggggcuugccuucuggccaugcccuucuucucucccuugcaccuguaccucuuggucuuugaauaaagccugaguaggaag

SEQ ID NO: 21469 - RNA, 470 nt, Artificial Sequence
  Description of Artificial Sequence: Synthetic transcript sequence
gggaaauaagagagaaaagaagaguaagaagaaauauaagagccaccauggcgcuguggaugcggcuucucccucuucucgcguuguuggcacuuuggggacccgacccagcugccgccuuugucaaacagcaccucugugggucgcaucugguagaggcccuguauuuggugugcggggaaagggguuucuucuacacaccggaaaccgaggcggaagauuugcaagucggacagguggagcuugguggcggaccgggagcggggagccugcagccccuugcauuggaagggucgcugcagaagcgcggaauuguggagcagugcuguacgucaaucugcucccucuaccaacucgagaacuauuguaauugauaagcugccuucugcggggcuugccuucuggccaugcccuucuucucucccuugcaccuguaccucuuggucuuugaauaaagccugaguaggaag

SEQ ID NO: 21470 - RNA, 1322 nt, Artificial Sequence
  Description of Artificial Sequence: Synthetic transcript sequence
gggaaauaagagagaaaagaagaguaagaagaaauauaagagccaccauggcggccuugcgacagccgcaagucgcggaacugcuggcugaagcccggagagcguuccgcgaggaguucggagccgaacccgagcucgcgguaucagcaccaggacgggugaaccuuauuggggaacauacugauuacaaccaggggcucguauugcccauggcccuggaacuuaugaccguacuugucgggucaccccgcaaggacggcuuggugagcuugcuuacgacauccgagggugcugaugaaccgcagcgacuucaguucccucucccuacggcgcaacggucauuggagccagggacgcccagaugggccaauuaugugaaaggagugauucaguauuaucccgcagcgccgcucccuggauuuucagcaguaguggugucgagcguaccucuugguggaggacugucgucguccgcaucccucgaggucgcaaccuacacguuuuugcagcagcucuguccggacucggggaccaucgcggcgagagcccaagugugccaacaggcggagcacagcuuugccggcaugccauguggaaucauggaccaguucaucucgcugaugggucagaaaggacaugcucuccugaucgauugccgcucgcuggaaacaucgcuggugcccuuguccgacccgaagcuggcugugcugaucacgaauuccaacguccgccauagcuuggccucaagcgaguacccggugaggaggcgacagugcgaggaggucgcccgagcgcuuggaaaagaaucguugagggaggugcagcuugaagagcuugaagcggcgagggaucuugucucaaaggagggguuucgacgcgcgaggcacgucgucggggagauucggagaacagcccaggcggcugccgcacucagacgcggggauuauagggcguuuggacgguugauggucgagucgcacagaagcuugagggacgacuacgaagugucgugcccggagcuggaccagcucguagaagcggcucuugcgguccccgguguguacggguccagaaugacgggcgguggcuucggaggguguacagucacucucuuggaagcgucggccgcaccccacgcgaugcggcauauccaagaacacuacggagguacugcaaccuucuaucuuagccaggcggcagauggugcgaagguauugugucucugauaagcugccuucugcggggcuugccuucuggccaugcccuucuucucucccuugcaccuguaccucuuggucuuugaauaaagccugaguaggaag

SEQ ID NO: 21471 - RNA, 398 nt, Artificial Sequence
  Description of Artificial Sequence: Synthetic transcript sequence
gggaaauaagagagaaaagaagaguaagaagaaauauaagagccaccauggcucuuaguucacaaaucugggcagcgugccucuugcugcuucugcucuuggccagccugaccucgggguccguguucccucagcagacugggcagcucgcggaguugcagccccaagacagggccggagcgcgugcaucuuggaugcccauguuucagcgcagacgacggcgggauacacauuuuccgaucuguauuuucugcugcggaugcugucacagaucgaaaugcgguauguguuguaagacguaaugagcugccuucugcggggcuugccuucuggccaugcccuucuucucucccuugcaccuguaccucuuggucuuugaauaaagccugaguaggaag

SEQ ID NO: 21472 - RNA, 1427 nt, Artificial Sequence
  Description of Artificial Sequence: Synthetic transcript sequence
gggaaauaagagagaaaagaagaguaagaagaaauauaagagccaccaugggagagccugggcagucucccagcccacggagcucccauggaucaccgccaacccucucuacucugacccuucugcuucugcuguguggacaugcucauucccaaugcaagauccuucgcugcaaugccgaauaugucucaucuacucuuucucuucgggguggggguucauccggagcacucaggggcggugggggugguggcagaggugggggagucggauccgguggacuuugccgcgcacuccgcucuuacgcccucugcaccagacggaccgcacggaccugccgcggugaccuggccuuccacucugcuguccacggaaucgaggaucugaugauucagcacaauugcucacgccagggaccgaccgcaccaccgccaccucgcggacccgcucugcccggagcuggaucaggucugccagccccggacccuugugacuacgaaggacgcuucucacggcugcacgguaggccacccggguuucugcauugugccagcuuuggcgacccucacguccggucauuucaccaccauuuccauacuugucgcgugcaaggcgcauggccccuucucgacaacgacuuccuguucgugcaggcuaccucaucaccuauggcccucggcgccaaugccacugccaccagaaagcugaccauuaucuucaaaaacaugcaagagugcauugaccagaagguguaccaggccgaaguggacaaucuccccguggccuucgaggauggguccaucaacggcggugauaggccagggggauccagccuuagcauucagacugccaaccccggaaaucaugucgagauucaggcagcuuauaucggaaccaccauuaucauccgccaaacugccggucagcugagcuucagcaucaagguggcugaagauguggccauggcuuucucagcagagcaagaucuccagcugugcguggguggcugucccccuagccagaggcucucacgguccgagcgcaacagacggggagccauuaccaucgacacugccaggcggcugugcaaagaaggccugccggucgaagaugccuacuuccauucuuguguguucgacgugcuuaucucaggcgacccgaacuucaccguggcugcucaggcugcucucgaggacgcacgcgcuuuucuccccgaccuugaaaagcugcaccuguucccaagcgacgcuggagugccgcuguccucugcaacccugcucgcaccucuccuuuccggacuguuuguccuuuggcuuugcauccaaugauaauaggcugccuucugcggggcuugccuucuggccaugcccuucuucucucccuugcaccuguaccucuuggucuuugaauaaagccugaguaggaag

SEQ ID NO: 21473 - RNA, 1403 nt, Artificial Sequence
  Description of Artificial Sequence: Synthetic transcript sequence
gggaaauaagagagaaaagaagaguaagaagaaauauaagagccaccauguccuuuaucccuguggccgaagauucggacuuccccauucacaaccucccguacgguguauucuccacacgcggugaccccagaccgagaaucgggguagccauuggagaucagaucuuggacuugucgaucaucaaacaucucuucaccggcccaguccucucgaaacaucaggacguguuuaaucagcccacccuuaacuccuucaugggacugggacaggccgcauggaaggaagcgcgggucuuucuucaaaaccuuuugagcgugucacaggcgaggcugagggacgauacugagcugcggaagugugcguuuaucucacaagcguccgcgacaaugcaucuuccagcuacuaucggggacuauacagauuucuacagcucccgccagcacgcgacgaaugucggaaucauguuccgagacaaagagaaugcguugaugccuaacugguugcaccucccggugggcuaucacggucgagccagcucggucguggugucaggaacgccgauuagaaggccuaugggucagaugaaacccgacgacucgaaaccgccgguauauggcgcgugcaaguugcuggauauggagcuugaaauggcguucuucgucggucccgguaaccgguugggugaacccauucccaucagcaaggcccaugaacauaucuucggcauggugcucaugaacgacuggucagcuagagauauucagaagugggaguaugugcccuuggggcccuuucucgggaagucguuugggacgaccgucagccccugggucguaccgauggacgcucuuaugccguuugccguaccaaaucccaaacaggacccuaggccucucccguacuugugucacgaugagcccuacacguucgauaucaaccucucggucaaucucaaaggagagggaaugucgcaggcggcaacgauuugcaagucaaauuucaaguauauguacuggaccaugcuucaacaacucacacaccacagcgugaauggguguaacuugcgcccaggggaccuccucgcauccggaacuauuuccggucccgagccagagaacuuuggaucaaugcuugaacugucguggaaggggacaaagccuauugaccuuggaaauggacaaacgcggaaauuucugcuggauggagaugaggugaucauuacgggguacugccagggagaugguuaccgcaucggguuuggacagugcgcagggaaggugcucccugcgcuucugcccucgugauaagcugccuucugcggggcuugccuucuggccaugcccuucuucucucccuugcaccuguaccucuuggucuuugaauaaagccugaguaggaag

SEQ ID NO: 21474 - protein, 14 aa, Homo sapiens
LLDNWDSVTSTFSK

SEQ ID NO: 21475 - protein, 9 aa, Homo sapiens
WQEEMELYR

SEQ ID NO: 21476 - protein, 7 aa, Homo sapiens
LHELQEK

SEQ ID NO: 21477 - protein, 10 aa, Homo sapiens
VQPYLDDFQK

SEQ ID NO: 21478 - protein, 12 aa, Homo sapiens
ASSVVVSGTPIR

SEQ ID NO: 21479 - protein, 12 aa, Homo sapiens
GEGMSQAATICK

SEQ ID NO: 21480 - protein, 10 aa, Homo sapiens
HLFTGPVLSK

SEQ ID NO: 21481 - protein, 16 aa, Homo sapiens
IGVAIGDQILDLSIIK

SEQ ID NO: 21482 - protein, 9 aa, Homo sapiens
LGEPIPISK

SEQ ID NO: 21483 - protein, 13 aa, Homo sapiens
VFLQNLLSVSQAR

SEQ ID NO: 21484 - protein, 12 aa, Homo sapiens
WEYVPLGPFLGK

SEQ ID NO: 21485 - protein, 17 aa, Homo sapiens
AHEHIFGMVLMNDWSAR

SEQ ID NO: 21486 - protein, 13 aa, Homo sapiens
GTKPIDLGNGQTR

SEQ ID NO: 21487 - protein, 22 aa, Homo sapiens
HQDVFNQPTLNSFMGLGQAAWK

SEQ ID NO: 21488 - protein, 11 aa, Homo sapiens
QHATNVGIMFR

SEQ ID NO: 21489 - protein, 9 aa, Homo sapiens
ASWMPMFQR

SEQ ID NO: 21490 - protein, 16 aa, Homo sapiens
DTHFPICIFCCGCCHR

SEQ ID NO: 21491 - protein, 9 aa, Homo sapiens
MICSTQLDR

SEQ ID NO: 21492 - protein, 13 aa, Homo sapiens
LAHPFSLAVFEDK

SEQ ID NO: 21493 - protein, 13 aa, Homo sapiens
NVVALDTEVASNR

SEQ ID NO: 21494 - protein, 8 aa, Homo sapiens
TCSQDEFR

SEQ ID NO: 21495 - protein, 11 aa, Homo sapiens
FGMHLQAATPK

SEQ ID NO: 21496 - protein, 14 aa, Homo sapiens
KPEEVDDEVFYSPR

SEQ ID NO: 21497 - protein, 7 aa, Homo sapiens
LAEQYAK

SEQ ID NO: 21498 - protein, 12 aa, Homo sapiens
LQAFQGYQVTMK

SEQ ID NO: 21499 - protein, 8 aa, Homo sapiens
SLGMIFEK

SEQ ID NO: 21500 - protein, 14 aa, Homo sapiens
VAASDWTFLHCLPR

SEQ ID NO: 21501 - protein, 10 aa, Homo sapiens
GEYLPLLQGK

SEQ ID NO: 21502 - protein, 23 aa, Homo sapiens
GLTLSWIGDGNNILHSIMMSAAK

SEQ ID NO: 21503 - protein, 31 aa, Homo sapiens
LLLTNDPLEAAHGGNVLITDTWISMGQEEEK

SEQ ID NO: 21504 - protein, 31 aa, Homo sapiens
LSTETGFALLGGHPCGLTTQDIHLGVNESLT

SEQ ID NO: 21505 - protein, 10 aa, Homo sapiens
YMLWLSADLK

SEQ ID NO: 21506 - protein, 13 aa, Homo sapiens
CNAEYVSSTLSLR

SEQ ID NO: 21507 - protein, 11 aa, Homo sapiens
GGGVGSGGLCR

SEQ ID NO: 21508 - protein, 22 aa, Homo sapiens
GPALPGAGSGLPAPDPCDYEGR

SEQ ID NO: 21509 - protein, 8 aa, Homo sapiens
AFLPDLEK

SEQ ID NO: 21510 - protein, 20 aa, Homo sapiens
LHGRPPGFLHCASFGDPHVR

SEQ ID NO: 21511 - protein, 9 aa, Homo sapiens
NMQECIDQK

SEQ ID NO: 21512 - protein, 18 aa, Homo sapiens
VAPEEHPVLLTEAPLNPK

SEQ ID NO: 21513 - protein, 11 aa, Homo sapiens
VVDLMAHMASK

SEQ ID NO: 21514 - protein, 15 aa, Homo sapiens
HLEINPDHPIVETLR

SEQ ID NO: 21515 - protein, 9 aa, Homo sapiens
YIDQEELNK

SEQ ID NO: 21516 - protein, 9 aa, Homo sapiens
DQLIYNLLK

SEQ ID NO: 21517 - protein, 14 aa, Homo sapiens
GEMMDLQHGSLFLR

SEQ ID NO: 21518 - protein, 17 aa, Homo sapiens
ALESPERPFLAILGGAK

SEQ ID NO: 21519 - protein, 15 aa, Homo sapiens
LGDVYVNDAFGTAHR

SEQ ID NO: 21520 - protein, 10 aa, Homo sapiens
IIQLLDDYPK

SEQ ID NO: 21521 - RNA, 1295 nt, Artificial Sequence
  Description of Artificial Sequence: Synthetic transcript sequence
gggaaauaagagagaaaagaagaguaagaagaaauauaagagccaccaugggugucuugcuuacucagcggaccuugcugagccuuguguuggcgcuccucuuuccguccauggccucaauggccaugcaugucgcccagccugccgugguccuggcaucaucacgaggaauugcguccuuugugugugaguaugcgucgccgggaaaggcgaccgaaguaagagugacuguacugaggcaggcggauagccaggugacagaggucugugcagcgacuuauaugauggggaacgaguugacguucuuggaugacucgaucugcacggggacaucguccgggaaucaagugaacuugacgauucaagggcuccgcgcuauggacacuggccuguacauuugcaagguggaacuuauguacccgccacccuacuaucuuggaauugguaaugggacacagaucuacgugaucgacccugagcccugccccgacuccgaccaggaaccgaagagcucggacaagacgcacacaucgcccccuucgccugcucccgagcuucucgguggcagcuccgucuuucuguucccgccgaaaccaaaagauacccucaugaucucacggacccccgaaguaacaugugugguagucgaugucucgcacgaggauccagaggugaaguucaauugguauguggacggcgucgaaguccauaacgccaaaaccaaaccccgggaagagcaguacaacucgaccuaucgcguagucuccgucuugacgguacuccaccaggacugguugaacgggaaagaguacaagugcaaagucagcaacaaggcacucccugcgcccaucgagaaaacaaucucgaaagcaaagggacagcccagagagccccaaguguacacgcucccgccgucacgcgacgaauugacgaaaaaucaggugucacuuacguguuuggugaagggauucuacccguccgauaucgccgucgaaugggagucgaauggacagcccgagaacaacuauaagacgacucccccagugcucgacucagaugguucguucuuucuguacucgaagcucacaguagauaagucgagguggcagcagggaaauguguuuucgugcucggucaugcacgaagcguugcauaaucacuauacucaaaaaucacuuagccugucacccggaaagugauaagcugccuucugcggggcuugccuucuggccaugcccuucuucucucccuugcaccuguaccucuuggucuuugaauaaagccugaguaggaag

SEQ ID NO: 21522 - RNA, 1400 nt, Artificial Sequence; identical to SEQ ID NO: 1662
  Description of Artificial Sequence: Synthetic transcript sequence

SEQ ID NO: 21523 - RNA, 2039 nt, Artificial Sequence; identical to SEQ ID NO: 1666
  Description of Artificial Sequence: Synthetic transcript sequence

SEQ ID NO: 21524 - RNA, 800 nt, Artificial Sequence; identical to SEQ ID NO: 1650
  Description of Artificial Sequence: Synthetic transcript sequence

SEQ ID NO: 21525 - RNA, 1325 nt, Artificial Sequence
  Description of Artificial Sequence: Synthetic transcript sequence
gggaaauaagagagaaaagaagaguaagaagaaauauaagagccaccaugacaacauauucagauaaaggggccaagccagaacgggguagauuccuccacuuucacucggucacguucuggguagggaacgccaagcaggcggcgucauucuauugcagcaaaaugggauucgaaccuuuggccuaccgcgguuuggagacugguucgcgcgagguaguaagccacgugaucaagcaggggaagaucguguuuguguugucgucggcacugaacccguggaacaaagaaaugggcgaccaccucgucaagcauggggacggagugaaagacauugccuuugagguggaggauugugacuacaucguccagaaagcgcgagagaggggagcgaaaaucaugagggagcccugggucgagcaggauaaguuuggaaaggugaaauuugcgguccuccagacauacggagacacgacacauacguugguggaaaagaugaauuacaucggucaguuucugccgggguacgaggcaccggccuucauggacccucuccuuccuaaacugcccaaaugcucgcucgaaaugauugaccacauugucggaaaucagcccgaccaggagaugguguccgcgucagagugguaucucaagaacuugcaguuccaccgcuucuggucagucgaugauacucaaguacauacugaauacuccuccuugagaucgaucguagucgcgaauuacgaagaguccaucaagaugcccauuaaugagccagcaccggggaaaaagaagucgcaaauccaagaguacguggacuauaacggaggagccggugugcagcauauugcgcucaaaaccgaagauaucauuacggcuauccgccacuugcgggaacgagggcuggaauuucucagcgucccuuccacguauuacaaacagcuuagagaaaaacuuaagaccgcgaagauuaagguaaaggagaacaucgaugcgcuugaggagcuuaagauccuuguggacuaugaugagaagggcuaucuguugcaaaucuucaccaagcccguccaagauaggccgacccuguuccuugaggugauucagagacacaaccaucagggguuuggagcuggaaacuucaauucgcuguuuaaagcauucgaggaagaacagaaucuccggggaaaucuuacaaacauggaaacgaaugguguaguccccggcaugugauaagcugccuucugcggggcuugccuucuggccaugcccuucuucucucccuugcaccuguaccucuuggucuuugaauaaagccugaguaggaag

SEQ ID NO: 21526 - RNA, 1442 nt, Artificial Sequence
  Description of Artificial Sequence: Synthetic transcript sequence
gggaaauaagagagaaaagaagaguaagaagaaauauaagagccaccaugcaugucagaucgcucagagcagccgcuccccacuccuucguggcacucugggcgccucuguuucucuugcggucggcauuggcagauuucucguuggacaaugagguccauucaucguucauccaccgcaggcugaggagccaggagcgccgagagaugcagcgcgaaauccugucgauccuuggacuuccccaccggccucggccacacuugcaaggaaaacauaacagcgccccuauguucaugcuggaucucuauaacgcgauggccguagaggagggaggaggaccgggagggcagggguuuuccuacccauauaaggccgucuuuucgacacaggguccgcccuuggcgucauugcaagauucccauuuccuuacggacgcggauaugguaaugagcuuugucaaccuggucgaacacgacaaggaguuuuuccauccccgcuaccaccaccgcgaguucagauucgaccugucaaagauuccggaaggggaggcugugacggcagcggaauuucggaucuacaaagacuauauccgggagcgguuugacaaugagacauuccgaauuuccgucuaucagguacuccaagagcaccuugguagggaaucggaccuuuuccugcuugacucgagaacuuugugggcgucggaggaaggguggcugguguuugacaucacggccacuagcaaucacuggguagucaaccccaggcauaaucuuggacugcagcucucaguagagacauuggauggucagucaaucaacccuaagcuugcuggccuuaucggacgacaugggccgcaaaacaagcagccguuuaugguggcguucuucaaagccacggagguacauuuuagaucgauuaggucaaccggcagcaagcagagaucccagaacagauccaagacgccgaaaaaucaggaagcgcuccggauggccaacguggcggagaauucguccucggaucagcgacaggcgugcaaaaagcaugaauuguauguguccuuucgcgaucuugguuggcaggauuggaucaucgcacccgagggguaugcggcguacuacugugaaggcgagugcgcguuccccuugaauucauacaugaacgcgaccaaccacgccauugugcaaacucucguccacuucaucaaucccgaaaccgucccuaaacccuguugugccccuacacagcugaaugccauuucagugcucuacuucgacgacucaagcaaugugauuuugaaaaaguacagaaacaugguggugagggcgugcgggugccacugauaauaggcugccuucugcggggcuugccuucuggccaugcccuucuucucucccuugcaccuguaccucuuggucuuugaauaaagccugaguaggaag

SEQ ID NO: 21527 - RNA, 1469 nt, Artificial Sequence
  Description of Artificial Sequence: Synthetic transcript sequence
gggaaauaagagagaaaagaagaguaagaagaaauauaagagccaccauggggccucccgggucgccguggcagugggucaccuugcugcuuggguugcuguugccuccugcugcgcccuuuugguugcugaaugugcucuuuccaccucacacgacaccaaaggccgagcucucgaaucacaccaggccggugauuuuggugcccgggugccuugggaaccaacuggaagccaaauuggacaagcccgauguggugaacuggauguguuaucgaaagacagaggacuucuucacuauuuggcuugaccucaauauguuucucccgcugggaguggacugcuggaucgauaauacccgcgucguauacaacagauccagcggucuuguaucaaacgcucccggaguccagauuagaguccccgguuuuggaaaaacuuacagcguagaauaccuugauucaucaaaacuugcgggauaucugcauacgcuggugcagaaccucgugaauaacggguacgucagagaugaaacaguccgagccgcaccguacgacuggcgcuuggaaccgggccaacaggaggaguauuaccgcaaacucgccggacuugucgaggagaugcacgcagccuacggaaagccaguguuucugauuggucauucacuggggugucuccacuugcucuauuuucucuugagacagccucaagcguggaaagaccgguucaucgacggcuuuaucucccucggugcgccauggggaggcuccaucaagccuaugcucgucuuggcaucgggcgauaaccagggcaucccgauuaugagcagcaucaaacuuaaggaggagcagaggauuacuacgacaucgcccuggauguucccguccagaauggccuggcccgaagaucauguauucaucagcacgcccucguucaauuacacagggcgagacuuccagagguuuuucgcggaucuccacuucgaggaagggugguacauguggcuucaaucgcgggacuugcuggcgggacucccugcgccugggguggaaguauauuguuuguacggagucggccuucccacgccacggacuuauaucuacgaccacggguuccccuauacggauccgguaggaguacuuuaugaggacggggaugauacaguggcgacgcggagcacggaguugugcggauuguggcagggucggcagccacagccggugcaccuguugccgcugcacggaauucagcaucugaauaugguguuuucgaaccucacccuugaacauaucaacgcaauccugcucggugcguaucgccagggaccgccagcuucacccacagcaucgccggagccgccaccgccugaaugauaauaggcugccuucugcggggcuugccuucuggccaugcccuucuucucucccuugcaccuguaccucuuggucuuugaauaaagccugaguaggaag

SEQ ID NO: 21528 - RNA, 949 nt, Artificial Sequence
  Description of Artificial Sequence: Synthetic transcript sequence
gggaaauaagagagaaaagaagaguaagaagaaauauaagagccaccauggaaaaagucagacgagaggggguuaaggugaugcccaaugcuauugugcaauccguuggagucagcaguggcaaguuacuuaucaagcugaaagacggcaggaagguagaaacugaccacauaguggcagcugugggccuggagcccaauguugaguuggccaagacugguggccuggaaauagacucagauuuugguggcuuccggguaaaugcagagcuacaagcacgcucuaacaucuggguggcaggagaugcugcaugcuucuacgauauaaaguugggaaggaggcggguagagcaccaugaucacgcuguugugaguggaagauuggcuggagaaaauaugacuggagcugcuaagccguacuggcaucagucaauguucuggagugauuugggccccgauguuggcuaugaagcuauuggucuuguggacaguaguuugcccacaguugguguuuuugcaaaagcaacugcacaagacaaccccaaaucugccacagagcagucaggaacugguauccgaucagagagugagacagaguccgaggccucagaaauuacuauuccucccagcaccccggcaguuccacaggcucccguccagggggaggacuacggcaaaggugucaucuucuaccucagggacaaaguggucguggggauugugcuauggaacaucuuuaaccgaaugccaauagcaaggaagaucauuaaggacggugagcagcaugaagaucucaaugaaguagccaaacuauucaacauucaugaagacugauaauaggcuggagccucgguggccaugcuucuugccccuugggccuccccccagccccuccuccccuuccugcacccguacccccguggucuuugaauaaagucugagugggcggc

SEQ ID NO: 21529 - RNA, 1382 nt, Artificial Sequence
  Description of Artificial Sequence: Synthetic transcript sequence
gggaaauaagagagaaaagaagaguaagaagaaauauaagagccaccauguccucgaagggaagcguagucuuggcguauuccggaggccuugacacuucauguauucuggucuggcucaaggagcagggguacgacgucaucgccuaucuggcuaacaucggacaaaaggaagauuucgaggaagcgcgcaagaaggcgcugaaacucggagccaaaaagguauucaucgaagaugugucgcgggaguuugucgaagaguuuaucuggccugcgauucagucgucagcacuuuaugaggacagauaccuccuuggaacuucacuggcccgaccgugcaucgcgcgcaaacagguagagaucgcacagagggagggggcgaaauaugucucgcauggugcaacugggaaagguaaugaucaggugcgguucgaacucuccugcuacucguuggcaccccagaucaaagugaucgcuccguggaggaugcccgaguuuuacaaccgauucaagggaagaaacgaucugauggaguaugcgaagcagcauggaaucccgauccccgugacgccgaagaaucccuggagcauggacgagaaucuuaugcacauuucauacgaggccgggaucuuggaaaauccgaaaaaccaggcgccuccgggguuguacaccaaaacacaagacccagccaaagcgcccaacacccccgauauucuugaaauugaguuuaagaaaggggugcccgucaaggugacgaaugucaaggacggcacgacccaccaaacaucguuggaacuguuuauguacuugaaugaggucgcgggaaaacacgguguggggagaauugacauuguggaaaaucgguuuaucgggaugaagagccggggaaucuacgaaacaccagcgggaacgauucuguaccaugcccaccucgauauugaagcguuuacaauggacagggaagugagaaagauuaaacaggggcuugguuugaaauucgcagagcugguauauacgggcuucuggcauagcccugaaugugaguucguacgccacugcaucgcaaagagccaggaaagaguggagggaaaggugcaagucuccgugcucaagggucaggucuacauccucgguagggagucgccucuuucacucuacaacgaggaguugguaucgaugaacgugcagggagacuaugaacccaccgaugccacaggguucaucaacaucaacuccuugcgccucaaggaguaucaccggcuucagucgaaaguaacggcuaagugauaagcugccuucugcggggcuugccuucuggccaugcccuucuucucucccuugcaccuguaccucuuggucuuugaauaaagccugaguaggaag

SEQ ID NO: 21530 - RNA, 968 nt, Artificial Sequence
  Description of Artificial Sequence: Synthetic transcript sequence
gggaaauaagagagaaaagaagaguaagaagaaauauaagagccaccaugaaaaagacucagacauggauccugacguguaucuaccuccagcugcuguuguucaauccguugguaaagacugaggguaucugccgcaacagagugacgaauaacgugaaagacgugacaaagcuggucgcaaaucuccccaaggacuauaugaucacccucaaguacgucccuggcauggaugugcuuccgucacacugcuggaucucagaaauggucguccagcuuagcgauucguugaccgaccuucuugauaaguucucgaacauuuccgaagggcucuccaacuacuccaucauugacaaauuggugaauauuguggaugaccugguggaaugcgucaaggagaauucgucaaaagaccuuaagaaguccuuuaagagccccgaaccucgacuuuuuacgcccgaagaguucuuccggaucuucaauaggucgaucgaugccuuuaaggacuuuguagucgcgucagaaacgucggauugugugguaucguccacauugucgccggagaaggacagcagggugucaguaacaaaacccuuuauguugccgccaguggcggccucgagccuucgcaaugacucgagcucgucgaaccggaaagcgaaaaauccgccaggagauagcucacugcauugggcagcgauggcgcuccccgcauuguucucauugauuaucggguuugccuucggagcccucuauuggaagaaacgccagcccagccucacgagagcuguagagaacauucagaucaacgaggaggauaacgagauuucgaugcuccaagagaaagagagggaauuccaagaggucugauaauaggcugccuucugcggggcuugccuucuggccaugcccuucuucucucccuugcaccuguaccucuuggucuuugaauaaagccugaguaggaag

SEQ ID NO: 21531 - DNA, 2102 bp, Artificial Sequence
  Description of Artificial Sequence: Synthetic transcript sequence
taatacgactcactatagggaaataagagagaaaagaagagtaagaagaaatataagagccaccatgtcagagcggaaagaaggaaggggaaagggtaaagggaagaaaaaggaacgcggatcggggaagaaaccggaatcagccgctggctcacagtcgccggcactgccaccccggctcaaggagatgaagagccaggaatccgcggctgggtcgaagcttgtgttgagatgcgaaacgtccagcgagtactcatcacttcggtttaagtggtttaagaatggaaacgagctcaataggaagaacaagccccagaatatcaagatccagaagaaacccgggaaatccgaacttcggatcaacaaagcgtccctggcggactccggggagtacatgtgtaaagtcatcagcaaactcggtaacgattcagcctccgctaatatcacgatcgtcgagtcgaatgagatcattaccggtatgccggcgtccacggagggagcatatgtgtcgtcggaaagccccatcaggatttccgtgtcgactgaaggagcaaatacaagctcgtccaccagcacgagcacgacggggacgtcacatctcgtgaaatgcgccgaaaaggagaaaactttctgcgtcaatggtggagaatgcttcatggtgaaggatctttcaaacccctcccggtacctctgcaaatgtccgaacgagtttaccggggaccggtgtcagaactatgtaatggccagcttctataaagccgaagagctgtaccagaagcgagtgttgacgatcacaggcatctgcattgcactccttgtcgtaggaatcatgtgtgtggtggcgtattgcaaaacaaagaagcagcgcaaaaagttgcacgaccgactgcgccagtcgttgaggagcgagcgaaacaatatgatgaatattgcaaatgggccccatcacccgaacccgccacccgagaacgtacaactggtgaaccagtatgtctcgaaaaacgtcatctcgtcggaacatatcgtggaacgggaggcggaaacaagcttcagcacatcgcactacacgagcactgcccaccactccacgaccgtgacacagacgcccagccactcatggtcgaacggtcatacagagtcgatcctgtcagagtcccattcagtaattgtaatgtcgtccgtcgaaaattcaaggcactcaagccccacgggagggcctagaggccgcctcaacgggactggcggtcctcgagaatgtaattccttcttgagacacgcgagggaaacgcccgattcgtacagagattcaccccactcggagcgctatgtcagcgcgatgaccactcccgccagaatgtcgccggtggattttcatacaccttcgtcccctaagtcaccgcctagcgagatgtcgccgcctgtatcatccatgacagtgagcatgccctcgatggccgtgtcaccgtttatggaggaggaaaggcccctgttgttggtcacaccaccaagacttcgggagaaaaagttcgaccaccatccgcagcagttctcgtcgttccaccataatccggcgcacgatagcaactccctcccggcatcgcctctccggattgtcgaagatgaggagtacgaaacgacccaagaatacgaacccgcgcaagagccggtaaagaagctcgcaaatagcagaagggcgaaacgcaccaaaccaaacggacacattgcgaacaggcttgaggtcgacagcaatacctcgtcccagtcgtcaaactccgagagcgagacagaggacgagcgagtcggggaggacacaccttttctcggaatccaaaacccgcttgcagcgtcgttggaagccacgccagcgtttagacttgcggactcacggactaaccctgccggaaggttctcgacgcaagaggagattcaggctaggttgtcctcggtgattgctaatcaggaccccatcgccgtgtgataataggctgccttctgcggggcttgccttctggccatgcccttcttctctcccttgcacctgtacctcttggtctttgaataaagcctgagtaggaaggcggccgctcgagcatgcatctaga

SEQ ID NO: 21532 - RNA, 659 nt, Artificial Sequence
  Description of Artificial Sequence: Synthetic transcript sequence
gggaaauaagagagaaaagaagaguaagaagaaauauaagagccaccauggacacuaggaacaaagcgcaacuucuugucuugcuuacgcugcucuccguccuguucucccagacguccgcauggcccuuguaccgagcgccuucagcuuugcggcugggcgauagaaucccuuuugaaggggccaacgagcccgaucaggugucgcuuaaggaggacaucgacaugcuccagaacgcccucgcggagaacgauacaccguacuaugacguaucgcggaacgcgcgacaugcagacggaguguuuacaagcgauuucucgaaauugcugggacagcucagcgccaagaaauaucucgaaucacugauggggaaaagagugucgucaaauaucucagaagauccagucccgguaaagcggcacucggaugcgguguucacggacaauuacacccgccuccgcaagcaaauggccgucaagaaguaucuuaauuccauuuugaauggaaaaaggagcucggagggugaaucgcccgacuuuccggaggaguuggaaaagugauaauaggcugccuucugcggggcuugccuucuggccaugcccuucuucucucccuugcaccuguaccucuuggucuuugaauaaagccugaguaggaag

SEQ ID NO: 21533 - DNA, 779 bp, Artificial Sequence
  Description of Artificial Sequence: Synthetic transcript sequence
taatacgactcactatagggaaataagagagaaaagaagagtaagaagaaatataagagccaccatgcgccggtggttgggatgcgtatgtttcgcgctcgtccaagccgacagcccgtccgcgcctgtcaatgtcacagtccgccaccttaaagctaattcggcggtcgtgtcgtgggatgtattggaagatgaagtagtgatcgggtttgcgatttcccagcagaagaaagacgtccgaatgcttcgctttatccaagaggtgaatacgacgacaaggtcatgtgcgctctgggacttggaagaggacactgagtacatcgtgcatgtacaggccatttcaattcagggtcaatcacccgcaagcgagcccgtgctgttcaagacgccaagagaggccgaaaagatggccagcaaaaacaaggatgaggtcaccatgaaagaaatggggaggaaccagcagctcagaaccggtgaggtactgatcatcgtggtggtgttgttcatgtgggcaggggtgatcgcactcttttgccggcagtatgatatcattaaagacaatgagcccaacaacaacaaggaaaagactaagtccgcgtcggaaacgtcgacaccggagcaccagggaggcggacttctgcggtcgaaaatctgataataggctgccttctgcggggcttgccttctggccatgcccttcttctctcccttgcacctgtacctcttggtctttgaataaagcctgagtaggaaggcggccgctcgagcatgcatctaga

SEQ ID NO: 21534 - RNA, 1238 nt, Artificial Sequence
  Description of Artificial Sequence: Synthetic transcript sequence
gggaaauaagagagaaaagaagaguaagaagaaauauaagagccaccaugccauaccaguaucccgcgcuuacgccugagcagaagaaggagcugucggacaucgcucaucggaucgucgcacccgggaagggcauucucgcagcugaugaaucgacggguucaauugcgaagcgacuccagucgaucgggacagaaaauaccgaagaaaacagacgguucuaucgccagcuguugcucacagcggaugaucgagugaacccuugcauuggaggggucauucuguuucacgagacacuuuaucagaaagccgacgauggacgcccguucccucaagugaucaagagcaaaggcggaguggucgggaucaaaguggacaagggagugguaccccuugcuggaacuaauggugagacaacgacgcaggguuuggacgggcucagcgaacggugcgcccaguacaaaaaggauggagccgauuucgccaaauggagguguguacucaagaucggugagcacaccccguccgcacuugcgauuauggaaaaugcaaaugucuuggcgagguacgcgucaauuugucagcaaaacggcauuguaccgaucgucgaacccgagauccucccggacggggaucaugacuugaaaaggugucaguauguaacggagaaggugcucgcagcgguguauaaggcgcugucagaccaccacaucuacuuggaggguacucuucugaaaccaaacaugguaacucccggacaugcaugcacacaaaaguuuucgcacgaagagaucgccauggcuacugucaccgccuugcgcagaaccgugccgccugcagugacggguaucacguuuuuguccggagggcagucggaggaagaggccucgaucaaucugaacgcaaucaacaaguguccccugcugaagcccugggcgcuuacguucagcuacggacgggcguugcaggcgagcgcccucaaagcguggggagggaagaaagagaacuugaaagcggcgcaagaggaguacgucaagagagcucuugcgaacucccucgccugccaggggaaauacacaccgucaggacaggccggugccgcagcgucggaaucacuuuuuguguccaaucaugcguauugauaagcugccuucugcggggcuugccuucuggccaugcccuucuucucucccuugcaccuguaccucuuggucuuugaauaaagccugaguaggaag

SEQ ID NO: 21535 - RNA, 866 nt, Artificial Sequence
  Description of Artificial Sequence: Synthetic transcript sequence
gggaaauaagagagaaaagaagaguaagaagaaauauaagagccaccaugagcaugcuguuuuacacgcucauuaccgcguuccucaucggaauucaggccgagccgcauucagaaucgaacguacccgcuggacacacaaucccacaagcccacuggacgaaacuccagcacucccuggacacugcccuuagaagagcgcggucagccccugcagcagcgauugcugcacggguagcggggcagacaaggaauaucacgguggacccacgcuuguuuaagaagcgaagguugaggucgccgagaguccuguuuucgacgcagccgcccagagaagcagccgauacgcaagaccucgacuucgaggucgggggugcggcucccuucaaucgcacccaucgcuccaagcggucgucgagccauccuaucuuucaccggggagaguucucagucugcgauuccgugucggugugggucggugauaaaaccacugcaacagacaucaaagguaaagaagugaugguacuuggcgagguaaacaucaacaauucgguguuuaagcaguauuucuucgaaacgaagugucgagaucccaauccgguggauagcgggugcagggggaucgauuccaaacacuggaacuccuacuguaccacaacucauacauuugugaaggcguugacuauggacggaaaacaggcggcguggcgguucauccgcauugacaccgcgugcgucuguguccuuagccgaaaggcggugcgcagggccuaagcugccuucugcggggcuugccuucuggccaugcccuucuucucucccuugcaccuguaccucuuggucuuugaauaaagccugaguaggaag

SEQ ID NO: 21536 - RNA, 2255 nt, Artificial Sequence
  Description of Artificial Sequence: Synthetic transcript sequence
gggaaauaagagagaaaagaagaguaagaagaaauauaagagccaccauguugagggguagaucguugucggucacgagccuuggaggauugccgcagugggaagucgaagaacucccgguggaagaacucuugcuguucgaaguggcaugggaggugacgaauaaggugggugguaucuacacagugauucagaccaaggccaagacgacagcggacgaguggggagagaacuauuuucuuauugggcccuauuuugaacacaacaugaaaacccaaguagaacagugcgagccgguaaacgaugcugugcgcagggcagucgaugcgaugaauaagcacggcugccaaguccacuuugggcgcugguugaucgaaggguccccauacguggugcucuucgacauuggcuauagcgcguggaauuuggacagguggaagggugaccuuugggaggcgugcucagucggaauccccuaccaugaucgagaggcaaaugacaugcugaucuuuggcagccucacagccugguucuugaaggagguaacggaccacgcagaugggaaauacguggucgcacaguuccaugaguggcaggcggggauuggacuuauccugucgcgagcgaggaaguugcccaucgcgacaaucuucacaacgcacgccacacugcuugguagguauuugugugccgcgaauaucgauuucuacaaucacuuggacaaauucaacauugauaaagaggccggagaacggcaaaucuaccaucgguacugcauggagagagcguccgugcacugugcccacguguucacuacggugagcgaaauuacugcaaucgaagcagagcacaugcugaagagaaaaccggacgucgucacgcccaacgggcugaaugugaagaaguuuuccgcuguccaugaguuccagaaccuucaugcuauguauaaagccaggauucaagauuucgugagagggcauuucuacggacaucuugauuuugaucuugagaaaacgcuguuccucuucaucgcggggagauacgaguuuuccaacaagggugccgacauuuuucucgaaucacuuucgaggcucaacuucuuguugcggaugcacaaaucggauaucaccgucauggucuuuuucaucaugcccgcgaaaaccaacaacuucaauguggagacacugaagggacaggcgguccgcaaacaacugugggacguagcgcacucgguaaaagaaaaguucggcaaaaagcucuacgacgcgcuccuucgaggcgagaucccggaccucaacgacauccucgaucgcgaugaccugaccaucaugaaacgcgcgaucuucagcacacagcgccagucauugccucccgucaccacucauaacaugauugacgacucgaccgauccgauccucucgacaauucggagaauuggguuguuuaacaauaggacagacagggugaagguaauccuccacccggaguuccuguccuccaccagcccuuuguugcccauggauuaugaggaguucguacgagguugucaucucgguguguuucccucauauuacgaaccguggggauauacgcccgcugaguguacuguaauggggauucccagcguaacgacgaaucuuucggguuuugggugcuucaugcaagagcacguagcugaucccacggcauauggaaucuacauugucgauaggcgcuuuagaucacccgacgauucguguaaccaguugaccaaguuucuuuacggauuuugcaaacagucacggagacagcggaucauccagagaaaucggaccgaacgccuuagcgauuugcucgauuggagauaucuggguagguacuaucagcaugcacggcacuugacucugagccgggcauuccccgacaaguuucacgucgagcucacaucaccgccgacgacugagggauucaaauacccucgcccaagcucagugccuccuucgccgucggggucccaggcaucgucgccgcagucgucagacguggaggaugaaguagaggacgagcgguaugacgaggaagaagaagccgagcgcgaccgcuugaacaucaagucgcccuuuucgcuuagccaugucccgcaugggaagaaaaagcuccacggagaauacaagaauugauaagcugccuucugcggggcuugccuucuggccaugcccuucuucucucccuugcaccuguaccucuuggucuuugaauaaagccugaguaggaag

SEQ ID NO: 21537 - RNA, 2333 nt, Artificial Sequence
  Description of Artificial Sequence: Synthetic transcript sequence
gggaaauaagagagaaaagaagaguaagaagaaauauaagagccaccaugugggugacgaaauugcucccugcucuucugcuccagcaugucuugcuccauuugcuucuccugccgaucgccaucccuuacgcggaagggcagcggaagcggcgcaacacuauccaugaguucaagaagucggccaagacgacccucaucaaaauugaccccgcauugaagaucaagacaaagaaagugaacacagcagaucagugcgccaacagaugcacgcggaacaaagggcuuccuuucacauguaaagcguuuguguucgauaaggcgcgcaagcaauguuugugguuccccuuuaacucaaugagcuccggagugaagaaggaguuuggacaugaguucgaucuuuacgagaacaaagauuacauccggaauuguaucaucggaaaaggcagaucauacaaaggaacagugucgauuacaaaaucagggaucaagugucaaccguggucaucaaugauuccgcacgagcauucguuccuucccuccuccuaucgggguaaagaccuucaagaaaacuacugccggaauccccgaggagaggaaggugggcccuggugcuuuacaucaaauccagagguacgcuacgaagucugugacaucccgcagugcucggaaguggaguguaugacaugcaauggggaaagcuacagaggauugauggaucacaccgaguccgggaaaaucugccagaggugggaucaccaaacaccacacaggcauaaguuccuccccgaaagguacccggacaaagguuucgaugauaacuacuguaggaauccggacgggcagccgaggccauggugcuacacucuugauccucauacuaggugggaguauugcgcgauuaagacgugcgcggacaauaccaugaaugacacggaugugccacuggaaacaacugagugcauccaggggcagggagagggcuaucgcgguacagucaauacgaucuggaacggcaucccgugccagagaugggacucccaguacccgcaugaacacgacaugacucccgagaauuucaagugcaaggauuugcgcgagaauuacugucgaaaccccgauggaucggagucacccugguguuuuacgacugaucccaauauccgaguaggcuauugcucgcaaaucccaaauugcgacaugucacacggucaagacugcuaccggggaaacggaaagaacuauauggguaaccugucgcagacgaggucgggucugacgugcuccaugugggacaaaaacauggaggaucuucaccgacacaucuuuugggaaccggacgccuccaaacucaacgagaacuauuguagaaaucccgacgacgacgcgcaugggccgugguguuauaccggaaaucccuugauccccugggauuacugcccgaucucgcggugugaaggagacacgacaccuaccauugugaacuuggaucauccggugauuucaugcgcgaaaacgaagcagcugcgggugguaaacgguauucccaccagaacuaacauuggguggauggugagccucagauauagaaacaaacauaucugcgguggcucgcuuaucaaggaaucgugggucuugacugcaaggcaguguuuucccagccgggaucuuaaggacuacgaggcguggcucgguauccaugacguccacggacgcggagaugaaaagugcaaacaggugcucaaugucagccagcucguguaugggcccgagggaagcgaucuuguacuuaugaaguuggcgcgaccggcgguacuggacgacuuuguaucgacaauugauuugccgaauuaugguugcaccauuccggagaaaacguccugcucagucuacgggugggguuacacggggcugaucaacuaugaugggcuccuuaggguggcacacuuguauaucauggggaacgagaaauguucgcagcaccaccgcgguaaagugacgcugaacgaaagcgaaaucugugcgggagcugagaagauugggucaggcccuugugagggagauuacggugggccccuggucugugaacagcacaagaugcgcauggucuugggagugauuguaccaggacgcgguugugccaucccuaauaggccuggaaucuucgugcgcgucgccuauuacgccaaauggauucacaagaucauccuuacauacaaggugccccagucgugauaauaggcugccuucugcggggcuugccuucuggccaugcccuucuucucucccuugcaccuguaccucuuggucuuugaauaaagccugaguaggaag

SEQ ID NO: 21538 - RNA, 1112 nt, Artificial Sequence
  Description of Artificial Sequence: Synthetic transcript sequence
gggaaauaagagagaaaagaagaguaagaagaaauauaagagccaccaugucagcaaagucgagaacuaucgggauuaucggugcuccuuucagcaaggggcaaccccgagguggaguggaggaaggccccaccguccuucggaaagcaggacuuuuggagaaacucaaagagcaggaaugcgaugucaaagauuauggagaucugcccuuugcagacaucccaaacgauucaccguuucagauugugaaaaauccgcgcuccguagggaaggcgagcgaacagcuugcggguaaagucgcggaggugaagaaaaauggacgcauuucgcucguguugggaggugaucauucguuggcuaucggauccaucuccgggcacgcgagaguacaccccgaucuuggugucaucuggguagacgcgcacaccgacaucaacacaccccugacgacaacuucggggaaccuucacggacagccugucucguuccuccucaaggagcuuaagggaaagauuccggacguaccgggauuuucgugggugacgcccuguaucucagccaaggacauugucuacaucggucugcgcgauguggacccaggcgagcauuacauccucaagacccuugguauuaaguacuucuccaugacggaaguggacagguuggguauuggaaaagucauggaagagacuuugucauaccucuugggccggaagaaaagaccgauucaucucuccuucgacguagauggacuugacccaagcuuuacgccugccacggggaccccugucguaggugggcugacauauagggaagggcucuauaucacggaggagaucuacaagaccggcuugcugucgggguuggauaucauggaggugaauccuucacucgggaaaacacccgaggaagugacgcggacagugaacacagccguggcgaucacgcuugcgugcuucggacuggccagggaagggaaccacaagccgauugacuauuugaauccgcccaagugauaagcugccuucugcggggcuugccuucuggccaugcccuucuucucucccuugcaccuguaccucuuggucuuugaauaaagccugaguaggaag

SEQ ID NO: 21539 - RNA, 818 nt, Artificial Sequence
  Description of Artificial Sequence: Synthetic transcript sequence
gggaaauaagagagaaaagaagaguaagaagaaauauaagagccaccaugaauaagccucucuuguggaucucggucuugacgucccuuuuggaggcauucgcccacacggacuugucgggaaagguauucguguuuccccgggaaagcgucacugaucaugucaaucucaucacgccucuggagaaaccacugcagaacuuuacacucugcuuucgagccuauucggaucugucaagagccuacucgcucuucuccuauaacacacagggacgggacaacgagcuucuuguguacaaggaaaggguaggagaguacucacucuacaucggucgccauaaagugaccuccaaaguaaucgaaaaguucccggcucccguccacauuuguguaucaugggaguccucgucagggaucgcggaguucuggauuaaugggacaccccuugugaagaagggacugagacagggguauuucguagaagcgcagccgaaaaucguguugggucaggaacaagacagcuacggagggaaguuugacaggagccaaucguuugugggagagaucggugaucuuuacaugugggacucgguccugccacccgaaaacaucuugagcgcauaccaggggaccccguugcccgcgaauauucucgauuggcaggcgcucaacuaugagauucgcggcuaugucauuaucaaaccgcuggugugggugugauaauaggcugccuucugcggggcuugccuucuggccaugcccuucuucucucccuugcaccuguaccucuuggucuuugaauaaagccugaguaggaag

SEQ ID NO: 21540 - RNA, 1364 nt, Artificial Sequence
  Description of Artificial Sequence: Synthetic transcript sequence
gggaaauaagagagaaaagaagaguaagaagaaauauaagagccaccaugacccucgacgucgguccagaagaugagcuccccgauugggcagcagcgaaggaguucuaucagaaauaugacccgaaggacgugaucggaagaggagucucgucgguaguacgacgcugugugcauagagcgaccgggcaugaguucgccgugaagauuauggaaguaacugcggagcgcuugucgccggagcaauuggaagaggucagagaggccacccggagagaaacacacaucuugcgccaggucgcgggacauccccacaucaucacgcugauugauucauacgaaucauccagcuuuauguuuuugguguucgaccuuaugcggaaaggcgagcuguucgauuaccugacagagaaaguagcgcuuagcgaaaaggaaaccaggucgaucaugcggucacuccuugaagccgugucguuuuugcacgcuaacaacaucgugcaucgcgaucuuaaacccgagaauaucuuguuggaugacaauaugcagauccggcugucggacuucggguucucgugucaccuugaaccaggagagaagcugcgcgaguugugcggaacacccggguaucuggcgccugagauucucaaaugcagcauggacgaaacacacccgggcuacgguaaagagguggaucucugggcguguggggugauccuuuuuacgcugcucgcgggguccccacccuuuuggcaucggaggcagauccucaugcugcgaaugaucauggaaggacaguaucaauucuccucgccugagugggaugacagguccagcaccguaaaggaccucauuucccgcuugcugcaagucgauccggaagccaggcuuacggcagaacaggcacugcagcacccguucuuugaacgcugcgaggguagccagccauggaaccuuacgccgaggcagagauuccgggucgccgucuggacagugcuugcggcuggaagaguggcccucucaacgcaccgaguccggcccuugacgaaaaaugcucuuuugagggaccccuacgcguugaggucaguaagacaccugauugacaacugcgcauuccgccucuacggacacugggugaagaagggugagcagcagaauagagcggcccuuuuucaacaucgaccuccuggcccuuuucccaucaugggacccgaggaagaaggggauucagcagcgauuacugaggacgaggccgugcucguacuggggugauaagcugccuucugcggggcuugccuucuggccaugcccuucuucucucccuugcaccuguaccucuuggucuuugaauaaagccugaguaggaag

SEQ ID NO: 21541 - RNA, 335 nt, Artificial Sequence
  Description of Artificial Sequence: Synthetic transcript sequence
gggaaauaagagagaaaagaagaguaagaagaaauauaagagccaccaugcccucgagcgugucgugggggauucugcuccuugcgggacuuugcugucucguaccggugucccucgcccacggagagggaacguuuacaucggaccugucaaagcagauggaagaggaagcgguccgguuguucaucgagugguugaaaaacgggggucccagcuccggcgcaccaccgccuucaugauaagcugccuucugcggggcuugccuucuggccaugcccuucuucucucccuugcaccuguaccucuuggucuuugaauaaagccugaguaggaag

SEQ ID NO: 21542 - RNA, 2687 nt, Artificial Sequence
  Description of Artificial Sequence: Synthetic transcript sequence
gggaaauaagagagaaaagaagaguaagaagaaauauaagagccaccauggcgaaaccgcuuacugaucaggagaagcgccgacaaaucucgaucagagguaucguagguguggaaaacgucgccgagcuuaagaaaucguucaaccgccacuugcauuucacguuggugaaggaccgcaacguggcgaccacgcgggauuacuacuuugcauuggcccacacagugcgggaucaucuggucgggagguggaucagaacacaacagcacuacuacgauaagugcccgaaaagaguguauuaucuuucgcuugaguucuacaugggaagaacacuccagaauacgaugaucaaucuugggcuucagaacgcaugcgacgaagccaucuaccaguugggauuggacaucgaagagcuugaagagauugaggaggacgccggacucgggaaugguggacuggggcgacuugcggcguguuucuuggacuccauggcgacccugggccuggcggcauauggauauggaaucagauaugaguaugggaucuuuaaccagaaaauucgggauggauggcaggucgaagaagcugacgauuggcugagauacgggaauccuugggaaaaaucccgacccgaguucaugcucccgguacauuucuacgggaagguagagcauacaaacaccggcaccaaguggaucgauacccaagucguauuggcguugccguaugacacuccgguccccggguauaugaacaacacugucaauacaaugcgguuguggucggccagagcgcccaacgacuuuaaucuccgcgacuucaaugugggagauuacauucaagccgugcuggacaggaaccucgccgagaacauuucgcgggugcucuacccaaaugacaacuucuucgaggggaaagagcugcggcuuaaacaggaauacuucgucgucgcggcgacgcuucaagauaucauucgacgguuuaaggcauccaaguucgguucgacaagaggugcgggaacgguguuugaugccuuucccgaucaggucgccauccagcuuaacgauacccacccugcccucgcaaucccugaacucaugaggaucuuuguggauauugagaaacuucccuggucaaaggcgugggaacugacucaaaagacguucgcauacacaaaccacacaguacuccccgaggcgcuggaacgcuggccaguagaccugguggagaaacugcugccaaggcaccucgaaaucaucuacgagaucaaucagaaacacuuggaucggauuguagcucuuuuccccaaggacguggaucgcuugaggcgcaugucccucaucgaggaagaagggucaaagaggaucaauauggcucaucucugcaucguaggcucacacgcggugaacgggguagccaagauccacucggacauugucaaaacgaaagucuuuaaagauuuuagcgaacuugagcccgauaaguuucagaacaagacgaaugggauuacgccucggagaugguugcuucuguguaauccgggguuggcugagcuuaucgcggagaaaaucggcgaggacuacgugaaagaucugucgcaauugacgaaacuccauucguuucugggugacgauguauuccuucgcgagcucgcaaaaguaaagcaggagaauaagcugaaguucucccaguuuuuggagacagaguauaaggugaagaucaauccgucaagcauguuugacguacaaguaaagcggauucacgaguauaagcggcaacuucuuaauugccugcacgucaucacaauguauaaucgcaucaaaaaggacccgaagaaauuguucgugccuagaacagucaucauugguggaaaggcugcacccggauaccauauggccaaaaugaucaucaagcugauuacgagcguggccgacguggugaauaacgacccgauggucggaucaaaauugaagguaaucuuuuuggaaaacuauagagucucgcuugcggaaaaggugauucccgcaacggaccugucggaacagaucucaaccgcuggcacagaggccucgggaacgggaaacaugaaguucauguugaauggcgcucucacaauuggaaccauggauggagcaaauguagaaauggcagaggaggcuggagaagaaaacuuguuuaucuuugguaugcgcaucgacgauguagcggcauuggacaaaaaggguuacgaagcgaaggaguacuacgaggcccuuccggaguugaaacucgucaucgaucagauugacaauggcuuuuucucgcccaagcagcccgaccucuucaaggacaucaucaauaugcuguucuaccacgauagguucaagguguucgccgauuacgaggcguaugucaaaugucaggauaaaguaagccagcucuauaugaaccccaaagccuggaauacaauggugcuuaagaauauugcggcguccgggaaauucagcagcgaccgcacgauuaaggaguacgcacagaauaucuggaacgucgagcccagcgaccucaaaaucuccuugucaaacgaauccaacaaggugaacggaaacugauaagcugccuucugcggggcuugccuucuggccaugcccuucuucucucccuugcaccuguaccucuuggucuuugaauaaagccugaguaggaag

SEQ ID NO: 21543 - protein, 10 aa, Homo sapiens
AMDTGLYICK

SEQ ID NO: 21544 - protein, 14 aa, Homo sapiens
GIASFVCEYASPGK

SEQ ID NO: 21545 - protein, 14 aa, Homo sapiens
ITPNLAEFAFSLYR

SEQ ID NO: 21546 - protein, 10 aa, Homo sapiens
LSITGTYDLK

SEQ ID NO: 21547 - protein, 14 aa, Homo sapiens
IGGFYALSPYPGLR

SEQ ID NO: 21548 - protein, 13 aa, Homo sapiens
DLNHVCVISETGK

SEQ ID NO: 21549 - protein, 14 aa, Homo sapiens
EMGGHHIVALCVLK

SEQ ID NO: 21550 - protein, 9 aa, Homo sapiens
AFEEEQNLR

SEQ ID NO: 21551 - protein, 8 aa, Homo sapiens
EMGDHLVK

SEQ ID NO: 21552 - protein, 8 aa, Homo sapiens
EVVSHVIK

SEQ ID NO: 21553 - protein, 7 aa, Homo sapiens
ATEVHFR

SEQ ID NO: 21554 - protein, 10 aa, Homo sapiens
ESDLFLLDSR

SEQ ID NO: 21555 - protein, 13 aa, Homo sapiens
IPEGEAVTAAEFR

SEQ ID NO: 21556 - protein, 13 aa, Homo sapiens
LDKPDVVNWMCYR

SEQ ID NO: 21557 - protein, 11 aa, Homo sapiens
LEPGQQEEYYR

SEQ ID NO: 21558 - protein, 14 aa, Homo sapiens
SSGLVSNAPGVQIR

SEQ ID NO: 21559 - protein, 13 aa, Homo sapiens
DGEQHEDLNEVAK

SEQ ID NO: 21560 - protein, 14 aa, Homo sapiens
TGGLEIDSDFGGFR

SEQ ID NO: 21561 - protein, 9 aa, Homo sapiens
ELNEALELK

SEQ ID NO: 21562 - protein, 12 aa, Homo sapiens
SVTCTYSPALNK

SEQ ID NO: 21563 - protein, 17 aa, Homo sapiens
TCPVQLWVDSTPPPGTR

SEQ ID NO: 21564 - protein, 13 aa, Homo sapiens
APNTPDILEIEFK

SEQ ID NO: 21565 - protein, 19 aa, Homo sapiens
FAELVYTGFWHSPECEFVR

SEQ ID NO: 21566 - protein, 13 aa, Homo sapiens
FELSCYSLAPQIK

SEQ ID NO: 21567 - protein, 20 aa, Homo sapiens
AVENIQINEEDNEISMLQEK

SEQ ID NO: 21568 - protein, 9 aa, Homo sapiens
LFTPEEFFR

SEQ ID NO: 21569 - protein, 7 aa, Homo sapiens
LVANLPK

SEQ ID NO: 21570 - protein, 12 aa, Homo sapiens
ASLADSGEYMCK

SEQ ID NO: 21571 - protein, 12 aa, Homo sapiens
HADGVFTSDFSK

SEQ ID NO: 21572 - protein, 12 aa, Homo sapiens
HSDAVFTDNYTR

SEQ ID NO: 21573 - protein, 14 aa, Homo sapiens
ELIHISDWLPTLVK

SEQ ID NO: 21574 - protein, 11 aa, Homo sapiens
GVGFVASPLLK

SEQ ID NO: 21575 - protein, 13 aa, Homo sapiens
HSVPVYFPAQDPR

SEQ ID NO: 21576 - protein, 9 aa, Homo sapiens
FLSDEENLK

SEQ ID NO: 21577 - protein, 12 aa, Homo sapiens
VYETDNNIVVYK

SEQ ID NO: 21578 - protein, 13 aa, Homo sapiens
YMEEAIMQPLDHK

SEQ ID NO: 21579 - protein, 17 aa, Homo sapiens
SASETSTPEHQGGGLLR

SEQ ID NO: 21580 - protein, 9 aa, Homo sapiens
IALVLTPLK

SEQ ID NO: 21581 - protein, 11 aa, Homo sapiens
ALANSLACQGK

SEQ ID NO: 21582 - protein, 8 aa, Homo sapiens
ALQASALK

SEQ ID NO: 21583 - protein, 14 aa, Homo sapiens
GILAADESTGSIAK

SEQ ID NO: 21584 - protein, 10 aa, Homo sapiens
LQHSLDTALR

SEQ ID NO: 21585 - protein, 14 aa, Homo sapiens
TQVEQCEPVNDAVR

SEQ ID NO: 21586 - protein, 10 aa, Homo sapiens
AASAMQFFTK

SEQ ID NO: 21587 - protein, 7 aa, Homo sapiens
IVEIYSR

SEQ ID NO: 21588 - protein, 9 aa, Homo sapiens
VHIGYLPNK

SEQ ID NO: 21589 - protein, 16 aa, Homo sapiens
GEEGGPWCFTSNPEVR

SEQ ID NO: 21590 - protein, 10 aa, Homo sapiens
HIFWEPDASK

SEQ ID NO: 21591 - protein, 18 aa, Homo sapiens
NPDGSESPWCFTTDPNIR

SEQ ID NO: 21592 - protein, 13 aa, Homo sapiens
NDLSGGVLNDWSR

SEQ ID NO: 21593 - protein, 11 aa, Homo sapiens
GGVEEGPTVLR

SEQ ID NO: 21594 - protein, 11 aa, Homo sapiens
TIGIIGAPFSK

SEQ ID NO: 21595 - protein, 9 aa, Homo sapiens
YFSMTEVDR

SEQ ID NO: 21596 - protein, 13 aa, Homo sapiens
IVLGQEQDSYGGK

SEQ ID NO: 21597 - protein, 10 aa, Homo sapiens
QGYFVEAQPK

SEQ ID NO: 21598 - protein, 10 aa, Homo sapiens
VGEYSLYIGR

SEQ ID NO: 21599 - protein, 8 aa, Homo sapiens
IMEVTAER

SEQ ID NO: 21600 - protein, 9 aa, Homo sapiens
LLQVDPEAR

SEQ ID NO: 21601 - protein, 10 aa, Homo sapiens
LSPEQLEEVR

SEQ ID NO: 21602 - protein, 13 aa, Homo sapiens
IAAFNIQTFGETK

SEQ ID NO: 21603 - protein, 9 aa, Homo sapiens
IVVAGMLLR

SEQ ID NO: 21604 - protein, 10 aa, Homo sapiens
YDIALVQEVR

SEQ ID NO: 21605 - protein, 7 aa, Homo sapiens
LFIEWLK

SEQ ID NO: 21606 - protein, 8 aa, Homo sapiens
APNDFNLR

SEQ ID NO: 21607 - protein, 11 aa, Homo sapiens
DYYFALAHTVR

SEQ ID NO: 21608 - protein, 12 aa, Homo sapiens
VLYPNDNFFEGK

SEQ ID NO: 21609 - protein, 17 aa, Homo sapiens
FDGCYCDSLENLADGYK

SEQ ID NO: 21610 - protein, 10 aa, Homo sapiens
NFADIDDSWK

SEQ ID NO: 21611 - protein, 12 aa, Homo sapiens
SILDWTSFNQER

SEQ ID NO: 21612 - protein, 8 aa, Homo sapiens
LDYISLHR

SEQ ID NO: 21613 - protein, 9 aa, Homo sapiens
SPLSWGLLR

SEQ ID NO: 21614 - protein, 11 aa, Homo sapiens
THWLLELVTTR

SEQ ID NO: 21615 - protein, 9 aa, Homo sapiens
GHALLIDCR

SEQ ID NO: 21616 - protein, 11 aa, Homo sapiens
LAVLITNSNVR

SEQ ID NO: 21617 - protein, 10 aa, Homo sapiens
LQFPLPTAQR

SEQ ID NO: 21618 - protein, 18 aa, Homo sapiens
AMAIADALGKIPQTVLWR

SEQ ID NO: 21619 - protein, 14 aa, Homo sapiens
WLPQNDLLGHPMTR

SEQ ID NO: 21620 - protein, 8 aa, Homo sapiens
IPQTVLWR

SEQ ID NO: 21621 - protein, 8 aa, Homo sapiens
TYPVPFQR

SEQ ID NO: 21622 - protein, 10 aa, Homo sapiens
AMAIADALGK

SEQ ID NO: 21623 - protein, 5 aa, Homo sapiens
ENIMR

SEQ ID NO: 21624 - protein, 5 aa, Homo sapiens
SDFVK

SEQ ID NO: 21625 - protein, 12 aa, Homo sapiens
QKGEYLPLLQGK

SEQ ID NO: 21626 - protein, 12 aa, Homo sapiens
VLSSMADAVLAR

SEQ ID NO: 21627 - protein, 11 aa, Homo sapiens
FGMHLQAATPK

SEQ ID NO: 21628 - protein, 10 aa, Homo sapiens
SLVFPEAENR

SEQ ID NO: 21629 - protein, 10 aa, Homo sapiens
GEYLPLLQGK

SEQ ID NO: 21630 - protein, 10 aa, Homo sapiens
GYEPDASVTK

SEQ ID NO: 21631 - protein, 9 aa, Homo sapiens
ILLNNAAFR

SEQ ID NO: 21632 - protein, 9 aa, Homo sapiens
QSDLDTLAK

SEQ ID NO: 21633 - protein, 8 aa, Homo sapiens
NFTGEEIK

SEQ ID NO: 21634 - protein, 8 aa, Homo sapiens
SLGMIFEK

SEQ ID NO: 21635 - protein, 8 aa, Homo sapiens
GRDLLTLK

SEQ ID NO: 21636 - protein, 7 aa, Homo sapiens
LAEQYAK

SEQ ID NO: 21637 - protein, 6 aa, Homo sapiens
DLLTLK

SEQ ID NO: 21638 - RNA, 656 nt, Artificial Sequence
  Description of Artificial Sequence: Synthetic transcript sequence
gggaaauaagagagaaaagaagaguaagaagaaauauaagagccaccaugaaaacgcagcgaaauggacccagccucggucgcuggucauuggugcuucugcuucugggucuggugaugccucucgcuaucguagcgcaagucuugucguaucaagaggcgguccuuagggccauugauggaaucaaccagagaucgucggaugcaaaucucuaccggcuucucgauuuggacccgaggccaacuauggacggggacccggauacgccgaaacccguguccuuuacgguaaaagaaacagugugcccucgcacaacccagaagucccccgaagauugugacuucaaagaggauggguuggucaagcgaugcgucggaaccgugauuuugaaucaggccagggacucguucgacaucagcugugacaaagacaaccggagaucagcgagacuuggaaacuucuuucggaaggugaaagagaagaucgguggcgggcugaagaaggucggacagaagauuaaggacuuucucgggaaccucguaccccgcacugcaucauaaugagcugccuucugcggggcuugccuucuggccaugcccuucuucucucccuugcaccuguaccucuuggucuuugaauaaagccugaguaggaag

SEQ ID NO: 21639 - RNA, 749 nt, Artificial Sequence
  Description of Artificial Sequence: Synthetic transcript sequence
gggaaauaagagagaaaagaagaguaagaagaaauauaagagccaccauggcuuucacagagcauuccccuuugacgccgcaucggagggaucugugcucccgcucaaucugguuggcccggaagauuaggagcgaccugaccgcgcugacagagucguaugucaaacaccagggccuuaacaagaauaucaaucuugacucagccgaugguaugccagucgcuucgacggaucaguggucggagcucacagaggcagaacgacugcaagagaaccuccaagcguaucgaacuuuucacguacuucuugcgagauuguuggaggaccagcaagugcauuucacucccaccgaaggggacuuccaccaggcaauucacacgcuccuccuucaaguggcggcguuugcguaccagaucgaggagcugaugauccuccucgaauacaaaauuccccggaacgaagccgacgguaugccgaucaaugugggagauggaggauuguuugaaaagaaacucuggggauugaagguacugcaagaacuuucccaguggacggucagaucaauucacgauuugagguucaucucgagccaucagaccgggauccccgcacgcgggucgcacuacaucgccaacaauaagaaaaugugauaauaggcugccuucugcggggcuugccuucuggccaugcccuucuucucucccuugcaccuguaccucuuggucuuugaauaaagccugaguaggaag

SEQ ID NO: 21640 - RNA, 533 nt, Artificial Sequence
  Description of Artificial Sequence: Synthetic transcript sequence
gggaaauaagagagaaaagaagaguaagaagaaauauaagagccaccaugaaaacacuucaauucuucuuccucuuuuguugcuggaaggcuaucugcugcaauucgugcgaacugacaaacaucaccauugcgauugaaaaggaagagugucgauucuguauuuccaucaacacuacauggugugccggguacuguuauacgcgggauuuggucuacaaagacccggccagaccaaagauccagaaaacgugcaccuuuaaggagcugguguacgagacaguccgcguacccgguugugcgcaccacgcggacagccucuauacguacccuguggcaacccagugccauuguggaaagugcgacucggauucgacggauugcacugugaggggcuuggggcccucauauugcucauuuggagagaugaaagagugauaagcugccuucugcggggcuugccuucuggccaugcccuucuucucucccuugcaccuguaccucuuggucuuugaauaaagccugaguaggaag

SEQ ID NO: 21641 - RNA, 896 nt, Artificial Sequence
  Description of Artificial Sequence: Synthetic transcript sequence
gggaaauaagagagaaaagaagaguaagaagaaauauaagagccaccauggcggacaauuucucccuccacgacgcacugucgggcucgggaaauccgaauccgcaaggguggccuggagcguggggaaaccagccggcaggggcuggaggguaucccggagcgucguacccaggcgccuacccaggccaggccccucccggugcguacccgggucaggcuccucccggagcuuauccgggagcacccggagccuaccccggugcuccugccccugguguguauccuggucccccgagcgggccuggugcguaucccucaagcggacagcccuccgcgaccggugcauaccccgcgacuggacccuacggugcgccagccggaccgcugaucguacccuauaaccugccauugccaggggguguggucccgcgaaugcuuauuacgauccucggcacagucaagccaaaugccaaccggaucgcgcuugauuuucagcgggggaacgaugucgcguuccacuuuaauccgagguucaacgaaaacaauaggcgcguaaucgugugcaacacgaaauuggacaauaacuggggaagagaggaacgccaaucagucuuuccguucgaaucggggaagccuuuuaagauccaagugcugguagagccggaucauuucaaagucgccgucaaugacgcgcaccuucuccaguacaaccauagagugaaaaaguugaacgagauuucaaaauuggggaucucgggugacauugaucuuacauccgcgucauacacgaugauuugaagcgcugccuucugcggggcuugccuucuggccaugcccuucuucucucccuugcaccuguaccucuuggucuuugaauaaagccugaguaggaag

SEQ ID NO: 21642 - RNA, 1385 nt, Artificial Sequence
  Description of Artificial Sequence: Synthetic transcript sequence
gggaaauaagagagaaaagaagaguaagaagaaauauaagagccaccaugaagaugcacuugcagcgcgccuuggucguguuggcacuucucaacuucgcgacggugucccuuucgcuuagcacaugcacuacgcuugacuucgggcacaucaagaagaagaggguagaggccauucgcggucaaauccucucgaaacuucgccucacgucgccgccugagccgacuguaaugacucacguccccuaucaaguacucgcgcucuauaacucaacuagagaguugcuugaagaaaugcacggggagagggaggaagguuguacacaagaaaauaccgagagcgaguacuaugccaaggaaauccacaaguucgacaugauucaggguuuggcggagcauaaugaguuggcugucugcccaaaagguaucacaucgaagguguuuagguucaaugucucguccgucgaaaagaaucgaaccaaucucuuccgggcagaauuucgcguguugagagugccgaauccuucgucgaaacggaacgaacagagaaucgagcuguuucagauccucagacccgaugagcacauugcgaaacagagauacaucggcgggaagaaccuuccgacccggggaacggcggaguggcugagcuuugaugugacggauacugugagagaauggcugcuucgccgcgagucgaaucugggauuggagaucagcauucacugccccugccacacauuccagcccaacggcgacaucuuggagaauauccacgaggucauggagaucaaguucaaagggguagacaacgaagaugaucauggacgaggagacuugggacggcugaaaaagcagaaagaccaucacaacccacaucugauucucaugaugaucccuccccauagacuggacaaucccgggcagggaggucagaggaagaagagagcauuggacacgaacuacugcuuucggaaucucgaagaaaacuguugugucaggccccuguacauugauuuuaggcaggaucucggguggaagugggugcaugaaccgaagggguacuaugcaaacuucugcagcgggccauguccuuaucuccggucagccgauacaacccauuccacagugcuuggacucuacaauacgcugaacccagaagcguccgcgucaccguguugugucccucaagacuuggagcccuugacgauucucuacuaugugggacgaacaccgaaaguagagcagcuguccaacauggucguaaaaucaugcaaaugcucaugauaauaggcugccuucugcggggcuugccuucuggccaugcccuucuucucucccuugcaccuguaccucuuggucuuugaauaaagccugaguaggaag

SEQ ID NO: 21643 - protein, 11 aa, Homo sapiens
CMGTVTLNQAR

SEQ ID NO: 21644 - protein, 9 aa, Homo sapiens
FALLGDFFR

SEQ ID NO: 21645 - protein, 12 aa, Homo sapiens
TTQQSPEDCDFK

SEQ ID NO: 21646 - protein, 11 aa, Homo sapiens
CVGTVILNQAR

SEQ ID NO: 21647 - protein, 8 aa, Homo sapiens
SSDANLYR

SEQ ID NO: 21648 - protein, 9 aa, Homo sapiens
LQENLQAYR

SEQ ID NO: 21649 - protein, 8 aa, Homo sapiens
TFHVLLAR

SEQ ID NO: 21650 - protein, 11 aa, Homo sapiens
VLQELSQWTVR

SEQ ID NO: 21651 - protein, 11 aa, Homo sapiens
CDSDSTDCTVR

SEQ ID NO: 21652 - protein, 8 aa, Homo sapiens
ELVYETVR

SEQ ID NO: 21653 - protein, 24 aa, Homo sapiens
VPGCAHHADSLYTYPVATQCHCGK

SEQ ID NO: 21654 - protein, 13 aa, Homo sapiens
SFSLSTNLQESLR

SEQ ID NO: 21655 - protein, 9 aa, Homo sapiens
TLMLLAQMR

SEQ ID NO: 21656 - protein, 10 aa, Homo sapiens
YSPCAWEVVR

SEQ ID NO: 21657 - protein, 8 aa, Homo sapiens
LLWQLNGR

SEQ ID NO: 21658 - protein, 8 aa, Homo sapiens
LMSSLHLK

SEQ ID NO: 21659 - protein, 11 aa, Homo sapiens
GNDVAFHFNPR

SEQ ID NO: 21660 - protein, 11 aa, Homo sapiens
IQVLVEPDHFK

SEQ ID NO: 21661 - protein, 15 aa, Homo sapiens
MLITILGTVKPNANR

SEQ ID NO: 21662 - protein, 13 aa, Homo sapiens
LINEIEEMGGMAK

SEQ ID NO: 21663 - protein, 14 aa, Homo sapiens
NTQIIIQEESGIPK

SEQ ID NO: 21664 - protein, 15 aa, Homo sapiens
TGLQAGLTIDEFAPR

SEQ ID NO: 21665 - protein, 9 aa, Homo sapiens
ALDTNYCFR

SEQ ID NO: 21666 - protein, 15 aa, Homo sapiens
GYYANFCSGPCPYLR

SEQ ID NO: 21667 - protein, 10 aa, Homo sapiens
VEQLSNMVVK

SEQ ID NO: 21668 - protein, 11 aa, Homo sapiens
EAEQSNVALQR

SEQ ID NO: 21669 - protein, 14 aa, Homo sapiens
IAYLEAENLEMHDR

SEQ ID NO: 21670 - protein, 10 aa, Homo sapiens
SEVQYIQEAR

SEQ ID NO: 21671 - RNA, 779 nt, Artificial Sequence; identical to SEQ ID NO: 1643
  Description of Artificial Sequence: Synthetic transcript sequence

SEQ ID NO: 21672 - RNA, 1215 nt, Artificial Sequence
  Description of Artificial Sequence: Synthetic transcript sequence
gggaaauaagagagaaaagaagaguaagaagaaauauaagagccaccaugaauggaacggaagggccaaacuuuuaugugccuuucagcaacgccacggguguagugagaucgccguuugaguacccccaguauuaucuggccgagccuuggcaguucucgaugcucgccgccuacauguuccugcuuauuguacugggguuuccgaucaacuuuuugaccuuguauguaacggugcaacacaagaaguugaggacaccgcuuaacuauauccugcuuaaucucgccgucgcggaucuguucauggugcucggaggguuuaccuccacacuguauacgucccuccacggguacuucguguuuggucccacugggugcaacuuggaaggauucuuugcaacacugggaggggaaauugcguuguggagcuuggugguguuggcgauugagagauacguggucguaugcaaaccaaugucaaacuuucgguuuggagagaaccaugcgauuaugggagucgcguuuacgugggucauggccuuggccugcgcagcuccuccucucgcgggcuggucccgcuauauccccgagggacuucagugcucaugcggcaucgacuacuauaccuugaagcccgaggugaauaaugagucguucguaaucuacauguuugucgugcauuucacaauucccaugaucauuaucuucuucuguuacggacagcuuguguucacuguaaaagaggcagcagcgcagcagcaggaaagcgcgacaacccaaaaggccgagaaagaggugacgcggauggucaucaucaugguaaucgcguuucuuaucuguugggugcccuacgccucgguggcauucuacaucuuuacgcaccagggcucgaacuuuggaccgaucuucaugacuauuccagcguucuucgccaaaucggcagcuaucuacaaucccgucaucuacauuaugaugaacaagcaguuccgaaauuguaugcucaccacgauuugcugugggaagaaucccuugggagaugacgaagcgagcgcgacagucucaaaaaccgaaacuucacaagucgcaccggcgugaagcgcugccuucugcggggcuugccuucuggccaugcccuucuucucucccuugcaccuguaccucuuggucuuugaauaaagccugaguaggaaggcggccgcucgagcaugcaucuaga

SEQ ID NO: 21673 - RNA, 1871 nt, Artificial Sequence
  Description of Artificial Sequence: Synthetic transcript sequence
gggaaauaagagagaaaagaagaguaagaagaaauauaagagccaccaugcugggaguacuggugcucggggccuuggcgcuugcgggacuuggguucccggcaccggcugagccccagccgggagguucacaguguguagaacacgacugcuuugcgcucuacccuggacccgcuacauuucugaaugcgucgcagaucugugacggacuccgcggucaucuuaugacggugagaucguccguagcggcggaugucauuucgcuuuugcucaacggggacggaggugugggcaggaggcgccuuuggaucgggcuccaguugccgccugggugcggugaucccaagcgguuggggccucugaggggauuucaauggguaacgggugacaacaacacauccuauucccggugggccagacucgacuugaauggugccccucuuugcggaccccucugcguggcggugucggcagcagaggcaacggucccgagcgagccgauuugggaagagcagcagugugaagucaaagcggacggguuccuuugcgaguuccacuuccccgcgacgugcagacccuuggcaguagagcccggagcggcagcagccgcgguauccaucacuuacgggacgccguucgcugcgagaggagcagacuuccaagcucuucccgucggcucgucggcagcgguggccccauugggacugcaacugaugugcacugcaccgccaggggcgguccagggacacugggcacgcgaggcaccgggagcgugggacuguuccgucgaaaacggcggaugcgagcaugcauguaacgcaauccccggagcgccucgcugccagugcccagcuggagcggcgcugcaagcggaugggcggucguguacggccucagccacucagagcugcaacgaucugugcgagcauuucugcgucccgaauccggaccagccugggucguauagcuguaugugugaaacaggauaucgguuggcagcagaccagcacagaugcgaggaugucgaugauuguauucuggaacccucgccuuguccgcagcgaugcgucaauacgcagggugguuucgagugucacuguuauccaaacuacgaucuuguggacggagaaugugucgagccggucgaucccugcuuucgagcuaacugugaguaccagugucaaccccugaaucagacaagcuaccucugugugugcgccgaaggauuugcucccaucccgcacgaaccccaucggugucagauguuuuguaaccaaacggccugcccugccgauugcgauccgaauacacaggcuucaugugagugcccagagggauauaucuuggaugaugguuuuaucugcacugacauugacgaaugugaaaaugguggguuuugcucgggugugugccacaaucuccccgguaccuucgaaugcaucuguggucccgacucggcucuggcacgccauaucgggacagauugugauagcgggaaggucgacgguggggacuccggcuccggagagccuccgcccucacccacgccagggagcaccuugaccccaccggcggugggguuggugcacucgggauuguugaucgggaucucaauugccucgcucugccuugugguggcgcuuuuggccuugcugugccaucuccgcaagaagcaaggugcagcucgcgcgaaaauggaauacaagugugccgcaccgagcaaagaggucguccuccagcacguaagaacagaaaggacuccucagcgacucugauaagcugccuucugcggggcuugccuucuggccaugcccuucuucucucccuugcaccuguaccucuuggucuuugaauaaagccugaguaggaag

SEQ ID NO: 21674 - RNA, 1991 nt, Artificial Sequence
  Description of Artificial Sequence: Synthetic transcript sequence
gggaaauaagagagaaaagaagaguaagaagaaauauaagagccaccaugagagccuugcuuuugcugggauuccugcucgugucccuugaaagcacacugagcaucccgccaugggaggcgccuaaggagcacaaguacaaggcggaagagcauacagugguacuuacagucacgggagaaccgugucacuuccccuuccaguaccauaggcagcucuaucauaagugcacccacaaaggucggccagguccucagccguggugcgcgacaacuccgaacuucgaccaggaucagcgcuggggauacugccuggaacccaaaaaggucaaagaccacugcuccaaacacagccccugccaaaagggcggaacgugugucaacaugccauccgguccgcacuguuuguguccacagcaucugacggggaaucauugccagaaagaaaaguguuuugagccucaguuguugagauucuuccacaaaaacgaaauuugguaccgcacagaacaggcugccguagccagaugucagugcaagggaccggacgcacauugccagcgccucgcgagccaggcgugucggacgaauccuugucugcauggcggaaggugucuggagguggaggggcaccgccucugccauugcccugucggcuacacaggggccuuuugcgacgucgauaccaaggcgucgugcuaugacggcaggggacuguccuaccgcggguuggcccgcacuacguugucgggugcgcccugucaaccgugggccucggaagcgacguaucgaaacgugacggccgagcaagccagaaauuggggacucggagggcaugcuuuuuguagaaaccccgacaaugauaucaggccauggugcuuuguccucaacagggauagacugucgugggaauacugcgaccuggcucagugucaaacucccacgcaagccgcaccacccacacccgugucacccagacugcacguaccgcuuaugccugcccagccggcaccucccaaaccucaaccaacuacgcggacaccgccgcagucgcagaccccuggagcgcuuccggcgaaacgggaacagccgccuucccucaccaggaaugggcccuugagcuguggucagaggcugcgcaaaucacuuucgucgaugaccagagucguaggagggcucguagcauugcgaggugcucaccccuacauugcagcgcucuauuggggacauuccuuuugugcugguucgcuuauugcgcccugcugggugcugacggccgcacacugucugcaagauaggccggcacccgaggauuugacgguggugcuggggcaggagcggcggaaccacucgugcgaacccugccagacacuggcgguccggucauauaggcuucacgaggcuuucucaccgguaucauaccagcaugaccuugcguugcuucgccuucaagaagaugcggacggaucgugcgcacuccuuagcccauauguacagccggugugucucccguccggagcggccagacccucagagacaacgcuuugccagguggcaggguggggacaucaguuugaaggugcggaagaguacgcaucguuuuugcaagaagcgcaagugccguuccucucacuugagagaugcucagcgccugacgugcacggcagcucgauccuucccggaauguugugugccggguucuuggaggguggaacugacgccugccagggagauagcggagguccguuggugugcgaggaccaagcagcggagaggaggcucacacuccagggaaucaucagcuggggaucgggauguggagauagaaauaagcccgguguauauacggaugucgccuauuaccucgcguggaucagagagcacacaguguccugauaagcugccuucugcggggcuugccuucuggccaugcccuucuucucucccuugcaccuguaccucuuggucuuugaauaaagccugaguaggaag

SEQ ID NO: 21675 - RNA, 704 nt, Artificial Sequence
  Description of Artificial Sequence: Synthetic transcript sequence
gggaaauaagagagaaaagaagaguaagaagaaauauaagagccaccaugccucgcuuguucuucuuccaucuguugggagucugccuccucuugaaucaguucagcagggcggucgccgacucauggauggaggaggugaucaaacucugcgguagggaacucguaagagcgcagaucgccauuugcgggauguccacauggucgaagagaucgcuuucacaagaggaugcaccccaaacgccucgccccgucgccgagauugucccgucguuuaucaauaaggacacggagacuaucaacaugaugucagaauuuguggcgaaccuuccgcaagaacugaagcuuacgcugagcgagaugcagcccgcacugccgcagcuccagcagcacgugccaguguugaaagauucgucguugcucuuugaggaguucaagaaauugauucgaaaccgccaguccgaagcggcugacuccucacccagcgaacuuaaguaucugggacuugauacccauucgagaaagaaacggcaguuguacucggcgcucgcgaauaaguguugucacguagggugcacaaaacggucccuggcacgguuuuguugauaauaggcugccuucugcggggcuugccuucuggccaugcccuucuucucucccuugcaccuguaccucuuggucuuugaauaaagccugaguaggaag

SEQ ID NO: 21676 - RNA, 776 nt, Artificial Sequence
  Description of Artificial Sequence: Synthetic transcript sequence
gggaaauaagagagaaaagaagaguaagaagaaauauaagagccaccauggacucagacgagacaggguuugaacauucagggcucuggguguccguauuggcagggcucuugcuuggugcgugccaagcccaccccauuccagauucgucgccccuguugcaguucggaggacagguccggcagcgguaucucuauacugaugaugcgcagcagacggaagcgcaccuugagauuagggaggauggcacgguagguggagcggcagaccagucgcccgagagccucuugcagcuuaaagcucugaaacccggcgugauccaaauccuuggggucaagaccucccgcuuccucugccagcgcccagacggugcucuguacggauccuugcacuuugacccggaagcguguuccuuucgagaacugcuuuuggaagaugguuacaacgucuaccagucagaggcccacggacuuccgcuccaucugcccgggaauaagagcccucauagggacccugcgcccagaggaccggccagauuccucccgcugccugggcuuccgccagcccuccccgagccucccggaaucuuggcaccucaaccgcccgauguggguucgucggacccgcugucgauggugggacccagccaggggcggagcccgucguaugcgucaugauaauaggcugccuucugcggggcuugccuucuggccaugcccuucuucucucccuugcaccuguaccucuuggucuuugaauaaagccugaguaggaag

SEQ ID NO: 21677 - RNA, 1483 nt, Artificial Sequence
  Description of Artificial Sequence: Synthetic transcript sequence
gggaaauaagagagaaaagaagaguaagaagaaauauaagagccaccaugccccucaacguuagcuucaccaacaggaacuaugaccucgacuacgacucggugcagccguauuucuacugcgacgaggaggagaacuucuaccagcagcagcagcagagcgagcugcagcccccggcgcccagcgaggauaucuggaagaaauucgagcugcugcccaccccgccccuguccccuagccgccgcuccgggcucugcucgcccuccuacguugcggucacacccuucucccuucggggagacaacgacggcgguggcgggagcuucuccacggccgaccagcuggagauggugaccgagcugcugggaggagacauggugaaccagaguuucaucugcgacccggacgacgagaccuucaucaaaaacaucaucauccaggacuguauguggagcggcuucucggccgccgccaagcucgucucagagaagcuggccuccuaccaggcugcgcgcaaagacagcggcagcccgaaccccgcccgcggccacagcgucugcuccaccuccagcuuguaccugcaggaucugagcgccgccgccucagagugcaucgaccccucgguggucuuccccuacccucucaacgacagcagcucgcccaaguccugcgccucgcaagacuccagcgccuucucuccguccucggauucucugcucuccucgacggaguccuccccgcagggcagccccgagccccuggugcuccaugaggagacaccgcccaccaccagcagcgacucugaggaggaacaagaagaugaggaagaaaucgauguuguuucuguggaaaagaggcaggcuccuggcaaaaggucagagucuggaucaccuucugcuggaggccacagcaaaccuccucacagcccacugguccucaagaggugccacgucuccacacaucagcacaacuacgcagcgccucccuccacucggaaggacuauccugcugccaagagggucaaguuggacagugucagaguccugagacagaucagcaacaaccgaaaaugcaccagccccagguccucggacaccgaggagaaugucaagaggcgaacacacaacgucuuggagcgccagaggaggaacgagcuaaaacggagcuuuuuugcccugcgugaccagaucccggaguuggaaaacaaugaaaaggcccccaagguaguuauccuuaaaaaagccacagcauacauccuguccguccaagcagagacucaaaagcucauuucugaaauugacuuguugcggaaacaaaaugaacaguugaaacacaaacuugaacagcuacggaacucuugugcgugauaauaggcuggagccucgguggccaugcuucuugccccuugggccuccccccagccccuccuccccuuccugcacccguacccccguggucuuugaauaaagucugagugggcggc

SEQ ID NO: 21678 - RNA, 2564 nt, Artificial Sequence
  Description of Artificial Sequence: Synthetic transcript sequence
gggaaauaagagagaaaagaagaguaagaagaaauauaagagccaccaugucgucauccucauggcucuugcugucauugguggccgucacagcggcacaaagcacgaucgaagaacaggcuaagacguuucucgacaaauucaaccacgaagccgaagaucucuucuaccaguccagccucgcgagcuggaacuacaacaccaacaucacugaagaaaaugugcagaacaugaauaacgcuggagacaaaugguccgccuuucucaaagaacaaucgacgcucgcacagauguacccgcuucaagaaauucagaaccuuacagugaaacuccagcuucaggcacuccagcagaaugggucaucgguauugucagaggacaagucaaaacgcuugaacacgauuuugaauacgaugucgacaaucuacucgacgggaaagguguguaauccugauaauccucaagagugucuccugcuugaacccgggcuuaacgagaucauggccaauagccuugacuacaacgagcgacugugggcaugggagucauggcgcucagaagucgggaagcagcugcgccccuuguacgaggaauaugucgugcugaaaaacgaaauggcccgagccaaccauuacgaggacuacggcgauuauuggaggggugauuacgaggucaauggggucgacggguaugacuacagccgaggucaguugaucgaagauguggagcacaccuucgaggagaucaaaccccuguacgagcaccuccaugcguaugucagggcgaaauugaugaaugccuauccgagcuacaucucgccaaucgguugccugccagcgcaccuucuuggggauauguggggucgauucuggacuaaucucuauucguugacggucccguuuggacaaaagcccaauaucgacguaacggaugccaugguagaccaagcgugggaugcgcagaggaucuuuaaggaagcggagaaauucuucguauccgucgggcugcccaacaugacacagggauuuugggagaacuccaugcucacugaucccggcaauguccaaaaggcagucugccacccuaccgcuugggaccuuggaaagggagauuuucggauucugauguguacaaaagugacaauggacgauuuccugacagcucaccaugaaaugggacacauccaguaugacauggccuacgcagcgcagccguuuuugcuucgcaacggugcgaaugagggguuucacgaggccgugggagagauuaugucgcucuccgcugcgacacccaagcauuugaaguccaucggacugcugucacccgacuuucaagaggacaacgaaacggaaaucaauuuccugcucaagcaagcgcuuacuaucguaggcacacuccccuucaccuauaugcuugaaaaguggagguggaugguguucaagggcgagaucccuaaagaucaguggaugaagaaauggugggagaugaagagagagaucgugggugucgucgagccggugccccaugaugagacuuauugugacccggcgucacucuuccacguguccaacgauuauagcuuuauccgguacuauacuagaacguuguaccaguuccaauuccaagaggcccucugccaggcggcgaagcacgagggaccccugcauaagugcgacaucucaaauuccaccgaagccggucagaagcuuuucaauauguugcgcuugggaaagucggaaccuuggacucuggcucucgaaaaugugguaggagcgaagaauaugaacgucagaccccugcugaacuauuuugagccccuuuuuacguggcugaaggaccagaacaaaaacucauucgucggcuggucaacggauuggagccccuacgcagaucagagcauuaagguccgaaucucguugaagucggcucucggugacaaggcguacgaguggaaugacaaugagauguaucucuuccgcucguccguggcguaugcgaugaggcaguacuuccucaaaguaaagaaccagaugauuuuguucggggaggaggauguccggguagccaaucuuaaaccucggaucucguuuaacuucuuugucacggcgccuaaaaacgugucggacaucauuccgcggaccgaaguagagaaagcgaucagaaugagccggucgaggauuaaugacgcguucaggcugaacgacaacagcuuggaauuucucgggauucaaccgacgcuugggccuccgaaccagccacccguauccauuugguugauuguguucggaguagugaugggugugaucguggucggcauugucaucuugaucuucaccgggauuagagaucggaagaagaagaacaaagcgagaucgggagaaaacccguaugccucgauugacaucucgaaaggagagaauaacccaggguuucagaauacugaugacgugcagacaucauuuugauaauaggcugccuucugcggggcuugccuucuggccaugcccuucuucucucccuugcaccuguaccucuuggucuuugaauaaagccugaguaggaag

SEQ ID NO: 21679 - RNA, 3455 nt, Artificial Sequence
  Description of Artificial Sequence: Synthetic transcript sequence
gggaaauaagagagaaaagaagaguaagaagaaauauaagagccaccauguuccaacugccggugaacaaucucgggucauugcgcaaagcccgcaagacugucaagaaaauccugucagacaucgggcucgaguacuguaaggaacauauugaggauuucaaacaauucgaaccuaacgacuucuaccucaagaauacgacuugggaggacguagggcugugggaucccucacucacaaagaaucaggauuaccgcacaaagccauuuugcuguucagccugcccauuuucgagcaaauucuuuucagcguacaagucacacuuuaggaacguccacuccgaagauuuugagaaucgcauucuccuuaacugcccuuauugcacguuuaacgcagacaagaaaacucucgaaacacacauuaagaucuuccacgcgccgaaugccucagcgccuagcucgucccucucaaccuuuaaagacaagaauaagaacgacgguuugaagccgaaacaggcagacucggucgagcaggcagucuacuacuguaagaagugcacguaucgggacccgcuguaugaaaucgugcggaagcauaucuaccgcgagcacuuucaacacguggcagcgcccuauauugcgaaggcgggagaaaagagccugaacggagccgugccgcucggaucaaacgccagggaggagagcagcauccacugcaaaagauguuuguucaugcccaaaucguaugaggcacucgugcagcauguaaucgaggaccacgagaggauuggguaccaagucacugcgaugaucggacauaccaacgucguggugccuagaagcaaaccuuugaugcucaucgcgccgaagccccaagauaagaagucaaugggauugccuccccgaauuggcagccucgcaucggggaaugucagaucauugcccucacagcagauggugaaucggcucucaaucccgaagccuaacuugaacagcacuggagucaacaugauguccucgguacacuugcagcaaaacaauuacggagugaagagcgugggacaagguuacucggugggacagucgaugcgccuugggcugggagggaacgcaccgguauccauuccccagcaaucacagucagugaagcagcuucucccaucagguaacgguagaucauauggacuugguagcgaacagagaucacaggcacccgcacgauauucgcuucagagcgcuaaugccucaucccucucgucgggacaguugaaguccccaucguugucacagucacaggcgagcaggguauugggucaaucguccucgaaaccggccgcggcggcgacggggccaccgccugguaacacguccagcacacagaaauggaagauuugcaccauuugcaaugagcuuuuucccgagaaugucuacucagugcacuucgaaaaagaacacaaggccgaaaagguaccggccguggcaaacuauaucaugaagauccauaacuucacgucaaagugucucuacugcaaccgguaccuccccacggauacccucuugaaucauaugcucauccacgggcuuuccugucccuauugccgcucaacguucaacgacguagagaagauggccgcucauaugcgcaugguacacauugaugaggagauggguccuaagacagauucgacgcuguccuucgacuugacuuugcagcagggaucgcauacaaacauucaucugcucgucaccacuuacaacuugcgggaugcuccggccgagagcguggcguaccacgcgcagaauaacccuccugucccgcccaagccgcagccuaaaguccaagagaaggcggacauuccugucaaaucgucgccccaggcggcagugccguacaagaaagacgugggaaaaacauuguguccgcuguguuucucaauccuuaagggaccgaucuccgaugcacuggcccaccacuugagagaaaggcaucaaguaauccagacaguccaucccguggagaagaaguugacguauaagugcauccauugcuugggaguguauaccucgaacaugacggcgucgacgaucacacugcaucuugugcacugcagaggcgucgguaaaacacagaacggacaggacaaaacuaacgcgcccucacgccucaaccagagccccucgcuggcaccugucaagaggacauaugagcaaauggaauuuccucuuuugaagaagagaaaauuggaugaugauucggacucgcccagcuucuuugaagaaaagccggaagagccgguggucuuggcgcuugacccgaaggggcacgaagaugacagcuacgaggcgaggaaaucauuucucaccaaauacuucaacaaacaaccauauccgacgaggagagagauugaaaaacuggcugccagccucuggcuuuggaagagcgacaucgcgagccacuucuccaauaagcgaaagaaaugugugcgggacugugagaaguauaagcccggaguacugcugggguucaauaugaaggagcuuaacaaaguaaagcaugagauggauuucgaugcggaauggcuuuuugagaaccacgaugaaaaagauucgcgcgugaaugcuucgaaaacagcagacaaaaagcuuaaucuugggaaagaagaugauuccucauccgacucguuugaaaacuuggaagaggaaucgaacgaaagcgggagccccuuugaccccguguuugaagucgagcccaagaucucaaaugauaaucccgaggaacauguauugaaggugauucccgaggacgccucggagucagaggagaagcucgaucagaaggaggacggcuccaaauacgaaacgauccaccuuacggaggagccgacgaaacugaugcacaacgccuccgauuccgaggucgaccaggaugacgucgucgaguggaaggacggugccagccccagcgagucaggaccaggaucacaacaggugucggauuuugaagauaacacgugugagaugaagcccggaacguggucagaugaauccucgcaguccgaagaugcgcggucaagcaaaccggcagcaaagaagaaggccacuaugcagggagauagagagcaacuuaaguggaaaaacagcucauauggaaagguggaaggguucugguccaaggaucagucgcaguggaagaacgcaucagagaaugacgagcgguugucgaauccccaaauugaguggcagaauuccacgaucgacucggaggacggggaacaguucgacaauaugacggauggaguggcggaaccuaugcaugggucgcuggccggagucaaacuuucaucccagcaggcgugauaauaggcugccuucugcggggcuugccuucuggccaugcccuucuucucucccuugcaccuguaccucuuggucuuugaauaaagccugaguaggaag

SEQ ID NO: 21680 - RNA, 1600 nt, Artificial Sequence
  Description of Artificial Sequence: Synthetic transcript sequence
gggaaauaagagagaaaagaagaguaagaagaaauauaagagccaccauggaccguucacugggauggcaagggaauucugucccugaggacaggacugaagcugggaucaagcguuuccuggaggacaccacggaugauggagaacugagcaaguucgugaaggauuucucaggaaaugcgagcugccacccaccagaggcuaagaccugggcauccaggccccaagucccggagccaaggccccaggccccggaccucuaugaugaugaccuggaguucagaccccccucgcggccccaguccucugacaaccagcaguacuucugugccccagccccucucagcccaucugccaggccccgcagcccauggggcaagcuugaucccuaugauuccucugaggaugacaaggaguaugugggcuuugcaacccuccccaaccaaguccaccgaaaguccgugaagaaaggcuuugacuuuacccucaugguggcaggagagucuggccugggcaaauccacacuugucaauagccucuuccucacugaucuguaccgggaccggaaacuucuuggugcugaagagaggaucaugcaaacuguggagaucacuaagcaugcaguggacauagaagagaagggugugaggcugcggcucaccauuguggacacaccagguuuuggggaugcagucaacaacacagagugcuggaagccuguggcagaauacauugaucagcaguuugagcaguauuuccgagacgagaguggccugaaccgaaagaacauccaagacaacagggugcacugcugccuguacuucaucucacccuucggccaugggcuccggccauuggauguugaauucaugaaggcccugcaucagcgggucaacaucgugccuauccuggcuaaggcagacacacugacaccucccgaaguggaccacaagaaacgcaaaauccgggaggagauugagcauuuuggaaucaagaucuaucaauucccagacugugacucugaugaggaugaggacuucaaauugcaggaccaagcccuaaaggaaagcaucccauuugcaguaauuggcagcaacacuguaguagaggccagagggcggcgaguucggggucgacucuaccccuggggcaucguggaaguggaaaacccagggcacugcgacuuugugaagcugaggacaaugcugguacguacccacaugcaggaccugaaggaugugacacgggagacacauuaugagaacuaccgggcacagugcauccagagcaugacccgccugguggugaaggaacggaaucgcaacaaacugacucgggaaagugguaccgacuuccccaucccugcugucccaccagggacagauccagaaacugagaagcuuauccgagagaaagaugaggagcugcggcggaugcaggagaugcuacacaaaauacaaaaacagaugaaggagaacuauugauaauaggcuggagccucgguggccaugcuucuugccccuugggccuccccccagccccuccuccccuuccugcacccguacccccguggucuuugaauaaagucugagugggcggc

SEQ ID NO: 21681 - RNA, 1354 nt, Artificial Sequence
  Description of Artificial Sequence: Synthetic transcript sequence
gggaaauaagagagaaaagaagaguaagaagaaauauaagagccaccaugguggccgguacccgcugccuccucgcgcugcuuuugccccaaguguugcuggguggcgcagccggacucgucccagagcuuggacgaaggaaguuugcagcagccucgucagguagacccucuucgcaaccuucggaugaggugcugagcgaauuugaauugcggcugcucuccauguuuggacugaagcagcguccgacuccaucgcgcgacgcgguggugccaccuuacaugcuugaccucuaccgcagacacagcggacaaccuggcagcccugcacccgaucaccggcuggagagagcagcaagcagggcaaauacuguccggucguuucaucaugaagagagccuugaagaacugccagaaaccuccggaaagaccacgagacgguuuuucuucaaucuuucuucgauuccaaccgaagaauucauaacuagcgcagaacuucaaguuuuucgcgagcagaugcaagaugcacuuggaaacaacuccucauuccaucaucgaaucaacauauacgaaaucaucaagccggcaaccgccaacucaaaguucccggugacucgucugcuugauacgcgccuggucaaccaaaacgcuucccgcugggaaucauucgaugucaccccagccguuaugagauggacugcucaaggacacgcaaaccauggguuugugguggaaguggcccaucuugaagaaaagcagggggugagcaagcgucacgugagaauuucgagaucccugcaucaggaugaacauucauggucgcaaauucggccacuccuggucacuuuuggccacgaugguaaaggacacccucugcauaagagggagaaaagacaggcgaagcauaaacagaggaagagacugaaguccagcugcaagcgacauccccuuuacguggacuucucggacgugggguggaaugacuggauuguggcaccuccuggcuaccacgccuuuuacugucauggagaaugucccuuuccacuggcggaucaccucaauuccaccaaucaugcaauugugcaaacccuugugaacucagucaauuccaaaaucccuaaggcuuguugugucccuacugagcucuccgcaauuucgaugcucuaccuugaugagaacgagaaagucgugcugaaaaacuaucaggacauggucguggaggguugugguugccggugauaauaggcuggagccucgguggccaugcuucuugccccuugggccuccccccagccccuccuccccuuccugcacccguacccccguggucuuugaauaaagucugagugggcggc

SEQ ID NO: 21682 - RNA, 736 nt, Artificial Sequence
  Description of Artificial Sequence: Synthetic transcript sequence
gggaaauaagagagaaaagaagaguaagaagaaauauaagagccaccauggcggcgggcgagcuugaggguggcaaaccccugagcgggcugcugaaugcgcuggcccaggacacuuuccacggguaccccggcaucacagaggagcugcuacggagccagcuauauccagaggugccacccgaggaguuccgccccuuucuggcaaagaugagggggauucuuaagucuauugcgucugcagacauggauuucaaccagcuggaggcauucuugacugcucaaaccaaaaagcaaggugggaucacaucugaccaagcugcugucauuuccaaauucuggaagagccacaagacaaaaauccgugagagccucaugaaccagagccgcuggaauagcgggcuucggggccugagcuggagaguugauggcaagucucagucaaggcacucagcucaaauacacacaccuguugccauuauagagcuggaauuaggcaaauauggacaggaaucugaauuucuguguuuggaauuugaugaggucaaagucaaccaaauucugaagacgcugucagagguagaagaaaguaucagcacacugaucagccagccuaacugauaauaggcuggagccucgguggccaugcuucuugccccuugggccuccccccagccccuccuccccuuccugcacccguacccccguggucuuugaauaaagucugagugggcggc

SEQ ID NO: 21683 - RNA, 883 nt, Artificial Sequence
  Description of Artificial Sequence: Synthetic transcript sequence
gggaaauaagagagaaaagaagaguaagaagaaauauaagagccaccauggcggcucugaagaguuggcugucgcgcagcguaacuucauucuucagguacagacaguguuuguguguuccuguuguggcuaacuuuaagaagcgguguuucucagaauugauaagaccauggcacaaaacugugacgauuggcuuuggaguaacccugugugcgguuccuauugcacagaaaucagagccucauucccuuaguagugaagcauugaugaggagagcagugucuuugguaacagauagcaccucuaccuuucucucucagaccacauaugcguugauugaagcuauuacugaauauacuaaggcuguuuauaccuuaacuucucuuuaccgacaauauacaaguuuacuugggaaaaugaauucagaggaggaagaugaaguguggcaggugaucauaggagccagagcugagaugacuucaaaacaccaagaguacuugaagcuggaaaccacuuggaugacugcaguuggucuuucagagauggcagcagaagcugcauaucaaacuggcgcagaucaggccucuauaaccgccaggaaucacauucagcuggugaaacugcagguggaagaggugcaccagcucucccggaaagcagaaaccaagcuggcagaagcacagauagaagagcuccgucagaaaacacaggaggaaggggaggagcgggcugagucggagcaggaggccuaccugcgugaggauugauaauaggcuggagccucgguggccaugcuucuugccccuugggccuccccccagccccuccuccccuuccugcacccguacccccguggucuuugaauaaagucugagugggcggc

SEQ ID NO: 21684 - RNA, 2342 nt, Artificial Sequence
  Description of Artificial Sequence: Synthetic transcript sequence
gggaaauaagagagaaaagaagaguaagaagaaauauaagagccaccaugagcgagacuucgcggacggccuuugguggacggagggccgugccuccgaacaauucaaaugcagccgaggacgaucugccgacggucgaauugcagggcgucguaccacgcggagugaaucuccaagaguuccuuaacgugaccucgguacaucuguuuaaggagcggugggacacgaauaagguggaucaucacaccgacaaauaugaaaacaacaagcucaucgucagacgcgggcagagcuuuuauguccagauugacuucucgcgaccuuacgaucccagacgagacuuguuccggguggaguaugugaucgggagguauccgcaagagaacaagggaacuuacaucccgguccccauuguaucggagcuucaguccgggaaguggggugcaaagaucguaaugcgcgaggaccggucggugcgguuguccauucaguccagcccaaaaugcaucgucgggaaauuucggauguacguagcgguguggacucccuauggugugcuuagaacaagccggaaccccgaaacugauacguacauucucuuuaacccguggugcgaggaugacgcggucuaucuggacaacgagaaggagcgcgaggaguacgugcucaaugacaucggagugauuuucuacggagaggugaaugacaucaagacgcggucguggucguaugggcaguuugaagaugggauucucgacaccugucucuaugucauggauagggcgcagauggaccugucgggaaggggaaaccccaucaaagucucgcgaguggguagcgcgaugguaaacgcgaaggacgaugaagggguccucgucggaucaugggacaacaucuacgcuuacggcgugccaccgucggccuggaccgggagcgucgacauccugcuggaauaccggucaagcgagaacccggugcgcuacgggcaguguugggucuuugcuggugucuuuaacacuuuccuucgcugucucgggauucccgcgagaauugucacgaacuacuuuucggcacaugauaaugaugcgaaucuucaaauggacaucuuuuuggaggaggacgguaaugucaauucaaaauugacgaaggacuccguguggaauuaucacuguuggaaugaggccuggaugacucggccugaucucccggugggcuucggugguuggcaggcuguagacucaacaccccaagaaaacuccgaugguauguacagaugcgggccugcgucagugcaggcgauuaagcauggacacguaugcuuccaguucgaugcacccuuugucuuugcggaagugaauagcgaccuuaucuacaucacagccaaaaaggacgggacucauguaguggagaacgucgaugccacacauauuggaaaguugauuguaacgaagcagaucggcggugauggaaugauggacauuacugacacauacaaguuccaggaggggcaggaagaagaacgccuugcauuggaaacggcguugauguauggggcgaagaaaccccuuaacacagaaggagugaugaagucgagaagcaauguggacauggauuucgagguggagaaugcagugcugggaaaagauuucaaguugucaaucaccuuucgcaacaauucccacaaucgauauacaaucacagcauaucucucggccaauaucacauucuacacgggcgugccuaaagcggaguucaagaaagaaacguuugacgugacgcucgaaccuuugucguucaaaaaggaggcaguacucauucaggcgggagaguacaugggccagcuucuugagcaagcgagccuccacuucuucguaacugcacgcaucaacgaaacccgcgacguacucgcaaaacagaaaucgacgguguugacgauccccgaaaucaucaucaaagugagagguacacaagucguaggcucagauaugaccgugacaguccaguucacuaaucccuugaaagagacacugcggaacgucuggguccaccuugauggacccggggucacaaggcccaugaagaaaauguucagagaaauccgaccuaacucgacggugcaaugggaggagguaugcaggccguggguauccggacaccgaaagcugauugccucgaugucgagcgauucccugcggcacguauacggggagcucgacgugcagauccagaggcgcccaucaaugugauaagcugccuucugcggggcuugccuucuggccaugcccuucuucucucccuugcaccuguaccucuuggucuuugaauaaagccugaguaggaag

SEQ ID NO: 21685 - RNA, 1952 nt, Artificial Sequence
  Description of Artificial Sequence: Synthetic transcript sequence
gggaaauaagagagaaaagaagaguaagaagaaauauaagagccaccauggaacuuggacacccacucauucuuucagugacgucgggagucuacagccagguacaguugcagcaaagcggugcagagcuggcacgcacgggugccuccgucaaacugagcugcaaagcauccggauacaccuucacgucguauuggaugcaguggguaaagcaaaggcccggucagggccuugaauggaucggugcaaucuaccccggugacggugacaccagauauacgcagaaguucaaggggaaagcgacucucaccgcagacaagagcuccucgaccgcuuauaugcaacuguccucacucgcaagcgaggauucagcaguguacuauugugaacgagaaaggggagauuacuggggccagggaacgucagucacaguguccucgggaucggcgucggcgccaacacuuuuuccguuggugagcugcgaaaacucgccgucagauacgagcucagucgcaguagguuguuuggcccaagacuuccuuccggacagcauuacguucucauggaaauacaagaauaacagcgacaucucaucgacaaggggauucccgucggugcugcgcgguggcaaauacgcggcaaccagccaggugcuucucccuuccaaggauguaaugcaggguacugacgagcacgucgucuguaaggugcagcauccuaacggaaacaaagaaaagaaugugccgcuucccgucaucgcggaacuucccccuaagguaucgguguuugugcccccaagggacggauucuuuggcaacccucgcaagucaaaauugauuugccaggcuacaggguuuuccccucgacagauccaggugucguggcuccgagagggaaaacaagugggaucgggagucacaacggaucagguccaggcggaggcgaaagagucgggaccuacgacauacaaggugacauccacucugacuauuaaggaaagcgauuggcucucacagucgauguuuacaugucgggucgaccaucgcgggcugaccuuucagcagaaugcuucaucgaugugcgugccggaucaagauaccgcgauucgcguauucgccaucccacccuccuucgccagcaucuuccucacgaaauccacgaaguugacaugucuugucaccgaucugacaacguaugauucggugacgauuucguggacgcggcagaauggcgaggcugugaaaacccauacaaacaucagcgagagccacccgaacgcgaccuuuuccgcggucggggaagccucaauuugcgaagaugauuggaacagcggagagcgauucacauguaccgucacucacacggaucugcccucgccuuugaagcagacuaucagccgcccuaaaggggucgcgcuucauagacccgacguguaucuccugccuccugccagagagcagcugaauuugcgagaaucggcgacgauuaccugucucgugacuggcuuuucgccagccgauguauucguccaauggaugcaaagagggcagcccuugucgcccgagaaguauguaaccucagcgccgaugcccgaaccgcaggccccugggcgguacuucgcucacucgauuuugacggugucggaagaggaguggaauacgggggagacuuacacuugcgucgucgcgcacgaggcacucccgaaucgggugacugagcgcacaguggacaagucaaccgggaaaccuacguuguauaaugucagccucgucaugucagauaccgccggaacgugcuaucccaccuuguacaacguaucaguggugauggcugagguagacggcacuugcuacugaagcgcugccuucugcggggcuugccuucuggccaugcccuucuucucucccuugcaccuguaccucuuggucuuugaauaaagccugaguaggaag

SEQ ID NO: 21686 - RNA, 635 nt, Artificial Sequence
  Description of Artificial Sequence: Synthetic transcript sequence
gggaaauaagagagaaaagaagaguaagaagaaauauaagagccaccaugagaucgucaccgggaaacauggagcggauugucauuuguuugauggugauuuuccucgguacucuuguacacaaaucgucaucccagggacaggacaggcacaugaucagaaugcggcagcugaucgacaucguagaucaguugaaaaacuacgugaaugaucugguccccgaguuccuuccagcgcccgaggacguggaaacaaacugcgaguggucagcauuuucgugcuuucaaaaggcccagcuuaaguccgcgaauacgggcaacaacgaaaggaucauuaaugucuccaucaagaaguugaagagaaaaccgccuucaaccaaugcugggaggcgccaaaaacaucggcucacaugccccucgugugacagcuaugagaagaagccuccgaaggaauuucucgagcgcuucaaaucguugcuccagaaaaugauccaccagcaucugagcucgcgaacgcacgggagcgaagauuccugauaauaggcugccuucugcggggcuugccuucuggccaugcccuucuucucucccuugcaccuguaccucuuggucuuugaauaaagccugaguaggaag

SEQ ID NO: 21687 - RNA, 1748 nt, Artificial Sequence
  Description of Artificial Sequence: Synthetic transcript sequence
gggaaauaagagagaaaagaagaguaagaagaaauauaagagccaccauggcgacggcgcuuauggccgucguccuucgagcggcagcgguggcgcccagacucagggguagaggagggacgggaggagcuagacggcugucguguggagccagacggcgagcggcgagaggaacgucacccggacgccgccuuucgacggcguggucccagccucagccgccuccagaggaauaugcuggggccgaugacguaucccagagcccgguagccgaggagccgucguggguccccagcccgaggccuccggugccccacgagucaccggaaccacccagcggucgcucgcucguccaacgggauauucaggcguuucugaaccagugcggagcaucgccgggagaagcgaggcacuggcugacccaguuccaaaccugucaucacuccgcugacaaacccuuugcagucauugaaguagacgaggaagugcucaagugccagcaaggggugucguccuuggcguucgcgcucgcguuccuucagaggauggacaugaaaccccuuguggugcuuggccucccugccccuacugccccuucgggaugucuguccuuuugggaagcgaaagcgcaacuggccaaaucguguaaggucuuggucgacgcauugagacauaaugccgcagcagccgugccguucuuuggaggcgguuccguccuuagagcugcggagccagcgccccacgccucguauggcggaauugucuccguggagacagauuugcuucaguggugccucgagucagguagcauccccauucuuugccccaucggagaaacugcagcaaggcgcagcguguugcuugacagccucgagguaacagccucccucgcaaaagcuuugaggcccaccaagaucaucuuucuuaacaacacgggaggauugcgagauucgagccauaagguacuuucaaaugugaauuugccggcagaucuggaccucguaugcaaugccgaguggguguccacaaaggaacgccagcagaugaggcugauuguggaugugcuuucgagacucccgcaccacucaucagcgguaaucacugcagcgagcacucugcugacggagcuguucagcaauaagggcucagggacgcucuucaagaacgcggaaagaaugcuucggguccggagccuggacaaauuggaucaggggcgacuugucgaucucgucaacgcgucauuugggaaaaagcugcgggacgacuaucuggcgucguugcgaccacgccuccacucgaucuacgugucggaggguuacaacgcagccgcaaucuugacaauggaaccagucuugggagggacaccguaccucgauaaguucguggugucgucgucacggcagggccaggguagcggucaaaugcucugggagugucugaggcgggacuugcagacccucuuuuggcgcucccgcgugacaaaucccaucaauccuugguacuuuaagcauucggaugggucguucucgaacaaacaguggauuuucuuuugguucggacuugcggacauccgagacucauacgaguugguaaaccaugcgaagggguugcccgauucguuccacaagcccgcaucagaccccgggucaugauaagcugccuucugcggggcuugccuucuggccaugcccuucuucucucccuugcaccuguaccucuuggucuuugaauaaagccugaguaggaag

SEQ ID NO: 21688 - RNA, 1657 nt, Artificial Sequence
  Description of Artificial Sequence: Synthetic transcript sequence
gggaaauaagagagaaaagaagaguaagaagaaauauaagagccaccaugacuuuuaacaguuuugaaggaucuaaaacuuguguaccugcagacaucaauaaggaagaagaauuuguagaagaguuuaauagauuaaaaacuuuugcuaauuuuccaagugguaguccuguuucagcaucaacacuggcacgagcaggguuucuuuauacuggugaaggagauaccgugcggugcuuuaguugucaugcagcuguagauagauggcaauauggagacucagcaguuggaagacacaggaaaguauccccaaauugcagauuuaucaacggcuuuuaucuugaaaauagugccacgcagucuacaaauucugguauccagaauggucaguacaaaguugaaaacuaucugggaagcagagaucauuuugccuuagacaggccaucugagacacaugcagacuaucuuuugagaacugggcagguuguagauauaucagacaccauauacccgaggaacccugccauguauagugaagaagcuagauuaaaguccuuucagaacuggccagacuaugcucaccuaaccccaagagaguuagcaagugcuggacucuacuacacagguauuggugaccaagugcagugcuuuuguugugguggaaaacugaaaaauugggaaccuugugaucgugccuggucagaacacaggcgacacuuuccuaauugcuucuuuguuuugggccggaaucuuaauauucgaagugaaucugaugcugugaguucugauaggaauuucccaaauucaacaaaucuuccaagaaauccauccauggcagauuaugaagcacggaucuuuacuuuugggacauggauauacucaguuaacaaggagcagcuugcaagagcuggauuuuaugcuuuaggugaaggugauaaaguaaagugcuuucacuguggaggagggcuaacugauuggaagcccagugaagacccuugggaacaacaugcuaaaugguauccagggugcaaauaucuguuagaacagaagggacaagaauauauaaacaauauucauuuaacucauucacuugaggagugucugguaagaacuacugagaaaacaccaucacuaacuagaagaauugaugauaccaucuuccaaaauccuaugguacaagaagcuauacgaaugggguucaguuucaaggacauuaagaaaauaauggaggaaaaaauucagauaucugggagcaacuauaaaucacuugagguucugguugcagaucuagugaaugcucagaaagacaguaugcaagaugagucaagucagacuucauuacagaaagagauuaguacugaagagcagcuaaggcgccugcaagaggagaagcuuugcaaaaucuguauggauagaaauauugcuaucguuuuuguuccuuguggacaucuagucacuuguaaacaaugugcugaagcaguugacaagugucccaugugcuacacagucauuacuuucaagcaaaaaauuuuuaugucuugauaauaggcuggagccucgguggccaugcuucuugccccuugggccuccccccagccccuccuccccuuccugcacccguacccccguggucuuugaauaaagucugagugggcggc

SEQ ID NO: 21689 - protein, 11 aa, Homo sapiens
ISFNFFVTAPK

SEQ ID NO: 21690 - protein, 8 aa, Homo sapiens
LWAWESWR

SEQ ID NO: 21691 - protein, 15 aa, Homo sapiens
SEPWTLALENVVGAK

SEQ ID NO: 21692 - protein, 10 aa, Homo sapiens
NVHSEDFENR

SEQ ID NO: 21693 - protein, 21 aa, Homo sapiens
ESGTDFPIPAVPPGTDPETEK

SEQ ID NO: 21694 - protein, 13 aa, Homo sapiens
FLEDTTDDGELSK

SEQ ID NO: 21695 - protein, 8 aa, Homo sapiens
HAVDIEEK

SEQ ID NO: 21696 - protein, 13 aa, Homo sapiens
NYQDMVVEGCGCR

SEQ ID NO: 21697 - protein, 17 aa, Homo sapiens
SFHHEESLEELPETSGK

SEQ ID NO: 21698 - protein, 12 aa, Homo sapiens
WESFDVTPAVMR

SEQ ID NO: 21699 - protein, 12 aa, Homo sapiens
ALYLQYTDETFR

SEQ ID NO: 21700 - protein, 14 aa, Homo sapiens
DIASGLIGPLIICK

SEQ ID NO: 21701 - protein, 13 aa, Homo sapiens
GAYPLSIEPIGVR

SEQ ID NO: 21702 - protein, 8 aa, Homo sapiens
ESLMNQSR

SEQ ID NO: 21703 - protein, 18 aa, Homo sapiens
HSAQIHTPVAIIELELGK

SEQ ID NO: 21704 - protein, 6 aa, Homo sapiens
WNSGLR

SEQ ID NO: 21705 - protein, 10 aa, Homo sapiens
AVYTLTSLYR

SEQ ID NO: 21706 - protein, 10 aa, Homo sapiens
LAEAQIEELR

SEQ ID NO: 21707 - protein, 7 aa, Homo sapiens
NHIQLVK

SEQ ID NO: 21708 - protein, 13 aa, Homo sapiens
MYVAVWTPYGVLR

SEQ ID NO: 21709 - protein, 12 aa, Homo sapiens
STVLTIPEIIIK

SEQ ID NO: 21710 - protein, 7 aa, Homo sapiens
VEYVIGR

SEQ ID NO: 21711 - protein, 16 aa, Homo sapiens
DTHFPIBIFBBGBBHR

SEQ ID NO: 21712 - protein, 8 aa, Homo sapiens
TSTSPIVK

SEQ ID NO: 21713 - protein, 7 aa, Homo sapiens
WIYDTSK

SEQ ID NO: 21714 - protein, 8 aa, Homo sapiens
WKIDGSER

SEQ ID NO: 21715 - protein, 7 aa, Homo sapiens
IINVSIK

SEQ ID NO: 21716 - protein, 11 aa, Homo sapiens
LTBPSBDSYEK

SEQ ID NO: 21717 - protein, 10 aa, Homo sapiens
QLIDIVDQLK

SEQ ID NO: 21718 - protein, 8 aa, Homo sapiens
DLQTLFWR

SEQ ID NO: 21719 - protein, 10 aa, Homo sapiens
DSYELVNHAK

SEQ ID NO: 21720 - protein, 17 aa, Homo sapiens
HNAAAAVPFFGGGSVLR

SEQ ID NO: 21721 - protein, 13 aa, Homo sapiens
AGFLYTGEGDTVR

SEQ ID NO: 21722 - protein, 18 aa, Homo sapiens
DHFALDRPSETHADYLLR

SEQ ID NO: 21723 - protein, 13 aa, Homo sapiens
IFTFGTWIYSVNK

SEQ ID NO: 21724 - RNA, 311 nt, Artificial Sequence; identical to SEQ ID NO: 1644
  Description of Artificial Sequence: Synthetic transcript sequence

SEQ ID NO: 21725 - RNA, 494 nt, Artificial Sequence; identical to SEQ ID NO: 1647
  Description of Artificial Sequence: Synthetic transcript sequence

SEQ ID NO: 21726 - RNA, 299 nt, Artificial Sequence
  Description of Artificial Sequence: Synthetic transcript sequence
gggaaauaagagagaaaagaagaguaagaagaaauauaagagccaccauggccggacccgcgacgcagucaccgaugaagcucauggcucuucaguugcuccucuggcacucggcgcuguggacagugcaagaggcaaaacuucuccugcugaagcuccuucuguugaaauuguugcuucucaaguugcuuuugcugaaauaaugagcugccuucugcggggcuugccuucuggccaugcccuucuucucucccuugcaccuguaccucuuggucuuugaauaaagccugaguaggaag

SEQ ID NO: 21727 - RNA, 1613 nt, Artificial Sequence
  Description of Artificial Sequence: Synthetic transcript sequence
gggaaauaagagagaaaagaagaguaagaagaaauauaagagccaccauggccccugucgcggugugggcggcucuugcgguaggccucgaacucugggcggcagcucacgcccugccagcccaagucgccuucacgccuuacgcgccagaacccgggucaacuugucgccuuagggaguauuaugaccaaacggcucagauguguugcagcaaaugcucgccagggcagcacgcaaaaguguuuuguacuaagacguccgauacgguaugugauucaugugaggacuccaccuacacucagcuuuggaauugggugcccgagugccugucaugcgggucgcgcugcucgucggaucagguagaaacucaagcgugcacucgagaacagaacagaauuuguacgugcaggcccgguugguacugcgccuugucgaagcaggaaggcugcaggcuuugugcgccgcuucgcaaguguaggccuggauuuggagucgcgaggccgggaaccgagacauccgacguagucuguaagcccugugcuccgggaacguucuccaacacaacuucgagcacggacaucugucggccccaccagauuugcaauguaguggcaauccccgggaacgcgucaauggacgccgucuguacguccaccucgcccacuagauccauggcaccgggagcagugcauuugccgcagcccgugucgacgcgaucacagcacacacagcccacaccagagccuucgacagcgccgucgacaucauucuugcugccgauggggccgucgccgccugccgagggcucaacuggugaugagccgaaaagcugcgacaaaacgcauacauguccgcccugccccgcucccgaacuccucggugggccuagcguguuucuguucccaccaaaaccgaaagauaccuugaugaucucacggaccccugaagugacgugcguggucgucgaugucucgcaugaggaccccgaggugaaguuuaacugguacgucgacggaguggaagugcacaaugccaagaccaagcccagagaggaacaguacaacuccacuuacagagucgugucgguacucacugucuugcaucaggauuggcugaacggaaaggaguauaagugcaaaguaucgaacaaagcgcugccagcgccgaucgagaaaacaaucagcaaagcgaagggacagccucgcgaaccucaaguguauacguugccgcccucacgagaggaaaugacgaagaaucaggucagccucacgugcuuggugaaaggcuucuauccgagcgauauugccguggagugggaguccaauggucagccagagaacaauuacaagacgacaccgccugucuuggauucggacgggagcuuuuucuuguacucgaaacucacgguagacaagagcagauggcaacaggggaauguauucucguguucagugaugcacgaggcgcuccacaaccauuauacacaaaagucgcucucguugucaccgggaaagugauaagcugccuucugcggggcuugccuucuggccaugcccuucuucucucccuugcaccuguaccucuuggucuuugaauaaagccugaguaggaag

SEQ ID NO: 21728 - RNA, 2228 nt, Artificial Sequence
  Description of Artificial Sequence: Synthetic transcript sequence
gggaaauaagagagaaaagaagaguaagaagaaauauaagagccaccaugacguuugggcaaucgaaacuguauagguccgaagauuacgggaagaauuucaaagauauuacggauuugaucaauaacaccuucaucagaacugaguucgguauggccaucgguccagaaaauucgggaaaagugguccucacagcagaggugucaggaggcucgcgcggagggcggauuuuucgcucaucggacuuugccaagaacuucgugcagacugaccucccauuucacccgcucacacaaaugauguauucaccgcagaacucagacuaccuccuggcguugucaacggagaauggccuuuggguauccaagaauuuuggagggaagugggaggaaauucauaaagccgugugccuugcgaagugggguagcgacaauaccaucuucuuuacaacguaugcuaacggcucauguacggaucuuggugcgcuugaauuguggagaacuucggaucucggaaagucguucaaaacgauuggugugaaaaucuacagcuuugggcugggaggaagguuccucuuugcuuccgugauggcagacaaagacacgacuaggaggauucacgugucaaccgaccagggagacacguggucaauggcacaacugccgagcguaggccaggagcaguucuauucaauccuugcggcgaacgaugauauggucuuuaugcacgucgaugagccaggugauacaggguuuggaacuaucuuuacaucagaugaucgagggaucguguauucaaaaucgcucgaccgacaucucuacaccacaacugguggugagacugauuucacgaacgucaccucacugcgcggaguguauaucacauccgugcuuagcgaggacaauuccauccagaccaugaucacguuugaccaaggaggaagauggacacauuugagaaaacccgagaacagcgaaugcgacgccacugcuaagaacaaaaacgagugcucguugcacauccacgcuuccuauucgauuucacaaaagcugaauguaccuauggcaccucucucggagccuaacgcaguagggaucguaaucgcucaugguucggugggagaugccaucucaguaaugguccccgaugucuauaucucggaugacgggggauacucauggacaaaaaugcuugagggaccccauuacuauacuauuuuggacucagggggcaucauuguagccaucgaacacucaucgaggcccauuaacguaaucaaguucucaacagacgaaggacaaugcuggcaaacguauacuuuuacgcgagauccaaucuacuucacggggcuggccuccgagccaggagcccggucgaugaauaucucaaucuggggcuucaccgagucguuccuuacgucccagugggugucauauacaaucgacuucaaagacauccuugaacgcaauugugaggaaaaggacuacacaauuuggcuggcacauucgaccgaccccgaggacuacgaggacggcuguauucugggguacaaagagcaguuccuucgcuugcggaagucaagcguaugucagaacgggcgagauuacgucguaacgaagcagccuucaaucugucuguguucgcuugaggacuuucuuugcgacuucgguuacuacagacccgaaaaugacucgaagugugucgagcagccugaacucaaggggcaugacuuggaauuuugcuuguacgggagagaggaacaccuuacuacaaauggguacagaaagauccccggagacaagugccagggugggguaaaccccgugagggaggucaaggaccucaaaaagaaaugcaccucaaacuuucucucgccggaaaagcagaauagcaaguccaauagcgucccuaucauccucgccauugucggucuuauguuggugacuguaguggcaggugugcugauugucaaaaaguaugugugcggagggagguucuuggugcaucgguauagcguguugcagcaacacgcggaagcuaacggagucgaugguguggaugcccuggauacagcgucgcacacaaacaagagcggcuaccacgacgacagcgacgaggaucuccuugagugaagcgcugccuucugcggggcuugccuucuggccaugcccuucuucucucccuugcaccuguaccucuuggucuuugaauaaagccugaguaggaag

SEQ ID NO: 21729 - RNA, 857 nt, Artificial Sequence
  Description of Artificial Sequence: Synthetic transcript sequence
gggaaauaagagagaaaagaagaguaagaagaaauauaagagccaccauggacuuccagguacaaaucuuuagcuuccugcugaucuccgcgagcguuaucaucagccguggccaaauugugcugacccaguccccugcgauuaugagcgcaagcccgggugaaaaagugacgaugacguguagcgcgucgagcagcgucaccucuaugcacugguuucagcagaaguccgguacuucuccgaaacgcuggauuuacgauacgucgaaacuggcuagcggcgucccggcucguuucagcgguagcgguuccgguaccagcuacagcuugaccaucagcauuauggaggcggaggacgcggccaccuauuacugccaacaauggaacuauaacccaccgauggguaccuuugguggcggcaccaaguuggagaucaagcgugccgacgccgcaccgaccguuuccauuuucccgccgagcuccgaacagcugaccagcggcggugcgucugugguuuguuuucugaauaacuucuacccgaaagauaucaauguuaaguggaaaauugauggcagcgagcgccaaaauggugugcugaacagcuggacggaccaggauagcaaagauagcaccuauagcaugagcagcacgcugacgcugaccaaggacgaguacgaacgucacaacagcuauacuugcgaggcaacccauaaaaccucuacgagcccgauugucaagagcuuuaaucgcaaugaaugcuaaagcgcugccuucugcggggcuugccuucuggccaugcccuucuucucucccuugcaccuguaccucuuggucuuugaauaaagccugaguaggaag

SEQ ID NO: 21730 - RNA, 1502 nt, Artificial Sequence; identical to SEQ ID NO: 1663
  Description of Artificial Sequence: Synthetic transcript sequence

SEQ ID NO: 21731 - RNA, 1712 nt, Artificial Sequence; identical to SEQ ID NO: 1639
  Description of Artificial Sequence: Synthetic transcript sequence

SEQ ID NO: 21732 - RNA, 3839 nt, Artificial Sequence
  Description of Artificial Sequence: Synthetic transcript sequence
gggaaauaagagagaaaagaagaguaagaagaaauauaagagccaccaugagguuguuggcuaagaucauuugccuuaugcugugggcgaucugugucgccgaggacuguaaugagcuuccgccucggaggaauacggaaauccucacggguagcuggucggaucagaccuaucccgagggaacccaggcgaucuacaagugccgaccgggguaucgaucacucgggaacgugaucaugguaugccggaagggagaauggguggcgcugaacccccuucgcaaaugucagaaaagaccgugcggccaccccggugacaccccuuuugggacuuuuacacugacuggaggcaaugucuuugaguacggggucaaggcgguauacacuuguaaugagggauaucaacugcucggagaaaucaacuacagggagugugauacggacggauggacgaacgacauccccauuugugaggucgugaagugccuucccgugaccgcgccugaaaacggaaaaaucguaucgagcgcaauggaaccagaccgggaauaucacuucgggcaggccguacgguucguaugcaacagcggcuauaagaucgagggugacgaagaaaugcauuguucggaugauggguuuugguccaaagaaaaacccaaauguguagagaucucgugcaaaucaccugacgucaucaacggcucccccauuagccagaagaucaucuacaaggaaaaugagcgcuuccaguacaaauguaacaugggcuacgaauacagcgaacggggugacgcagugugcacagaaucgggauggaggccgcucccuucgugugaagaaaaaucaugugauaacccguacauucccaauggugauuacucgccgcuuaggaucaaacacagaaccggugacgagauuacguaucaaugccgaaacggguuuuaccccgccacucgggggaacacggcuaagugcaccuccacgggauggauuccagcaccgcggugcacauugaaaccuugugacuaccccgacauuaaacacggcgguuuguaccaugagaacaugcgacggccauauuuccccguggcggucggaaaauacuacucauauuacugugaugaacacuuugaaaccccgagcggaucguacugggaucacauucacuguacgcaagacgggugguccccggcagugccgugccucagaaagugcuauuucccauacuuggaaaauggguacaaccaaaaccacgggagaaaauucguccagggaaaaucaauugacguggcgugucaucccggauaugcccugcccaaggcucagacgacggucacguguauggagaacggauggagcccuacuccucgguguauuagggugaaaacaugcucgaaguccagcauugauaucgaaaauggcuuuaucucggaaucgcaguacaccuacgcucugaaggagaaagcgaaauaucagugcaaacucgguuaugugacggcggacggagaaacuucgggaucgauuacgugcgguaaagauggcuggucggcacaacccacaugcaucaagucgugugacaucccgguguucaugaaugcgcgcacgaagaacgauuucacgugguuuaaguugaacgacacgcucgauuaugaaugucaugacggguacgagucaaacaccgggucaaccacuggaagcaucguauguggguacaauggguggagcgaccuccccauuugcuaugaaagagagugcgaacuucccaaaaucgaugugcaucucgugccggaccgaaagaaggaccaguauaaagugggagaaguccucaaguuuagcugcaaaccgggguucacuaucgucgggcccaauucaguccagugcuaucacuuuggacucucacccgauuugccaauuugcaaggaacaagugcagagcuguggaccacccccagagcugcuuaauggcaacguaaaagagaaaacaaaggaagaguacggacauucggaggugguggaguauuacugcaacccccgguuucugaugaagggacccaacaagauccaaugcgucgauggagaauggaccacucugccugucuguauugucgaagaaucaacaugcggagacauucccgaguuggaacacgggugggcucagcuuucgagcccuccuuacuauuauggggauuccguagaguucaauugcagcgagucauucacaaugaucggccaccgaucaauuacuuguauccacggggucuggacacagcuuccacagugugucgcaaucgauaagcucaagaagugcaaaucaagcaaccugaucauuuuggaggagcaucucaagaacaagaaagaauuugaucauaauucaaacauuagguaucgcugcagaggaaaagaagguuggauucacacuguaugcaucaacgggcgaugggaccccgaggugaacuguucgauggcacaaauccagcuuugcccgccuccgccucagauuccaaacucccacaauaugaccacaacauugaauuaucgggacggagagaaaguauccgugcugugccaagagaauuaucucauccaagagggugaggaaaucacguguaaggauggccgguggcagucgaucccguuguguguagaaaagaucccgugcucgcaacccccucaaaucgagcacggaacaaucaauucaucgcggucaagccaagaaagcuacgcgcauggaacaaaguuguccuacacgugugaaggaggguucagaaucagcgaagaaaacgaaaccaccuguuauauggggaaguggucgucaccaccccagugugaggggcugccauguaaguccccucccgagaucucccauggggucgucgcgcacaugucggacagcuaccaguacggagaggaggucacuuacaaauguuucgagggauuuggaaucgacgguccagcgaucgccaaaugcuugggagaaaaguggucccaucccccgagcuguauuaagacggacugucucagccuccccucguucgagaaugccauuccgaugggggagaagaaagauguguacaaggcgggagaacaggucacauacacaugugcgacauacuauaagauggauggggcgagcaacgucacuugcaucaacucacgguggacaggcagaccgacgugccgcgauaccucaugugucaauccuccuacugugcagaacgcauacaucguaucacggcagaugucgaaguaccccuccggugagagagugagauaccagugcagaagccccuaugaaauguuuggcgacgaggaagugaugugccuuaacgguaacuggaccgaaccuccccaguguaaagauagcacggggaagugcggaccgccuccucccauugacaauggagauauuacgucguuuccacugucgguguacgcaccagcuucguccgucgaguaccagugccaaaaucucuaucaguuggagggaaacaaacggauuacgugucgcaacggacaguggagcgagcccccuaagugucuccaccccugcguaauuagcagggagauuauggaaaacuauaacauugcgcuucgguggacggcuaagcagaaacucuacagcagaacuggagagagcgucgaguuuguaugcaagcgagguuauagguugucaucgaggucccacacauugaggacgacgugcugggacggcaaacuggaguaucccacgugcgcuaaaagguaaugagcugccuucugcggggcuugccuucuggccaugcccuucuucucucccuugcaccuguaccucuuggucuuugaauaaagccugaguaggaag

SEQ ID NO: 21733 - RNA, 578 nt, Artificial Sequence; identical to SEQ ID NO: 1627
  Description of Artificial Sequence: Synthetic transcript sequence

SEQ ID NO: 21734 - RNA, 1793 nt, Artificial Sequence
  Description of Artificial Sequence: Synthetic transcript sequence
gggaaauaagagagaaaagaagaguaagaagaaauauaagagccaccaugcccgcgucggcaccgccgagaaggccccgaccuccuccaccuucacuuagccugcugcuggugcuccucggacugggaggacggaggcugagggccgaacccggagauggggcucaaacgugggccagguucucacggccaccggcucccgaggcugccggcuuguuccaaggaacguuuccggacggguuccuuugggcgguaggaucggcggcauaccagacggagggaggguggcagcagcacgguaaaggggcaucaauuugggacacguucacucaucacccgcucgcuccaccgggugacuccagaaaugcuucgcuuccgcuuggagcacccucaccccuucaaccggccacuggggaugucgcgucagauucguacaauaauguguuucgcgauaccgaagcccuuagagaacuuggcgucacacauuaccgauuuucaauuucaugggcuaggguguugccuaaugggucggcggguguaccgaauagagaaggucugagguauuaucgccgccuucucgaacgccuuagggagcuugggguccaaccggugguaacacuuuaucacugggaccucccacagcggcuccaagaugcguauggagggugggccaaucgggcguuggccgaccacuuuagagacuacgcggaacuuugcuuucgccacuucggaggacaggucaaguauuggauuaccaucgacaauccuuacgugguagccuggcacgguuacgccacggggaggcucgcgccugguauccgcggguccccgcgacucgguuaucuugucgcccacaaccucuuguuggcccacgccaaaguguggcauuuguauaacacaagcuucaggccgacgcagggcggacaggugucaaucgcauugucgucgcacuggaucaaucccaggcggaugaccgaucauucgauuaaggagugccagaagucgcuggacuuuguacuggguugguuugcgaagccaguguuuaucgacggugacuacccugaauccaugaagaacaaucuuagcucgauuuugcccgacuuuacggagucagagaaaaaguuuaucaagggcacggcggacuucuucgcacuuuguuuugggcccacucuuuccuuccagcucuuggacccgcauaugaaauuccgccagcuugagucgcccaaucucagacagcuccugucguggaucgauuuggaguuuaaccacccacaaaucuuuaucguggaaaauggaugguucgugucggguacgacaaagcgggaugaugcgaaguauauguacuacuugaagaaauucaucauggagacacugaaagccaucaaacuugacggcguagaugucaucggauauacagcguggucacucauggauggguuugaauggcauaggggcuacucgauuagacgcgggcuguuuuacgucgacuuuuugagccaggacaaaaugcugcuccccaaaagcuccgccuuguucuaccagaaacuuauugagaaaaacggguucccgccacuuccggaaaaucagcccuuggaagggacauuuccgugcgauuucgcgugggguguaguagacaauuacauucagguaagccagcugacaaaaccgauuuccucauugacaaagcccuaccacugauaagcugccuucugcggggcuugccuucuggccaugcccuucuucucucccuugcaccuguaccucuuggucuuugaauaaagccugaguaggaag

SEQ ID NO: 21735 - RNA, 3851 nt, Artificial Sequence
  Description of Artificial Sequence: Synthetic transcript sequence
gggaaauaagagagaaaagaagaguaagaagaaauauaagagccaccaugcgaucgagguccaauucgggugugcgccuggacgguuaugccagacucgugcagcagacaauucucugcuaucaaaauccggugacggggcuccucagcgcgucacacgagcagaaagacgccugggugcgcgacaauaucuacagcauucucgcgguauggggucuuggaauggcguauaggaagaacgccgauagggacgaggauaaagccaaagcguacgagcucgaacagaacgucguaaagcugaugcggggcuugcugcaaugcaugaugcgccaagucgcuaaggucgagaaguucaaacauacgcagagcacuaaggacucccugcacgcgaaauacaauacagcuacgugcgggacaguggugggcgaugaccaguggggacaucuccaagucgacgcaaccucgcuuuucuuguuguuccuggcucagaugacggcaucggguuugcgaaucaucuuuacuuuggaugaagucgcguucauccagaaucucguauucuacauugaagccgcguauaagguagcggauuauggcaugugggagaggggugacaagacuaaccaagguaucccggaacucaacgccucgucagucggcauggccaaagcggcguuggaagcgaucgacgaguuggaucuuuuuggagcucacggugggaggaaaagcgucauucacguauugcccgaugaaguggagcacugucaaucgaucuuguucucgaugcucccuagggcaucgacauccaaggaaaucgaugcgggguugcugucgaucauuagcuucccggcguucgcagucgaggaugucaaccucgucaacgugacaaagaacgagauuaucagcaaacuucaagggagguaugggugcugccgguuccuuagggaugguuacaagaccccgagagaagauccgaauagacuucacuaugacccggcagagcucaaacuuuuugagaacaucgaaugcgaguggcccguguuuuggacuuacuuuaucaucgaugggguauuuucgggugaugcgguccaagugcaagaguaucgggaggcucuggaagguauucucauccgcgggaaaaaugggauucgacucgugcccgagcucuaugcgguaccuccuaacaagguggacgaggaguacaagaauccucacacaguggauagggucccuaugggaaagguaccccauuuguggggccagucgcucuacauucugucaucgcuucucgcggaaggguuccuggcggcuggagaaaucgaucccuugaauaggagguuuucaacgagcgucaagccugauguggucguccaagugacggugcucgccgaaaacaaucauaucaaagaccuucuccggaagcacggcgugaauguccagucgauugcggauauucacccaauucaagugcagcccggaagaauccugucgcauaucuacgcgaaguuggggcggaauaagaacaugaaccugucgggucgaccguaucggcauauuggaguccucgguacgucaaaacuuuaugucauccgaaaccagaucuucacguucacuccacaguuuacggaccagcaucacuucuaucuugcgcuggacaacgagaugaucguggaaaugcuuaggauugaacuggcguauuugugcacuuguuggaggaugaccggacgacccacccucacauucccaaucucccggacgauguugacaaacgacggaucagacauccauuccgccgugcucucaacuaucaggaaacuggaggacggguacuuuggaggugcuaggguaaaacucggaaaucuguccgaguuucugacgacuucguuuuacacuuaucuuacguuccucgacccugacugcgacgaaaagcuguuugauaacgcuucagaagggacuuucucgccugauucagacuccgaucucgucggauacuuggaggacacaugcaaucaggaaagccaggaugaacuggaccacuacaucaaccacuugcuucagucgaccucauugcgcucguaucuuccuccccugugcaagaauacggaggaccgccacgucuuuucggcaauucauagcacgcgagacauccugucggugauggcgaaagcgaagggccuugaggucccauuuguacccaugacccugccgacaaaaguguugucagcccaccggaagucacuuaacuugguggacuccccgcagccauugcucgaaaaagucccugagucagacuuccaguggcccagggacgaucacggugacgucgacugugaaaagcugguggaacagcugaaggacugcucgaaucuccaagaucaggcagacauccuuuacauucucuauguaaucaaagguccuucaugggauacgaauuugucgggucagcacggggugaccguacagaacuugcuuggggagcucuacgggaaagccggucuuaaucaagaauggggccugauccgguacauuuccggacucuugcggaagaaggucgaaguguuggcugaagcauguaccgaucuccucucgcaucagaagcaguugacugugggacucccucccgagcccagagaaaagauuaucucggccccauugccgccagaagaacuuacaaaacuuaucuaugaagccagcgggcaggauauuucgaucgccguauugacgcaagagauuguggucuauuuggcgauguacgugagggcgcagcccuccuuguuugucgagaugcuccgcuugagaaucggacucauuauccaaguaauggcaacugaacucgcucgcucccucaauugcagcggggaggaggcuuccgaaucccuuaugaacuugagcccguucgauaugaagaaccuucuccaucauaucuugucagggaaggaguuuggggucgagcgcucagugaggccgauccacagcucgaccuccagcccuacgaucucgauccaugagguagggcacaccggagucacaaagaccgagagguccgggaucaauagacugcgaucggagaugaagcagaugacaagacgguucagcgccgaugagcaauucuucucaguaggacaggcggcaucgucgucagcacauucgucaaagucagcaagguccucgacuccgucaucgccuacgggcacaagcucaucggauucgggagggcaucacaucggcuggggcgagcgccaggggcaaugguugaggagaaggagacucgauggagccauuaaccggguccccgucgguuucuaccagagagucuggaagauccuucaaaaaugucacgggcuuucgauugacgguuacguccuucccucauccaccacccgcgagaugacuccccacgaaaucaaauucgcggugcaugucgaguccgugcuuaauagagucccgcagcccgaguauaggcagcuuuuggucgaagccauuauggugcuuacguuguugagcgauacggagaugacgagcaucggcgggauuauucacguggaucagaucgugcagauggcgucccagcucuuucuccaagaccaagucagcaucggugcgauggauacgcuggaaaaggaccaagccacgggcauuugucacuuuuucuacgauucggcaccgucgggagccuauggaacaaugacauaccucacgagagcaguagccuccuacuugcaagagcugcugcccaacagcggcugucagaugcaaugauaagcugccuucugcggggcuugccuucuggccaugcccuucuucucucccuugcaccuguaccucuuggucuuugaauaaagccugaguaggaag

SEQ ID NO: 21736 - RNA, 3425 nt, Artificial Sequence
  Description of Artificial Sequence: Synthetic transcript sequence
gggaaauaagagagaaaagaagaguaagaagaaauauaagagccaccauggcgggugcggcagggcucacggcggaaguaucguggaaaguacuugaacggcgagcccgcacaaaaagauccgguuccguguaugagccauugaaauccauuaaccuuccuagacccgacaacgaaaccuugugggauaagcucgaucacuacuauagaaucgugaagucgacacuccugcucuaucaaucgccgacuacagggcuuuucccgacgaaaacauguggaggggaccagaaggcaaaaauccaagauucgcucuacugcgcggcaggagcgugggcacucgccuuggcguauagaagaaucgaugaugauaaggggcgcacccacgagcuugaacauuccgccaucaagugcaugaggggcauccucuacuguuacaugcgccaggcagacaaggugcagcaguucaagcaggacccucgccccacgacguguuugcacuccguauucaauguccacacuggggacgaacugcucucguacgaagaguauggacaccuccaaaucaacgcuguaucacuguacuugcuguaccuuguggagaugauuucgagcggacugcagaucaucuacaauaccgaugaaguaucauucauccagaaccucguguuuuguguggagcgggucuacagagucccugacuucggagugugggagaggggaucgaaguacaauaauggaagcacagaacuucacuccuccuccgucgguuuggcgaaggcggcuuuggaagcgauuaauggguucaaucucuucggaaaccagggaugcuccuggucggugaucuuuguggaccucgacgcgcauaauaggaaccggcagacacucugcucacugcuuccgcgcgagucgcggucgcacaauacggacgcagcccuccuucccugcaucucauauccggcguucgcguuggacgacgagguccucuuuagccagacucucgauaaaguaguaagaaaguugaaagggaaguaugguuuuaagcgguuucuucgggauggauauaggacuucgcucgaagauccuaacagguguuauuacaaacccgcggagaucaaacucuucgaugggaucgaaugcgaguuuccgaucuucuuuuuguauaugaugaucgacggaguauuccgagggaacccaaaacagguccaagaguaccaggaucuucucacacccguacuccaucauaccacagagggguacccgguaguccccaaauacuauuaugugccggcagauuucgucgaguaugagaaaaacaaucccgguucacaaaagagauuucccucgaauugcggacgagaugggaaauuguuucuuuggggucaggccuuguacauuaucgcuaagcugcuggcggaugaacucauuuccccaaaagacauugauccagugcagagauacguaccccucaaggaccagcgcaacgugucaaugcgcuucucgaaccaaggaccuuuggaaaaugaccuugucgugcaugucgcgcucauugcggaaucccagcggcuccaaguguucuugaacacuuaugguauucagacccaaacgccgcaacaggucgagccuauccaaaucuggccacaacaggaacugguaaaggcuuaucuucagcucgggauuaaugagaaauuggggcugagcggacgccccgaucgcccuaucgggugucucgggacguccaagaucuaccgcaucuugggcaaaacaguggugugcuauccgauuaucuuugaccucucggacuuuuacaugagccaggauguauuucugcucaucgacgacaucaaaaacgcguugcaauucaucaagcaauacuggaaaaugcacggacgcccucuguuccucgugcugauccgcgaggauaacauccgcggaagccgguucaaucccaucuuggacaugcuugcggcucuuaagaaggggaucaucggaggugucaaaguccacgucgacaggcugcagacucugaucucaggcgccgugguggagcagcuugauuuccuccggaucucagacacugaagagcucccagaguucaagucguucgaagagcuggaaccgccgaaacacucgaaggugaagaggcagucgucgacaccuucagcuccggaacuuggccaacaaccggacgugaacaucucagaauggaaggacaagcccacccaugagauucuucaaaaacucaacgauuguucguguuuggcaucccaggcgaucuugcucggaaucuugcugaagcgggaggguccaaacuuuaucacuaaagaggguacgguaucggaucacauugaacgagucuaccgaagagcggggucgcagaaacuguggcuggcagugagguacggcgcagcuuucacgcagaaauucuccagcucgaucgcaccgcauauuacgaccuucuugguacacggaaaacagguaacgcucggggcauucggccaugaagaggaggugaucagcaauccccugucaccuagagugauccagaacaucaucuacuauaagugcaauacgcaugaugaacgggaagccguaauccagcaagaguuggucauucacaucggguggauuaucuccaacaacccugaauuguuuucgggaauguugaagauucgaauuggcuggauuauccacgccauggaauacgagcuccagaucagaggcggagauaaacccgcacuugaucucuaucagcuuuccccaucagaaguaaaacagcuuuugcuugacauucuucagccccagcagaacggucgcugcugguugaauaggaggcaaauugauggcucacuuaaccggacgcccacggguuuuuacgaccgagucuggcagauuuuggagcggaccccaaacggaaucaucgucgccgggaaacaucugccgcagcagcccacgcugagcgauaugacaauguaugagaugaacuucucgcuucugguggaggacacguuggggaauauugaccagccccaguacagacagauuguagucgagcucuugauggucgugucgaucgugcuggagagaaacccugaacuggaauuucaagauaagguggaucucgaucggcuuguaaaggaggcguucaaugaguuccagaaggaucagucgagacugaaggagaucgaaaagcaagacgacaugacaucguuuuacaauacaccgccccuggguaaacgcgggacauguucguauuugacgaaagccgucaugaauuuguugcuggagggugagguaaaacccaauaaugacgaucccugcuugaucuccugauaagcugccuucugcggggcuugccuucuggccaugcccuucuucucucccuugcaccuguaccucuuggucuuugaauaaagccugaguaggaag

SEQ ID NO: 21737 - RNA, 1736 nt, Artificial Sequence
  Description of Artificial Sequence: Synthetic transcript sequence
gggaaauaagagagaaaagaagaguaagaagaaauauaagagccaccaugcuucuggccguccuuuacugucucuugugguccuuccagacaucggcgggacauuuuccaagggcgugcguaucgucaaagaaucugauggaaaaggaauguuguccacccuggucaggagauagguccccuugcggccaguugucagguagaggaagcugucagaacauucuucuuucgaacgcuccguugggaccgcaguuccccuuuacgggugucgaugaucgcgaaucauggcccagcguguuuuacaacagaacgugccaaugcagcgggaauuucaugggauucaacugcgggaacugcaaguuuggcuuuuggggacccaacugcacggagcggcgacuccucguacggcgaaacaucuuugaucugucagcgcccgagaaagacaaguucuucgcguaucuuacucuggcaaaacauaccaucucgagcgauuacgugaucccaaucgguacguacggacagaugaagaauggaucgacuccuauguucaacgauaucaacaucuacgaucuuuucguguggaugcauuacuaugucuccauggaugcccucuugggaggaucggagauuuggagagacauugacuuugcgcacgaggcgccugcguuucugccuuggcaccgccuguuucuuuugcgcugggagcaggagauccagaagcugacuggggacgagaauuucaccaucccguacugggauuggagggacgcggaaaaaugugauauuugcaccgaugaauacauggguggccaacaccccacaaaucccaaucuccuuucacccgcauccuucuuuucguccuggcagauugucuguuccaggcuggaagaguauaacucacaccaguccuugugcaaugguaccccggaggggccucuccgccgcaaucccggaaaucacgacaaaagcaggacaccgcggcucccguccucggcagacguggaauucugucucagcuugacgcaguaugagucggggucgauggacaaggcagccaacuuuucguuccggaauacgcucgaaggguucgcaagccccuugacagggaucgcggacgcaagccagucgucgaugcauaacgcgcugcauaucuacaugaaugggacaaugagccaggugcaggggucggcuaacgacccgauuuuccugcuccaccacgccuucguagacagcauuuuugaacaaugguugcgacggcaccggccguugcaagaggucuauccggaggccaacgccccgaucggucacaacagggaaucauauaugguaccguuuaucccucuguauagaaauggugacuucuucaucagcucgaaagaccuuggcuaugauuacuccuaucuccaagauucggauccggacucauuccaagacuacauuaagucauaucucgagcaagcgucgcgaaucuggucgugguugcugggagcggccauggucggggcagugcugacggcgcugcucgccggucuugugucgcuguugugucggcacaagagaaaacagcuccccgaggagaagcagcccuugcucauggaaaaagaggauuaucauucacuuuaccagucgcaucugugauaauaggcugccuucugcggggcuugccuucuggccaugcccuucuucucucccuugcaccuguaccucuuggucuuugaauaaagccugaguaggaag

SEQ ID NO: 21738 - RNA, 2060 nt, Artificial Sequence
  Description of Artificial Sequence: Synthetic transcript sequence
gggaaauaagagagaaaagaagaguaagaagaaauauaagagccaccaugucagagcggaaagaaggaaggggaaaggguaaagggaagaaaaaggaacgcggaucggggaagaaaccggaaucagccgcuggcucacagucgccggcacugccaccccggcucaaggagaugaagagccaggaauccgcggcugggucgaagcuuguguugagaugcgaaacguccagcgaguacucaucacuucgguuuaagugguuuaagaauggaaacgagcucaauaggaagaacaagccccagaauaucaagauccagaagaaacccgggaaauccgaacuucggaucaacaaagcgucccuggcggacuccggggaguacauguguaaagucaucagcaaacucgguaacgauucagccuccgcuaauaucacgaucgucgagucgaaugagaucauuaccgguaugccggcguccacggagggagcauaugugucgucggaaagccccaucaggauuuccgugucgacugaaggagcaaauacaagcucguccaccagcacgagcacgacggggacgucacaucucgugaaaugcgccgaaaaggagaaaacuuucugcgucaaugguggagaaugcuucauggugaaggaucuuucaaaccccucccgguaccucugcaaauguccgaacgaguuuaccggggaccggugucagaacuauguaauggccagcuucuauaaagccgaagagcuguaccagaagcgaguguugacgaucacaggcaucugcauugcacuccuugucguaggaaucaugugugugguggcguauugcaaaacaaagaagcagcgcaaaaaguugcacgaccgacugcgccagucguugaggagcgagcgaaacaauaugaugaauauugcaaaugggccccaucacccgaacccgccacccgagaacguacaacuggugaaccaguaugucucgaaaaacgucaucucgucggaacauaucguggaacgggaggcggaaacaagcuucagcacaucgcacuacacgagcacugcccaccacuccacgaccgugacacagacgcccagccacucauggucgaacggucauacagagucgauccugucagagucccauucaguaauuguaaugucguccgucgaaaauucaaggcacucaagccccacgggagggccuagaggccgccucaacgggacuggcgguccucgagaauguaauuccuucuugagacacgcgagggaaacgcccgauucguacagagauucaccccacucggagcgcuaugucagcgcgaugaccacucccgccagaaugucgccgguggauuuucauacaccuucguccccuaagucaccgccuagcgagaugucgccgccuguaucauccaugacagugagcaugcccucgauggccgugucaccguuuauggaggaggaaaggccccuguuguuggucacaccaccaagacuucgggagaaaaaguucgaccaccauccgcagcaguucucgucguuccaccauaauccggcgcacgauagcaacucccucccggcaucgccucuccggauugucgaagaugaggaguacgaaacgacccaagaauacgaacccgcgcaagagccgguaaagaagcucgcaaauagcagaagggcgaaacgcaccaaaccaaacggacacauugcgaacaggcuugaggucgacagcaauaccucgucccagucgucaaacuccgagagcgagacagaggacgagcgagucggggaggacacaccuuuucucggaauccaaaacccgcuugcagcgucguuggaagccacgccagcguuuagacuugcggacucacggacuaacccugccggaagguucucgacgcaagaggagauucaggcuagguuguccucggugauugcuaaucaggaccccaucgccgugugauaauaggcugccuucugcggggcuugccuucuggccaugcccuucuucucucccuugcaccuguaccucuuggucuuugaauaaagccugaguaggaag
